United States Patent 8,781,750 (CELL-TYPE-SPECIFIC PATTERNS OF GENE EXPRESSION) - sequence listing, part 56

SEQ ID NO: 38500 - DNA, 2132949 bp, Homo sapiens
atggatgagaaagaaagtgatttcttgggagcaaaacttctggtgatgatgctgtgaacactgttgaaatgatagcaaaggattcagaatattacattaacttagttcaaaaagtagtggcacagtttgaaaggattgacaccgatttggaaagaagctctactgtgggtaaaatactgtgaaagagcatcacatattgcagacatgtcttttgtaaaacagtccatcattacagcaaacttccttttttttttcacttaaagaagttgccatagccacccaaaccttcagcaaccaccatcctgatcattcagcagccatcagcatcagggcaagaccctccaccagcaaaatgatcatgacttattgaagtctcataatcatatttagcagtaaaatatttttaaattaagtatttttaagtgtacttttttaatacataatgctattgcatgcttaatatgctacagtagaatgagaagtaactttcatatgcactggaaagccaaaaaatttgtgcgacttgctttattgtggtggtctggaaccgaacccacaatatttctgatttatgcctataatactaaagtgatccatttttatttctccttcaaattactgaacacttacatgcttctccttctcagagtgatcctttgggttatcatcccagggacagagagggtagttaagaaacttaacaagaaaataggttcactgacaggtctggatgaaaaggatgccatgtttggctaactagactgttggagtgtactcaagggcataccagacaggaagagcaagagggaaagctccattctttcaagtccctggggattgaagaggaagaaggaaaatgatctaatataaggttctctcctcatttccatccccacttccttggtaaatccaattccaaagaatataaggtagccaaaaacctagacatgttcagaaagagtgtgggaggaacactaaggccactatggcttttctcccttctaaagtttgggttctaagaaagaccatcttgtagtctgcccccacagccatatggggcattgctatatcaaagtcagggtagcatggctgggaggaggaggcttcagtgtttagcttgccctaactaccctcagttcctgtttggcaggaacatggttcccaaatagatcaaagcctggccagagctttctagcagtgcctaccacagcatgaaataaaaggacagcagctgtagggtggatgcttgggccaaaatggatggagaccattagtgcttccaagaccaagaacacattgcagattgaaacaaaacaaaacaatactaaataaaacaaaaataactttttctgttagtggtggcagtggacacagaaggagaatctatatcaattatgagcaatgccaatgggattttagaatcctaaaaagccggtttaaattattggattgttttctgactcccagatggagaatgtataattaagaattcaatcagagaaagggaaccaatagtttatgtatattaagagatttattgccaggaattggtttatgaacttgtgggactggctgggaaagcctgaaatctgcgttgcaggatttcaggaaggatgatctggaattctcagccaggggcagaagctactgtttacaggcagagtttcttcttcttcagggaagcctcagctgtgctctgaaggcctttcaactgcttagatcaggcccacccagattatttaggataatctttgtataagtcacctgattatggaccttaatcacctctataaaacaccttaatagcaacatctagattagcatttagctgaatcactgggtactttacctttgccaaatggacacacagagctgaccatcacagggaagtatgtttattctctcaccatactttttaactatcagtgggcttcaaataaggagactggatacatttcccaaaaaataaaaaagcactctttatttttgcagttaagttgtcctgtgaatttaggaagtgcaattctgtacaacaaagttagagagatacttaattgtggtgtgtgagctcaaggaggtaatcttcctgttattctctacctggagcagagaaaagtaaaaaaaaaaaaaaaaaacaaaaaactgggatctgttctgtaaactggatctaagggaataaccttgatttcagactcctgccaccaatatcacggtaatttgtgacatcagccatcagaaactaataaaagcacactgtaaatcttgcttgaattaaaaaacttgggaagcttgttggaactatgacttcaggacattctttgggctttttcatttttatttttttttagcagtctttccttctccttaaataagaaaacaagcatgactcaataagtactcaaaatgagtttttaaaatcttatatcaagtagtctctaggatttttgctttgttgtattcagagggctttgaaaatgttctctgatcactgaggaagcacattcttcaccccagtgaatagtaccactgagcatgagccaaggaagccatgcgaagccttcttttttcctctcccctaagagcttgctctcctgtatctgtctctctccatctttacaactcacagccatcctctcccctaagagcttgctctcctgtgtctgtctctctccatctttacaactcacagccatcctctcccctagcatctctgcttcagttctttctcccctaacaagtcactgtacctataaaagccagggtaatattttaaatacctcagtcagatcttgttactctacatctcctttcccagcttaaaaatcatcaaaggcttttccattgccctcagcataacatcaaatgccttaccatgccccagatggacgggtgtgatctggctcctgccaacacagccaccccatctcacactcccttcctcctgctcactgtgccccagtcactctggcctaattcctgtccatgaacatgcttgcctctaggcctttgcatttgttgttggctcttccagaaagctcttcccttgaatgtttgtctgactgacatcttcttggctttcaagtctcaccttaaatgttacattttcacagaggctttccctaacgcctcccaatttgctaacacttatattcactcatcacagactataaatacctgtttatttgctcacttacttattttctgtctaaattcaccagaaggcaaactccttggaactggaattttgccaattctattaatttgcatattctctgcatttagaacagtgcccggcacatagatatccaataaatatctgccaaaatgatcaataaataaatattaaaatagaagatggtgtgctacactgtatctgtataagctatgaactaaatacagcttcatatacaagctactcattacattctgttaatttgcatcatttggacctttaatacctccattattttctatatacaatgctgttaacaacttgtaaaacttaatacagttaataactttttaatgagatcaccaatcttaccaatgctaatactgttctttagctttggatccaaaagctataagaatggtaccatcttttcctgtgccttacacttcatctgccatttgattttcatgttggaagagtcctacaacagcccaaggcagcaaaacctttatatgagcatggatgacatcatgaccctagtataggtcatttaaaataacttttgccagttttagacacagaggtaaacatagataggaacagaatttccaggtaatttgaggtttttttcttactttttgggaagaaagcagctagttatgaaaactaaacacagaggaaagcattttgtttctgtaaaaagaccccagcttgcttgaacatgtttctaagaatgtttactttggatatctaatattataacagatttctttctaagttatgttcatcaagcttctggtcggcagcgccataatttctgctataaataagtctgattattgtaagaaagaactacttttcaaagcactccatgcaactcactcaggatgtaaaccaccataactccctaaatttatatgcacagtgcaactgacatgccttcactatgtcttcacaatttagacaaccagcacactactggttctatgtccagaaaggcttagcactcttctattagatgttagaagtctggaaattcactagaagtctgaactgctttcatatggcatttaaaagcaggaaacaattgtataaattcatattaaatttgttaagaggctccagggtttcagaagttatttggatgaaacagctaaaacctcaaaagaagaatgaatgctgagctgctttctaaataaagatattgtgacacacaaagcaataggcatgatttaacataggtcaaaatatgactgtgaccctggcatacacaacatcttaaaattcttctttgatggatggaaaagcattttcctagacccatgacattacaaactgccattctatataaattcagctgtaaaattatttttagtatgtatattctcctccaagacttaatcaattcctctctcaatgcttacagatgttttcattgagctaaggtagataaattcatagactatgtgctagaatgttaattatagtttttctttatagctcctgggtgatcatgccttaactcatctatgaaaaattacattttggccagatgaaaatttgatgtccctgggaaaatgggatttatacaactaagacaaaatcctaaactgcccatctgagatgccaaagcctcatttataatatttgctggagaggggggcaattagcttggggggaaagacttctcaggtacctgtaaaacattcccaaaagcttaagaccaaactctcactcctcaccgaagttactggtctcaaactctaaaccaaagccctagaatattttgggaaatgtatagctattaaaaaacacttgacaactggggaaatgagaatgagtaaacctcattattcttcatattttacccctcagtttaaaccatttgggtatagggggtgagttcacagggctttagttctcgcctgtccctgagggtgggaggatgccatctctcagactgcctgcatataatactacaccctctgggtatcatcactcaagtctctgagccttgaggtcaggactcccgagaaatcctggtcagtggtgaatgaaatgcaccaaagtcccctttgcagttaaactctgttttaatgaaattacttcactttccagtattcatttttgtgtaatgtagctaacataaatactagtaaatctccccagattgagtctaattatgaagggccagagggtaggagaattagaaggactgtattgtaagttaagaatcttagatgctgaaataaaactattagcagccaaattataaggcaattttttgtttaacagataagatttttcatcttagaaattaaatacggccgggcatggtggctcatgcctgcaatcccagcactttgggaagccaaggcgggtaggagttcaacaccagccttgccaacatggtgaaaccccgtctctactaaaaatacaaaaattagccgggtgtggtggcgggcacctgtaatcccagctacttgggaggctgaggaaggagaattgtttgaaccctggaagcggaggttgcagtgagctgagattgcaccattgcactccaggctgggtgacaggagtgagactctaactcaaaaaaaaaaaaaaattaaacacactgttatcaatgtattcaaataaaggacggtcagagaacttagggtacacacacacacacacacacacacacacacacacgtgtatatatatggtatatttactgattcagtgtttgaaattttgattgaatgtggtttggtgatttatagcaagaaagagaagatgacatcaaaagtttgggtgtgaaattgaaattatctaaatttgaatgttttaaaccaatttgtttttttgtaagcactttctactctcaagaagagaattttaatttgggagtaataagaaaaagtcataggctaagctttctgtaagaaatatggacttaagaaaaagctttgaaaatgtagcctaatagcacggccccagtgggaaactctttttcagtaaaagattcatttttaatcttttgcagtgtatctctatagatacacagcacacacacaaacatatatatatatatatatatatacatgtgtataagtaaaatataacatttattaaaaacttgggaattttgtattaaaggcttcttgagtttgaaagggtggtcagaaaaataaaacaataaaaatgattgttaactttattttaaaaaatatgtttctcttttactctgaactggtagattaaattattggagaatgcaaaaatggggaatttggggcttggcatatttaattccatggaagagtttggatttcctcattaaaactacacagctaatgtttgatgtaagtatgagatttcaattgaaatgtgatccaattgggtgaaaaaaaatacctttatgaaatggtcctatcaggaaccaatctgaagattatataaattttgcaaaagacaccagttgacttattaggtgtggcttaaacatgtaatattttacatattttccagtcatctttaaaaatgtaattgtaatttattttgataaactatggctgtcttttataacatctctagttatctgtggaaagttagaattcttatagttttatttcagcagtgatatgtatttttccaaaagcttatgtgcatatggaattctctattatgtttacctgtcattaaagtgaggatattaatgatacatataaagtcaaaggaggatttttgtctaaacctcaagtatattctgtatttacatagactgttctttgaaaattatatagatatgtaaggtaccaggaaacatcctgatccttctacgggaaaattaaatacaagttcggaaaaaaatactaattgggataaatatttggtttctatactataaaccttggtgggtgataaagcgatgcatcatactataaaattaagaagagctcatagcaccccaaaaaaggagaaagttaaatgaaagttttaattaatgaatttagtaaagtcaaatttataagacagtaaagaagcaaaaatcatacatatgacatcattaattcgttgcagtaaaaagaaatattggtgaaatgaaactgttaggtagataggcagacataagcagggcaggagaaccacccaccatctccaggaatgtcaatagaccatcatgtgatagttgagcagttgttgaactgtctctctaaaacaataattgatcgcagccagctccagcaaatgacagtctctcaatagatagaaaacacctgaagctggtgttcagcagcttcccgataacatctcaggagttgggtgagccgattcaagcatgcactaaggggcaaaatggcagaatttaactgttatatgaccttcctgtaggaatgcgcaactggtaagggaaaaatgcctcaagcaagcatgtgcgcaacctcaggaaacacactacgtatgcagccactcccatgtgctggcaggtcaccaagcatgtggacagcctgcccccaggaagaatcaggggagaataaatgcaaaccccggaaccatgccaatgtataaaaccccaagtcggccaggcatggtgacccaggcctgtaatcccagaactctgggaggccgaggtgggtggatctcctgaggtcagtagttcaagaccagcctggccaacatggtgaaacactgtctctgctaaaaatacaaaaactatctgggcatggtggcgggcaactgcaatctcagctactcgggaggatgaggcaggagaatcgcttgaacacggcaggcggaggttgaactgagccaagattgtgccattgcactccagcctgggcgacaagagtgaaactctgtctcaaaaacaaacaaacaaacaaaaacccagttaagggcacaacagggcacttgaatctctcaagtagccctcctggccctcttccaagtgtattttactttcttttgttcctgctccaaaactttttaataagctttcactcctgctctaaaacttgccttggtctaactctctgccttaaacttacttctgccatttggtcaaattcttttcccggaggaggtaaggatgaattgctgcggactcatatggatatgctgctgttaacaagacaattttagagaactttgaaactgagatctttgagcttttccatagacccagggtagagcagacccttctgttgaccagtgattgaaaaccaccacattccaaaaacagaactatcatagtgctgtaggaatgcctatgctctcaaattaaaagccaactgaaatcaaaataatgcattatacgagaaagctgtctatagaatcatgcagtttgtgttcaacccctaaatagaatgcagctgtgggcagggcttctaataaacgttgtttcaacactccttgacacttgatttcagctgtagctagcctagctgtggccagcagcttgactttgtgctcagtgtctcactgcatgttctttttggtttccagcatcttggaagctgctagagcctgttggctcatggaaggcctgcagcctggaaatgcagagtagtgaataacctttgggcagcctgtcctcaaccaagagagactgacagttggtggatagtcccttgcctttcatttgtaggcagacaattcttgcaagcttctctggagaattcaataacattcccaaaagcagtgacctccatagcagactctaatattgccttcctttcttctctcattttgcatgctttctcacttctgtttcttcggattagctcccaaatgacctgcctacacccaagtctgtgtctcaggctctgctttcaagggaacccagaccaagagacacagtcctttgattgcacctcttttcagcaattccataaaagtgataggttaagaactgagttagccttgggttttggctggtagttaatctgcctcttttcaacctgcatgaaaattgtttttagaaaaaagcaaaaagatacctcaaaaatctccaaaactactcatttatttcctttacactatttatttttgttcacaattacttgtctataggtttagcatcttatttcattgctcatttacagatggatcagcattacagtgctgaataaatgtgattagtataatgtcctgcccatctttatgtactacacacaacttcattaaatgttaaataataggggaattgatgatcacagcatttatcttcagtggaggatttgcatatgtatttaaagtatttagtgaaatttgttggtggttctagatgggttaggagaaaattattattttttcaattaaaaataatggaagataagctgtaactacctgaaaattttttatccaacaattttttttttatctatctttaggaacagattaaataagagggattcatgtggtgttcactaccttattgttggaagcacccaatatttacccaaaagattctaataacaatattttagctgcagtgacttagataaatcaacaacacacatatatggttaaatattttgtgttccttcaaaaatttttaccaggccttaaataaaggagaaaatggcaaatgataaaccaaccccattacagagaaattacattgggagaaaagtaaatgtcagttatatattttaaatgtatcttacatattctataatatatacctaaataatatacaatatatcatgtcatattaaaatacagtaggataaacagataattatataatttaaaataatcatatttctttctcagattagagggaaaatttgcttcgctattttgcacatatttaataacaacaaaagtgtatgatctcacttggttaattgtgatatggaaataaaatagaagtttttaccactctgtgtatatgtagctaattttaaatgtttgggatatataaaatagaactataatatacatatgtatgttcatgatttttgaataaagcagagaaacagagttagagaaagagagagacatttttttctccctatacaatttgaacgaaaattgtttatgtttcctttggcttcatgatatttgggtaagcatttttaaaagatgtactaatcatcctgtagaatctaattatgaaaatattttaagtcaagcttaagaaaattactactcttggatgttatttcagaactcttcataatttcaattttatttgattataaaaatttcatgcaatcccagcactttgggaggccgaggtgggcagatcacaaggtcaagagatcgagatcatcttggtcaacaaggtgcaaccccgtctctactaaaaatacaaaaattagctgggcctggtggcacgtacctgtagtcccagcaactcgggatgctgaggcaggggaatcacttgaactcaggaggctgaggctgcagtgagtcgagatcacaccactgcactccagcctgatgacagagtgagactccatctcaaaaaaaaaaaaaaaaaaattccaaaaaataaagtgacattaaaaattgttcatagctataaaagcaaaagaaatcacagcacttccatctcccacactctttaaaacacctttgaaaacaacacatgttctgatttatcatatacattcagtcttctaatctctgcaacacgaatccatttttaaaaatgtttgatcaaatattcagatagtatgctaatgtgcatgtttaaaaatactctatattgggcatttagggggaaaacattaaagggacttttttcctttttttttttttaataaaatcaatttctatttgattttgaattgcccttaacatgtttcagaaagaagatgcaaaattgaatgctgctctgagagcatgttgtgcccctgagccagcactgcttcgcagccagggattctgaccctgctggaaaccctacggcagagcagtgatggcaagaactgagaggatatcaaaacctcaaacgagctacactcctgtggatttggaaagaaacaagacacttaaacattcctgctatggtttccttagcaacatccataacaacaactctgtaatactatggggttctgttttcttaacccttcaggatgtcaactgaatgaaaacttccttgaggaaatatttcaacttactaggtggactggcataaattaaactcagtagtgcacgatcttctaaccccttcccttagcctgggtgaagtggctaggagagaagtagggagagggagcaacatacaagttctaccttgactgccatgagagtttacttcataaaagagttgggttggtactgtttagaggtgacttgtatggaaaaatgaaaatatactccaaggcagtgtgaagttaaattacccttggaagtccccatcaaatatatttagtaaaggagaaaatccaaagcccaaagagttttctataaccacattgtctgaaatgacagaaaacagcaaacagcccttaaatcatgtgtattcagaataaacgaagggtttaggaatattttattgagccaattttatgtaacgtatctcaaaggtaataattcagagcaatcatttaatattaaattggttgagaaaattatacacttaggaaaggttgggatgggaacaaatatatagcaatatgccagtcattcaaacgtttaaggtgtgtaatatgaaattatttttattcaagaatttaattatttggcatgtagtaaataattttattataataactcataatagtaatataataattgcaagaataatagaagatgagaaagaagagaataatatatcctactaataaaaaagttgaaaattatcagtgatatatttctgaagttattataattcaggaatattgtggagctgaagcaaattaatgaagatactactcaaaagtataattgtttatttctttatcccaggctaatattctttacctattgttatataatcaatttatttaaatgtctgtttaataaattaaaatttaaaagccttcttatctatatagaatagctgatatttgacaatcaacaaaatcaaagaaaagtaataatcaatgtttataggtgaataattccaattgagaaaattctcacaggtattatatcactaacacttgagtgttttgaattagtaggaatttgttttctttctttctcatcctcttcctattattattcttacagttgttattattatattagttttaattctttaatgatagacataaaatcaaaatatgtaaatactcgacatgaactgtaatctttaacttcctcttttatacgtttaagtcaagtcaggcttgtgacctgcaagaaggcagtttttgtttaagacaaaaaagatgtcagaatatcctcttgtcctttcacacatatggctctcactacgtcatccagtaagacccaacacattttcattaatgtcatactcaggatgcagaaataataaggttgctacgttgagaaaaggaaggcaggaggggaacatgttgggaggaagacgttgcctactttttattggaaagctattaatggagtccaaatgatttatcaatttgatgcaagcaacacattcattggttccttgaattgcttaggaaaatgggaaaatcatccagtttctgaacatttctgatcattttagtctaagaagggatcatagtttccatttaaggcctgtttcctaccttttagaccccaagctatctcctgtatatctgctttttttcttctactcgatatgagaattagaggccaaaaaaacaatttgaaagagaaaaataagtaagaagtaataatgaattacattagtgcaatcaatcttttaatgaaaatcaagttttatcagaaaagtaacagtacacccttcaatacatcatggagataaccatgttgaacttggatgagagaaatctggattcatcacaattttttcttctgggtcttcaaaaaggatgcataccctatgaaacttcagaatatgcaacaagatctttagataatgcaagcatggtgttttatccaaatgattagcggtgtccctaaatcccacaaaagaggaaagagacggtaacatacagtcaaagaattaggatgatgaccctaacaccacaactctaagcgaggatcacccatcggcaaacaagaagccctccacagattacagccccgccctgggaaatgactaagcacctaaccatgcttattgtgtggttattattgttatctacttgttattattatatttcttatttctcatgagccatgcaaacatattcacttgttttcagaccttgtcccatctctgttgaagatctatctgattcctgatagaatcctgcttttcaatccaccaacatctttcattacttgctaggacaggtattgccttcatcctaacacagttgtcagtaaacataaactcctgggcctacccacataggctttgtctcacaatcccagccctcacacatgaaggctacagcaaaggccagggtctccaggctgttgatcagtttataaagaaatctgcaacatatgaaggataaatgcaatatgatggtgaaaaaatatggtggaagatgggctgatgtgaggcaaagctcagcagattacaagggtaataatcaacaaataagcatattattgtctccaagggaagttaaaacatgtatcaacaactctgaacctagaaccataagaataaaagaaaagcaatggatggggtaaagtgagtagaagagaaaggtcatcaaaaatgccgtggtgaagatggccctacacagatagccttagaaagcaattcttacaagagctaatacaaaacaaaagaagaaggagaagattaacatgagtgaatgtataactaccgtcagaaaaaaggatgaaacacactgagccttttaagtagttgaaacttcaattattcttagtattagttatatagatctcccaatacgaagcctcttccgatagaaaagtttattacttttgtcttaatctaaaaaacacagtcaaaagaatgagcacacatcttcagtctttaccctttgctcatcttcctggtcacagccagccagagtcatcttctaaaaacacagttctgattatgtcctttttctgtttaaaatcctctttcattttctattgttaaaattaggtcatacccctattcctggaatgcagagttctctgatatttggcctataactctttctgatatttattttttcttctaattctactttccacgttttctacactagccaagtcaaactgccaatcatttcttgtgcatgcacttctgcaagttccccagccttcacagttttcccatacaatttcctatttggtctcagtatcatttatggcatgtttcaaatgctacttcttccatgaagaaaagtccaagtaattcctggcttttcctaatgctcacataattttatatggatgttatgaatttttcttcttcctcttttgtattaattataggtgaatgtagatgagtggatggatgggtaaattcacacatccaaagatattctccactactatgctaaacgagagccagagactatctgagatgcataaagacattaaaagtgcctgctctgaagctagagaaaactgagtttgaagccaaggtctgttagtttgtagctgacaccttgagttagttatctaccctctttaaacttaggttaacttatctgtttaaataaaaaaagaagtgatgatgtgtagaaggagggagagaaggaggaagataaggaagaggaagaagaggaaggagaaaaaacagaggataaacaagaagaggaggaggaagaaaaacaaacaatggatgaaggatgataattatgtatttggcatagtttttggaaaataaaatatattcactcaatattagtaattaaagttatcaattatcattaatatataactagtcttttcagttttacttttgcacacttcatgatgcttagcatgtaaaatgcactcaatcgatattggctaaatgagggcatgcctgttttatatttcactatgagaagtcgatagggcaagaacataccaagaataaaaggacctctgggtaagaacatcagaaatgaaagttgaaaatgaaaggatgtggtaaagaaggtggcagagtggatagcaaaggccagtgacacaaagtcgatcatacttgaaaaacgatgcatagtgcagtatctgtaaaatacaaatcaatagatcagagcaggtgtttgtaatatttggttcatgaatgggcctcataggcctgtgaactcctgaaattgtatgcagcatctggaaatgagcaagaaaccatggctttttatcagactctcaaaagaattgatgactccacaaatattaagcaactcattttagagatggagcacataagtaaggtcaattagagaccacagaaaataaggtaacgtaacttgtgcttcacgtagggatgctgtttggatattcagcataaacttcatggataatataaagctcctaaacagaaaacaaagggagccatggtgttaaggctgaaaaacacccaccttttacctccccctgggagaggaaatgttaagtcttgaagcatggaaagtcgtcaggagataactcaccaaaagggtgaagctcattggaaacagaagagagaagcaaaagagaactaaaaagaacaaaaatgaaaacttgtcaaaaacaaaaactgtttttgagatactagcatgcagttgatagaggatagaaactggaattaatttaaaaaagaaatgctggaaacttttacatataaacaaaacaaagcaaacaaaagacaaataaaacaccttgttgggataaatcaaagcattgttccttaaaatgaccatgtagtacgaacttgtaacatgttacttacagtttacttattttacttgtttgcttgggatgggtttcagtggaagacacattaccttcaactgccctttcatattaatcactatccactggagcttttatttttttttaaatacttctatagagattaaattgcatcaatttcttaaaagtctttagaaaaccagagtatcaaagccactatggacttgcacaatattagtgatattgatttatactgtacattttccaaagaatgaatctatctcactcaggaaccaattgagagaaaatagaaccttgcaatttatcttaatatctaacaatcctatattagctctctgtccataaaaatatattatttttagcatttcagttatttttgcatctcaaattatttccctcttaaggtaatacatgaacacatacacttgtagaatccaaattcaatctcagtttacacactgcgcttagagtctgaatcaaagatatttaattaaattgcaagaaaaaattcagtatttttatcttctttgaaacactgattagtatattttaaattggaattgcaattaatatgactcttagatgtgtagaggaaagaagagaaaaaatgctttatataaattaagagaatctgtttaaaataaagtaattgttaccatgcagaaggtggttttaaataataggcagatgcacaaactttatttttactgtaaaagacaaagtcaattataaaacgctggtataaatccaaagccctaaggacttgtttgctaatgtaatattggaatcctaaaatagaaagaaagtccattgggaaactttactgccagagacttagcctctgaaaatcaactgattgtaagagaacttatggttccaactgaatagaagtagtcaaaaactgagcccaggaccagctacataatttgcaaggcccagtgcaagacgaaaatgctgagcccttgttcacaaattaaaaatttcaagatgatgacagcagagcattaaactaaagcccagtgcagggccctgcgtgagactacacatccgtgacatgagtcctgccaaggcctttcaagcccagagctctctagaatcagatatcatgatttatttgataccttaggtgccaatggaaaatttaagtttccattataaagaccttaagaatgatattgatgaaaagatttaatagctgacttataaccatttgtttgtgtatgttatggaagaatcaagtatctacatccttggtaggcctaaagatgaaaaagaaggcattaaggaaatttttacaagttcttgaccatggcacataatctttttcactacgaccttttccaactatggacagcaattgcctagcaagatgcaggtcaatgctaaagtcagtagttaggaagagggtactctgtagaagtaagccttaaaaagtgtttgacaacaagatggtataaaatattaagccgtggacatgaaggtttcatggtaggactcctagaggattctgaaaccaagcaaagttaaaaaaaaaaaaaaaaagaaagaaaggaatgattaaatctggggagaaagctagcatttgcttgagttgttaattggtaagcatgagagttaataacaagtcatcgtcttcccttgattttagggccttgtttcagaagtaccgtgtgttaagtattaatagacaagggatctcatttcaacccaaaattttataggcatatattcatggatatacacacatccacatgcatatatgttaacctatgtggccacagccaaggcagttaccatctgtggcagtgtacatttgttggaagatgagattttcagttagaaatattataattttatcacatcacatctacatttacaaaagtaaatatgataatgaaaaaatcttcttgaattagaatggattcaaataacccccataatttctaaaatttaagatataagcttctttcatccaaataatctgcttttgttatacagaattatgtggaatggatttggctgacttacttgggtacatcttcatttttttccccaaagtttacaaataagagttaataagaaaaaaactctaatgtacttacagtgatttttaaaaatgtactccactcttctcatccacagcctatattttcctgatttagaatctaaattggatttgagaaatagtcatacttatatggagagaagtagtaattttatatttattcactatagtacaccaggaactatgcttaacactctccatccatggtatttttttaatcttcaaaatatttctgagatgggtaaaatttccgttttacaaataaggaaacagaggtccacagatattataaaacctgcccaaagtctcacagctactacataatttaagaaaaatatttggctgtaaaagagaccaaaaaatacttaaacaaatgagggttgacatttttcttttgtaacaagaagtctggaaacaggtatttaagacttgggaacatcaactggaaagccctatgattcttttggttgttaaattattgtttcaagatggctgctccaaccctagtggcaagttagtagtccaggctggaaggaggcagaagggaagtgccaatggctgaataggctcttaagcactgttttttcagaaatccaagtcaacaagtgcaaggtggattttattcacccattatgcaaataagtctaagaaatgcaagtttgtttgtttgcatgtttgtttattttctaaatggggcttattgctgcccctttcaaaatcaaatttattagaaaggagaaaagtagctactgggtagaaaaccatcagtctggcaactgcttgatgccctttcctcttggaatttttctacctaggaaggattcccagcccagaagtggtgataaggaagcttccttcttcttcaatctttaccatctcttccatttgggaaaaggagatgggaatcacatttgttcccagtgctgtgggtgcttccaaagaaaaacaatgccttctttctcttctctctctttttttatttttctgctcacaaaaggaacaagctcatgaaactggatgttaaattgaaccaagccaacaatagaagggataaggcaggcatgcttataagtaattcaaagtaggtgaccgagagcagtgagaatataaaatgtatatcttctatacgaaatacataagatgatcaaggcaatgatgatcagaacagatctttccttttcaaagaaattattgggtaattggcagagtgctgtgagtccatcttccaacccaactctttgcccctcattacaagacataagcttcaatatagccaggagtttggtggtatatagtggacgtgtgcctgacaaaagccgaaagagtctaaaggcaagaatctacagctattagttgtaaactgtaggacataaaaagagtgctcagctatgtttgagttagctacaattctacaataattcaggagtttttcttattgtctacagatggaccatgcaaggacagagacacctgacattctctaaaaagaccatcttaaagaatgataggaccaacagtgagacatgatgtaaaaggactgtcagaaaccagaggctaatgggagtccagaggacgagataaagttgcaacacctgtatcatagaaagcacagttgactactccagtggaaatgctgagaaactcaggaaagctcccatgataggtggagacagttttaaaaatctgccaagacctcagagcatgaagcatgttctcattatcagttacataagaaccttctttatctcttgtccctccccttaactcctcccccactgttaatcttgaagccattcacaacagcagccaaggagtggtgaggaggtgagcaataaagagagaaggtgcttagcttttggaaaaggcaggactacaggctaccagctcaggataggtgaagtgaaaatctttcccttcaataaatattggattataaattaacatgttatattgagcaattgcaattaggttggtgcaaaaataattgcatttttgccattaaaactaatagcagtctcaatactaaattaagactgtttgccactgaaagaagccataggatctttgattacataagataagagtgagcgtaagaggcatgcacttgcctgagtttgtaatccctgaatttccatcaggggcagaggaagagcttctttacaatgaagagatttaaagggagcagtgagagacaacaatgtacttgcactgaattaccctcggggaaccttgcttgttccccatgctggttacacttgccagttgctttctgacttcctatactgagcacaccagatacagtctgaccctgcccagctccttagtctcctctttgtgctctaacttcctccccaggtcatgctgtcagtttgctttggctcaactgggaagaaaagaagaaggaggtgtttatcttcaactcaggtgaaggcaggataattgcaaatttcttccttgatgcataagtcagttaggtccttcattaaaccattaccatacataaaactgatcttctcattcctctgtgttcatgccatggagtttatgacatataaatatgagccctgaaggaaacaggggtgtttagctgcataagctaaacctcaactgtggcagagccgggatttaaacatggagctgctgcagaagactaagctctcaacctattccctttgttctctaactccagagaacgagagagctgaccggaccctccctatcctgccctaaacttgaggtctctgaggaaatcacatttacagaattcacctggaaaatgactaccctgactaccattaggtatgagttctagtccagtggagatttctgttgagctaagctgaatcattcaggactccttcctgagctagagaaaacacgtcaaatgagcttctttgcacatttcctctaacccaccacacatatttgacctttcatctgtaacacctggaatacctggtgcagaagaataaagataaccaagaacatgaacactatggcaagactgcactaagttgtaggaccctttcttttgctcccaagtttggagctatttgagaaacagaaatagttcttaaaagcacatgaaaagaacaatgtcaataatcatgctgactgaaacattgaaaacatcgttaagacaatattaagctcttgttgtacttgaatctgggctgtgaaagacgtggcatcttagttcgttttctgttcttataacagaatccctgaaacaaggtaattgataaagaaaaggaatttatttcttatggttattgtggctaagtccaaggtctaggggctgcatctgatgagggtcttctttcaggtgggggctgtttgcagagtccccaggtggtaaaaggcagcacatgatgggaaagctgagcgtgctcatgtgctagctcaggtatctcttactcttcttataaagccacaagttcctctcccaagataacctattaatccattaatttgttaatccattcatgatagcagagccctcgggatacaaccaccccttaaaggccccacttctcaatcctgccacattgggtattaaatttcaacctgacttaaagggggcaaatattcaaaccatagcaatcagatatacttcgacactcttaaactactgtttattagagttcttggtatttgtaaaaggtagctttccaaaatcctatacccctcccataactcctctaacccttacgcacatgcaggcatgtacaggcatgtgcgtacatacacacgcacatgcacacacacacacatatttgtacacattgatgattgcatcaatgaagagaaggcaaactggtatttttcttttcttcctttctttttctttttttttgagacagagtctcgctctgtcgcccaacaacattcaaaagccagcagcaagattgaggttccatcatgtagaagttagagcagaagctaaggacagagaatgcctgggttcaaaccctacttttgttacttatcagtctgtgtaacttttgtgaaacttacttaacctgcctgtgctatagtgtactgatctgtaaaatgggggtactaagagtacctacatctgtataatgggggcaataatggaacctgcctcagatggttactcattggtaaaagagtgacaataatagtatttgtctctttcgtcttaaggattagaagagttaatacatataagcacttaggagactggcatgtagtgagcattaagtaatcatttactcttattgctattatcatcgaagaatcaaaaatgagattggcacagcagctgctcagatataagcatagcaaagaaaggagaaccaggcaactgacaaggtaactgaggaacagggagaaccgtgagtcatgtttatgaactgtagagtgcttggtgtgtgtgtgtgtgtgtgtgtgtgtggatcaggcccccaaaaagtgccatcaacaaggtagacagaatacttttgtttttctaaaagtccaaagcatagctcctggggagatttgacttacaatttagtcagtgtggaaccaaataacctaaagttagcagtgccaaatgcctttggttgaatgtgtcttcatataaagacttatttgttcaaaccaagaataaagttttcttttgaagtaaaccctttgaactcccatgaaccaaagtgatctgtgcactacagttatatttcacaatcaagggtttatttatatcacttccctccacagcaaaactttatgatacaaattgtaaatcttcaacatccctaagtttctctatcagttagttatctgtctcataggtgttgacatcacacatactacacacgcacggggatagcctttcaccaataataaaatcacatagactttatttcaccagtaatcaaattacatagatgtgttagctgctctttcttaaactgtaaaacatgtgtactcttgttaattctaggacatggatttttttttcagctgaggatattcccactgattctcaatgacttccgtgtgggaaggcaggatcttttctcttaccatatcatatgtatgtttctacaatttcagctgctccatacattcagctcttggttaacttgttccacatgacaattaatggaaattagaagtttgaagacagtgtcatcaacttttaaaatatatatttaaatattttgtatcaacctagaaatccatctatagtacctgtgtaatgttttaggctctagccttacacctataacttaaaaatggaagtgattgctttatatgaacatgaatgtagtatctcacaatcattttaagaaatgctttgtaagttagccatttcaataaaagttgtttttatatcagcagatatttaaaagtgaattatcaattgcagaaaagtagggggcaagaaacagagaattactatctttttctcattcattaagttaacgaacaagtagatttttaatttttttttaaaagttactgttatttcttttttattaccaatggaaaggcaaaccaggagggaaaataaccttaagctctacatcatatttattatcctcagtggtgaagtgagtaagtaagtgtagaggtatgaaattccaacagacagaaacatgctgtttgaagaggaagtggtgatatatagactacaattagacaaaaaatatgattgctgaaatttacaaatcattcataaaaagaaaacaaggtggataatgtcatcatctacatagctcacagcttccactgatctaaataaagtgtatatatttttaaatataattcaattagcaactacagcaatctaagtgatcaattacagaaataaaaaaaagacaccaaacaggaaattaatatatttttatactctcatttttcactacatcatgattatgattttactgtaagcttacaaattcactagttcaggtttgttagtagtttgttttagttttatttgtggtttgagagtttctacaatcctaagtagatttatagcacagatgtatttaacataaatccgaaaatattaaaacatactcagagaaaatttgtatcttcttgagataccgttaggccttaatattattaaaatattttgacaatattgattgacaaaaatgcatgccgatgacaataggattttctttatgaaatttacttcaatagaatttactttatgaaatttaagaacaaaataattattgttgacaagaaaataccatgatttaaaggctctgtgataaatgaaaacagcaaatatgagtgagagactattaataaatccaatggaagaccaagatggatttctatcataagcattaaaaacaaatatttcagtgacttctggtttccagtccagcatgtaagaagcttagaaggcatcgctggaatcctcacaacaaggaaaaaactgaacctactgaaaatagacaacttttcttacatctgccagataattgagttcacaggtcaaaccagtacctcccaaattgaaaagacaggcagatacaaagaatcacaacttaactgagcagaaacctttgagggaaccaatagggggaaggaaaacctaaactatagttgacaaattgctggagctcagtgttgataagtctgagagttaaagtctctaggaggggccagtcttctgggggctacacacttgtatgagttttacctccagaaaccctattaggttctcacagtgaagatctgagaaaaatcccctcctgcttccagtaagggaaagggaaaagtagccattttgaaatatatcagggcattctacttttcttgacagggtctacccttaagagaaactactttaccagagctaatctacggaggttttattgaagcctaactgatttgcggaaggggaagagaaatacccaactccagccctctctttccacctatcccacctaaggtggaggtgagggaatgagagggagagggtatgtgtgttcacaatccagtttacagtgtggaggcacaggcatactaaaagactaaaagacagacctaatgacaggagtatagaaggcttctcctcccccagtaccgtatggccatactaccaaagccctatatattacagttgtcagtgagaaaacacacaatccaattacaaaatgggcaaaagatttgagaagacacctcaccaaggaagatatacacatagaaaataagcctatgaaagacaatcaacatcaaacatgagataccactacaaacatagtaaaatggcgtaaatccaaggtgctaacagtgctactgtcaggagtgagtgggtatgtgagaaatgtctgtgttctgtattctctgctcaatttttctgtaaacctaaaactgctcataaagaacaaagtttatttaagtaataaataaggccaaatgctagtgaggatgtggacaaaaaagcaaaagcagtagttgacctagaattttaaaaatggacgtaaatgtatattgaaagatagattaaatagatggatagatgatatataggtaatagataaatagataagcttgactatcttattttcctttataaagcattgttagcataaacaataatgctgggacgctcgctttttcttataatatttttcatgtattttaatttttaaaataaattcattcattatgacttctaataattactaataaaaatggaactgattcatttctctatcattttaagtagtatgggctaggtttagcatttgagcatttgtatatagtttgtctctgtttgaaacaaatcttactactataatttgtgaaaccaacattgtgtgtctggcttattccttttaatattttaaataataaaatcatttatggcttgggctatttccattagttataactgacaatgagaaatgtagtaaaatatgatgtggtttaaagggtactaattaagctataaatgacagcaacatcatgactctgaagctcatgagtcatttgtaattcaagtgcaggagtattttttggtaaggcctcagttgtggagcaatcccagtggaagtatatctcatctgtctggaattacctaggtgtggttctgcccagaggcagagggatggactgattgatctctgggagctacttcccagcccagagtctcagatggttaaagcctgcaattgaaataaacgtcctgccatcactcagcccttaatccccccattctatccatgattaagtgatatcctgactcccttgtactttcccaacctctttcatgtccacacttgtcaggatgcccgatcctcacttagtctccttttagcaataattcaaatgctgattcacttgaatcaaaaaagaggtgaaagagggtacacaattggaacacactaaagaatttgtaaattccagccagtgaatccattttcttaacagaatgcaaaaggattaagagatagaaagctcttaacttagaacttatgctgaagaaataagagttctgattaccatgttctatggagatgccacacacacgcatccatatacaggagaacacacacacacacacacagacacacacatatatatatagtcttctgtataatggatgtgtgtgtgacatctccatagaacatggtaatatacatataaacacgtgcgcgcgcgtgtgtgtgtgtgtgtgtctgcccattccaccttctacctacccttttcagggctgagtgactgatcttcatgcttgatatggtttggatctgtgtccttccccaattctcaggtcaaattataatcctcagtgttgaaggtgggctctggtggtaggcaattggtagtgaatgagtgctcatgagatctggtcattttaaagggtgtagcacctcctaccacctccgtcttgctcctgccatgtaaggctcctgctcccactttgcctcctgccatgagtaaaactccctgaggcctcctcagaagcagaggctgccatgcttcctgtacagcctgtggaacagtgagcgaattaaacctcttttctttatatattacccagtctcagctattccttttatagcagtgggagaatgaactaatacaatgtccatattctatattcacacagctaatcggttctcatatcactctttatattaataacaatagctactcctcactattattagcaacaataatagttctttttattgagatagggtcttactatgttgctgaggctagccttgaactcttgggcccaaacaatcctcctcttcagcctcctgagtagctgggaatatacgtgtgcaccactgccccaagctaataatagttcctatatactatatataatatatgtgtgtgtgtgtctgtgtgtgtgtgtatgtgtgtatataaaaccactgttcaattcacaaggcatcctgtgacctagcatcaacctttacttctaaaagtcaacttaaattttatgcttccagaattatttgagagatgtagccagagaaagcaagcagctctgtgcaggggaacatactcttggctttatatcaaaaagccatagcctttatgagaattgctgtcattttcagctaggccataactaacagtcagctcacattgtgaatgcagaacagccagttgtgccttgggattttccagcctaatagattctcacttcatcatgtacttggaggcagaactagttaagtggatgacaagagaagtggcaaaaatagtaaagagagcttagaagaaatcatgaaaaggaatagatatttccctcctgccttccattctgttctttctacctcctttgctaatttcttattttcttttctctgctcttttaaatcaaagacactctttactctgcaatttcagtaacataaaacagatataaacatatttgcaaaatcagagttcctgccatctattagaaatctctattgtgcattaagaaaggtgagatatatggcaccaacttctatcttttgtttcatcatctccaatctaaatcataattgcagcaagaaagaggtaatgaatattcaattttataataaaaaatagggcattgttttgttacacatgcaagaggcccatgtctaaaacaagacagagtaaagcaaagcaaaacaaaacaagaccacttctaatctactagttgcctgccctatgtgtgagttaaaatacaatttgtgaattgcaaattagaaaatgggagtccacaaaagactatttagacatatcacctgtctcacaagtattttcctgttcattctccccattagtttctgcccttctacttttaaatataaataaaaagatctgcacaaagctcttgtatctgtctgcacagacgcaggctgacacgacaaaataccggggaccaggtgcttaaacaataggtatttatttctcacagttctggaggctggaaagtccaagatctagatgcctacagattcaattcctcagtgagggggttcttcctaagttgtaggtgctgtgtcctcacaaggtgaaaagggagaaagagaaagtaaactctctagggcctcttcttataaagtcactaatctcattatgaggatgagccccccttcatggcttcatctaaatctaattgtctccccaaatcttcatctccaaataccatcatgttggggttagggcttcaacatataaatttggatgggacacaattcagtccatagcagtcctcgttctcaatcaaataacgcatcctttatagtaaaaattcctagtcaaggcttccagtggtacagtgctgactgcgtgccaaggatctttgcaaggctgttttgcataagcctctttaaaactcataacaactgtttaaggcagttactgtgatcattctcatttttcaaaggaggaaattgaagaagagagaggcttaacaactccttttgggttataaaactagtaaggtctaaggccaagtttcaaactcaacccaattatctcccaaacatgctaatctataaagccaccaacttaaagaagaaatcttttttttacatattgctcttcttcctaaccttcaccaccattgtatagtgcacccttgacataagtaactccatcttaagaaaagactccatcttaagaaaagactccatcttacattaataaggcactttgacaacagggaccagatattttggttaataaataaagacagcatccaaccagataaggacataaccaagcacactcttccactatcagtcctcactagacaactctgtggctataaaaagaacagactgacatagtcttgccgttacttgtgataagcaccaggatctgccgctgagagctctgcccacatcaaagattcttccttgcaagaccaatggactacctggcccagaccagaagattctttttgtctacttcgctctccctggactggttccttttcccattcccttatggactgtttaatccataacgtttgtttgtatgttgattaagtgtactattatgtatggtttgcaatatcaactgacttatgaaatggcttgagcctgtgtgccataggctctgactaatgagtgaacaggaattactaaggagaattgcctctttggaaactccatgtagctcccggcttttgtgattgaaatagcattgataaaagcctaacactgtggaaagacacaaatgtgcatgaacctggttatttctgaccttgcatcactcatgagaattactgtgttaaaatttcaaaatttgatggtttctaactccatagatctattttaaaaatacagtattctttgtgcagttactctttgctttcttttctgctgaccactgtactttctttgctggcattgttaacattttcactctcttttattttttctttccttcacattccttttctccttccctcttttgtctttcctttctcctgtttttatagcatcttcaaatgactgagtccccaagcatgaaacctgaaatctgctctatacattttcttgtttcaagtttttttttttgacattttatttatttattttttaaggttaagttacttaatttcttttcttttcttttttcttttcttatttatttatttatttatttatttatttttgagatggagtttctctcttattgcccaagctggagtgcaatggtgcgatcctggctcactgcaacccccgtctcgcaggttcaagtgattctcctgcctcagcctcccaagaagctggaactacaggcgtgcaccaccaagcccggccaattttgtatttttagtagagatggggtttcaccatgttggccaggctggtctcgaactcctgacttcatctacctgactcggcctcccagaatgctgggattataggcatgagccatggtgcctggcaaattacttaatttcttcacctgccctaaaacctaatcactcttacctcaaagtcagtgagaaactatgaagcatggatttatatttaataacaacagtggagactcagctacctaggccttttgaacttggagataccactattttagtgggcttcaggtttttatgattaaaatgaggaaataatatcttcccaaattactttaccaggttgttaagaatatcaaataatgctatacacaaagagagaattctttgtaaatattaaagtgttttataagtaaagatgataactggcatgcctaaaatgaaattcattatcttaatttgctataatttatctcatatcttttctttctctttccccaaaccatatcttgccgccactgataatgttgcttgtatttattcaggtatccattgttcaattattcaatcaataaacatatatttattcaactcctactatatctacctctcctaagaatgcaatacccagggtgtaccctgccatggacctttaaataactaacaatatagaggaagtggcagacaaatacacataagattgtaagagacagcaacagaaattccactgttaaaaatgttcaaggttatcatcttaggtcacctacaacttctaactttatattcacttccctctccaaacgataatcttcttgttttaaggaaattgagatagttcctcacatagaggcagacaatcccattttagaagaggttctaaattgcaatgttcagatattcatttattttgggtgactttgaaattatgaaaaaggctcttaaggtcaaatgtaacaagaatttatgactttgtgccatattgatggcatagcaagataccaagagcttggtgatagtgactgagaaaacagttatcaaaatcctagcaggatcttccaatgcaatgataaatgcaagaatacctccaacaggaacatataaagaagtgcatgatcattttggcctatatcaagtcaattgcatatatgccagtgtggctactttatctgtagccgcaatttccatttcagtatccattctaacgtctaaatatgaagattgttaatttttcgaaggaatcaatgtaaattttatacagaaaagagtctcagctatgcaaagctttcttatttttaaaaaagtaaagtactattttggataggatcagtattttgacaaaatctaacacattttatgtctgccacttaaaatagtttaattactaaaattagaaatcacacatcaacttactactagaacaaggcttctgcattcacatattttttgaaatactattactcataatttgggaagtaaatctttgtttgaaatgtttcaacataggcccttaatgatttcactatatttttaatgcaaatttcattgttacatggcaatacgtgattaggcttttgatcatactaccttgctaacttctatattcatattaaatcctgtatgaaagtcacttgaaaagaagtgttgaatcatgtctacaacagtatcaggagccttagggaaaaccacagactcagttcaatgaagcagtcaacatggttttcaacacaatattggctcccaataagcgtttaatatctggtaaaatgatctagttggttttaaaaataggagaagtaagtgggtacctcctgatgtgatttggcatgtacttttaggagagaaattttaaatgtggctcatttgaaagagacaaagtgaagatcaaacaagtcagtagatcgaaattttacactatgtcttcccggctacagatttgaaatctcacagctaaattcttcataaaatttgaacatcttttcatgtcactaacacaaattcctgtatctggtttaaatacaggagaagagtataaaagaaaacaacgttttatagaactgtttagaatatgatatggtttggttctgtgtccccacccaaatctcatctcaaattgtaatccctacatgttaaaggagggacctggtgggagatgattagatcatggggttagcttctcccatgctgttctcgtgatagtaagtgagttctcatgagatctgatggtttaaaagtgtgacacttcctctctctctctctttcctgctgccatgtatgacatcccttgcttccccttcaccttccaccatgattgtaagtttcctgaggcctcttcagtcaggcagaactctgagtcaattaaacctcttttattaaataaattacccagtctcaggtagtatctttatagaagtgtggaaatggactaatacagaaaattagcaggaagaagcaagaaggcccttcctatgtaaaatttaaacaaatgagttttaaaaattcagaacctccaggaccaatgaataagtgcttatttctcagctatggaaaaatctgtcgcaatcgcatatgtttacatatacatgcagttgaatttcttgtccttctaaggtaaatggcatgcccagtactataacacacagcccatgagaacaggcaatcctcagtatccactgacgtctttgccttcctatgtcttcctggttttcatccaaccttcatctactctttggtttttccacctccttttttctctgtgtgtcatttaaatacagatagtatatatctctgagttctgctctaaattcttccatttgttctctagacacagatcttttccattgttgatcttatttagtatcacggacgcatatgccattgctaatgatcctcaaatgtgtaaatccagctgaggtctttgccttgagccttctacctaaaagtttcctgactcctcactcaattcataccttaaactatgttcatccttcccaaaacttattctgttttcttatgattctgattataaaggaatagcttcaccattcagtgtccaacacagaaatctgtgcattatatttggatgttccctttccatatccaatcaatgcaagcaatcaccccacaatgtctgaactactttcaactttccagagtcagtcccctctccttatagctgattttaggtaaatgtgattctttttagggattactgccatattcttctaaaagtaataccttccttaagtccttgtggctttgtgacttatgcaaactcccttaaccccagaacaaaatatccaagtactaatcctcagaacttgagaatgtgttattttatacgggaaaaggtagtttgtagatatgattaagattaaacaatttaacttggggagattaacctggattatccaggtgagcccaatcatatcacataaatttttgaaactgagactctttgccagaactgttctatcataagtaaaagacatgattattaacactcagagttggggaagaggtcagggagagattgggcgtcctgtctcttaagaggatttgacccaattattttttagccacaccttccttcccatttccagagtcatctgatcatctggggactctttagagcctttccctcctgcttatttaggattacctttccctgtctgttatttcactggcctttgctttcaggtattcaaataatttattctatctcctaccccatctttttatacttgtaagtgtatgccttttattgttaatgtatctttagtgtcattttaggaggtttgaagagggagtttggctaaatgcgtatctccaatccacagtctttaaacaaaaacccaccctctttaattttctttctcatctaagccatttaagatcagtctgctcacttgcttctttctacactggcacatctgaatgatgctctcttaatgtaagacttagtggaatcagggcaaattttatagaaccaatgcaattttgagatacaataactttgatacatattgaagatttatataaaatgcaatatcaaaaatagtacctttttggaaaccaacaaaaagaatcccaaacctgtatttccctagagaggttggaaatccaagagacactaacagaacataaatttttatattaaaataaaggaaacacctctacttttttttgctttgtaacaagcacatagattttcagttttaagcaggaaatttaaggtcagatgtcaaagaccaatttctaataactgtcaagtttatcctctccttagctccatattttatactcagtatatatatatttataaatatgcatataaatatttaataatatatacatataaatatatatttccttagctccatatttatactcagtatatatatttatatataatatatataagtatatataaacacacacacacacacacacacacacacacacacacctttaatcttccctaattttttggagaggagccagacttaaaatgcaagttttcaagggacttgaatagaatcttgtctaaaatgcaaaatagcattttttttaacatctatggtatgctttaatatttttccttatatactcatggttttgctggcttcttggaaaggggtggagacaaccaacttaaaaaacaaagggaaaaggagagaaagagagagaggaagtgtagatataaacatcaccaataatgatcattttattgaaatgtaaaccaagtcttcttaaatcctttccagattgagtcttagttctgtctataattttttaagatcagttcaaattttattcaagtaagacatttgtctttattttggccccagtcatgggtgttatgaagtcaccattaatctgtttcaagaattcttttaagaaaagatattttattttaaaatagaagtgtgtttcatagaagccttcaatcataaattataaattttacagaaaacagaatctgcagtgagaccaatactaaactgctcttaaggtcactcttccacttgagccaacagtctttggaatcaaacatgatattgtttgtgataggaaacatgacacttcctaaggaaaatttctgatgaccaacctaatgatttgcatgcaagtgatagtcaataacttgacaaaataagtatatagatggaatgcagagaagagatacagaaagcatagtagcaaagctttgattttacttgtaaagggtaaaattaaagcattataaatgtccttccctcaacagtaaccaaatatgctgaacaatagcttccaactttggcgtattaccagacctccatgaaaaatagtctctgagctcgatctgagaataaaaaaagaaaaataaacaagaattggaaacaattgaaaagttatttatgagcattcacagatgacatttactagaatatgagaggagttaataaagtttggccttgtctatgtattacatagaacttcaatctgggatttttgcataaataagaaaataaaagttgaatatgattagttgacaagctgataatgagaaaatgttctgacacatttatagcttgtccaaaacacattgatcgaggatgaacacatttggacatactgtaatttaggggtacagctattgcatcactattcactttggcctcggttcaatgtaaggctattacaaattaaagtttgtctctgctatcaaggtgatgtgttatcctgagcagtaatgtgagtctcaaaagtagcttacaggttgtcttgaagaggtctttccctgacattgccaatgtgagtcacaagtcacagaagtttaaaactgggcctgtgatacagaaagggaaagcagaaagtggtggtgaaaacttgacagattgctgcttttagaaatcagcagagattggattagacctgaaatcctggtacaaagaacaggattttaagatcagaagaaattctggcccagttcaaaaccattgatgtgggagaaattgttggaagttgtataaattttgggagcatcatgggaagttagggaatctacatcagaaaatagagcatgtctagccagagaagagggcccagatgagagggaagttagcagcaattagaaaacatgagtaaatattgaagaaactggggctaaataaagaggtttatgacaggatttacaaatgtctgaaaagctgaattgtaagcaaagagccaaaaacataaaaactaatattccctgttttgagagtttttctggttggacccaaagggcagacccaggagtaaagcaagatatttatagggagatataatttagttaaaacaagaaaggcctttctaagaatttggttctctaaaatcgagtggtgtacttcaggagaaactatatgaatagtttacagtctcagggagagtggtaaagcagatctagatcatgtgggttggggagaagggcgagggacagtcaagcatcagagcacgttgaatttcgtgacttctaaggtctttccaatcctttgagttagcaaatgacctggcttgatccgaatccaaacatgaggccatgcctacctcatgtgtcactattctgtgaaccattgttttctctagatactttggcaatgtagattaaatacagctttcatttgattcacatatttacctaaaatatgtatatataatgctattgatagtgacaggaggcagccaaatgcataggcagataggggtgggtacccagtaaaaccccacctctagtccaaagatgttttaaagcctgaaagccaagccaaaacttaaatactcagaacagattaagaatttgtcttcctgtttggcatgctttcctctgattgatctcccctcttcacctattttacatatacctaccctttcctaattggttttctatactgtcattcccacctttgagtggtgtctttgctttaaatttttgtgcacactcacaaaccgtcagcatgctctacccgtcctgtcctataaagaccacaggctcagtcagtagaggagaatatggcctaacttcaggaaaggagatggcttgacttcagggaaggaacaatctgactctggggaagacaacctgcgcttcccatcctctctccaccaaccctctacactgagaaccatttttactgctcaagaaaattctccaccttcaccatccttcaaccatccatgtgacctcattcttcttagatgctggacaagagctcaagacccactgagtgtgggtacccagaaaggctgtcacactggccctttgctatcactggtagagggcagctacctctcatgatgaggcaaggggccaaatgagctgctaacacaccgccgtccaaggacagtagaactaaaggagcactgtaacaccccctctgggactttggagtcacaggtaccctcacctggacaccaccacgttcccctcaaggcgacatgcctggtctgaccacaggccctgcatggagcttgctcctgtgtcagtgcctggagcagccagctgggtcccgcatttgctctctcacatgctccctcccataaaggagcacagcaggccaagcagagaggggcactcttgctctgagtccagtgagggggccaagaaaaattctgcatcactctaacaattcataatttggacatcttttttctacaggtagaaatctttatagaaatctcagcaggagataggtataacctaattcatcagctatttttatcacatgatacaagtgtcaagttaataaaatgtagaatttgaatcttatggatggcatagggtttccatttcattagaatgtttccatttaaattcctaaataatccttaaaatagctggttactgggttttgaattgagccgtggcttggacgttgagttgcattccagtatcatacaatttcccttccctgtatctcctgcctaatccagcataggaggttcttatgaggctggtagggaagaagagatttggcttacttaggaagctactagtagcatccaatctacatggattgccttcctgtgctttaaaccacggtaatccacatgccatctggcctacacttgtaagggaatagtattcttttgccattctaggctgtgcatggcaaaagtcttaaattgtgttgattcatttcagcctctgtttctacctttttgatattccactccggcccttatgtgattgcttacttttgacttcctttactgattcaggttcttcatccttttaactatggatatttttcagggtcagaatctgcacttggtcttgggtactcttgctcctggctgctcatctacattatcaacacctggtttgagtcactatcctatttgaccagtccctggatctacttcttggtttacattaaatactcatcaggatggacatacagtggtctccttccaaattattataagtgaagctcagagattcaggtgtttctaaatgctgaataataacagatcatgtgtttaacttggaattcttacaataagctgatagttctgggtgctttatttgagtgtgattttcctgggtccccttatctaccagattaatatcttactctataatattttggagaccttcatcatgctttgactgaatgtcaaaagaatttgaccaagaacaatgatacgaccagctctggcatgaatgtgaccatttatctaagccaagcacacaaagcagggttagtttttgaaactgactcacagatttaggagaaaatttaagtgggtatcattttatctgaaactctatcagacaaatgcttaagcacaatattttcctaggagaaataatgtattttgagaatactgagataagaatttaatgaaaattaaggtaaaatagaaaatcttaatttaagtatttatacaattacagggaaatttacatgaaaaaggtcacttaaaaatgaatataaagcaaatgtaaatacacttctctgttcatgccatatagaggatgaatttgtttctggacaggtttagagagctctctaaccttctgtcttctaaatttccaattaaaatatgggcacagggagtagaggaatgtgtttgtttacagttggcaaaaactgatttcctgtttctaagaaaaaaaagcttttcaaagcctttttggacttcaaatagctcttgcaaaacaatattttgatgagctaagtgtaaatgaatcaggaacatatggattggatttccattgagatacacatgggtttaaacataagctgaagagaatgcctggtaagttatacttagaattgataaaaaccaaagtgtagtatatttttcagaacttgttttgagacacacccacctcccagcccaaacactgggagtttattttcttttcttaagaaatcttttctgaaaggtggatgttacttgttcattactgaaaaagagtcaagttttaaggagcagcttccaagcgatgttattacatgcatctacctatcagaaggagtagaaagaagatgttattacatgaatctacctatccgaagaaaccctcagggccaccaacacaaataaattatcattttgatattttttcttgccctttctactttctgttccacttccctgtcctcaaacagaagtatctaagcacgggaggatagagaatgaaatcttgtaattgctaaagcatgcatgcccaggtatagctttcattgcatttataaaggtggctttacaatagttctaaaaatgtttaaagtgaataatctcaaaaatatgccatcctccatcctgggtgatatttaaaattgcactagggaccatcttgatacaagatgttataacactaaataatttgggattagaaattcttacacatagaagagatgattacatggttaatgctatttatatagcctaatcctttaagagtctctggggtttgtgaaacaatacaagacatacctctcttagccactcaacaacaaacttgcaccagatgttgttatgaatgttgtttgtgtctcctaggattcatatgttgagtcctaatacctgggaatgtgactgtattttacagagagggcctttaaagcaataattttcttaaaataaggtcaatagggtgggttctaatccaagatgactggtgtccttagaagaagagattaagacacagacaagctcagaggttaagaccatgtgaagacacaagaagaatgtggccatgcacaggcctcagaataaaccaactctgccaataactttgttttggacttgcagattccagaattgtgagaaaatatattgtcattgtgtaagccatctggtctgatattttgttatagcagccctagcacattaatagataaacctatttgctcttcaccatttacaaataattatgactcttaactataggccactgtctagttttgttccctattacacctggaagctatcttcctagaacctaaacttttgaccatcaggcttaaaagccagggactctataatcagcagcctacaagaaaatgcatacttaagccaagacaaggtccagttctcctgatcatagtgtaatctgttcttagtattcctccgacagatgctgaatcctattcctttccctgatcagattctgttttttgcccatttcccatatgctcagtttatattttcagttttattcttttctcccaaagttaagcctatttcctcaacatggcctaatacctgtattccattctcacagtcaagcaatggactcatgattagtcatatttttctcattaataagaacactggtgacattcttgccatgtgatggcttaactgctacactttggaggcacatcctcctcctcttccttcatcaacttggcccactcaggcctgctgtcttctctaaactaatctgaatttccttacaggataattgctccaggctctggcatcagagtggctatgttcttattctgaccccctttcatatgaactaggtgggaaattccttcatctgaaaatagggataatcatagaatctatttcacagggttgtaggggacttgaatagaatggtgtatgaacagagcttaggatttctcaaaagctcaataaatgttagataacttgttaggaatgataatggcttctctaaaatgtgaatatgcattgttcattgacagcaatcctatgaagggggaattagctttatctatttgagataaaaaaaagcctgagcaaaacctgactgagtgcaaaaacaatggttttcatgcattttccagcatggttccaccttggaagagaaagtcaagggaaatgagccagatataatgattcactgtagcctaaatacatcatggcttcattgggggccactggggagaacaactcactttggaaaagggattaatatgttataaccaagactatggataagcttttagacctttctttttaaaaaaataattttttttgtgctttgagtttctgttttatagacctttcttaagaagatagttggagcaaattcctatagttagaaacaaactcattatatgctccaaaggcctgaatccaatgttctgactaatggatctgaaataaaacattatttatatccatattatacaatgaatgaattggccaggaaactgagggtgtgttgatgactttgagtcttagtgaatagggtgatctcatgaccacagcattctggagaggtgcattagtgcactttcatgtcatctgtgggagccttgacattgagaagcatgacagtaaattacatcattcaagtcttgaagcaaaccagtggagttaggttcattcttcttgctccctccttattgtattttgctgaccacagtatgttctctgtttggagtgggggtggaggcaagaagccacaaatagcataagcaggagttgatgcttcaagggggttatcatgattggagctgtgccttcatgcaatgtcttgcactgttatctgtcatttgttttgcaaagtgttaatacacaaaatcatttggaaactccatcaaagacagatggcattatgccatatgaggccatgagactaagagactgtcttctcaagggccaagtgcaggaaaatagaaagctgattttaaagatcttcctcctctattttcaccttctcgtctaactgattttaattgttctctaaagttatgagtaacacagtttatagcaatttccacacatttccctaagaaaaatgctgccataaacacacataattaaaatatgtgaagtatcaggttatcaacattatattactaaataagactaacacagtaattactcccaagaaggcatgtataggtctttctgtgtgggtgttcatatgtgcaacactgaaggggaagaaggctgtggcaggaaatgtatcccttaggaaagagtaggaatgtaatcaagtgcattttgattccaaggaaatgactacattgacttcaacatttttcacatgaaggttgcaggaccttgtactgactatcaagtttcagctcaaagttaccaggaagaaaggctgtcctcagctgtagtagcctggatctctaaactctgatgctcttctctattattcattttaaattttgcataatgcataccattatctgcaagttgtttgtgctttttggtatttattatctcagttttctcaccagaatgtgggctatgtgatagcagaaacttagttcatcatattcattattgtgttttcaacacatagaacacagtctgccacaaaggagatgttcaatcatgattgctccaataagaaataaatgattgattgaatatccatgttgttaagagaaatgttttcaaagaaaagcatgaaccagtttgtttattctattaataatgttggccattggaattaaagccagctctgtacactaaagcatagattatcagggaaaatgtgtgactttttacttacccttctcaattcatgtatttcttttgtgtgttcattcaacaaacattaacacagctcttattttgtgccaaatgtagtacttttgaaatgagcacactaaaaagtaaaatacagttccagttacatttactatgtaactagcaaggaaaaagttaagcagaaaataataagcacctggtaaaagttctttccaagtggactgccattatgtctattaccaaaacatgtgagaggcaattttttaacaaataccataaggttacttctaaaaacataacaagattgagtatataatgaagttttaggctagaaatagttttcatgaacagttgagtatcagataagatataattcaattatgctttttaatattaccacctcccaagaagatactactccatatggcaagaagtttgggcagggaatgtggatgaaccccatgatactttactcagaaaagtttcaaagtgggaaggtatttctttctctgtcttccctgttccttgactccaagcccaagtgtttatggcaagcagaaaataagcatatactcttttctcccctttgattactcttgcctctgcagtcatgatcctattttctcactttccaccacctcactttttctatgtctaggctgaaactgcagactttggaaacagtgggacaagaagttaagagttgtgaatagcaggacaataacaggtaataaaataaggttttgcatggtattttctctgtctagagtttcagagatgagtaaagaaaacagaaatggaagaaaaaagctaccccaaaagaacaaaggtaccttccatgaaaatctactggatacaagcaattgatctgcgttctgcctgaggcccacaagtactcaaagacttcagaaggagactggttaaccatcttagtgaaaaagagcagagccacaggtgaccgatttattctgtctgttcataaaaatcttagtccagatcattaaagaggatatatatacaaatatatacatatacatatatacacacatatacatatatatatacacattcacatacatatatacattcatacatacatatatatatatgctaggtgatatatcaactagaaggcacactatagaataagacaagggatactacactaaaaatacttgtaaaaactgaactaaaatatgtagagtaatttttcagaagagttcctatatacttcagcaaaatgtagtggataataaagagaaaaaatgtcataagaaagtttagttgaatgaaagaagtgtatgaaaagataacaatatgagatgaaaaggtgaaaagaaagaataataaaattataaaagagagaaaaagaaaactaaaatcataggatcaaaattaaatatgggaggtaaagacagaaaacatcaaatctgatgttacagaaaactaaaatatggaagacaaatttcaatagagcttccaaaatttagaagcaaagacttagagattaacattaataaaacagaaagaaaaccaaatactcagaaaaatgttgataccaaagaactgggaatacatgagacagaggttatttttccatatctcactgaaaacaaattttggagattaagatagtttaatgcaggcacatgaaaaggggaaaattattgctacataaaattgattaaaatattaataatcagaaaacatagtggatgtctacaaatcaataaaatgaaaaaatgtgtgtaaagatacaattcatagaaaagaccttctaaaaagatgctcaacttcactagtaatcaagatagcactaaatttaaaaattagataccatttcagttgtactagattggcacaattttgaaattaaaacttgtagtagtaaagatgtcagaaaacaaaacatttttagagtattcacatggatatacatggtgacagtacacgtatatttcattttaattgtcttatatatggatatgtcacgattatttcatacatttatctagtgatggcatttggattctgcctatttttttctccttaataatgtcataaaatgttgttatgcctagatggtaagcttgtgaatggttttccttaaaagaaaactccttctgacttatgaattgtaaaataatcaataaaataaaatagagcatatcactaagtgatcaaggaaagttgagccatatatgggttggtgtattagtctattttcatgctgctgataaagacatacccaagactgggtaatttatacaggaaaaagggtttaatggacttacagttccacatagctgtgaaggcttcacaattatggtggaaagcaaggaggagcaagacgcatcttacatagatggcagcaggcaaagagagagaatgagaaccaagcaaaagaggttttcctttataaaaccatcagattttgtgagacttattcactaccaccagaagagaatgggagaaaccaccccagttgttcaattatctcccacagggtccctcccacaatccatgggaattatgagagttacaattaaagatgagatttgggtggagaaacagccaaaccatatcattccaccctggcccctcccaaatcacatttcaaaatcaatcaagccttttcaacagtcccccaaagtctttttttttttttttttttttttttttgagatggagtcttgctctgtcacccagcctggagtgcagtggcgtgatctcagctcactgcaacctctgcctcccaggttcacaccattctcctgcctcagcctctcgaatagctgggactacaggcacacgccaccatgcctggctaattttttgtatttttattacagacagggtttcaccatgttagccaggatggtctcgatctcctgacctcatgatctgcctgcctcagcctcccaaagtgctgggattacaggcatgagccaccatgcccagcccccgaaagtcttaattcatttcagcattaactcaaaagtccacagtccaaagtttcatctgaaacaaggcaagtctcttctgcctgtgtgcctgtaaaatcaaaagcaagttacttacttcctagatacaatggtggtataggcattgggtaaatatacctgttccaaagacagtaattggccaaaatgaaggggctacagtccccatacaagttcaaaatccagaacataccaaataatctcctttgactttgtgtctcagattcaggtcatgctgatgcaaaatgtgggttctcatggtcttgggcggctctgcccctgtggctttgcagggaatatcccccacctggctgatttcacaggctggcattgaatgtctgtggcttttcctggtgcacagtgcaagctgcctgtggatctaccattctggggtctggagaatggtggccctcttctcacagggaagagccccagtaggcagtgccctagtaaggactctgtatgggggcttcaaccccacatttcccttctgcactgccctagcagaggttctccatgagtgccctgcacctgcagcaaacttctgcctgggcatccaggcatttccatacatcctcagaaatctaggtggaagttcctaaacccaaattcttgacttctgtgcacttgaaggcacaatgccacatggaagttgccaaggcttggggcttgcaccctctgaagccaaggcctgagctatatgttgatccctttcaagtatggctggagtgttgggacagggggcaccaagtccctagggggcacacagcacaaggaccctgggtccagcccatgaaaccactttttcctcctaggcctctgggcctgtaatgagaggggcttctgcaaagttctatgacatgccctggaggcgttttccccattgtcttggtgattaacacttgggtcttcattacttatgcaaatttttgcagctggcttgaatttctcctcagaaaatgggattttattttctatctcattgtcaggctgcaaattttccaaacttttttgctctgtttcccttttaaaacagaatatctttaacagcaccaaagtcacatcctgaatgctttgctgcttagaaatttcttccaccagatgccctaaatcatctttctcaagttcaaagttccacaaatttctaggggaggggcaaaatgccaccagtctctttgctaaaatgtttaacaagagtcacctttgctccagttcccaacaagttccttacatccatctgagtccacctcaacctggatttaattgtccatatcattatcagcattttggtcatagccattcaacaagtctctagggagttccaaactttcctacattttctcatcttcttctgagccctccaaactgttccaacgtctgcctgttacccagtcccaaagttgctgccacattttcaggtatcttttcagcagcaccccactctactggtaccactttactgtattagtctgttttcatgccactgataaagacatacccaagactgggtaatttatacagaaaaaagtgtttgatggacttacagttccttgtggttggggaggcctcagaatcatggtagaaggcaaggaggagcaagtcatgtcttacatggatggcagcaggcaaaaagagagggtgagaaccagcaaaaagtgtttccccttataaaaccatcagatcttgtgagacttattgattaccatgagaacagtatgggggaactgctcccatgatttgattatctcccactgggtccctcccataacacatgggaactataggagctaaaattcaagatgagatttgggtggggacacagccaaaccatataaagttgggtacagctaagtatatagtgatactggcagtttaatttactcaaactcaaattagagaaacaaacaaatacttgatctcaaatgtgataagttctatacatgaggaaaaaaaggaattatgaaaataatattggtggccactattttatattaggtactgggataaaatatcttgaagacatggcatttaagttgaggctaagacaggaaaaagacatcatgtaaagatgttaaggagagaatcacacgtatgaagaacagtttaagtgaaggtcccagggcaggaagagcttgcctcttttgagaaactgaaagcagtcagtgtggatgggagtttagtcaacagagagcagtggcagttggagttaagtgtgaagagttacaaaggaccccatggtggctgttagaacatggtttacaaaatagtatttcaaacaagcccttatctgatttcaatatgtgttttgtttcctctccattaatttcacaccctctggccgttttcatatctctcagatggcttctgcctttatcatggtgttgtggtaggtctcagttcctccctgggcctgtcattttatatgaattggtaactgaatgctgattatgcctaaaggactgctgctatataagcaatgctgttttcattgatttgttgtgatttataatttgaaaagttgagggagaatgttgaagagaaattgagtggatgagacagaagtgctaaagggcaaagaatatcagtatctgaatttccaaacgatacaagttgttatgttgtttatttcaacagaatatcagccatactattaggtgcttctgagttacgtacgagagtaggtaacctgttttacagtatttaaagtgaaatggcaggttttggggatggaggcatcagcactagaatacagaattcacaacactgaaacatcctatcagcatagcattcaaaagggaaattctcagcaataacttaacacatctataatgaaacacaaaagtcagttaagaaatattcaaacctgatgcataaaatcttatgatttaatcacaaatatgccattctaaaactacattaataataatttatacttaatgtaagatattctaatatatctcctaaaagatagtatatgaagcatgcagcttatacatacacaaaataagaatttacagtatacattcttctatcctcaggtattgcaaaaaagtgatatatttttagttttattgcttaactgtcatgggttccttggggtgtcactttgccagtcagaaacctctgtggctggcggcaactctgcttgtgttttgcttgcgcctgctgggctcattccacccatttgagccagcaggctgcaactggctcatactactggcctggatcccatacctgccaaggataagccaggagcagagtggtgaggggtgtgtgagcaagtgagcacagggtacagcaactgtgcacagcccagcatgctggctgcaatagggcagtcatctccaggttccagcacaggcagtggttccacgtgaggctgtggctagaccaggtgtaccacaagctgtactgcttcaggcactagggaatacagtggtgcccagaagcttagagacactggaaaccatagaccccaaaagagggtggcacagccctggcttggggagcccttaactttgggctccccaaagtgacacagctcttctctcctacttattgcccaccacttagtgagtgaaggagcatgtttcagccctgtttgtgttacagctctttcagtcttgccatttggtgtgtcctaagttcttgtcccatttccaggaagaatgacgtatgcagacaactggagggtgaacaaggtggagaggagatttattgagcgacagaacagctctcaggagccctgaagtgggcagcttctttctgcaggcaggttgttccaatgagtgtccagctttcagaggagaggagacccatagtgggtagcttctttctgtaggcaggtcatctggacaagtgtccaactcttaatggagaggagacccatagtggctatctcctttccatagccaagtagtcctgatgagtgtgtgagactgattgagtctgggcttttcgtctgctctgaatggagaagtgcatgctgattggtcaatgggcagccacagggcaggcctggaaaaagcaccatccaattggtcaaatggttatcaatgaatttctcactctcaatggtggactttgcccagaactggcagcccagctttcaggcttcaggctatccttggcttgaaagtgaggtttcaccagggactcgccccacaccaagaagctcccataggtcagtgctgagctgcctttaccccatcccccttcctatgctccttggcaccaaagtccgagggggctgaggcaacaggaggctggtgagtcagtgctgccctgagtgcacacacacctggctgggttgtgacagtgcctgggcttggccacaactttgctctgccctggagtgggcacctggagtggggaaaggccagggagcaggaccaggcactttaagcctgcaggggcagggagcttcctgaacccctgagagtgcaaggatgctggggtctggagctaaggtcgggtggctgcagctgcacccaggagagtgggctcctgactcacaaactcagtagtgggcagggctgttgcctgtttccagctaccgccagctccacaaacggcacaaccctggccatgcccccacccccccaatgcagccagcaaccttgcagctgccacttaagataggctgttgctgccatcataaggataattctgtacggatgatttatttttataattttgcataactaactttaaaaataattgttgggagttgagacaacagaaaaataataccactattctaaaaattttagaaaatatctaagactggtgatagattttcacaccataaaaacaggaaagaagaatgaattttcattgtattctgaagttaagctccatgaacaacatgcagtgtatagaagagtcatttaatgatcaggcaaagtagcatcaatattttgcagagttgtttcacaattatgaaccaaactaaaaattattgatcttatttcaagatctctttctttctctctctctgtctctctctctctcaactcagtcttgctaatatattcgcttatttttttcaaagaattggcatgtgactttgttgattttctttattgtaagatttttaaaataattgtttttatttttatatttttatctcttctatttacttagactttgatttgactctttttaattacttcttcagccataatttagattatttattttaagccattatactttttaaacagtggcatttaaaactataaatttttcttaagttcagctttacatgcatctgataaattttgacatgttactttattattaccattcacattaaaacatgatttttaaattattttcttgtgacttctgtggcctgtgggaaaattttaagatattacaatgttcttgatttcaaatgtaatgcttttttgatccctgtatgatttcattctttttagatatataaagatttattttgtgggtttttttaaaatagtgtatcatttctcttagtgaatgtctcacatgcacttgaaaggatgatatgttctgtgtgtgtagtagtctttaaatataccttagttgctagaattgtttgcatattttatatttgtattgatttcttgtctatttgttccatcaatttctgaggaaaacatatgaaaacccccaaacccccaaatatgattgtagatttgactatttccccttttgttttgcccaatgtttactcatatatcgtaaagttctattattgtttctgtacagatttaagattcttgattttattccaaagtctgtctttggaataaaggcagagacaggccttctgatggcaagaaacttgggaatttatgtgttattgacaaatttacccttatatcattataaaatgtcccttttatatctagaaatgttctttgtcttaaaatccactttggtattaatttagtaaaatcaacattctctaattactgtttacctaacacacatttctcaccattttcttttaatcagtttgtgtctttatatgtgagggatattattttaaagagcatatagttgagctctaatttttaaaattcagctgaagatctctgtcttttatttgaatattttattaaattacattttatgtaatattgatatctttggtttaagactaacatgttggttggttgttttctcattgtcctatctgttcttgttcctctattcctccttctcttacttttgtctttcaccgtaagaaaccagaaaaataggagtaattaaacacaaaaagtaaaaggaagaagataaaaatagcagacgtcatgatacaattttttttttttttgaaacagtttcactcttgtcgcccaggccggagtgcaatggcgtgatcttggctcactggaaccttcacctcgtgggttcaagtgattctcctgtctcagcctcctgagtagctgggattacaggtgcccaccaccaccacacccagctaatttttgtgtttttagtagagacggggtttcactatgttggccaggctggtctggaactcttgaccttaggtgagccacccgccttggtctctcaaagtattgggattacaggcataagctaccacacccagccgaaacatttttttttttaaacccagttcagaaaaatcaataaaaccaaaaactgacactttgaaaagtatcagtaaaattgataaaacccttatcagactaatgacaaaataattaaatagaaaacacattatcattatcaaaattgaacgagaaaaatcattgcagataccaaaatattaaaaagataacagaggaacgttataaataactttatttcaatgaatttgtaacttagaaaacatgcagaaatttattgaaaggtgaaaatcaccaaaactggtaacagaagaaataacaaacatgatttactttatcaattatgtattgaattaataacaatgacaacaaaaaactcataaaaaactccaaattcactcatgaattctatcaatcatttaaggaactaataataccaatcctacaccaactattttagaacatggaggagaaaacacttcataacaaatttaatgaggttagtattatctgatattaaaaccagacaacttactttagtagaaaaggaaaacaacaacattagtagaaaaggaaatagaccaaggatacctgtcatgtatagagatgcagaaatcactaacaaaatattagccaatcaaatccaacaatacatagaaaagaaaacacttcatgaccgagttccttttatctcaggaattcaaggtcaatttaacacttaactatcagtcaataactgttgtcatattggtagataacaagatggacaactagacacaagcaagaagtgtcactccctctgagagagaccaaattatcaaataaaccaccatcatttgggcaggtcttcagagagaaaatgctgagagtagatggagaagcaatgctgaagctgaggctgaagagaaaggtagctgggaactatacatgggatatccagatgctacagctagttccctgccccaaatggctcctgggaaaggggtgagtgcaggaactgagagtcagctcactctcaccacagacctctgggatcctacaatagctacaggggaccctgtgtcccctatggacatgtcagctggcagcgggatctccccagggagcagaaagagacaggccttcggacagcagggaacctgggcacttttgtatgctgtgcatctctggctgagagcagccatacaaccccatttccccagtgctcttcatctgctgcaggaggctctggctccagctgacctcaaagccaggagagaggcttgcccatgggactggggcacagctgttctacaaaacctcctgctttccaccccctaccaggagctatgcctagctgccctgcaaaagtaggtgcacagcgcagcctttgcatcccagcctgagtgtgttgctccactggagtacttccctggagcagattggatcccctagtacagttggagcccaatgtcaagctgcaagacatcctggcacctcctccccatggctgtggcacacatctcagtagtaacagccaagacccatgtccagtacttgagcagaggagaatcctccactctcagagcactgacaggggttagacatttgggtttctgagccagtgcacaagtggggcatgcctccctccacagagccagtcctgaaagactatggtttatatccctgccacagcctctgcccaaggggaaccctatggcctgaaacacttaacaaaaatatgtgagtgtagtaccagtaattgtaggtggctcccccaaggcccaggagcagacttggtgaggggaccatctctctgcctgcctcaccacatagcatgcctatgaatgtgaagtacaaacaagccgtggctgagtattgacctagctaccagccattattcttaagcatcacttactggattgcaacccaaacgtcatcaccagaaattattctgctattatctatacctgtgaaaccaagtgcaataattcatccacacataaagattctgtacagagaactggcactctgaaggcacccagaaacaaagccaactgactgtactcaacttataccacagttaaaggagcaccaactctcccagatgagaaagaatcagcacaagaactctcacaattcaaaaagccaaagtaccctcttacctccaatctactagctacctagcactgattcttcaccagtataaaatgaatgaaatgataaagaattcagaatgtagatgccaaggaagctttctctcattcggaagaaagttgaaacacaatatgtggaatccaaggaatccagtaaaacaatccaaaggctgaaaagcaaaataatcactttaagaaagaatcaaactaaacttctagagctgaaaaactcactataagaatttcataattcaattggaagtattatagtagaatagaccaagatgaagaaagaatctcagagcttgcagactggttctttcagtcaactcagtcagacaaaaataaagaaaaactaatttcttaaaatgaacaaaacctctaagaaatgtgatattaggtaaagagatgacatctacagctcattggcattcctgagagagaaggagagaaaataagcaacttggaaaatatagtccatgaaaatatcctaatctcactagagaggttaacatgcaagtaaaagaaatacagataagccaaactagatactatacaaggtgaccatcaccaaggcacatagtcatcagatttaccaaggtcaatgcaaaagggaaaatcttaaaggcagcttgagagaagggtcaaatcacgtgcagagagaacaccatcaggctagcagcagacctctcagcagaaacctttcaagtcagaaaagattggggcctattttcagcattcttaaagaaaagaagtttcaaacaagaatttcatatcccaccaaattaagcttcataagtgaaggagaaatacaatccttctcagacaagtaaatgctgaggtaatttatttcaactagaccagccttacaagaggtctgtaagggagtgctaagcacagaattgaaagaatgacacctgctaacataaaaatacacttaagcacatagcacatatgcaccataatgcaactacacaataaagtatacataacgaccagtaacaacatgatgacaggattaaaatctcacacatcaattctaaccctgatggtaaatgagctaaatgtcccacttcacttaaaagacgtaaagtggcaagctggataaaaagacaagacccaaccatctactgttgtgaaaagacccatctcatatgtaatgacacccaaagtaaagggatgaagaaaagatctaccatgcagacagaaaacaaaaagaggaggagtcactattcttatatcagataaaacagacctaaaccaataaaaaactaagaaagacaatgaaatacattacataatgataaagggtatagtccagcaagaagtcttaactatcctaaacatacatgcacctaacactggaggacccagtttcataaaacaagttcttcttggtctataaaaagacttagaccaccagacaataatagagggatatttctaaatcccactcacatcatgagacagatcatcaaggcagaaaactaacaaaaaatactctggccgtaaactcaacacttgactaagtgggccttatagacctctacagagcacttcacccagcagccacagaatatacattcttctcttctgcacatggaacatattctcagatcaaacacatgcatgaccatacagcaagtctcaataaattaaaaaaaaatgaaacaataccaagcacagtcttggaccaaaatgcaataaaaatagaaattagtatcaagaagatccctcaaaaactacataaacacatggaaattaaacaacttgctcctaaataattcatgggtgaacatcaagattaaggcagttatcaagaaattctttgaaatcaatgaaaatagtgacgcaactaaacaaaatctctgggatacagttgaagcagtgttgagagaaatgtttatagccctaaacaccttcatcaggaagtgagaaagatctcaaattaacactctaactttgcacctaaagaaactagaagaaaaaaaaaccagagctagtgaaagaaaagaaataactaaaattagagaagaactgaataaaattgggatgaaaagcccatacaaaagatcagtgaaaccaggagtgggttcttcaaaaataaataaataaacaaacaaacaaacaggattattacctgactgccagctagattaaaaaagaaaaaaatgaagattaaaataagtacaatcagaaattacaaagatgacattataacaggtcccacagaaatcaaaagatcagcaaagaatactgttaacaactctgcaaacaaactagaacatctagaggaaatggataaatttctggaaagacacaatctcccaagattaaatcagaaagagattgataccctgaatagaacaatattgagctctgatattgattaagtaatacaaaacttaccaactaaataaacgcactggaccagatggattccaactaaattctacaagacatataaagaagaacctctatcaatcctactaaaactattccaaaaaattgatgatgaggcattcctccctaattcattctttgaagccaacatcagccttctacaaaaatctggcagaaacaaagtgaaaaatagaaaacttcagcctgatatccccaatgaacatagactcaaaagtccacaacaaaataccactagcaaattgaattcagcagcacatcaaaaagataattcactatgatcaagtaagctttattcctaggatgtatgtctggttcaacttatgcaaatcaataaatgtgattaattacataaatttaaaagcacacaccatataaccatctgaatagatgcacagaaaactttttataaaattcaacatctcatgataaaaaccctcaacagactagacattgaaggaatataccccaaaataatcagacatctatgacaaaccccacagctaacagcatactgaagaggcaaaagctgaaaccactctccttgagcactggaataaaacaagaatggctactctcactgctgctattcaacatagtgctggaggtcttagccaaagcaatcagaaaagatgaagaaataaaagtcatccaaataggaaaagatgtcaaattatctttcttcactgacaatatgattctatgcttagaaaacactaaagactccaccaaaagactgctagaactattaaatgatatcagcaagtttttaggaaacaaaatcaatgtgcaaaaatcaatatcacttctatacaccagtaatatctaggctgatcttcaaatcaagaacacaataccaattgcaatagccacaaggaaagttaaatacgtaggcatatgtctaatcaaggaggtgaaagatctctatgaggagaactactacaaaacacttctgaaagaaatcagaaatgaaacacaaaaaatgggaaaacatgccatagtcatggattggaagaatccctattgtcaaaatggccacactgctcaaagaaattcacagattcaatgctattcctatcaaactaccaatgtcattctttacagaattaaaaaaaaaaactattctacaattcacttctaaccaaagagacctcaaatagccaaagcaatcctaagtaaaaagaatgaagctggaggcatcacactacctgactttaaactatactataaggttacagtaaccaaaacagcatggtgctgggggaaaaaaaaaaagacatatagaccaatggaaaaaatagaaaactcagaaataaagccacgcatctactaccatcagatctttgacaaggtcaattaaaccaagcaatggagaaagaatatgctatgcaacaaatggtcctgggataactggctaaccatatgcagaggaatgaaacacccttacctttcactgtaaataaaaacaaacctgagatggtttattgtatactattcttattacctgggtataatatacccatgtaacaaaactgcacatttatccgtggtattgaacataaaagttgaagtcttaaaaaaagtcaccctatcaataaataatgaaagcaaaccacatttcaatggatgcattaaagttgttcataaaaattcaacattcttacatgataaaatatttttaagcagtagaaaaagaagaaaacatcctcaatttgattaagggcatctgtgaaatgcctacagatgatatcacgctcaatggttaaaggcccattgtttctagctaagatcagaaacatgcaaagatgtctacattcattacttctatttaacattttactcagcatattaaccagtgcaacaaagcaaggaaaactaaaattaatatagattgtaaaaatgattaaaactctcctgtgtagacattattatatttgtaaaaatcttgaggactctacaaaaaaaagtaaatgaataagtgaatttagcaaggttataggacactaggttgctgtaaaaagtattagattggtgcaaaaataattgcggtttttgccattaagggtaataattataattccatatactaacaattaataaataaaagatacaatttgaaaaccagttatatttaaaagagcatcaaaaattaaatattaggaataaatataacaatatttgtgcaaaagctgcatactctacaaagcaaaaggaaattggagaagacttaaagtaagatatatactttgttcatggactggtgacttaatcttaagaacaattctactgaaatagatttatagcttcagtgcaatcaattattgtttcttttttacttttttacgtttgcatctctattttttattttaaaaacattcataactaaattctaacacaattcattaaagaaattgataaactgtttttaaaaatatatttaaattttaagaagcaggaatatataaaataatttgaaacaaactgaaaacctgcctgattgaaagcttattgtaactctacagtattaaaggcagtttggaattggtgtgtagatacacatagaaattagtaaaacatgataaagagtccaaaaagaaaccaatgctcatggtcaaatgatgtttttaaaaattgccaaggcaattaaatggggacaaagtgagtcttttggtgctagaacaactgtatatcttcataaaaaaaattatttccagcccttgccttacatcatacaaaaaatcaactctaaatgagctaaagtttcaacttctagatgaaaaaaggagaaaaatatttgtgacaattaggcaaacaattttcaatctggacacaagtacaaactcttagtggaaaaaaaataaaattggacccaaatttctcctcattacacattttgctcttcaaaaaatatagtttaaaaagcataagacaagccacagtctggcaaaaatatttttgcaagacatacaggaaagggcttttcctcacagaaaatacatagaattctttaaataataagaaaacaaaccacagaaaaaagggcaaatgatttgaatacacatttatcaaatgaagtgtctgtgtcaataagcacaaggaaaggtgttaaacattgcaagttatcagaaaaaggcaaagtgaaatcaaaatgcgatatcactgcatacccactagaatggttgattttagaaattctgaccataccaagtgctggtgagaatgtgaagcaattgtaaatctcactattgctgatagaaatgcaaaatggtacatattaccatatgagtcatcaattccattcataggtatttacccaacaattccaccaaaaaaatctatgcacattttcttagcaatattattcataagagtctgaagtaaaagcaactcaaatggccatcaactgatgaatggataaacaaattgaggtaaatccatactataggatgctatttcacaatgaaaggaaaaaatattaatatgtacaacaacatggatgaactcaaaaattatcttaagtagaagacaaacacaatcaatcaatcaataagacaacatattgtatggttacatatgtatgatatgctaggaaaggcaaatacagtgtgatagaaagaacatcaggttttgtccgatgctgagattggtggtacaaaggttctagctataaagatgcatgcagagtaagccatcctgtatctttttgtgatgatgattaaacaattatatatagttaccaaattttatcaaactgtacacctaaaatgggtgaatttcactgtttataaatgctaccataaatacaacaaaatgccacaatgcagaatgactactcatatagaaagagctgtactagtgtgtggaaacaagactgtttggatctgggagattatctgtctgtattagttagctagggctgacataacaaaataccatagactgggtgacttaacagacatgtattttctcacagttctggaggatagacgtctaagatcaaagtctccacagattgggtttctcctgaggcctatctccttggtttgcacatgttggccttcaggctgcaacctcacatgaccttttatctgtgcatgcacatcctggtgtctcttcctcttataaggacaccagatgtattggattaaggccccacccttatgacctcatttaactttaattacctctttcagggccctatctccaaatagagccacatggggaattagagcttcaacatgtggactgagagaacacacaattcatccataacactgccagtgaatctttaagaatacatttgaaaaaaagtaagtctgtattttctagtgcttgcataactggtgcattgtaaaagcattctaaatgctaatctggtaattaagttccaactaacatatgaattctataactaaagaggtcatgtgaggagtcactacaaaaccaaatatttataaacaagataaaagttaaatcttagattctgtaatgaagaggaaccctaacaaccaaaatgtactggcattgcctcatcagaaaccattaaaaaaaacaaagataagcaagtcaaggttcatgatattttgaattcatagcatggtctaggatactatatttagtattgtcactgtgaaatttgacataggtttttatcaattcttgtaaatttttaatttatcaaccataaaattagtactaatgaaagaaaatgtttctttcatattttcatattttgtcttatgattcctgacttcatgaattagtattttttctaaaacatatactgtaagataatgctaaatctagaagaaactgttttcaagacagtactcttaaaattacttaggataaccagtaatatccatagaaaacaattgtaaagtaagaaaaaatttttcagatagcatacttattatgacattatagatgtttccatcatttaaaaatgataaatgagctgaatctcaaaagtgatagtaaagacaaattgaattcatgttatgatagaataatgaattagatgacatgaatacacactttttgtgttgtattactatatttcatttgtgtaattttagcactaaaatttgctgctcaaaatattcagaggaatatttgaataatagctataatactttgcatataccatttaaaatagcttctgatataaataaatggattgaataataatcaattggcaagttatttcaacaaaaagaaaaatcagttttatatgttttatagattaaacacagagatgattaaatatacttttccacccaattactttgtgttggtagagacatatttaacatatctcttaatttttgtatattaattcacataatccaaaatgtgaatgttaatttattcatataatacctctcatttacagcatcccttctttattgggtggattggtttatacaaattttattaaactttaagaagattttgaatttgactacttttggtttctaatgaactacactgatgctttcttgcacctatattcttcttctaactgaggctggaaagaaaagaaaggaagaaaggaaaatattaatactactactaacaatagggcctgcttgacttgctaacctacatctgtgctatccaatatggcagctactggctacatatggtgactgagcacttaaaatgtggcttgtccaaactgagaagttctgtaagtgtaaaatacacacccaaatttgaaaacttagtataaaaagaaagaatacaaagtagcctgttaataaatttttcatattgattgcatgttgtaatgaatattttagatatacttgaatacacctgaatagaagggatttttttgatatattgggttaagtaaaatatattattacatcaatttcatgtttttctttttagttttctttttaatttgcctactaaaaaatataaatttaagtatgcatcaagtattacatttttattggaaagcactgatctagaaaatacttatgtctacttcattttattcattcagataatcaacttctaaattatgtttttataagatgttaaagaaagccaatgaattacctgatagatgaatttgagagaggaactgggcaagacccttattccttatggcacaaaatacctaccagaaagtggcatgcattctcccctcttcttccaggctatatgtcttatcttagcaaacttacagatttgtctatcttggtccagtgctgcaatggcagagtagacaaatacactgaattctggggttcagtatgaggttcatttagctttctctaatttagaccttatgtatcataaatctgttacttgtttgtcaaaactcctgaaaaagaaggaaaatctatataatgtaaatacttttagtatttatagaaatgagccataattgtgtatttctgagttttgcacatatttgctcaaaatgtatttctgctacatacaaaaattcttatttattctgcattaattttattttgaacttttgatatatatatgtgtgtgtgtatatatatatattaatgtgtatatatatatatataagtgtgtatatatatatatatatatatataatagccatcctaacaggtgtgaggtgataaatatctcattgtggttttgatttgcatttcacagatgactagtattgttgagcatctttttcatatatctgttggccatttgtatgttgtgctcggtaaaatgtcttttcagtccctttgcccattttttaaaaattgggttatttagttttattgctattgagttataggagttccttatactctttggatattaactctttatcgaatacatggtttgcaaatattatctcatattttatagattgccttttcattttgttatttcttttgttgttcagagcttttgatttttatagaatcccatttgttggtttctgcttttcttgcttttgcttttggtaaaaattattgcaaaagccaatgtcaataagctcttttgctttgttttttcctagaagttttatctcttcagattttatgattaggtctttcacctattttgaattggtttttgtgtatggtgtaagataagggcccaatttctttctttttttttttttttttggcatgtgaatatccagatttttcagcagcattcattaaggagactatccttttcccattgagtagtcttgatatcctttttaaaactcagtgaacagtctatgcttgggttattgtagggctgcctatgttgttccattgatctagatgtttgattttatgccagtacaatactgttttgattactgtagttttgtaatatattttgaaattaggaatggtgatgccaccagctttctttttctagctcctttattgggctgtttgtggtcttttctggcttcatataaattttaggattttttttttctgtaaaaatgccattgggattatggtagcgattatattaaatatttaactctttgggtagtatagacattaaagcaatattaattcttccaatcaatgaacacaaatgtctttccatttatttgtgtcttcacaaatttaatttatcttgtcagttttttatagctttcaatgtacaagtctctcacctccttggttgagtttattcctgagttatttatttatttatttatttattgttagtattattataaatagattgtgttcttaattgctttttcagatagctaattggtattgtatagaaacaactgattttgtatattggtttttttattctgcaattttgttaaacttgtttattagctctatcagggattttttgtgcagttttaagggttttctgtgaataagaccatgtcatctgcaaagagatagcaagtattgtcaagaatttggagaaaagggaacccatgtacacagctggtgagaatattaacttgtgtagctactatagaaaacagtatggacgttcctcaaaaaactaaaaatggaactaccatatttgtaacaatcccacctctgtgcatatatccaaaggaaatgaaatcaagacctcgaagagatatgtgcactcctacatccattgcagcagtatttgctgtagccaaactatggaagcaacttaaatgtccattgatgggtgaatgaatagagaaaatataacatatacctagaataaaatattaagccacaaagcagaaggaaatcctgtcatttgaaatatgaataaacctggtggagattatgctaagtgaaataagccagacacagaaggacgaatagtacatgataaatttaagataatgtgacatatacctacaataaaacatgaagccacaaaaaagaaggaaatcctgccatttgcgatatggatgaacttggtggagattatactaaatgaaataagccagacacagaaggatgaatactacatgatacatttatatgagaaatctaaaatagtcaaactcatagctgctgagagaagaatggtggttgccattgactgggaagaagaggaaatgggaaggtattagttaaacgatacaaagttttatttatatagtatgagtaagttctagagatttatggtacagtatagtgcctatagttaacaatactgtattgtatgcttaaaattttgctaagggggagattttatgttgtgttatcacaataaacaagctgaaataaatacagtgggaggaaaccatatggaaacatatagatatgtttatggcatagattgtggtagtggtttcatgagcgtatccttatctccaaatgtaaatatgtatagctttttgcatgccaatcaaacctcaataaagtggtttaacaaaagaagcacgttagctggttttccagtttttttttttgttttgttttttttgttttgttttgttttgttttgagagggagtctcgctctgccacccaggctggagtgcagtggtgtgatttcagctcactgcaacctccacctcccaggttcaagtgattctcctgccttagcctcccgagtagctgggattacaggcatgggccaccatgcccagctagtttttgtatttttagtagagacggaatttcactatgttggccaggctggtctcgaattcctgacctccagcaatctgcctgccttggccttccaaagtgctgagattacaggcttgagccaccacacccagccatttttataattttcaatcacttattagttgaatagctttagcattcagggaatacattgaatttttaattatcttcattcccatatattgtgattgtggtggttaatactgtgggtcaactttatttgattgaaggatgcaaagtattgatcttgagcctgtctgtgagggtgttgccaaaggagattaacatttgagtcagtgggttgggaaaggcatacccacccttaatctgggtggacacaatctaatcagccgccagctcagctaggataaaagcaggcagaagaatgtgaaaagactagactggcctagcttcccagcctacatctttcttccgtgctggatgcttcctgcccttgaacaacggactccaagttcctcagctttgggacttggactggcttctttgctcctcagcttgcagatggcctattgtgggatcttgtgatcatgtgagtttaattctccttaataaactccttaataaaaaaaaaaaaaaaatatatatatatatatatatatatatatatatatcccattacttctgtccctctagagaaccctgactaatacagtgatattcagttaggattttcagaaagtgcagtgttttttatgatgtatgataaaccaggatgaaagcaatgacttagctgttgaaaaataagactaacacaaccctattttttgtttaataaattacatgtattttttccactagtattattctacctatttttcacaccctatttgatacagatagaaagcgtattattcattgagcctcagtgtctgtcatctctaattatataaaatcaggtggtatgtttgcagccaactctacaagcattttattaatccccacattcttataatttcaactcaaattatagatgagttcccctaaaaatgaatgtctggagtttaaatagtgaaataaaaacatgtgagcagtcaacaatcaagcaatgggctttttcagtgtattaaataaatatctaactctccttaacctgaaggggatttttttgacctactgtcattttttataatgttttatacttctgttatattatagtagtactgtttatgttcctgtagttaaatcagggtcagagtttctattaaagtgatctcatttgatggaggtaggcaaatgacagtcttctaatatacctatgacatccgttggcttaaaaaaatataaggttaatatttaaaaatgctagaatttgataaattggttgattattctcttgatgcttgaaatatttcatttagcaactatatttagagatttgtaatatagccatgaaatttgttctgaattacatcttaaacaccatctactacatataaatatatgtatctttttctttttttctgagaaatgtccttaaatgttttatgctattaactcagctcaattaattactttaataacctccaaaccactagaatattaaaaatacacatttctgaaagaatgcaatacattttacattgtaggtaactaaaacggaataaacatggactaatgagatatatttaagcaaccataaagagtcagatatctcaaagcttatgctgtaacatcattggtcttcctatgcccacagtgtctccttccttacagaaatactgagaacaagtgattgtactgaattgtgtagacatagatcagactgcggtgatccatcctacaaaacttaaattaaattaagaaaataattatttactgccctaagtatatagcactgtattggggatgaatgggaatgccaacatgaaaacaatacaaactctaacaacaaaaagtccaccatctaatgtgtggtgaaggggctgcatggaatgatagtgatgacataaatgcagaaataaaaaataaagactaattgtacttaaaaaatgaggaacatgggatgctgtagattttctgcagagatagttcataagtgtttaggagaatttacataaattcaaatattttatgtatctgtttccctgttccttggaaccttgattagatttagctcaaatatcttacaaaatctaccttgtctcttaatttatttgtcaaatattctattacttattttaagagccacagatatctatgtctgtgtatccacatctaaatctaagtgtagaattgctatattttggataatttatttatatattcattccagttcattaattttctcttcaacagtgtctaatctactataaatctattcattgagtttttaaattgcaaatattatagttgtcatctacagaagttctatttgtcacttggtaatgaatttttcccattttcccattttaaatatctaacataatttctttaaaatgtcaaatactagataatttgcaaactgtgtctaatagttaaatatctgaaacttcacaaatcaatgttagctctatgtgatatttcttctgctctctctatgatgcctttttccttaactgttttgtgggttcttagctgtaacctgctcatttttcttgacacattatctataagaattcttagaagactggaataaaggggaatcttccagagtgatatatatttgcctcttccagtaacctgggttgtattcacagactgagactcctttaagcttattcttaaattacccaagtagtaagaatgtggctgagtttctgcatgaatcttagcttgtaattacaaattatcagggcatttttttttcttagtttcaaccccaaagtaaaatatataagaaaaaatcatgtaacaaatatcagaactcctaattacatttatttttcttttctaatttctattctgatattatttatatgtcttagatctgaaactttctgtatattggcatgttactaagaaaatcaaagtttattacatataagaattaaatgggggggtggggtggagccaagatggccaaataagaacagctccagtctacagctcccagcatgagcgaggcagaagatgggtgatttctgcatttccaactgaggtactgggctcatcttactggggagtgtcaggaacggggtgcaggactgagccaaagcagggcaaggcatcacctcacctgggaagcacaaggggtcagggaattgcctttcctagtcaaagaaaggggtgacagatggcacctggaaaatcgggtcactcccacccattactgcgcttttccaacggtcttagcaaacggcacaccaggagattatatcccgtgcctggctcagagggtcctatgcccacggagcctcgctcatcgctagcacagcagtctgagatcaaactgcaaggtggcagcaaggctgtgggaggggcgcctgccattgctgaggcttgagtaagtaaacaaagctgctgggaagctctaactgggtggagcccactgcagctcaaggaggcctgccagcctctgtagactccacctctgggggtagggaatagccaaacaaaaggcagcagaatcctctgcagacttaaatgtccctgtctgacagctttgaagagagtagtggttctcccagcacacagctggagaactgagaatggacagactgcctcttgaagtgggtccctgacccccaagtagcctaactgggaggcagccccagtaggggcagactgacacctcacatggccgggtaatcctctgagacaaaaattccagaggaacgatcaggcagcaacatttgctgctctccaatatccgctgttctgcagcctctgctgctgatacccaggcaaacagggtctggagtggacctccagcaaactccaacagacctgcagctaagggtcctgactattagaaggaaaactaacaaatagaaaggacatccacaccaaaaccccatctgcacatcaccatcttcaaagaccaaaggtagataaaaccacaaagatgggggaaaaacagaacagaaaaactggaaactctaaaaatcagagtgcctctcctcctccaaaggaacgcagctcctcaccagcaatggaacaaagctggatggagaatgactttgacgagttgagagaagaaggcttcagacgatcaaactactctgagctaaaggaggaagttcaaacccatggcaaagaagttaaaaaccttgaaaagaaattagaggaatagctaactagaagaaccaatgcagagaagtccttaaaggacctgatggagctgaaaaccaaggcacgagaactacgagatgaatgcacaagcctcagtagacgattcgatcaactggaagaaagggtatcagtgacggaagctcaaatgaatgaaatgaagtgagaagagaagtttagaggataaagaataaaaataaacgaacaaagcctccaagaaatatggggctatccaagaaaagaccaaatctacgtcgattggtgtacctgaaagtgatggggagaatggaaccaagttggaaaacactctgcaggatattatccaggagaacttccccaccaatctagcaaggcaggccaacattcaaattcaggaaatacagagaccgccacaaagatactccttgaggagagcaactccaagacacataattgtcagattcaccaaagttgaaatgaaggaaaaaatataaagggcagccagggagaaaggtcaggttacccacaaagggaagcccatcagactaacagctgatctctcggcagaaactctacaagccagaagagagtaggggccaatattcaacattcttaaagaaaataattttcaacccagaatttcatatccagccaaactaagcttcataagtgaaggagaaataaaatactttactgacaagcaaatgctgagagattttgtcaccaccaggcctgccctaaaagagctcctgaaggaagcactaaacatggaaaggaacaaccagtaccagccactgcaaaacaagccaaattgtaaagaccgtcaaggctaggaagaaactgcatcaactaacgagcaaaatagccagctaacatcataatgacaggatcaaattcacacataacaatattaaccttaaatgtaaatgggctaagtgctccaattaaaagacacagactggcaaattggataaagagtcaagccccatcagtgtgctgtattcaggaaacccatctaacatgcagagacacacataggctcaaaataaagggatggaggaagatctaccaagcaaatggaaaacaaaaaaaggcaggggttgcaatcctagtctctgataaaacagactgtaaaccaacaaagatcaaaagagacaaagaaggccattacataatggtaaagggatccattcaacaagaagagctaagtatcctaaatatatatgcacccaacacaggagcacccagattcataaagcaagtccttagagacctacaaagagacttagactcccacacaataataatgggagactttaacaccccactgtcaacattagacagatcaatgagacagaaagttaacaaggatatccaggaattgaactcagctctgcaccaagtggacctaatagacatctacagaactctccaccccaaatcaacagaatatacattcttctcagcagcacaccgcacttattccaaaattgaccacatagttggaagtaaagcactcctcagtaaatgtaaaagaacagaaattacaacaaactgtctctcagaccacagtgcaatcaaactagaactcaggattaagagttccatgtagttgatcaaaaccgctcaactacatggaaactgaagaacctgctcctgaatgactactgagtacataacgaaatgaaggcaaaaataaagatgttctttgaaaccaacgagaacaaagacacaacataccagaatctctgggacacattcaaagcactgtgtagagggaaatttatagcactaaatgcccacaagagaaagcaggaaaggtctaaacttgacactctaacatcacaattaaaagaactagagaagcaagagcaaacacattcaaaagctagcagaaggcaagaaataactaagatcagagcagaactgaaggaactagagacacaaaaaacccttcaaaaaatcaatgaatccaggagctggttttttgaaaagatcaacaaaattgatagaccactagcaagactaataaagaagaaaagagagaaaaatcaaatagacgcaataaaaaatgataaaggggatatcaccaccgatcccacagaaatgcaaactaccatcagagaatactataaacacctctacgtaaataaactagaaaatctagaagaaatggataaattcctcgacacacacaccctcccaagactaaaccagaaagaagttgaatctctgaatagaccaataacaggctctgaaactgaggcaataattaatagcttaccaatcaaaaaaagtccaggaccagatggattcacagccgaattctaccagaggtacaaggaggagctggcaccattccttctgaaactcttccaatcaatagaaaaagagggaatcctccctaactcattttatgaggccagcatcatcctgataccaaagcctggcagagacacaacaaaaaaagagaattttagaccaatatccctgatgaacatcgatccaaaaatcttcaataaaatactggcaaactgaatccaacagcacatcaaaaagcttatccaccatgatcaagtggacttcatccctgggatgcaaggctggttcaacatacacgaatcaataaacgtaatccagcatataaacagaaccaatgacaaaaaccacatgattatctcaatagatgcagaaaaggcctttgacaaaattcaacaacgcttcatgctaaaaactctcaataaattagctattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctacaaaaccccactgtcccagcccaaaatctccttaagctgataggcaacttcagcaaagtctcaggatacaaaatcaatgtgcaaaaatcacaagtattcttatacaccaataacagacaaacagagagccaaatcatgagtgaactcccattcacaattgcttcaaagagaataaaatacttacgaatccaacttacaagggatgtgaaggacctcttcaaggagaactacaaaccactgctcaatgaaataaaagaggatacaaacaaatggaagaactttccatgctcatgggtaggaagaatcaatgtcatgaaaatggccatactgcccaagatattttacagattcaatgccatccccatcaagctaccaatgacttccttcacagaattggaaaaaactactttaaagttcatatggaaccaaaaaagagcccacattgccaagtcaattctaagccaaaagaacaaagctggaggcatcaccctacccgacttcaaactatactacaaggctacagtaaccaaaacagcatggtactggtaccaaaacagagatatagaccaatggaacagaacagagccctcagaaataatgccacatatctacaactatctgatcaatgacaaacctgacaaaaacaagcaatggggaaaggattccctgtttaataaacggtgctgggaaaactggctagccatgtgtaggaagctgaaactggatcccttccttacaccttatacaaaaattaattcaagatggattaaagacttaaatgttagatctgaaaccataaaaaccctagaagaaaacctaggcaataccattcaggacataggcatgggcaaggacttcatgtccaaaacaccaaaagcaatggcaacaaaagccaaaattgacaaatgggatctaattaaagtaaagagcttctgcacagcaaaagaaactaccatcagagtgaacaggcaacctacagaatgggagaaaatttttgcaatatactcacctgacaaagggctaatatccagaatctacaatgaacccaaagaaatttacaagaaaaaaacaaacaaccccatcaaaaagtgggcaaaggatatgaacagacacttctcaagagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacactttcacactgttggtgggactgtaaactagttcaaccattgtggaagtcagtgtggcgaatcctcagggatctagaactagaaataccatttgacccagccatcccattactgggtatataccgaaaggattataaatcatgctgctataaagacacatgcacacgtatgtttattgcggcaatattcacaatagcaaagacttggaaacaagccaaatgtccaacaatgatagactggattaagaaaatgtggcacatatacaccatggaatactatgcagccataaaaaaattatgagttcatgtcctttgtagggacatggatgaaactggaaaccatcattctcagcaaactattgcaaggacaaaaaaccaaacaccgcatgttctcactcataggtgggaactgaacaatgagaacacgtggacacaagaaggggaacatcacactccagggcctgttgtggggtagggggagaggggagggatagcattagcagatatacctaatgttaaatgatgagttaatgggtgcagcacaccaacatggcacatgtatacatatgtaactaacctgcacgttgtgcacatgtaccctaaaacttaaagtataataataataaaaaaagaattaaatagagaagtgcaggtggtgaatttatgtattttgattgtgatatttattgacatatcctctcaaaaatatttattataaggaatgagcttataagattatggaggctgagactcccaaaatctattggagacgcgggagagatgattgtataattccagtctaaaatccaaaagttggcagaggctggagactaggacagccaacattttggtttgagtctaaagatgagtaaagactgatgtcccagctcatgcagtcaggcaggaaaagtttcttcttatttgtgggagggggcaggctttttgttgtattcaagccttcaactgattggaggagggccacccacactggggagagcaatccgttttactcagtgtactgactgattcaaatgttgatttcatccaaaaatcctcacacatacagaataatgtttgaccaaatatctgagcagcccatggttcagtcaaattgacacataaaattaaccatcatgcatcctttgtgacttacagctcataatttgtgagtgagagctcacaatttgtatatatattcacatacatgcatatatatctatatatttaaatatttatatatttatatatttatatatttatatataaatatttatatatttatatatttacacatgtatatatagttacattacgtagacacattaagctttccctctatagtaaattctgaccattcaaggcatatgaccatatctttattctgaaaaaactgaatcacaagagccagccaattactagatgtgttgaatgatttcttaatatagttttgaaaaaaaaatacagttcagtgatatagtccatggcctcaagatatttgtatgttgcagaaagtaagctttacgctagcatcccagttggacaatcatattaaatcatagaacagcaattttattatcaagcagttatgtttgtctcatagaaatttggccatattctgcatttttctctttaaaaattactcactatgtgatatgagtgatagacaaggagttttgttacccagatcctcttcagaaatggactgttgcctctactgctgctgctgaccacatgcctggtctagctgtcagctcctttaggtgcctcctcagtgagcgatctggctaaggtcacgtcctttccatagtagcccacatccagtgactgacctctggcgggtactaaagtgcagtcattctgactcctggggaacaagcctgttaagccatacgcactccaaaactccctgcacactcggccaaggctttgttgggcttgcctcaatgtttgacttctctctttgcctactcttactgctgacccctcccttccccaggtgttggtccctgatcaatatccttcatatcaaactgtgctcaatctctgcctttaaagattacaatctataaccatatagaaatcagaagggaaaaatgtttataaagtggataaatacatggtttatttttgatattggttttctgtgtctaatgttacagggatgtgattatttttaaaagtctacacatgctttcagatacttattttttcaaagctacacaatggggtataacttctatcagcttctccagccccaagtacaaatttgaaagtgattatttcagactctgttgctattgctgtaacctgttctccagtgaattagaataatgggagttgggtacatcctctgtggcagtaaagttggctctgctagtacacagggtattatcttctttgtaatgcttgcaagaagaagatcaaaagtagctccgatcttcatcttaaaccatagattatgagtcaaccagggttggcccaagataaatatctgatgtgtggttagtcatatggtgagtcagtgttctaatcagtggtagagttaatcagtcggggttactcaccatgcctaactttcatgcactccttccagagggaaaatacatgcattcttttggcatatttggttttgcatgtacatcattatgtttctcctcccactaccacaagaaaaagatattaattgtagtaaaaaataaagttataaacttctggcaagctaaaactgagaacaggttatcaaagggatgtgtgcctgttcacttttagaagtgtattaggtctttcatagctgagaaaggacagaaatagggagataaagtcgttcacctcagatcacaagctaaattggtggtaaaggctggactagaatctagatgtaatgggtaactttcacccacattatgtcagtcccatttagacttccttggttgactagtattgatgtaaccaaaaagacatctactcaaaattcaatattctaatggtagttattgagaacttactatctgtctggtcctgtttaaagagtaggacatatagcagtgaatcaggcactttttttttttttttatcaagaactttctggcaaagatatatattttgttcctgcgagaggccatttgttgcatatcaacagccagataagccttaaacaaacaggtaataaaaaggacagtcttggctactctttttgtgatttaatctagaacaacatttctctcttggtatttacttcatcaggctgatgtaaggacttgctactgcattcattgtcagcaatggtcacagcaggcctgaatacttttttgttgttgttaactgtatttaaaggtgttgtaccattcacttgcaaagaaactgtttttatcaaatgagattttgctttggaagaatggcaatgcaattcagccatgtttttttctaaattaatgtaacatttgcataataatattttaaagtaattgcttgggccactttctttttttattttttgcagaagaactagcagatcgctgttagaaaaacatttgttaaatttccaaatcataatgtattttagtggtgagaggagctcagtaaaggaaattaaaggcatcgtggactccacagagcatggaacacaatgagctctcaaaaagtcatttgttggcagatattgttattctcattttacagcattctgtgtatctcctttatatcacttattacaattagaattaatcctattcaattacttccggagaagcaccatggttaagtggctaagaggatgaactcagaagccagtttagcagggctcattcctgcatttctgctcccatcacctactagcaatatatagctttggatatgttactaaacttctatgtgtcaattccttgaatgtaaataagtataatgtattacctatagcgttattataagatttaaattaggtaatatttgtgaagtacttggaacagtgctcagtgtatataataagtattatgcaactatttataaaatgaataaaaaattaaaattttcctttcttactagtcatactgatagaaagtagaacatatcagtcttagttactgattctcatcttctcatcttctgtagttatgtttccaagttagttgttcaataaattattattgaatgaatgaatgcattaaagttttaaggcccataaatggtgaaaagatccatcaagatcatttgtcatgattctatagattcttcaatagaatagtagggctagtgctactactgattctgtgtaccttccttgttgttagacaaatattatttcatttgacattaaaacagccttaaaatgtaaatatcaaatctccacctcacaggtaaggcagctgaagtttgaagaagttaaataacttatcaaaagtttggacagaacctacaatcaaaaccacgtccttttgatgccgaagttcattttcttccatgctacacagtcttacatcaagacagcgtgttggctgatatcagacagagaagactaaaatccacaaggggaaatttatggaggtatgagaaaaatattacagaatgtattgtatatggatttgtctttcaaaagatgtgtctcctagttttccttccaagcaaatgtcaagcccaatgatattagcaatattccacattacttactaacatttttttactaatgtcaatttattacaaaggtaaagccaaagtatgaggtcattgcagttcagttcataaaatacaattaagcaagctattcgtaggtttgaagtacaggattaacaaaaaaatgcatatgaaatattttaccaatgataaattaacaagaaggccagtttaatttgatatagctcaagtgcaataaaacaaagtcaaaaatcgttacatccttagtcataaaccatagtatgtaaactataatgcataagccatatatgctcagatcagatgaatttggaaagtgagggaaaataagcagcctagacaactgttgaaaaccatgcaaagctaccaatggaattctatgatcaagctaggaattcgctgggcctggagaagttaagtagcaatgctgcaggagggatggaatagactggcacaagcacatcttatctgttcttcctgaattgagctttgtatactatcagattccactatactagaatgtcttatatttggactatgtagagtacattgagctgagggcaataacaagtatgaaacacagcaggattttgaaaaagattaatatgtcagcttaaggtagcaacctgatccacttattacctccattaaatagctataattgattattcatcatttcaaaacttatctccaaaaaataatagcatgcttaccctatcacacctggactttgagtgcattctactctatttaaaaacattgttttgaattctttttatgtcacaatcacttcacaaaatctaaaagaagtcagagatactaccaggggcaaaacacacttgccccctgcttctcatttgtcctatttagactggatccatatttttgtcttgtttagtagtaaaaataaaagtaaaagggggtgcttagaaatcatagattgtattccaaaacaaacaagcaaaaacaaacaaacataaagccagaccctaactctcaatttcatcaaaaagtagcagaactctctttcatggcaagaacagtgcaagcttgtcctttggaaattcttctgaatcaacaaaagtacgtgtgactgaatcgtgtggccaagatggaatgctgtggcaatacaaattacagagaagatgcacggcttttcatctgctgccctcacccgcagatgtctgtgggatgaaagtagtagtcactgccagccaccccagtcctgctgttctgacaccctgtaatcgtttgctgtattcattacctccctcatcatccactaagcctcctcttaggggtactttatggtacacatttcactttaaaaaattaagtcacatcacgattaattttgcctcgaggatttcacaacatcctttgagctcacagtaaccctgaggatattgtgcaattggagttgggactctcttgcctaagttataactttgtgaaagaaagtgggtgaaagtgggggagttgttcttgcttaagacaattgagtggatattaagcaaatacacaggggtaggtttaaaagtgactggcaaatctggtaaaactttatacatctcgagttatcatttttaatgttctcaccttcttacagtatttttacaggcagtatgcttttgcttgtcctaagtaaaatagcacgctttttttctgtttttctctggggcatgtcttctgtatgctaatctgactcatcattgttaatttaaaatattataaataagcaaatacatgactcaataaatgtgatgagtaaggagaaactggtgtttgcctagccagctcagacctacattttaattaaaaagcatgtctcatacaccatcaatatgttttcaagtgacctgtcatgaccagttctaatcacaagcatgccattcactctttcataataaattggcagattatgctaataaaagaaagggaagctatcaattttacgggtgccagacaagctatgccattgattttataatttatgacatgcacttgcaaaataaaggtggctaaggaaagagtttcataaacaggataaaatgctacaggagaataatcaattagattagtcgacaaataagtggataaaaacgttatgaaaatgttatgctttcctaatggtcaaacattcagggattcagtgtcatattatatctgtaaaatcccacaacaaaaaggtctgtgttaatggcagctatatgtcaatttttaagattggctaattggtatttttaaaagtatttggctggaaaatcacaaagattcagttgattgggactcaaaaattctttgttcaagagaaaaagaagtcataatacaggttgctattgattacaccaataaaatgttaaaaattactatatggcacagtgttttgtgactttacggcctttgtctatggaaaaaccatttaggttagttcacatttttatagaaaatgagagtttgcaatggaaataggaacttgggagctcacagaaaaatcaggggtagacttgggatcagataagacattctacctaaataagcatggttaaatacacattatgtcttacatttcaagccaaaactagttgtttgcttttgattaaaagattagattttgttctgaagtccagtttcaatattttagttttgtcattaaattgtttctaaattgaaaaacttttgataaaactagaaaaaataagtatacttatgctatgttatttattaatatgaacaaaaatcaatttgtctaagctttgctcatctaaaaatatatatgtatagcagacaaagcaatgcaaattaaacattttaaatcttatacttgcattcaacaatctttatcttgtgtagcgttaacgcacatacacatacatatgtatatgcacacacacacatattcctaatacctaaacacaagtcaatgttcatccaaagagtaacagatcatcgattacttctagaaatttcctgatacctttattatactgatgtttatcatattggataaatgcttgtcttatggaactcacagcactttgcatccaatcatcatgtatttggccaccgtttcaacagggtgaaaatttaaatgtattattgattacaaatggtcttatttaggtaatttcaagaatattaaatgttatgttgccccaaattgttatatctcagttaatggtgaagtgatatgactttgaatgctatgtaatggctccataatattttttttgtaaatataatctctagatcaattattaaaatcagctaataattggttgttttcaggtaaaattgatagtttttaaaacattcaaaataagtccatttgaaagtcattcaattttgttaagaaatcttttgctgaatatttgtgaaatatggatattaaataacttttgcaaccatagtatccactcatgttgcaggttattctttcttgttgtggttttaatctccccacaaaactaaaaaaaaaaaaaaaaaaaaaaaaaattagctacagatttgaagtgatatttattttgcatatgcaaactatgggactcagctgatggataaggatgtgtatgcagtgttgttctatccatcatcaaattcacttctcaactttttttaataagcaaaataatagttttaaataaaatacaagttgatgatacactgtctggaacaattaccaactagatttgtgtccccagtagtagcccctcattggttccactggtttcctgtaattattctggatcaaaggacttttcatgaaagaatcattattaagtgttttacaaaagcatttttcctgtttagggttagttcctcaaaattcatcttggccgcacaactctaacgctgtcttgtgtttgaacactttaaacaaccccctccagattcgtctagagcctgaaattaggtttatttttctctcttttttttcgacctttaaaaaaataagtaatattactaactggtctgaaatatgatcctttaaaaactatgtggcattaacagaattctgcagtgcaaaagtacaaagaagactaaaagaataagggcaaaggagagcaatcatttgcttcagccttgcattatgttgaactttggtggaatggatccaagatggaattaaatccaaatgtttcctggtttcttccatcttaatagcctcatatttccttccatttcatctcatccacagtgttcacatttaaaattgtcatctttgaaaacattgaacatatttatggcttgtctgcttcctgatatatattctgatctatcatattgttataattgctagacaacaaaagagatttcagatttatatataatatggaaatttaaattagggaggaaatgtgactacatcatgccaacttcaaaataaatcctccctcttactctaaaagatatgacaatatttgtaaagctattttcctgacctttataatatgtttagccattaaattgcagaaacctatgaagtagtccaagttcatggtataaaaacaatgaaaacgcaggataaaaacacaaaaatagagcagaaaaaatatggctataatgataaaaaattaacatgtaattcctgtttccagcttaatttatactaccttatttaaatcttccacaatatgatgagattattattcagtgcctacagggttgagatgttaaaagccttgtcccatgtcacactgctactaggtaatagaatcagaattaaatttaaacaattggattcccctagacacatttttttctctcttctttgagtaatctctgcacatcttacactcagggctgttgcaaaataagaaactgaagacaggaagtagaagggaaagaagaagaggaggaagttggtgtgatttaacatttataccatctctgtgcagcttctcactatcagtatcaaatcagactggcattttctgattcagtcattgttttaatcagggttctctagagggacagaactaataggatatatatctatatctatcttgatagatagatagagagaaaaagagagagagaggagtttattaaggagcattaactcacgcgatcacaagtcccacaatagaccatctgcaagctgaggagcaaggaagccagtccaagtctcaaagctgaagaacttggagtctgatgtttgaggtcaggaagcatccagctcaggagaaagatgtaggcttggaggctaagccagtctagtcttttccactttcttctgcctgcttttttttctggccacactggcaactgattagattgtgcccacccagattgagggtgggcctgcctttcccagcctactgactcaaatgttaatctctttggcaacaccctcacagacatacccaggatcaatactttgcatccttcaatccaatcacattgacactcagtattaatcatcacagtcatcattattttggttacctagttctcagcaggttccttttctatataatttcaacttttattttagattcagggagtgcatatgcaggtgtgtaacatgggtgtattgtgtgatactgaggtttgggatatgactgatccggtcatccaggtagtgtgcacagtactcaataattagtttctcaatccttaccactgtcctcccttcccactagtgcctattgttggcatctttatgtccatgagtacccaatgtttggcttttacttataagtgagaacatgcggtatttggttttctgatcctatgttaattcgcttaggataatggcctccagcggcattcatattgtctcaacaggtttctgtacaaaaaaaagaagaggaagagcaaggaggaaaaggaggagaacagaaaagagaggaaggaggagtagaaggagagaaatgaccattctacctaaataaacaactctatctaaatcatgcatcagcaggaggatatttatggcctcagcacatttcttttactgcatgctagagacacttggcttttccctcgcaaattcaaatgtcagtggaatggctaactcatgtgaacaggcttttttcccagggaggagccagccacacaataaaatttaaatggaaaaaaagcttcctgatgtttctctgcggtactttgaatcatgccaactgctagaccagattaattacacaattgtaagagcaggaaataaactaattgaggatattatcctcctctttcttttcgagaaatactgttttgtcttgatatgagtcctctctttcaccttgacttgttttgttaactcaaccacttctcaaacttttcaagaggggactgtgtatgacttgaacctaagtttttcccaaatgagaagcagcaattactttagtgcttgcttcctcagtaatggaattcttgattgcttttgaaagcattctagcatataaaagggggggtctttctgccaaaagtaaaattctaattcaagacaggtaaaatgggtagggcctggttcaacagattaaatccatattttcatactttaaatcaatccctccttatctgtcagccattgttcaggggaacacagactttagaagtgcaaatttttccagcctaactctattataataatgtatgtattcaaatattctatgaaactatattccagtaaacatgtgggaaaaaatagagactttattttacaggaaattatcacatttaatcttatttttgaagcttactcacagaagataatatatttagcaatttgctaaatgataaaaaaaaatggaaaattatacaaatgttggttgtaacatagttttccttgaggaataaaatatatgttagtctagtagtctattatcagatttggagagagattttcatctctatcatgccaattcctttattgacataatgtttccttggctactctgtttaatctatagagttcctctcaatactactgcttttatcattctcaggaatacacaaacttgaatcttaatctgaaccttgcaataaaattatacttataacagacattgagaaaactgtatgattcaaagacaattaaataggtaaaaccgtgtgtttgcatcccaaattcccttcatggaagatctccaactatattcaagcctttgctagtgctagaagaaagcagcccatgttattcttttgtggcagagcagtgtctgtttactcttcctacatctccttcccatttcatggattgtgacaaagcttttcctcagttccaaactacttcacttcaaaggtctggtggaaatctccccacttcctgaaatacctaggaaacccctctgtgtctgagtagccctttcattatgggaaaggcagggggtgaatgacgctcagattagatctaaaagagacttgctatgtcccgcaggcattgttggagagagagggtgttacagatgttggactggggccctgggtcaaattcatcagccctcatatttttcttttctcttcttgagaaaaatattccagatggtatatattaatgtgtatttgtaatacttttggcacaggatagtggcaagataagaaaaagtgaagtaaacagagatgaaaaagcaagttaccagtgaaacaaaactggaagcatttaagtttctaagtaagagacttcagagaattagatataaaaaaggccaattgatttatctgtcattttgtctcccagttggaggaaaaaaagagagaaatttcataagatccactcttcccttttagtggagttgtttgaaaacaaatattttccaaagttaataaatttaatgtggtaaactttacaattacatatttctcttgttattggtcttaactattttctgattcccttcactcatcactttatttccgaaacttgcctgataaaacttgctcaagcatgttgtatatgggaattgccaggcaattgctaaacaactgcatatctcttaaacttgaacatagagataatccattttcggtcatgcacttttaaggtagttagccttggccttacttctatggtaacttatccttgattggaagccatagcagtagaaatcaaattcagtgatcagaatcgctttacaagaattattcaatacattgaatgtaaacgtgattcatatctgttcccagcctcctgcaaaactgaagaatttgctgtgttgtttttctattttcctctctctggacctttatttaagcaattcctcttgttcgaagtatcatagtccagcttattgagaaacaattccttaagggtgtttttgtgttcctacacattttttgagcagagacacggactgcttctgttccaggctatctttccaaagatgtttacagagaaaacagcctagaaagatagaactactgttttcctctggagcaaagctcgggttcttttgtcacataacccactacttgtgtaggcattacatggctgtattgtatcttattactgtatgtgaatgagggcttaaggaactcacagaagaaaattctgacactcttgctactgctatttctgtgactgatacactttcctttgtctctgacacaggagtttgtgttttctgccagcatctatgaatctctggaagactaaattattagcttggaaatggagtaaaatctcagaccctttatagttcttgatacagcttcaattgtttttttcttaaaagaagttttatttaatccttcctggtgtaaatattaaatataataattcagtgcttccaaaaccttctctgaaaataaagctcctctagcatatggctaaataaacagactattagataaatctcctagaaaatcccatttatatttctaaatatgaacagggaaatctgtttttttttattttattttattttattttattttattttattttattttattttattttatgacaggatcttgctctgtcacccaggatgaatgtacagtggtgtgatcacagctcactgcagcattgaactctcaggctcaagcaatcctcctacctcagcctcccgagtagctgggaccacaagtgtgcacaaccacacctggctaatttttttatttcttacagagacagggcttttgttatgttactcaggctggtcttgactccaagactcaagcaatcctcccacctcagccttccaaagtgctgggattacaggtgtgagccaccacacccaacctctgtttcttttttaacagaattccaaataattattatctctgggtatatgatgtatctaaaacatgtatcgccactctgggtaaacagtaagcactcaataaatgtctgttattattacagtcttcaaaaagtatttaatacttattaacacttttactctcctcacatctgaagagtttaaaaaaaagatatcaaaaccccatttttattaccgatgaaggtcagattagagaacataactttggtcaattgtcaaggcagacctactaattacatcctaaaattaggtagattcaccatttggtctcaggcagaactgaactagggcagagcttccaatatagaatattttcatttgggtgggattaaaacagcatagaagactttggaagcttatcatgagttttgacttagaaaatgaagaataggaaaacatagatatacatgagaattatgaagtgtttaaagtaagaaatgcaataatctgatgacgtagccaattttgtctttcactttggtaagtattattattattttttctcttgagatggaattttgctcttgtcacccaggttggagtgcaatagcgaggtctccactcactgcaacctctgcctcccaggttcaagtgattctcctgcctcagcctcccaagtagctgggattataggctcccaccaccacgcctggctaatttttatatttttagtagagaccatgttggccaggctggtctcaaactcctgacctcaggtgatccgcctgccttggcctcccaaagttctgggactataggcatgagccaccgcgcctggatggttttggggtttctataaaaactttatttaggctcagggtacatgtgcagctttgctatacaggtaaactcatgtcacaggagtttgttgtgcagatgattttgtcacccaggtactaagcctagtacccaacgttagtttttttaattctcttccatctcccaccctaggtttttaaatgacctcttcaaattatcttatgactcaaagaagttaaggaaattgctaaatatcacatggttaacaaatgtcacagctaaaattccaactggcagctctaaaaccctattacattatacaatcttgctaaggagtgatgaatggtgtattggaggtgagaaagaacagagcatatagagaggtttggtcaatagtgtaaaaataaaacaatttgattctagagcaaatttgattgtcaccctttttcattttgatttattgaaacctcagcaaatcttgaccctatgttatacactggggtaacaatacaataagacctacatcttgtattgaaaggtagatgataatttagtgagggatacaagccaatataagaccacagtaaacttggtcattgtcatctcagagctggacattaagtaaacagtggaaagatattcagacatagaacaggagaagcgagaatcagaagcttttccaaaaatagttaccagggattagcaagttactccgtacacaagatcctgtgctaatacagaattaatagtctttaccttttcataatgatgcattgtaattttataaaatcagaaaataagataatattaaattcctataaatagtcggagacatctgctaatccaatgataactctcattagtatttgaacatttgatatgggttttaccaaactatttttctatgcagtaatgcacttcagagaagaatcataagaggtaaatagcataagcgtacctttgggtatgagtaaaccttctcatacctgaataaccttctcagggacactgagttttccgttacctttagccattatcaaatgcataaaatccctgcaagttttcattcactcatccatttatttaacccacagtgagtgcttccaatgtccaggtgctgagctgactgccaggaaaacaggacccctttctactaagggatcatccaataaagtatgggataatcagtctactgagagaaaatccattaagttctagcatctagagtgcacattccaggcgatattatagttcataccaataaatcaatggaaaacatttaccatggttgcaaacttcccagaattgaacatttaaaaatataaagagcgtgtgactatactacacttgcaagacagtctataacttttgttgtccgtctttctgggatgaacttctcaatggttctttccttgactaacttctcttttaagtctcagctccaatgcctcttcctcctcagagaggtcactagtaatcatcctgtttgaagaagcacctgttaaccaaataaatcactctatcatgtcattctatttatttccttcagaggattaattataatctaactgcatttatttgtttactatctattacttgtctacatcactagaatctaaactgttgagagcagaggcattatttattttcttcacagctatatgcttagcacttaaacccccacacttaataatcacttaatatataatttattaaataagctagccctagtcttcaagtctgcaccaacacataagatagtagttacatcacttaggatgctttaagctgcagaaaactgaaacccaaagccaagtggcttacatagtcccaaacatgtattatcttacaacaagaagttcagaggtaaggatgcaccagagtgcacttggcttctcaatgatatcattaagaatccagattcattctgtctctcagttttctcatatcaggaagttgacccttccataggtcagctcatcttgtgtttgcaagattctgcggcagttctgggttattatatccatttttgaaaacatacggaggaagaaatgggactatcacttactcagtgattcctacaatccataaataaacttttctggatgacactcagcaaacttctcatcaaagctcagtgtttgcaattttgttgcacatctacaaataatccaatcacaagggaaacaaggccatgatgactgattcacaccaaagatttccaaactctttgattgtgacccacgatagaattgtttttacattgacaccaagtacatatgtatacataattttttaagtttttatgagatttttcttagcctgtctctaatctgtatgtaacctgatatttcctattctatgtaatttgaggcacaataatatgacccactgatttgattttaggatttactaattattgtgattcatagttggaataatgttgtcctagaccaataacaatctacttcaaatgctaggctgtgaatcagttgaagtaagagtagatgtgcaaactaaattaaaattagggaaaaaacgaaagtggcctttggtggaggcaaatagcatctgctcagtttttacttagtaatttttatttatatttttaattttaattttcacattacattgttatatcacatgatatatctaatattaattgtaacaaagattctcaatatgtaaaactatcaaagacaataggttaggaatcaaataaatttctagagccaaatcaaaaggaaaagtatataaggactgtttattttttgttgtttatttgtttagaaaatgttacttaaaatggcagaaattagagcttaagtgttgggcccacaaaaaataccaagtaagtgggaccctctcagtttctttgaaacttgtcataaaccatgctgacatccccaggaggcctctgaaaaccctccagttggctctcttgctgataatgagttgcgctacattgatgttcgctgtccaaggtattctcaccaaaatactacagagaatggtctcctcccctatgtctctgaaacagacaaactcaagtcttcttggctagtcctgtgagctaacaaattgcatccttctagccactttctcaatcttctcttcagttttacttcttaaatatgtatctatctccatttccttctagctatatcttttttatttaaaaaaatcccattatttcaatatgtacaatagacattttgattcagttacaatgttgtgtcatttctctgttataagacagaatcaaagagtgctacaaaactggattatttatataaccaaacataatcacttccatccccaatattttatttaattttaattatttccatgaaatgtaaactgtattatagaattacttgtcataataaaatatgccaagaatctaaccttttgttgattcaagatgattataagagatggaatttattttgtaatactttaatacagaaatcctacatgtatttactgaaaacattttgataaataaaataagaaaatgaatgcagcactcagcacacaccaaaatagagcatggccagggaaggaagaaataaaagaaagacaaaataatctatggagaaaaaaattgaagtattagtgctatcccaaggagactaggttttctaaatttctgatatcctcattgatcccagtcttaagcaagctatatatgtatgaagtctatatagagagatgtgtttgtgtgtaatgttctggcacatattttcatcgtattcttgtactctacactatcaaatgggtaagctgaggcatggcatagttaaatgataacatcttagaatctgtgacagatttggaattcaatggcagatttggtcctgtatccaaacctactttctgtgacctcatatgttccctttgaatcaggcctaagaatagtcttgacaccacagagagcaccctccctggccatgtgataaccagggcaaggaaaagccaggctcaccttgagaggaatgtggctctgcaccaggtatttcagggtcactcagcaggtttatttttgctattctgctggcctttcctccctggccatggcccagaacactccaggctctgtcatcgttttgcaccgcacagagcagcccattggccttaatacctgaagccacagctgtatttcaggacctgttataatcaacctcaggcttcctaaggcattgcttttcctctctgccttctacaaaaggtgacagatggcactattacatcacattcagcttttgggggaagtaagcttaataaactatgcaataatctctatcagagcccaagaaaacaatgggccagggagtcagagatcagctgcccaatttctcaaaaaggaaatagattgattccagtaaatctagccctgcgaagacaaggaaacgtggtattctttatcacccccattcagcaacaccagcaatttgagctttgcattttcctattatgttacctggaaagtcactagtaaatacagatggatattaaaatagtttgtgttcaggataacataaagtaatgtaataatatgaacaagagtagattaaatgtaaatgtaataaaatcacagtgccaacactctgtcataagacacggaaaggagcacaacatacttgacatgttttcagggtaggcattgcaaatcctcaaattacaaaatttttctgtattatgatgtgtcttggataattagagaaaacataatttgagatcagaaaacttgaattttaatcctggctttgccactagttagtgttaacctaaataacagacagagagagactctctaaaacagaatgatatttattcagtaatggttattgcaatgaaaatacccattccatagtaaactgtatgtgtattcaaggaggtaaaggaagacaaagttttttcttaaaaaaaaagttacgtagctcttttgagaaaattatccttggctataaggatcagcaacaagtatgatgtcagtttgatgttggacaggcaattgttgggcaaatgacctggtgagttttgttttttttgtttgtgtgtttgtaaggttgcaatggcctttgtgcaaggttgtggtgtttgcagagtcttttgtggtagccttgttatcaggcattcacgcatgagaaacctttttcatggccttccttggccctatttgtctgtttttaacacaagtgattccatttgcattcactttcacattagctatcttctctttggcaaatcacttatctttcttggtacttcagtatctttgctacagaatgggaagaaagagttctcactagatgatctacaagatcccttccaattctgaatttttttattcatatgtaacccaccaaggcttcaccatcctgcaaatataaatgaggtcatgtatatgctgacattgcagttacgtaaacttattagcctccatttgctgaactgcgggccctcagcacccatgctattttctgcaaagttagccccagctatttctggctaaggtggcatagcaagtgttggttgggttctatcttgatcctctgaagtttcttttactgtttctgtgtgtccacccccaacttctgagagctttgtttctaaggtgtaacacctgcagttttcttcagagtactatatccttgggctagctgagctcttttgcctgctcaccaaatgcccggaggccttgagacaatggctgacttaaattagtgaggcagtttcagagcccaactcccttgttgcaaaaaagcacaaactctgtggtgtcaggagccttctgtgagggtcctcatcctcatcctgaagaccctcacagaacctcacctgagatccttttcgccctgtttttcctattctctgggatgtttcatggatgctttggaaaaatccccctttctcttctcagctggcattctcctggatgttttctgtctgcaagccacttgagggctgtgccttgtggggtcatggctggaggtgacctcactgggcacactgctactctaccaaggatgtggccttccagggcatccccagacggcaaatatgccagatatcaaggggcactgcctcctctccagccctctttgtaccacttgaatcatggggagctcttgtcagaaatgggatgtgtttttctccagttgtgttctgttttgctatctacactcagagctgagctgctggttctctgcatttcataaagcttcctgtgtaattcagatctctctctttagtgtgctcctattagtggtcaagcctagtcactgagaggaggcaggaaaaaagaaacatcatcctcgtttctccatcttcccatctctgtcctctacatgctacgttttgcaggtagattcctgaagagctactggcatcacgttcaatctaatttcttgttgctaacatttgaaatcatcttctagatgtagatagatcagaactcaaaatctagcacttcatggtctctctctaatgctgtcttatcaccaagacaatcaacttcataaaaatggtccacccaaaacaggtgagtggaaaaaccacttcatttataggacagctacattttttttaatctgctaatataaagtgatgagtaactaatttattttcatagattttaccttaaatcctcatccggatgtacatttccttttttgttacattcttcaagaatccatgaagtaataatattcattaattttatatttgttactcgataatgacaaacaaatgttcattgagcatctccaggaggacattttaatttatctagtactgaaataataccaatagtcctatttgttctggggctcctcagacaaacttgggcaaggtagaagacatccaggttagtggtacaaaacctagattagaaatagcaccattaggcagggtgcagtggctcacacgtgtaacctcagcactttgggaggccgaggaggactgatcacctgaggtcaggggtttgagaccagcctggatcaacatggtaaaaacctttctctatcaaaaaaatacaaaaattagctgagtgtggaagctgaggtgggaggatggcttgaacctgaaaggcagaggttgcagtgagccaagattgcaccaccgcactccagcctgggtgacagagtaagaccctgtctgccacaaaaaaaaaaaaaaaaaagaaaaaagaaaagaaaaacaaacaaacaaaaaagaaataaacaccattaaaacatgacatgcacaggaaacaagacttaatactctaccattaacttccttttaaataagccacagtatgcaggaataaaagggccatcacatttgcctcttgcttttatgtgcaatacatccttcacatgagatcagctcctttatttaaatcaacaacatcttatcagtattttcctcttatttattgttttgtcttcctacatctaaaataattatgcatgtcaacgtttattaactaggcagtggaatagaaaatataagttttattttcagtattttcattgacttgtgtgtgaactgggttagacacttcatcagcaggaaacaatagcatttattatgctctatcctgcaaggaacctggttttaggtattctgataaagtaatttttctggggaaaaggcatggtttctgtttataatctaagaaagcaatgtagaggcagacagaacaagcattgttcaaacacatacaacctgcttttaaatacacattcttcatatggcttttataaaattttcctttggtaataacttttaaggaggcaaaaagttggcaagaataagattaaatcaaaatgccctaaataatatggccaaagtcactttagagaaatggttcttaaacttgggggagggggatcatcaattccagaaaaaaaaatctgtgtgtataaatatcgacatttggtagaaaatattgagattttcagatctccttttttgaaccccaatttaagaactccaattacagttttccagaaacagtttacaaaatgctcaatcttgctaaaatagaataatatttactaaaactgtatgaccttttctcccttttccttttccatttcttcacttttctttctccctaaaaaatttctctctctctgtctctctctctctctctctctcttcctgccacctctctctctcctctctctccttttggtcttctgtgagttagtttcaaatactaaaccacctacaatttactatacttaacaagagttttgtagtaaggaaacagagatgaaaaaaaaacacacacacaaggcttttcatttctcctctccctcctgcacgtgatgatactggatatgaccaaccctaatccatatcatattatcttctccctgtgccttgccctagagaccacagctacctggaagactttgctctgaaatataaaaacttctgactttggcatctagacattgctaagtatgtgtgcactcactctccatgaggagtgtctcatctcagtgtttcaagctatgctcctgaatttctgtattatttagagtgacactagctgctgtaactaaacacccaacccccaatatttcactggcttaacccatgaaaagttaatttcttgcccagaatagatgttctgttcacaatagttcagagcaaatgctcctgtcctctatgagtgagtcaggactgttctttctggtcattcaggacccagcatggcatggaaaaaaaaaaaagagggcaggactggcccatctgtggcttaacccctaggcctggaagtgccacaatcattcccacacatgttattgtaagtgaaaaccagtcacatggcacctagaagtgaatagatgggccggacatagtggttcactcctgtaatcccagcactttgggaggctgaggcaggaggatggcttgaggccgggaatttgagaccagcctgggcaatatagcaagaccctatctctacaaaaccgtttttgaaaattacctgggcatggtggcacatgcctggagtcccagctcttcaggctaggctaaaggatcacttgagcttaggagtttgatgctgcagtgagctatgaccatgccactgcactccagcctgagcaacagagtgagatcccatcttaaaaaataataataatgaagaggtgaagatggagctggaaatcctagtctttgtcctggcagctgcttccagcaacaattctacactgtggaaggtcaccatggatttttggtgaactgccagccatctttgcttagcacctttttgataagcaaggtgtttctcatcctgctttgcttaggaatcaccgttatgcactacccaggtgtatatttgttgtttgttgctgtgaaaaataatttcccaaaatttcatgacttaaaacaacaaatactttgtatctcatgttttctatgagtcaagagtgttgatgtggctcaaccggatgcccgtggctcacggtctttcatagacatcaacagacactgcagggaggatccacttacaagctcactttcctggccacttgcaggcctcacttcctcactggcggttggtggtagatacaggtgcctggccactaaggtctttccactgggaaactcacaacttggcagctggcttccactgtaatgagccatcaagagagtgagaaaggaaactcaaggtagaattcaccatattttgtagcctattcttgttagtttcatcctgtgaaattaaataattcaaacttaaagctgttggaactttaaattattttaaaccttaagaggaatgtggctatgtggcctgagtcacaaagcatgaagctgcaagttctgcttttctgattatagatcatatctcttcctcattcttgccctgtaaatgattaggaaaggctgaacggcaccagagataagacccatcaaaaccattacccctccctacagaaagttaaggcagttttcctccgaatgtaaccaatcaaatcactataacacatgtactaacctgttttgaaaaatgctgcaaccttgttaagcttctctgtcttcgcctatataaatgaaaccttactttccccaccttggaatgctgacccattcttttggagtctgtgtttcccaggtggctactcttaagctctgcactcaaataaactttatacttagtcatatttcccaaatctcatcttttaaggttgatgatgtcatcaatattgctgcattgttttaatttggagcgagtcacaggtccaattcatgctcaaacaaagatcagtacacaaggttatgagtagcagggagcagtgatgagggatcatgttccaggttgcccactgaccacaggtgtgggcagagaaggctctctatctgtagtctctagcatttaaaaatatgtaaacatctctcaacttgttttggtaacaggaatgtaagaaggtgtctagacatctaattcttttctaaaatagaactgggaaaagagcccgcctggtagaaagtagtgggtgatcagggtggccagttcaggagcctgcacagattggaggctcttctggaacatgtggctgaggctgggttttcttgttgctctcctgtatgtcacagtctcacatatttattttctttaattaaatttatgtatttttgcttcatattactttttttttttttaccttaactttaacaatgaaaatttcaagatccagtaaatggtctaagacaggagaaaatggtaaaatatttatattcaacatataggcccattgaaagctgtgttcttttcacttaataattgacatatgcaaatttttaaataccataattgctttacactctattcattattttaatttttttcaattcttaattttaaaacattgtttttattctagtaaaagagaattagaatttatcattttaacttttttttttccttttttcttgagatggagttttgctcttgttgcccatgctggagtgcaatggcgcaatcttggctcactgcaacctctgcctcccgggttcaaatgattctcctgccttagcctcccgtatagatgggattacaggcatgtgccaccatgcctggctaattttgtacttttttagtagagacagggtttcatcatgttggccaggctggtctcgaactcctgacctcaggtgatccacccgcgttggcctcccaaagtgctgggattacagacgtgagccaccgcacccgggtattttcaccatttttaggcatacaattcagtggcattaaatatgtatatattttgtgcaaccactactacaaaccattgccagaactttttcatcttccctgagtgacactctgtaccccttactgatttttataacagggttctaatcacttaactgtcattttcttctctctccttaaaaatctttttgactttgattctttttctaatttatatagtctttggcttcctatctaaaaagcagctgttcattcttaaaaataatcaagagattagagttttattcagttttatttaaggagataatatgactaggagtttcgttccattatattcaagaagctaagatggtttaactccttggctgctcctagcacctcaaaaccatagctgggtgtatttcaatgacacctgcaggtttaacttgctctagtccatgagaccttattaaactcctaagaataataaataacaacaatctacatgtttagctgagccactctttattcatctcttttgtagctaagtcgctcttttcatcctgattctagtgaatagacctttgctttattcttcgtgaccacgtatcagggttctaggagccaggcattttcttccagaactttctacctgttgctctggttcccatgaccagctccaagcgtgctcttcccagagtttgagggaggtacagacatgtacatgaaactccattgctttgtctctacttcttgtcatcagagccctttcttatcctctctactatctcacacctggatctttctggatcctctatcttgtcaaatggagctttcttatctctgggtcctgaccattcttttttgtctatcctgctgaagcccaaacctatgctctgttactttctgtctttcacattcttctgggacagtaaaaccattttgagtttggaccaaaagatgaatacttttggtcatagcattcaaaatggaatgaatactgttccttccagaaggaagaggtaagaagaactcgtttttgatgcatgtgtctaaattctaattctgtatgtccaacatagactgttatttgtccaactaaaatctgttctgctttttccagagtactagtgtatatctgggtgctgagttgcttaggcacaccacatcttcctgcctcttggtagtgaggtgtggccatgcaactaaattctcatcaatgggatatgagcagaagtcaaatgtgtagcttctgccttacttccttagaaaacacttgctctgaaaccactcttcacttgtctttctgctagctgaaaatgagaacaagagagttcccttggaagctacattggagatgacagaactgcctttctgtccaaagcatggcttcctgaaatagaagccaccttcctgctctgtgccatgaagagacacaaaataaacttctgttttgctgaaccatgatctttgggtctccttgttacatcaactcagatttcattctagtggctacaacataattgatagaaatcttataattgctcattggttaacagatccaaatatttctcattttctccacaggtttgggtagctttttgaaggctaattgtatttaaataagaaataattaaaatattgcatatgctagaaatcagtcaaacttctgctttgttatttgcctctctgctacttctttctcagtaggcaggatgggggacaggagaaacattaggtgacacttgggcttcacgggctgaagtcaattttatcttccagatataataatgattgattatcactcaattttcaagatatggcaatatgctgacatgagaaccaaatcacttgttaaaggaatctgattgaccatattacattctcatggacagatattgcatatataattttcacagcagctgcttgcatttttttaggcagcagacattgaattaaactgaagaagcaagtacagagagtggcaaatgtctaaggcaaatggcaaagtgaactgagtcaattattattttaaaagcttcatgatttttagacaatgatgttcttagaaagaatataaggaacttctctatgaatggttcctaatctattcaaggccacaggctgccccaggaagctgatgaaactttggacccttttcctagacaaatgtataaggtaacaaattttgcaaacaacgtgagatggctcacaaacacccaccagcccaggcacatccatggatcacagattaagaacatacttttataggggaaacataaaagaataaatcagtttcttccattcaatcacgattatatcaaactagcatttatcaggtatttgtttgccagcaaaacctggatccaatgacactgagagaaataaaagaatatgtatgcccttgtctttgagtagctgaaagtccagtggagaaaacagacctgacaattgatattcacaatgaaatgtgatggaatgaatacgtgagcagcatgcagagacaacagaggactggttgaaatctttacccatgggagctagagaaagatttctttttgcacaatcaatgcttgaggatgatctgaagaaacaaagtgaccagtcctgtggaagcaatacttccaaatcttcatttatacatggtaaaaacaacaatcttaataagccacttattatatgttagatactattttaatatatgtttaatcctcacaacaattcaactgacaggttctcatcacccagctagtaaatgaggccaaatttaatcaggcctctggaaccatgaacccatcacactgtgttagatccatacgtaaaacagtgaactggaagacagtgaggaatatgttatttgtgtcaactgattatacagatacaaaaaagggatgttatggaccaggcgttttattggagcacagcacagtggcatgtgtattgttttccaaattttatagatgaggcatatagactttaaatcagtggttcaaagccatatagtcacagaagggaaggcccaagtgtgaacaccagccttctgatgtttagcgtgttgttatcgctactacctcccattgctttcaagcaccaaggggagcagataccacctggagttctaaacatttatgattagtatgagaaccaaaatggttgtaccaaatgcagatgcagaatttagatccacatctatattgtgcaattcaatcccagacataatcatttgcccaatctaagaagacatctgacttcccattcccatcctcccctagcaaatagaaatgaaaataagagaggtgaggaacaggtacaatatgagataaagttcaacttagctaaataataaaaatgtattatgactatcagataaattaaagcaagttacaaattcgaagcacagaaaatcagtttccagaatccagtaataaaatgagatactaaaagtccgcacaagtcttttctgcatgagctgacaatcagtcttcataaggtctctataatatagatatctaacatttggggagtattgtcaagttctattaaaatgatgatatagctaataaggaaagaatgatgcagcataaaatataggacaccatcttttttcttttaaatttgtgctctcagacttgctgagatattccttatcatgtcactgtgcagtttcagaaattatcatggaaattacatatatttctgtttatcaaaccaaccacctcatgataaatacttgtagactgtctctcatttaactcacagtttgggttttagaccaaacacactatgtccacactgttaaatgtacattaacacttgcaataaagaaacaaacattagttgatccagtcatctcccattgacagaccatcatcattctggtacacagagaaatatacacttcagaagctcatggcatgtttcctccttgattcaggttccttgtttattaccacatgaacatttctctggtatatttttagtacaatgtgttatcctagactgatcatatgttcacagattgtgaggagcctgtgaaagactttttgctgtacttgctattgggcaaaatcctgtctgctacctggtattcatgtagagtaaactgcaatgtggaaacagatggtatgaccaagtgggagagagactctgtctgcaaaactgggagagcttcactctgactgggggtggaagaggaatgaacaagtccaccccagcgtaaaaataagatgaaaatataaaagaatgtcagtgttgaaggttactccttttgattttgccaatatcccggaaccatgtgagcacatgaacattccaaagaagaagatacctccaggttcttcagatggtgagtggagccttagtgtttaaaccactgtggcttaatacatgacactttgcatgagataatttgaccaactcaaggcacccagtgtatccttttttgcatttgagaatcaaaaggagcaatgtgtttccctacaggttgtctgtcaaattataaatgaggcctcactagtattttatactttgtattgccttattttcatccagtcactaaaattaagatcaaattatttttcttcttttgaattcgaaaactgaaatcaattttctcttcacagcccagagctctgactatggtttagcaccttccacggggtgagaggaagttagataaattggaatttgtttcctgttcccatgtgaactgctacatctgtgcatgactctccagaatatttacttatttttatagattttgtccatgcttatgtttataaaacagatgtgttaattgaattttttaaatttttaatttttttattgttgtggggacatagtaggtgtacatatttattgagatgttttgatataggaatgcaatgcataataatcacatacatttttatttattttattttatttatttagagaaagggtcttgctctgtcaccaaagccagagtacagtggagcaattatagctcactgaagccttgaactcctggctcaaacagtcctcctgcttcagcctcccaagtagctgttagtgtgtgttaactggatttttaaaacacagaaaacacctgatcaaaattagcccagttctaaagaagtcaattatatatttaatcattgtattagtcagagttctctagagggacagaattaatggaatacatacatatatatatatatatatatatacacacacacatatatatatacatatatatacacatatatatacatatatatacacacatatatacacatatatatacacacacacacacacacatatatatatatatatatatatgagtttatttactattaactcacataatcacagggtcccacaataggccatccgcaggctgaggagcaaggagagccagtccaagttccaaaactgaagaacttggagtcagatgtttgagggcaggaagcatccagcatgggagaaagaaggctaggccagtctctcttttcacattcttctgcctgcttatattctagctgtactggcagccaattagattatgcccactcagactgagggtgcgtctgcctttcccagcccactgactcaaatgttaatctcctttggcaacaccctcacagacacacccaggatcagtactttgtatccttcaatccaatcaagttgacactcagtatcaaccatcacaatcatgcatcttcagttctcccaattatatgcccaggtcactaacctgactgaatctggattatctaaccaaggtatcatattaatggctgaaaaaacaaacaaacaacaacaacaacaaaaaaacaggttgagaaaaaaaagtttgctttggttacaggtcattataagcgaatgcttattgctagaataatttataactgaattaaacattgtttcttacactctccagtgacatacacaatgctacattactcttggcaccaggaagctgccaaagtttcagattcggccagtggactgattctcttagagcagacctggcacactggaaacagctccagggcctgctggagcacctcaccctggttatgctggaagcagctagagtggatgctgattctactcatgccaccttcatctgtgaacccccaaagatctcacaatgtaactgatatacagtcagcattaaataaacatacatattctgactgtatgccactggttcaaagggcactaaaattattacattaagatgaaacaaatgcataagttcaggaggttattggcttctgcttctctgtgcagatgcatggaatagcaaggagtgtgaagaactgctaactctgttgtcttacaggatcatccaggttagttgaatggtctggttatttggaaattatccaaagatgcagtgttgaacagcagaaatagccaagacaaagaggcaagatcctacgtgtcaaactgtgctctcccttgcttagctttctagtgcgggacctttctctttctggtacacctctattctttcatccataagttatgacttgctctgttttcagagattttctgaggacatatgtttgcaatatagtgaatgttagtgtgcccccaaaatttgtgtgttgaacccctcatctcattatgactgtatttggattgggagctgttggaagataaccaggacatgaggctggagccctcatgaatcgcattagtacctttataggaagagaccagagagctagctggttccttccaccacgtgaggttacgacaactcattagtctccaatttggaaaaagagccctcaccagaacctgagcatgccagtactctgaccttggactttcacactgcaaaactgtgagaaataaatttcttccgtttatacccatctggtctatgataatttgttacagtaacctgaactaagacggtgttcccactgtagtttgttacttcttaaaccaattagactttttttttttttttttttgagacagagtctcactctgttgcccaggctggaatacactggcaccgtctcagctcactgcaacctccgactccctggttcaagcgattctcctgcctcagcctcccaagtagctgggattacaggtatgtgccaccaagcccagctaatttttgtatatttagtagagacggggatttcaccatgttggccaggatggtctcaatctcctgacctcgtgatccacccacctcggcctcccaaagtgctgagattacaggcataagtcactgcactcggccaccaattaagcttttaaagaatgtttatatttaatcgtaaaaataaatattcattatgaaatgcaagagaaacagaaaaccataaagtagatgataaaattcatattgcatcttactgtccagaagtagccaatatcaaataagtaatggttaaattcctgaaataatttcttttatggtaacttttcttttctgtgtataaattttcttatttgagaaagttaggattatattaaccatacatttttaatcctgcttatttcattttcttaggtctataatatttctctaaagcctgatattttaatggcagaatgatatttgacattagttgttgtaccattttgagacggaatctcactctgtcaccaggctggagtgcagtggtgcgatctcggctcactgcaacctctgcctcctgggttcaagcaattctcctgcctcagcctgccgagtagctgggaccacaggcgcgcaccaccacgtccagctaatttttgtatttttagtagagatggggtttcaccatgtgtggccaggatggtcttgatctcttgaccttgtgatccacctgcctcggcctcccaaagtgctgggattacaggcatcaccgcgcccggcctgatgtactatttctaacaaaatcattcctctactttagattgttccttattttctaaattataaaaaattcaatgaaaattcttatatatgaatttctctctccctcactggaaatgagtacagaaaatggagttgctgggtcaaaagacaagtctttctaattttttcaatcttcatatacacattgcaatgttgcatccaggtaaataacaccaaattattgttccaattagctatatatacattctaatcaagactgaatatactcacttaaaaacatggccatttttgaatatgtgaagtagtagctcattttttattgaaagtaagatggtcatgtgtgtgtgttttgggtgtgtgtgatgtatttttctctgatttatctgttaatgcctttagttcattttatttccctatcagttttaatttgtaagaaatacattaaatgaacatggtcccttcattatgttttttatatactgtatgtattttaactaacaattaactcaaaagtcttttatacagccctatttcaagacttactataaggccaccataataaaaacagtgtagcgctggcaaagaatcaacaaatacatcaatgaaataaaatagagagcccagaaatatattcacattatatgatcatttgatattcaccacagggacacaacaatcctacgagaaaaggaaaagcttttaaacaaatgatcctggaacaatacgctatgcaaattaaaaagtaaactttgacccctatctcacaccatgtacaaacattaatttgagatggattctcgaatccatctcaacataatagctaaaactataagtttttaaaaatagtatatttttgtggattccaaatagagaaaagtttctttaaaaatcatagaaaacaatatcaatgaaataaaaatacatataaattgtatttttaaaaaattaacaactttggttcatctaaagacatcaagtaaatgaacaggcaagctgtagactgagacatacttgaagtttacacacctgacttaggactggtaactagcatacattttcagaaacaaaaaataataaagtttataaggcaatcataaaaagaaaaaaatggaaaaaagatttgaacatatgcacaaaagaggctaatttataaacaaccaataagcacatgaaaaagcactgaatattattagatattaggaaaattcaaattgaaaccccaatgagatatcaaatatccactgaagtagctaaaatcaaaagagaaataatgttaaaggttgatgaagacttgtggccaccagaactttcacatattgttgatggcagtgaaaatcctgcaattttagaaaaagctcccttagcatcttaaaaaaagtggatcaacctgtagtgtaagacttggtgattccaaagaaatgtatttccacaaacaggcttgtacaaaatcatttattggagccttatttgtaataatccccaaaaagaaacagcctagatacccaacaataggacattggataaataaaatatgcttttacagtgggatattagacagcaataaaaataataaattactgatatatacaataacatggatgaattgccaaagccttatatggagcaaaagaagtcttacacactaacatacactatgattctacctgtataaacttctagattaggcaaaactaattcatggtgtaaaacaatcagaacaatgaatgcttctgtggaaatgggggtaaagatttattgggaaggaacatgaaggaactttctggagtgacggtcatgttttgtttattaatagcaggttgttttctcaggtaatcaagtggtcgcatgatttgagtattttattgtatgtacatattacttgaaaagaagaaaacccataaataaatattgaattctaatgatacgtatgctgaagtatttataacatgtactaaagtctacaacttattttcaaatacattttcagaaaaggaaggagagatagatgtgtaataaaaacaagtatagcaaaacattaattgtagagactagttagtgggcatatgggtgtcccttctgaaattctctcaacttttctacatgtttgcaaattttcatcataaaacaggacgggaaaaaaggaacctagcagaatgggagagagaatctattcccacctttttttgtgtagacagtgtaacaggttggaattcaggatacaaaccaaatataaggaataggtttatatattaaaaactttgtagccgggtgcggtggctcacacctgtaatcccaacactttgggaggctgaggcgggcagatcatgaggtcaggagttcgagaccagcttggccaacatagtgaaagcctgtctctactaaaaatacaaaaattagccaggcgtggtggcacgtgcctgtagtcccagctacttgggaggctgaggcaggagaattgcttgaaccaggaggcagaggttgcagtgagccgagattgttccactgcactttccagcctggtctagagagcaagactccatctcaaaaaacaaacaagcaagcaaacaaacaagtaaacaacaacaacaacaacaacaaaactttgtgattcttttaagttatacaatcatttagttttttatgtagatatattatcaatctttgagttgggatgtccaaacgtagcaaatatattaataccactagtatataaacaatattaaatagtagctttagtattgataaccttttctcttttagaagaacacggctagtggttgaccattaagtacaaagctgactactgtttaatgtatttaatccagataatctttgcccttcaatagattaggacaatatttagtgtgataactagtactttgaaattattctcaccattttatggtgtgttttctttttactacctctttcattttctacctccctagtatctattttattaataatatttcttttatttcttttttgtttcgagataaaattatattttttagtatttagtttcactatcaattttaaatacacacttaactcaaattattccaacaaaatctattcagtattttgatccttttccttaatgtttctcagactgctccttttacacattctcttaaaaactttatttctgttattattgtcagaaggctaaatgcaaaattgatcaagatgaattattttaacatcattggtgatatttataaatatggtttacaatatctttgcttacctccttttctctgatttttctttttggtatttacgttagaaaggaccaataggggccgggtgcggtggctcacgcctataatcccagaactttgggaggcagaggcgggcggatcacgaggtcaggagatccagaccatcctggctaacacagtgaaaccccatctctactaaaaatacaaaaaattagccgggcatggtggcgggtgcctgtagtcccagctactcgggaggctgaggcaggagaatggtgtaaaacccaggaggcagagcttgcagtgagaatccgtctcaaaaaaaaaaaaaaaagaaaaacagaaaagaccagtaggtagtgactttctactctttatatgcctgaaaaaaaaaaaaaaaaaaaaactatctgtctatctatctatctatcttctctaattaacagtttagcactacatagaatttgtggattatagtctctttgtcatttggaaaactttgttaatgagaagcttgctgcatctgattgtaatagttttttaggaaatccgttatgctttttaataacattactattatttgtgtatgctcaatgatctatagtttagtctggtgtgaagtttagatttatttgtatttattcttctctagatggaatctattttaatctaagggcttactttttcttcaattacagaaaatgtctgccaatattcctcttctgccatttcttctagaatcttctggtggagcaacttctaaaactttgttgtggtttcccatcttaattccatgtcttttaactgctttttgagtacttttatctctttatttcagtggttctaactgggcgaggggtagtcacctggacattggacaatccagttttggttgtcgcaactggggagggggtgctatgggcatgtagtgggtagaggttatagatgctgctaaaactctgcaatgtacaggacactccccacaacaaataattatttagccctaagtgacaaaagtgttgatgagaaatcctactttatttctgtgccccaccttctagatgaattctttgttactatttttcagttcaccaaatctccttgctgctatcttgagagtattccatatattgagattttattttaaattaagattttttttaaatttccagtctttctcattttaataatgcctggatatcttatatctacccatgtttgcttcataaattcttgttcatttactgcattctaagttctttattcattacatgatttaaagcacactcattttaaaatcatttttgcacattctattattttcgttttccttggggtgaattaaccttcaaattgttggttgtctgtcttagcattagtttactttctgtgttttaatagcttaggttgcaggctgatattaaatggaaattttagttctccttttcttcctacatactttcaccccacccttttatttttttcctttaacaatttttcacagttgcctgaagttggatagcagtctggggctagatcttatgctagctattgagacctttcccacagtgatactgagaacaatgttgatcaactcatgaaaccagagggcagcttgacccaagtcttggttgctaggtgatgcctgctcctttgacgtccctggtttataattataactacagtgtagcttcaggctctagttagacttagcttgttttttttcaacctcttttcaaggagatgagcttcctcagccctcagttttcagtaaagagactgcctcagtgaacaatatttattctggtaatgccacatgtatcatttcagaatccctgcatacttgaagctttaagttcattttatcttttttcatccacagaaatatttaacttttacttgtggttcatatgcatagtcatttcttctttttatattttaccattatgctatacgtctggtgcagatggggtccttaaatatctgaaattacattatcccaactagaagtctcctggctcctagttcaaataataaactaatacttaaccatttttatagttattttaaaggttttatttttaataacaaatacgagtagaattatatcagttatctttccagtgacacttaagattttttccttaattagcctatttaaataaactatagttttatataaccaaatataacttcatagttacattcctgtcataaattctctttgctattcctatttcaaaatattaaattcaatattttaaatgtaatatttataccaatattttaaatataatatttataccaatatttaaaatagagattagttgtcaccttttattttagtctatttattaaattttattttaaacttttatttataagataaattgataggtccattgaaatatttctctaggttattgaaaaaagtatgttatatttataaataccaattattcagaaatttggtgaataagtccatcattcaatctggttcaggactatttggaggatttgttctttcgaaattatctcaatgtttttggctatctattataggagtattaaaccacaataatctttaccaagttattcaaacatatttcccatatgttatggcatccgctactcattgatttcttttttttaatctcaatatttcctcttagactgtgtagtaaacattctgaggtattttatgctattataacagattacacacatatttaaataataatttggcttgaaataaaagtgtggtagaatttatttttcttcataatttaaaaatatttctatgtttctattttatatccagcattggtactgaaaaatttggcatcaatctgattattattttgccatgatttattcttcctctatagagacttttagaataatatatttccctccaatgttttaaaatattgctgcaatatgtcaagatgtaggtttttaattctctccaaattgatactctaagagcctttttaatgcaaggtatgtaatctttttgaaatttttaaactgtatattcattatttctaaagacatgttctcttttctgtttttttccttgtcttctgagactcccattactatatgttgattctttctccatcttctttttttttttttttttttttttttttttttttgagacggagtctcgctctgtcgcccaggctggagtgcagtggcgggacctcggctcactgcaagctccgcctcccgggttcacgccattctcctgcctcagcctcccaagcagctgggactacaggcgcccgccactacgcccggctaattttttgtatttttagtagagacggggtttcaccgttttagccgggatggtctctttctccatcttctagcctggcttattattttatttttcttcatcagtttctgttcctgtggagtttttccatgtgacttttcagctgtctaattcccagctttttctttagctgtatccatcctggtgtttatcccttctatgtgttctttgttttaagtattatattttattcctaataaagtcagagggagattacacacacatacacacatgtatctgtctattttctcttagctctttgtgcatatttattatatttcttggtttgtcccaaaattccgttctattttacatgtgtgtgtgtatatatatatatatatacacacacacacacacacacacacacatatatatgtatatacatctgaatatttgtttctttaatgagtgtactccacaggtgtctattaattttggtattcctgataacatgttttggggtagacccaaaggctaggcccttgcctgcgtctctccattgtgtttataaagaggggaagggacatgccccagggctgagaaacccaggccccacagcatcatgttaaccactatataagtctcctagtcaaagattcacttttaaactactttaaataagcaatttcctgtttagtttattgagggggttggaggaagagtacacaaaaaagtaaggctagagagcagcagcagtccagacccaccatcatctgcaaacctaccgtttgatagcttctgtggcctgggctgtcctatatttttcgtggcaaagaaactggttatgccaaggtgacacagaaagggaaaaacaaaactaaaacagctttcccccacactactcacctttatctgcctcctattatcctgtgctcctgctgcagacataccacagccctctccacacagagactgcttcttggtagtcttcaatctcagcttgatttattttcttaattattgttattttccttaacctatactttccttgagcttctgtagtctctctagcattgattcagaagaataaagtgtgcagtccattcaaattcaccattacagcagcaggtactggaaacttttatagcattctatgtctggttattcagattttttttctacttaaaacctttcttaaaaattgaaatgtataatatttgcaaaagttttcataagtaaataattttaagatatattaaacccagtatatctttttttaaaaaaacctatatttatttttactttttattgttactttttcttgttgtcctccttaagactttgagaggattcttcggttacaagcttactttacatgttttctatttttctgtatgggtcattcaacttatacagaatttgacactgtgaattttcctctgaatacttcagacagattttctgggttttaatatgtgctatttcctttatcataaataacttgttctttttattactagtcacctcaatttgtacactcccattcccccccccccaaccgccaaataataaaatgtttccctgattaaaaaaaaaacaacaacaacaaatttccaaggcacttatggctggggtgccagcctttatatagaaactcagaaaccaccaataactaggcataactaggaaaagaaaattaatcaccacagagctgaaactccctgactagacaattttctaacactgttgattttcctcctaagtcacttttcctattttagcacggtaagcagcttttcacaagggatctgtagtgttgtattcaaacaagcacggctgtatgaaacacttcctctctagctggaacgtgtcaatcatttcatgtaattaatttcctaatgatcctgaaacatttgctttctacctgaatgatctcattctggtaccaggcaattttctggagcattttaaatgtaaagtttgtaggtaaacccaagtaaatacattgtagacaacttgcagaggaaaaactcaggatcaaaccttttcccaatgaagtgtataatattttctttgacggaagcaaagtgatatatagcgtgccacaactaaactgtaaaaataccacgacctttcatcagtctcaattattaggagtaatagcctcaggctgaaactacttgagaatccctgatgatatttaagacagaaaaactacagaatctaatgcaaagtccacggccaaactgtgctgggatagggttgcctagtggtccattcatcattttttttttctgcttacactggggctgacatctacttattaagtctttccctgggtcatttcacactgctggagaggcaaagtagaaatcccatcaggaggcctgcatttccagagggaagggagggattttatttttggtgccatcattatcttattaggcaaaaggaaaactgttggtcctgatagatcccttcctgttctttcaaaagtcatatccagtgtagatgagtgccccaatgcacaggaaagtgctaggagaaataaaacaaaaaactgctgtcctgtgaaatagtaatatttttcaatagctagggaccacgccttgctgatgagggaagccaggctgaactgagcattgtaaacagactgtgacaatctaccggaagaaaagaagggatgggaggaatcagtaaacaagattcaaggaatgggtaaatctttcattaaatactatggactaaacctcctcagtggagagactagcaatatttcactgaaacaggcagtgacaatatgcaagcagattgctttttatccaggatggaattcagaaacctttgttttccctgttctctgacatgtggcactttacttaactaggaatttatgaaacaaactgcagcagtatttgcaacacctccaactgtgtcaccaacggaaatcatgtatgtcatatcacatatcacatttcaattgtaggagatattatggaataccattttcatggaccaatacttctaaaatataatgttcttggccctgacactaactcttattatataataaagaaacacattttgttcatgccaagtgaaggcaaaacaaaaaaaagaaggaaaaaagagaaacagacattactatatcactttttaattattttataactatacttcaatataatttatttcctttaggatcatgtgcattttattttatgcatttgaaaaactttttttttcctcagaaggaggtctataggctttaccatactgcaaagtccatagcacaaagagcttaagaatgtttgccttattctaaatttatattcattaggcaaaatcactcccctcattccttcagggtttgtgtgtgtgtgatctcagtacacaagtatagacacattcagatcactgtgatgaacccagtcaatttcaaagatggtttttcctattaccaaaagtctagatgcaacaatggcatctaaatacaatgacatttaaaatcatcttaagatgtgtttttaaatatgtcaaatattattatgacatattatgtttttaaatatgtctaaatatataagttagtcaaggatggaggctcaaaatagacctaagacccttcctaggcctcctatcagtctgtagaaaccttggctcaggagagaaaggttaagaactggattttacttcccttatagtaatctctgagttactggtgagcaatcccaccacacgctcaccccagaataaatatcctaggtcatgaacaactagatgtgtaatgagattcaacagggacagtctgtgaggggtgggcagtcacgaggggtgaatggaaggtggtagtctgcatcattgcagcacagtctttttttttttttcatggaaacctctgcacaaaccaggtaggcatttacaaagcaagaggcagcttgaaacacttgccaggcccagagagtgcaacaccgtcatacagcaatgctggtcaagggatatcttcctttcacctttatttttgccctcagttccgccacactcctgctgctagggtggatcagaacccagtctcagtatgatggggagagagagagatggaggtaatgaggaccacatctccattcctggcttcttgtttgaggcaggctccaactggaggagttgagaaaatttaactttaatcaagtttggagttttgcatattaaatgcatttggacattctaatttctgaacgaagattctgtttggtgacttaagaatccatggtacttatttgcatagtcatctcatgccccaagatatagctcaggcagagaaagaaatcccttcaatgaattttaaagagacagaatacaaaattaagtggcattatggttacactccacgaatcctatacattcctaatgaagcttatactgatttttgtcttttttctcagctgtacaaaacttcttctgtgtttagtttgctttatcccagatccccagtcagttcctagtgttcattcccaggtttgttcttgtccagaaagcctcctcagttcattcccttgcaatataaaccctgcctacccatctggtctggctcaaacccattgcttcagctatgttttatttaaatgcacagtccacattgattcctttctaatttctattgctttttgcagtaccacttatttacaattgccatattccatttttatacaatttatttttttctttttcaactttttggttcaggggggtatgtgtgtaggtttgttgcatgggtaaattgcatgttgctgaggtttggtatacaaattatttcatcactcatgttgtgaacacagtaactgacaggcagttttttgactctcagactccccttagcctctaccctcaagtagaccctggtatctctcattcctctctttgtgtccatgtgcactcaatgtgtagctctcacttgtaagagagaatatgcattggttttccattccagcgataattcacttaggataatgacctccggctgcatccatgttgctgcaaaggactgattttcctcttttttttatgactgtgaaccacattttctttacccagttcactgttgttgggcatcttggttgattccatgtctttgctactgtgaatagtgctgtgatgaacatataaatgcatgtgtctttttggtagagtaatttatattcctttgggtaatgggattgctggattgaatggttattctgctttaagttctctgagaaaaggcttttaataaaactcaacatcccttcatgttaaaaaccttcaacagactgggcattgaaggaacatacttcagaataataagagctgtctatgacaaatgcacagccaacatcatactgaacaggcaaaagctggacgcattctccttgagcactacaacaagaataacaatgcccactgtcaccactcctacttaacatagtactgaaagtcctagtcagagtaatcaggcaagagaaagagataaaaggtatccaaataggaaaagaggaagccaaactatctctcttcacatatgatatgattctatacctagaaaaccccatagtctctgcccaaaggctcctgcagactgataaacttcagtaaagtttcaggacacaaaatcaatgtaaaagatcagtaatatttctatacagcagtaacatccaagccaaatcaagaatgtaatcccattcacaataactacaaaaagaataaaatacctgggaattcagctaatcagcaaggtgaaagatccctacaatgtgaattacaaaatgctgctgaaagaaatcagagatgacacaaacagatggaaaaacattccatgcttatggacaggaagaatcaatattgttaaaatagctgtattgcccaaagtgatgtacagattcaatatgattcctatcaaactactaacatcattttttacagagttagaaaaatctattttaaaattcatatggaacctaaaaagagcccgaatagccaaagcaattctaagcaaaaagatcaaagcgggaggcatcaccctacttggctttaaactgtaatacaaggctgcatgtattagtaccaaaacagcatggtactaatacaaaaacagcatggtactaatacaaaaacagacacatagaccaatgaaatgggttagagaacccagaaataaaactgcacacctacaaccatctgatttttgagaaagtcaacaatagcaagcaatagggaaaagactccctattcaataaataatgctggggtaactggttagccacatgtagaagattaaaactgtaccccttcctttcactatatgcaaaaaatcaatccaagatgtattaaagacttaaatataagaacaaaaacaataaaaaccctagaggaaaacctaggaaataccattctggacatagatcttggcaaagatttcacgagaaagtctccaaaagcagttgcaacagaaacaaaaaaaacaacaaatgggaaccaattaaatgaaagggcttctgtacaacaaaagaaactatcaacagagtaaacagacaacctacagaattagagaaaatatttgcaaactatgcatctgacaaaggtctaatatccagaatctataaggaacttaaacaaatcatcagtctttttctgaagttaacaatacatcatatttctctttatttttttggaattgtgggtaacttctagtctgggaaaatatgatgatccatttcttatcatttctagtataaatgtaaataaaaatcttatttccaatcatacctgcatctacaggacataaatcttggaatattatctgtttacatgtaaatatcctaagcctatgctttaaagagatttcagttttatttaaaattcatgcaaggttggaaggagcaaaaaggtgtctcaggggtcttgtgtattttagagaggaatgtcaagaatgcaggcttcccagcttgtaaaacaatagcttctttgattggaagttcagttgtgctttgcctgacattttctgtttttaaatccaaaggtaaatttaacttagggaggagatatgtctgtttgtcagcttcaaaagcgatttgttttcgttttgtttcttttttttccaagcagtaaatcttttgaaatttaaactctacccttgtttatcactgcagttattgctttagaggttaaagtttgtaacatagtcccttctctacccgctgaaagacaggagacagaaaagcctatttgagaaattctgttggtaaacctattcccaacgaccctatttaaggcagattatgctgttcaaaacatgccactaatctatattttcttgatatcataataaaagaagctgccatcaacaaaatagccccttgtcaatcaaacacttgccaaaattataccccacttttgagctcatgcaaaaaaaaagtttccattgttttgtgcctttctcaaatacatatcaaccaacattagtaattaatatcctcatgacatccctcatatttttgtacatctttcaatatttgggttaattcttttccttatgcatattcctaaaacacggaaaaacaagagaaaattcttggtacccatcctctagtatgattctattattaaataaatttttttctaatttaaaaacttatcaggctggatatggtggctcatccctgtaatcccagcactttgggaggctgaggcaggtggatcacctgaggtccagagttcgagaccagtctgaccaacatggtgaaacatcatctctactgaaaatacaaaaattagctgggtgtggtggcaggcacctgtaatccaagctacttgggaggctgaggcaggagaatcatttgaacccaggaggcggaggttgcagtgagctgagattgcaccatagccctccagcctgggcgatagggcgagaatccatctcataaaaaacaaaaacaaaaaacacttatcaactgacacttctcatttactttctcgtggtaatatttaaaaagaaaacaagaacacctctttttgagtcatcaaacatgtagaattgaaagctaaacctgaattttaatactataaatagaccattttcaaatgattcaccgattaccaaaaagtaaaagttagatatgggaaaataactttttggtttaccgagagactgaggatcatggaaggctggacttgcctttaagataacaggagtgggcaaattacagcacttgggccaaatcagccaaaagggcagaccacccattttagtgtgagagctaagaatgttttctatattttaatatggttaaaaaaaatcaaccgaaatttaaaagaaaatagcacttcatgaaaggcatgaaacatgaaattaagctctcagtgtccataaataaagtgtttttagaacacagtcatggtcaatcatttgcatattgcctattgctgcattcacaaaacagtggcggagttgaatagttacaacaaagactgtatgacctgcaaagcctaacatgtttactagctgatcctttacaaagaaagttaagattatgtctgttttctgaaacagttccactgataacagcacatatatttatggaccattaagttgtgattaaatatgattgctataaatcaagccttgaaataccatctgtctattcttctaagaatgatgacttcaacagctctttggcacaatagacagtgatttattttaactcttttttgagttttttgagatggggtctcactcagttgcccagcacggagtgcagtggcatgatcttggctcactgcaacatccacctcccaggttcaagcaattctcatgcctcagcctcccccgtagctaggattacatgtgtatgtcatcacatctggctaatttttgtatttttagtagagacagggtttcaccatgttggccagcctggtcttgaactcctgacctcaagtgatccacgcacctcagcctcccaaagtgctgggattacaggcatgagccactgtgccgggccttctaattcttttattcagtttccctttgaccagccaaatacttattttcaaaacaggaaaaactatgaaatattcccttgggtatgtactgacttacctgttgatatgtattttgctgagaatagataccagaatttaatatataccaaaactggcactccaaagaagtgtttatttattttacttaatttctcccttgaaacacacctaataaaaatgttcctgataaatttcccaaatacatactgttagaatgtcaataaaagcttcagtacagtagtatagttgtttcttcaaaatgagaaatatacagtatttattcagctatttattcaatcacttgcaagaaaataatctcaaactgaaagaaaaagataatttattggcacatatgattgagaaatccctgttttaaaatgatgccaattacaacgaattttctctccttcttttggtttagcttgtctctacccatctctctgtggtgttgtctacctctttaggctacatgtgatgggaagaagctagcagtagctttctatattcattctctgaaatttaagtccaacagaataagagagcatccattcccagtacatacagcacagaaacacagattcactatgattagaaccacgtgggagacatgagactacaagggggattgggaattctcattggccaagcctgggtgctatgccccaccctggccatcactgccatcccagccaataactggctaaaaaaaatgagaagaatgggttcccaaaggaaagttgagggtttttgttgttgttgttgttgtttgtttgtttgtttgtttgtttttgtcagaataaggaagaagaaatgtaagaccaggaaatttactatttgaattaaattattcttaaccacatttagaactttcaccaaatactgttcatgatttttctactgctaattcatttttatttttcacaaagaaagctttaaaatattatacattaggtgaggctgagagaagagaaactaaaagaagtttggtggaagcttttgaccatgtttcatgtatgcctatcccttaaccaccttcaacatgaggccagtccatggcaaacaattgttaatcatctgtgtactgcattttgccaccagtcaccctccaacatgcctctgcaacacaacaccaggccatcagaatgctgcgtgatgggctctcaaaggggaatggtggccacaggattggccttccataagctgatcccagaaaaggagtttaatgagctctaagatcaacctaggcccagttgattgacttatggtaaaattcagtttgcatctgctctttggggtctctttaattgtcatgatccttttttccctagagttccctttgtctaagcaaaacaacaacacaagagaaccttttctttatttcggacttaagtaacattcatgctctggtcctctgtcccaacttggtgttctgtatctttcctatcattccagctatggacatctatttttttttaataatttctacttttattttagattcaagtggtacatgtgcaggtttgttatctggatatattacataatgctgaggtttggggcacaattaatcccattacccatgtactgagcatagcacccaatggttagtttttcaacctttgtccccctcccaatctctcctctctagtagtccccagtttcttttgttgccatctttaggacatcatttaaaaaaaaaaaaaaaagctttgagaatacaatttgtatatttgggtctgaaatatcattttagtagaaaaaatatgaaataagttactataagtatgtccatatttttaaaaggctaaaaataccttgactcacagattgggccaactatctctttttaaaaataataataggccaagaaacagcatattattatttttatcaaagaccttagcattttatttaagataaaaaagaatatatttttttaacactttgtggtgtaaaagaattgattggccaggcgtggtggctcacacctgtaatcccagcactttgggaggcagagatgggtagattttctgaggtcaggagctcgagaccagcctggccaacatggcgaaacctcatctctactaaaagtacaaaattagctgagcatggtggcagacacctgtaatcccagctactcaggaggctgaggcaagagaatttcttgaacccaggaggcagaggttgcagtgagctgagatcgtgccactgcactctagcctgggtgacagagtgagactctgtttaaaaaaaaaaatgattaatctacattccctacacatcttattggccggaattcagtttctctaaggcaatcagactgcagaacctagtcctcttgtgtgcccagaaagaaaatgaaaaggacttcaagaaccactcaggattgtccctgctacaggaaataaggagaggctttctggaagaggaagaaattaatcaagcctagaaagattaagtaagcacatttcatctctggcctggaaattctagtagccctttcaggagcaagaaagtctagtactctcttaatattgagtctaggatgtgagatgatggttatgactccatattcagaagtgtgagcaatcagtggcagctccattcctggaaacacagtagagtctgtcagctgtagctgacagaggtagtgattgatggaaacctgccaccttcacttgaatctgtcataaaccgtctgcaactaatcaattccactacacagtgagagttgtaatgattctgaatccattttgtttctgaatagatagatatgtctataatcacactcaatctttaaactttctgctttctctgactgtatcatgtatattatgtatttggaagcatttgatacatagatgatattaatagatggatggatgcatagatggatggatggatggatagatagatagatagatagatagatagatagatagatagatcaagcaaatgatggagtgaagtagcaactggggagacaaagaataaaagcctacactttccaaggacattttaattccctctttttcttcttcttcttttcttatttatttatttatttttgtttcccgcaaaggatttatcaggattagcaatcaactgagcagtggaattttatgaaatgcctgaaggtaattatgtggaattgtgaaatgtatatcagtgggattactctagtcttgtctaattatttgaccgttatcaatacaactgagtgataagtatttagaagatgctatttaaatatttttcagtgaatactgagaggcacagtctcttgataaaccccttcctattcaataagcatgtcaaaatattaaacaatgtcatcttaggaaaggtaagaatggaattttggaacttaagctaaaactgccataaagacgctatggcgtttcaaacaagctgtagttgtttgcatagattggtagaatttaattttggaaaaattactaatctgaacaactagcgatcagccctggtgcataaaattacttgctttcaaaaattctgaccacaaatattcacaatggatgcacaaacaaattttgccagccacaatacgaaagatttttggaatcttaccttgtcttggcaaaataagttgcttgatttttcttgattgtcttgtattgagtactaaaattaaaggtgcaggaacagcacattttctttctcttcctaacttgactatttttggtttcgtgaaaaaatattgattgcaaagcactacctttgtgctaaattttaaaactgccgcttataacatgctgcttgtgtaaaaaaaaaaaaaaaaaagaaaagaaaagaaaaaagaaaaaaaagaatgtgcaaattgcagaagaaagtgaggtacaatgagtaagatcgcaggtgcaattatcagacttcttggcaaaacctctctaccacttagatggacccctgtgggcacattatttttctgcaactaatttcatcatttatgatataatgatcatattagtattcactggttaagtgatgtgataattaaatgaaacagataatctatttaaaatactggctatgatgtgtggcaaagtgtaagccctctataaatgatagctatcattatttgataaaatatattcagacatgtctccaaagtgatctggcgatcatcagtttgtgataaagcaaagtgacgtgagaccatcatgctagacttgtgttagaatctgttccactttccactaacctacttatgaaacagtctttagagaaatgtagaagacatgatatgcatattattaagaacactctaagtcctaaatatttactatcagtcttttgaaatatttcaggagtaaatagcaccttagacaatgtccagaaagactgacacattttgtcttgaattttccacacagtcctttctaccttaaccccactaaattttatttccatctggatcacgacttaaaaacttgatcagtaagatatccagtaatcaattgtgccaaatggacatttctgaactcatctctaacttgatcttcctggtcttattggtccttttcagtcccactttatatcaccaagtgaagtgaacttaacactcgttggctaccaactgactgtcaggtacactgagtcttaaactctgtggttcttgtatctcttagttttttctttttctttttttttcctaactctctgatcatagtattccagtcttctttatggatgcctcttcctttgactgcccttcaaataaatttcccatatgtgtgatccgatatctgcttttcttttcactctagatgtatcttatctacagccctgatttattacaggacaatttatcaagcaatctccaatatacataactattccagcactctctattgagctcctaccacatatcttcttgaatatccacttgcaaagatgttttgaaccacaatttcaacatatctcaccctgaatcaatgatatttcctccagtttggcttctcctccattatttcttattttcattaacagtaacatatcaatcctatcactcaagttagaaacctgggaactctctaaccatgtctccctccatcactttctaactccagtccatcgaaagttcattttgattttcattcccaagtatttgttcatttcagttgccacccttctctaacgtaactgacgtagttcatcgcttttcactgatattactagaacagcattatagctagttttctctcattcgtctttagttaattcaatcgccataatacttcagagtagtttgtcttaaataaaaatgtgatctcttcaacatctattttaaaatccttcattgtgttcccagactttttggtgaggctttatgtgcatggggccattatcctgtggcttgactctccagtctcatccctgatcaccctttcccatggatcttaaaaaaaaaaattatttcatctgaacttcatctctttcagcctcacctgaaaaaaacaggatgaaataatactttcatcatgcttggatcttcactgccttatcactaacattttccacagttcaaccttttaaaaagagttaaaaacatttgttttttctagctcctcactttctgttcacttgtaagttcaccataaaatctggatgctgtcaccaagatcataaagagcctgccacttgtcaaatttaatagggaccttgaagtgtttgtgttgcttgatgtaccagtagttaacactgttgatcactgttggttcttgaaactttcaatacctacagatttaaggacatttttctgggttttgtcttgcttgtgtgtattctcttacattttacaatggtaccaatattcttcccgagcccctctttgtgtgctaactcttaaaattgttttgttttttgccagggttctcttcttggtctccacgtatcattctcagcccagtggttctcaagtgtatttcaagccaggtacactgagggccccagtatgcaacagcaacagaagctcatatatttgcaaagctaagttggaggtgggagattttgtctaattttaaaaagcaccttagtgattttgacctgttgtctttctctgatcaagattcttaccctttctggccgatcttatccttgcttcatccttcactaccacctatgtttagatgattcacaaacttttacctctagttcttatctaatttctcagttccaagtccgtatattttcctgcctcttgccaactcaaactatatgttctaccattatgtttagcccaaactgtccaagttggaccgattattttgttttctccaaaatgtttgtcaaacagaattcctgtctctgtaattatccaagcaaaaaacctggggttcatttacctcctttccccaacatttttcaccatatccaatagatactctagccctgtcatttttttaaatttctcagtcactctcattactttacacttccctctcttctcattgatactgtcattgtttagtcttctttctaatctattatgatcattctctaattatcgtgcctacagcttgactgtctgcaatctcttccattcagatctcagagtaaattttcaaaataaaactcttatcatttcactgtctgaatcacaactcttttgaacccccaccatttacaggataaagtccaaattcctaacctgatgttagatctcctctttcagatgaataagaacagagttcactgacccattttcatttatttattcgacaaatatttattgagtatcaccaggcaatacactaaggatatggaatgaaaaaggtcagggaaaataaaataaacaaaacaaacataaattcaaagttgtaagttctatgttaaaaaaaaattaatgatgtaattgatattaactagatggctgttcttttttgttgtcttgtatgcttctcaattacagcacacagtgttcgtgttatttaaacagctgtatcctacactagattctcgatgccttaaataaagacaagtcttactgcattttcagcctcagcacttagcagtgacagcacagagtaggagcttcatcaatgttagctgaatgtactcactcaggagcatttgcaaatgttaatgttgactgactttgggatgtgtaaaatatttggcaaggtagtggggaaaggaaagagaaaaggcaaggggtgctttaccatgcaaatccattaaatagatcaggatacagtaagtagagttccaatggcaaaatatatatctctgattttataatttagtgaacaaaactcaaaaataacccattgacatagcacttttttgtccagtagaatctgcccatctgccaagtgggccttgatctttcatgcatttcatgtgctatttagctctctacttatcttcaactaccagcctcttactttatatgcttattattcagagtatgtaacattagctgctgtatagacaatccctcaaatctcagtgatttaacaaatcacaggttgatttcttgctcataccaaatctaatgtgtattagcaaggagcttagctttgtatagtcatttcaaggccaggattcttcaactgtatggctcctgtaccttttaaggccttagcatattccatcagatctcctacagtcaacagatattgggaaagatgaaagggtacccaggaatttgtggaaatcagatctagaaatggtatctatattccattacccgcattcttttggccaaaactcaataatgtagccacaactaacctcaaggagcctgggaaacaaagtctgattgtgtgtcagggaacaagggaaaaaagcatggctattgatgggcaagacttgatagagaaggagtactttgtctaagagtgattccttgcagattagccactcataaagtgccatgggtaccatctatagtcaagtgtttaagacactcaatcccggaagaattctgagctgatgaattcagttatccatccactatatcatgtgaattatatccactgggcttatttccagcccactgatcatagcacagtaggagctgggtctgctgcaaccatgcatgctgagccaatggaattaggctggaaccaaagttctgccaaatgatctaatgttgatctcaacttctgatcacatcaggaaagggacgtgtgctcaaaaattccgtagctcaaagtttagggtttcttccttggagtctgatgctggtcctgctagttgcaaggttgcagcagaggacctacattcctgctaatgctcctgcttcttttattttacccttggaaaccagacctgctgaatactgtctagccttttgtctttgtttactcaacacaggcattctctgctacaatacttatgtttaatcttgggcttccacatagtttctggtcccatgtctgtctatgtacagctaggtctgcccaacctacactttctcctcacattcagtgtccaactagtctcatacaagccccatatggccacaccacagtatcagacacttctcccaacacactccatccttttccatccagagaggcactagggctcaaacataataggctttgtgcagacaagtcccccagctgattgtttgaaattgctttgatagcttgtaatttgtgattatattttttaagctgaaagactaaaatgcctggtagttgaaaaatcatttaaaagattttacctttcactatactgctggtgcaaaaatgcattaattttaccatcagcattattaaaaataatgtcccatatttatacatttgaccatttttaaacttatttaacaaatatttactgtgtattcataatgcaccaagcactggggagcacttgggatacaaagtattttggaagataataatgaggtgcagacagtttagatgagttagctaagggagattttttttttttttaagaagaagttgcatgtaagttgtaacatgaaagataagtgtgagtttgccagagagcagggaggagggtatcctagatagaggcaagagcatgtcaaaggctatttggagaactggaagaattgaaagatggccacagtggctgagctgagtctgtaggtatggtgggggatgtatgaggggttgatgcaacatgaggctggagaaggggcaggtcttgataaacattgtcagtcatatcttaaaaatttagatttcttcttaaagaaaataaacgtctttaaaaataaagggtttaaaacaagtgtctcagataatcaaacatgatagctgcctcaagggtaatagattggcaagagacagtgtggacatagggtttcggagtctgttgcagtagcttgggtaggagagatggtatattttgtactaaggccgggacagtgaagatggtgaccattaacttatttgagatattttttggttataaaatgaatcataattaaagacaataggtcatgtaaatccttgagaaaaaaagcaccattaggaataaatttaagaattaacataaaaattggccaggcatggtggctcacatctgtaatcccagcactttgggaggccgaggcgggcagatcacttgaggtcagggggtcgagaccaacctggacaacatggtaaaaccccctctctactaaaaatacaacaattagctgagatacttgggaggctgaggcaggtgaattgcttgaatcttgtgggcagaggttgcagtgagctgagatcatgccactgaatgggcgacagagggagactgtctcaaaaaaaaaaagaaaaaaaattgtcataaaaataacgatattagaaacaaatcacagacactgtgaccctacacagctgcattattgtctattggtattgccatttttcatttaatttttgtccctatctaggaatagtcaacaattttttttttttaaatggggtctcactctgtcacccagactggagtgcagtgacacggtatcagctcatcacaacctctgcctcctgggttcaagcgatactcctgcctcagcctcctgagtagctgggattacaagcacccaccaccaggcccagctaattttggtctgtttagtagaaatggggtttcaccgtgttggtcaggctggtctcgaactcctgacctcaagtgatcctcccacctcagcctcccaaagtgctgggattacaggcatgagccaccgtgcccagctaacaattctcttaaaagagctaccatcaaaaaatctgaaaaaagcactatttaaaaaaaaaaatcacagacctgaacataatgaaatataacaaatgaatcactctgaatggtacactcccacaaaaatgccatgcctgggagtttgaaagaaaagccaaccacctgggcttgggattcaatctgtgttttcagtgacgcttgaaggtgaaactctcccttgtaactagagagttacagatccttagagaggcgcttcagtggtttcattcagcggttactgcaaaagctgtccaggtaagtcccatgacagcctcacagggtcctttgaaggatcaatcagtccacaggatcagagactactttgccctcagcattttcagaatttcagcgacagggcataatacattatttgattatcttagcttagtataacaaaatcccaagctcttcaattcctaataatatggggtttttgtttttgcattttttttttgtggtgattattacttcatagcaaacttctctctgctggtgttttgctgttttgcttatctccactggggctgggttataatagcttggagatgtttgtttcctgtttgtggaatgtctgactttccagctcactttgcccacaggtttgaggctgatagattccaggaaaataggaagaattccattcaaaataccataaaaatggagcaggctacaagacttttgagataacactactgttaaattttttaaaagaaagacattctgaacctgagagtctcttcagtttcatgaagtgtcccggcaggacgctgaaggctaccgagaaccctgactcctattaaatcagatggtaccttattgttgcgtcagagcatttttctactttctctcccttatggagctagctcaaaggtgtattttagctcctgttttctgaaagtccatgaaagagagacactatcagtttgcaacaattatcctttatgtagcacttttattttagtattctcatggagcaacaaagcagggcaccttacctgcagaaagtcaacaaaaaggaggggagatgctattgtctttgagctggggaagggttctctgttgacaagttagactccaaaaaatttgagccccggattgaggtagactaaggaaccatagtctgtcttgtgccatataagcacaaagaattttacaagaacaattcataataagctttgttaaactaaaattttatctttttgttatgatttgtagtgccattagcctaatgatgttaggtataaaactcattcattccaaaattttgtataaattatactttccttgcagctggtaaattcttaaggtgagtaatatcacttttccatctgtttctcatattcattaaataaaaactatattttgtatgcttacttacctttttttctaatgatactcacctatactcttttgcttttaatctatataatttcataacatagcatcatacagttaagaggcaggaaaaaccagtaccttggcctcaataggtaaactgtatgtttccaggacacagacattaatttgctgagttagagttcagtagtaccttattgattattatgtaaaactccttccttttaacagactaggtaacttaagtttttcatggacaaatattaattttcagccaactctgttccaaatgctatacaaatgtaagtaaggcataattcttgtcctttagtgtctaatactctgcaacaaggtttctcaacctctggctagataattctttgttgtggtacactgtcctgtgcattctagaatgttccaccacatttcttgcacctcaaaaatatctccagatttgctaacaatcccctagttgagaaccactgtactagaagcaaaaacaaaccatgcacataaagacttaaaatataagcagaaagtacaatgagacacagtagatataagcacagcctctggagtcagttggtctgaacttgaattctgcttctactaagcaggttacttaacctctccattcttcagtttcttcatctgtaaaactgggctctatgataatatctatcatatcttgagttctagtgaaaattaaaggattttatgtgtgtgtgtctatgtgattagaataggtgttcacaccacattgtcaacactgaataaatgttagctcttatttttccaataaagaaacattccacaattcaaatttaaaggaggtattttggaagtagcgggggagaatatttccagacagctgcatcttcaattaaggctttgggttagataattgctgagtcatctataactttattgatgaatgtcaatgtgaatggatgattctaatccaatctctttgtttttgaaaagtgaatggaaactgcatgaaataatttatctaataattcattaccaaggttctccctcaaatgttcacttcatccctgttgtttattatagataagaatatggaatgctcactccacaacattgtttgtgaaaatcttcagatttattttattgaacaaggtaaataatgcaattgtacccttgtcagtttcaacagagaaatcacacgtcagttgtatatgttccttcttgccttctttgatcactccctccttttcgccttccctatgtatttcattcctttcttccttctccttaccttctttcatttaacaagtgtttattgaatatctactatagccactgtgccatgtgctggggctataatttgatcaggaagcacataatcttcctcctagtcttccgcagcctgatttatatttatatattaataattaaaatagtcaaagaaacacacaatacattaatcaattcacataatcatggatttatttttccttatgtttcttcaaatctacattctaattctgttctgctattctttcttataaaaacaaacaaacaaacaaaggcttttcagtttttgatctctagatcaaaaagtaaatttctctcttgcttctcccctagcccattctgatagaaagatattcttaatgaatggagaaacatattccaaagccatgagaataagctaattttccacaggagcccaggcagtttccttcctgatcagagaggagttgcaggagtgccaggtggccagttgctgctctcttctttcccttctggaaagaacaaaacatttgtgtttctgagatagactgtccagggcatacacctggttgtgtattctcctaaaactctatctcctgatatttcagtgtaaaaaaattttcaacagaatactcagcgccaaagaaaatcttgaaaaataatgaaaatcaaactggaactagcattctatccttcactgtagtgttgtgtgtcttcacctctttgtagtgtgattatggtgccttagaaaaatacaagtaacaatacaggtaaaaatacaaggtaacattaatttttggattcattaatccagactttcaccttttttccaatacatgatgctgaggggaaagggaagaagaaaataggggagcaaacagtctaagcaagatttttttttttttttaaagtataatagccaaatttctggggggaaaaaaaagaaaaacatcagaaaaaaactaaactggcatgggttggagcctgatgaatctcagaccctggctcgggtctaagcttgcaaatgagggtgaaatagccccaaatgcgggggctaaaatggtgtgagtagaggaaaccaagccaatttttaaaatgtcctttaaaacacagcatactgctcctgtgtgccaaaaaaaaaaaaaaaaaaaaaagaaagaaaaattaaaaaagaaacccttgcaatacacttttgagtacatcttcttagttaattattttttttaagttttgtaaggcattatccctgttttatatataagaaaaccttgggccagagagttaaaatgactttgtcaggtcatataactagtcaactatagaactatagaaccaagaccctagcatttaattgtgtccattacagcccttgcttttagggggattttattcccctttctgttttctaaatctgtctttctatgatagtttccttaaaagtttagattatttcatttgtttttctttgaagcttgtaatacctaaaacccttcaatgggtcccagtcttacagctttacaagtaagcccttagcatgagataaaagctctttatgatgtaacccagtcaaaatatgtccacacgctgcagatactgcagctaaaattcacacccaagcagtctaagtgcagattctaccttccaaaccccaaaggtatcctgtcccactttgtgtcccttttcatatctctagctcagtgcctagcacatggcagcatggaacaaatccttgctatttgcacgtgtgtttgcatgaaggaagaaaggaatgattctctctggactatctatcttcccctgcccctgtctgaactctgagttttggccttgctcattctaactcatccttctaccagcccgacaccagcctgaaaagccatgctgagtggcattacatcatgctggtcaaaattcacaagttctaacttgtaaagcacatttaaaataaatagcaggaagcattgaaacttgattttaaaatgggcaaaagaataaacatttctccaaagaggatatgcaaatgatcaacaaacatatgaaaagatactcaacatcattaatcattagagaaatgcaaatctaaaccacaatgagatatcactcccacccatgaaaatggcaactatcaaaaagaaaaaaaaaaaaacccagaaaataaccagtgctggtgaggatgcagagaaattgacacctttgtacactgttggtgggaatgtaaaattgtgcagacactgtgaaaaacagtatggaagttcctcaaaaaataaaaagtagaattgtcatgtgatccagcaatctcacttctttatatttatccagaagaattgaaagcaggatcctgaagagatatttgcatacccatgctcacggcagcactgtctacaatagcgaaaaataaaagcaacccaagtttctatccatagctgaatgaataaacaaaatgtggtgtatacacataacgaaatactattcagccttaaaaaggaagaaaattctggcatgggttaaacatggatatatcttaatgacattatgctaaataaaataagacaatcacaaaaaggtaaaagttgtatgattttaattacatgaagttatctagattagtcaaattcataaaaatagaaattaaaatggtggttgtcagggactgggagtagggaaaaatggggagttatttaatgggtacagaatatggtgaagcctaaagctgtccttcaaatcacttctgtttttcatttttctactgatgttttctttctctattcccaaagccaatgttttctcagcattcccaaagccaacactggatttaagtgtgtttcttgagtgggaggatcagccagtactggtattcaccctatcaaaaaattgccacagcaggctttgccatcattccccaaaatatttatctaaccaagtccttcaggtttaaggacatttgggattttttttaaagcctaaaatgcaaatgttatcctagaagatcaagaacaactaataaccattaaccttaaaaataacaattaacacctcagtccaaatgagtttataacattttctttaatagtgaatggatcagtggttgttaaattttctgagttactagcactagagcttagggtgacattgaaggagttaaaaggtaaatgccaattcttttgaaaaaaatgtttaaaatataccattatagtcctattcatttggtattctttcagtactatttgggagtttgagtagaaatgcttatttccctgaccttgtcctatgaaagaaaatacaaacacaaagaaattaaaagttctagtggattgtgataaacaaagttccttttggtggcaccagcttacctctgacctaaaggggcacattcttccgtgccccaccatgcgtctcccaactcaatcatcagactcagttattctgaccaacgttataatatacagtatgaatcctcaactgttacaaaaatgtatttccacattgatcaaaatgtattgaaaaaaactattgcactgtttttgtatattgtttcagattccaatggaaagaactagaataaactataaattcttctaggacaaaaagaaaaaaaactctctgtcatcttctgccaccagaactctacaattcttagcacaagagagacattcaaaaactatctttagtaagataatttagtaagagtctggtaatagagaagtttaatggagagaagaggttggaaagtctattgcttgaggtggtggagactgtggtagtactgccctatggtgttgggaaccatagtttctgtgttttctgtcaaaagaactaaaaaattaagaggcgtgaggtggtttccatgaccatgtggaaagatcaaacatggaagaatatagaaaatcaactttcttttccttataatttaatttatgaacaattttcttttataaatttaagagaagcttaaatggggctctttctaacatagctttgaatgaggttccaataattaacatcagataacaagatgtgtatgagagagtttactataaacagattttacaaaggttaaaaaaaaactattgcataattcttatgtctcctcctttttttcaaggctataaaagtatttacagaggagagggaaagagagcacagtggagagatgccttgggagagagctgttactggccatggtgtcattcttcttccacaggtagtggtaccccattccatcccaagtctagtgaggagtgactacgtaatgattcagagggccatggaatgtgtgggaaatatgggctcagcttgactcatgactgccaaaggcatagtggcttcaggtagaggggtaggggtcactgccttggggagggcctgcctgcacttcagagtgctggaataaaggagcaaatatgctcccttccttgttttatgtgggagagagaaccaatgtagagcccttaagtccttctaagaaatccaactagatgggccagggatccccacaggagaagatggaaatgaatgctgtgtccctgggagctgaaaagctttcaatctaccatcataattagatgcatcggcccaggtgaaagggatttcaggagtggggtcttctgcaaatccatgaagatgactctcgagcagaaacatcaaccttagccatctgttgaaccctgaaaatgagaagcctgataaggaaggtccagttcaaataaggcttttcctctgtctccccgctgccaggatctgaatgacagacactgtctggtgagctgctgttagagggaggataaggatcacagtgtaaaagatagaaaggaaatcaggtgcctctcaagctctactcccacagccctttccctttgtctatttccagggagaagcagatccaaactgagaagggagaagatgtgatagttgatatcacaacaagcttgagttttgattaatatcttggacaggacattctatgttccaaatagagattgtgtgttacaaagtgactgcaggaccaaaaatgagtagcaaattcatgaacctcttagatttttttaatttaggacatgatgagattactgccagtgactcaacttttaaaatacaaggaataactaaataaataaagtaaaattgcacttttaattgtattttgaagacatcatgagctgtgattcattcacttcatctcatagaacttctgctggtgataattatatttaatattgttacaatcaccccttcctctcaacttgttgtgatgtatgtccccccagcctccttctgaaaggtgagttaacacagcttattagggtgttacattagaatcactgttttggaaaagccaagcatggtgtgggcttctggtgtcagatgtgaatgtgagagatgaacagccaagctctgcaaatgaaacacagcctcactcatcccccttccctcacatgcaccaccgccccatcttcaaagtcagggctgcctcagcatgtcacaggaggcaggtaatgtcatcttgtaaacaccagcgatgagcatgagccgagacccccagcagcagaggatataaaccgtcctcctgaagcaggatttaattacattctccgtcaggaaaggaagttggatttgcttcagtggaattgcattttctgcatttgggtgatttgtttatcctataaaaccatttcccagtaccactactggaatgctggcaactagaaacctgcgtggctcactctttagactgaaggacactcctgtccccgtgtttacatttctacctttcacagcctggcattccgagaggcctttgtgaaaacagcgcagagtcctcgggggaaagtgctcaagattagtgctataaattctcctccacggctctgctacttcatgttctataatattcctgaattcctgcatttctgaggtcaagggtcctgtcttgttgtccagtgtctcatactgaacaaaattctcatctgactcctttgccctattatgtttggggtgccgggctggttctctgatgatctcagtcacagcctctccatctttttcaaaaacagcaatttgtggatgagttgtgtgctggcggtattttctttaaacagttctctatgttaaaaatgttgccaatcagaatatcttcagatataacaaatgttaaagtacacaagaagtcctcggttcagggcttcaaggaactcacctggatgcaaatcaaagaatcagttgtcagcttggacaaagccaagaggtaaagaagtggacaatttggatctagtccttaaggaataaccatatggattatttcatgctcaaatgtaccccatttctatagcacttgggaaatatatgagtgtaaatgaatatttaacaactcatcgttgggaatttctgaatatcctcaaattgtagagattccagccatggggctacagacccaagctatgaatacgtgtgtttagaaaagagagcctttctgccctagtcccagccattgtttctggtggatgcagcaacatcctcctaccccctctccctgattctgtcttttgccacctttagcacattccagtggtgctcaagcagaatgactttgccccccatttggcaatgtctggagacagtttttgttgtcataactagggggtagggggtgacattatagctttattagggagaagccaggggtgctggtaaacatcctacaatgcagaggaatctctgttacaacaaggaatcatccagtccaaaatgtcagttgtgcagagaaaccctggtgtattcccacactgcagcaggaacaatccttttaacatttacagcagataatgttactcctctggtcagaacctctcagttgtttttagtgtccactggagtataagtcagagttcctcacagcttataaaggtcaagatgacctgttcctgctctccctgacttcacctcctgctgctttctttttgctcactccactccagccaggagtttctccttgttcctccaaccacttctccaatccattcatgcttctgctcaaatgtcatttccttagacaggatttccctggcaaatttatatatataaaagcaaatactccataacttttcccaaccctacaccacagggaaacacaattagatgaattattatccatagtggttaaccctgtaaaattcccaccctcccttccttccttttttccttctttcctccctccctctctcccttcctcactccctcctccctcccttccttccttctttcctccctcccttccttccttccttctttcctccctccctcccttccttccttccttccattcttccttccctgcaaataatataattaaatccaataacccaacacccaacatgaagctagaacactcacagaaacccatgtgagtatcccaagaatttctttgccactcctcattcaagacaactactaccccaaatcttgtattaacaatgttcctgacttcatttgatatatgttcacacatctatttgtatttctttaaaagtattagtttgggttgcgtgtgtttggctttatgaaaaatgtaatgttttaaatatataataacttattttgtattcctattatattgctatgatccatctgcaatgttgcatgtagttaaagtcattcattttcattgctacgtaatagtctctctttgaatatgccacacttttcttctccagcccccactatataggactgtgtttgtttctaggtgtttgccataatgaactttggaacaggttagggtttctctccatataacttatcatcacctgatattttatgtatgcactggcttatttgttgattgcctggctcctctcagtagaatgcaaaggccctgggaacagagcctctgttttccccctgatgtatcaacaaagcctaacatagtgcctgctatataataggaagtccatttatatctactctctccacctttaccctttgtcccgttgcctggcttattataatagccttctaaactgtctccctgcttcttcccttgccgcccttaaatcaactctcaacataacagccaggattattttgttaaaagttatacaagattctgtcatttttctgttcaaaaatccctagcagcctcccccatctcaaagtaaaagccaaagtccttataataaactatggctttgtaagatctggcttccttcacttctctaaacttatctcctactatctgtactccgggcacactgacctccttggtactcttgaacactctacattcacgatccctaggacctttgctcttgctgtactctttgcttggacagtttttccctcaaatatctacaaagcttttatcttacttccttcccttgtgtgctcaaaagtcacatattgaggtcttctcttttactccatgtaaaattgaaactctgtcatcatattctgtccctttacagtgctttttatccttagagctcattgctatttaacttttttttacttatatattttatttgtttatctcctcttactgaactactacctttataaagctacgattttgtattcactactgaatccttggtccctggaatatgcctggcacatacgagttgttcaattaatactgaatgaataaatgaataacggggaaagtgaacatgataagtagttgttatttatgcaaccacttatttgggcattcattagatcatagttatatttttgatggtctcgtggatatcagaatgacttaaaactttaaaaataaaatattcccaaagctactgatgcaaccatctgaaaaaatagaagatgatgtaagacatgcacatgactagagtcagaccactaactctgaagatcctaattcctgaagctagttttaaaatattaaacataatttttgctttgcataaagcaaggcacaagaattcctagagggcaaaatcagatctagacttggtgttgcatttatggaggagcgaagcacagaccccctttgctggagtttgtcacacgaggagcttctcaagactccaggggaacaatagtgcctctttgctgctggtgtggtcttgtggttcttgaggaaagcaatggttttgctaaagttattacaaatatttaaaaattattcagttctaagtttcaatgtgtgtttttaaaaattacttcactctagcttaataacatttccaaagaaatctctaagaaaaaacaagacttctggagggagctagataagaagggctgaggagaagataggtgatttccggctgccatgtcattattaaccacgaatagaagaaaagaaatgcacaaggaataaaattaatgtctttaaaagatatggatacatgttaacatcaaagaattttgagctcaggatatgtattttacaattttagctaaatcttgaattatatgaatctttaaaatgtcaagatgtggcaaataggcttcgcaatcatggtttgtcatctcgtcaatgctcttgacttttgagttttcatgtagagaagacattccttttgctatcatccttctgataaaattagctatgtgtgttgtgtagcagtatttccatccacacacaagggtgtgacttggcattctttgttacaactgctactcaaccacttatttaaaataaaagtctaaaactgaaatcctctaatgagttggaaaagttttgctttaaaaattatccttttagagtgatttccagtgccatttaggggatataaggaaggaaattccaaggtgtctgtattttatctgcaaataaaacgatcatgtgaccacatgcctgtttgatctgtgcctggtagcttagcatggctacagcaaaagacgcacttgctataatcatttcaacccccacccaacccaaatcatcaacatttctcatcaaaggagaacatttacatgctctgaaacattgaatgaaaataagtgaaaacctcttcagatatttgttttaaaaattctctgagagtacatagagtttggatcatgaaagcagaactcaattcatacttctgatccttcccggtttcacatttttaaaaaatgttatttcaccacctccatgatcagaaggcgatgagcttgctttgtttcccaactgacctattcatatcaagttagttacactcacttaagtctccccaccacctttggccaatcccacagagccctcctatggagctggaaactcatatagagacttttgttttttatagagaattcaatagctcaatgccacaagacaccctttcttattaaaacgagaaagaaatgcatggaagttgttaaaaacaaatcattttccattagtaaaagttacatgattggaaagagaagagcacattgctgtaattaccagtacattaagcaggggatgaacagctgcgtgaacttggagtcagtagaataacagccaccgagccagcttccccatatggtccaagcaaggaggtggggcttctagctgcctgggggttggggagaggtgaggagggggcaaacgaatcccattcaagtaggaaatgtaagccaagaaatgtctggcttcccaatccaaacccagatttctctgtgctgcactggaaaaatccccctggcctccataacaaaaacctctaaaatcaatgttgtcttttcctaaagagagcaaaatgtgagcgttttcagacttttggctacattgctactaatagaaaagacgacctcagaaggacttagtcacttcctcagctttttggggtgtggctatgacttggaattattggtatcacttagtaaacactgtttgatctagcatttgccttctctcccaattaaaaatagagtctggccaacaatgacaggtccccaccaccaggtattggcctcagtctgtttcagtgaaaagcattacagccttctaattggcattctcttcagaatttggcaaatttggtcaaagcagaccagcactatagtaacctttcattatcaatgcaaatcctaacagaaaagcattccattcttcttacattgtacgtcataaatgaaacacaataaattttattgtgaaacctcctaggaagacattcctgaatagacaaagcagaaaatgcttgcattatactaaacagagctaaaatttgatagttgctggaagggttggctataaggaatctagctgtttacaggggaaataccaaataggctacatcatttgcaaggagatgtttttgtaagtaccatgtccaaaaccatttgggtttcaactatatgaaggttattattgcagagaatggtgaccagctgttcttcattgcctccgaaaacagaatgagagaaaaaatggcattaaagtggaattggaagaattgaagcttcctaaaaatttgagtttgttaacaggagaaggatccacactagggagttataaaatgaatgcctttcattttctgttgcttttagaaataaaaagtggcacttttaagacaattcaggtaaaattttgtccatcaataaaatactgaatttgataatcttacaaatttctattaaaaataatttcaaaaatatttaagaaatatgactattggaaattaggctatgtctggagaataattcatccagtcatgctatggtgtcagggaatattgtaaaatgagagagtattattaaaagaatcctgtcggaaatgtgtgcatttcatgccatagatttatgcaggcatattctaggaagaaggataatgacttccctgtaaattaatattgtcttcagaaatatctaaatttacaaataaaagataaacagcctgggcacggtggctcacgcctgtaatcccaacactttgggaggcggaggagggcggatcacctgaggtcaggatcacctgagctcaagaccagcctggccaacatggtgaaaccctgtctctgctaaaaatacaaaaattagctgggtgtggtgatgcatgcctgtattcccagctacttgggagtctgaggtaggacaatcacttgaacccaggaggcagaggttgcagtgagccgggattgtgccactgcactccagcctaggtgacagagagagaattcatctcaaaaaaagaaaaaagaaaaaaaaaaaaaagaaaaacaatagtattctactcaatagaatagacacactgctatctcttagaaaattattagattgatgaatacatagatgtaaaaacatcatttggtgggtatcaggatttccactgatagttgatttgtggactctcaagaaatttatacctgtattcaaacacatactgtgatattaacttgcaggactttcttaataaaccaactgtgggaaggacacacattcctagactttcattcacagggcaaatccatcattgccagacttctgctttccatagaacactcacttttctgttttctattcaacttgaatgaaaatttctactagatctcattccaaatcctcccatgggacagagctacctttcagcaatcagtgctttaccaagggccgcactcaaatttgaacatctcagtagacatggaatcagaagcgagggattactgaatttcactctgaaagcttttcttctcagatactgtaataaaaaagcaccaccttcatctcagatgatttgcagcttttctgacagctaacgtttatctctgtgactcttgcattctagggaaaaaatacaatttgtagataactttaaatatttacctttttttttccaagcaggaagcaaagggtaaaacaaccacacacacacacacacacacacacacacacactcacacgcacacaaagtttcactacatagatacatcttgatttaaaattcctgggcacttaggctgcatgtcatggccctctgcgtgagttaagtggagtcagagatttctgccaagttatagagctggttacttacttcaggaaatattcagttatttcatttgaagtatgaaattgcaggagcatccaaaagtttaccagggtctaaaactacaagtgagcttgttatttgtctctactctttatccttctatggagtagttccaagggatcctttgaaccagctgcccagttttcatccctgtaaataaatttttcttcacacagtacagggtcaacttctgaagaagagaccgtttatcatggtagttaaaagcacagactcaacccagactgaatgggctctaatttcagttttgcctcttaacagctgtgtgccctttgggtaagatacttaacctctctgagcctcagtttcttcccctgtaaaactgggatttaatagcatctttcttaattggttgttttgaggattttaaaaagtactcagaatcttaccagactgtttgcccacagctcagtaaatatgcacagaggttgagaacagaaggaatgaaacagatcagcccagaaagaccacatgatcaaaaatcaccactttccatacagtaagacaaatacaatactctttaatatttatcttggtgcagcagtgtattaagcctgattttattttgaagcagaggtaaaacttattttacttgcagatataaaacattgcataaaactgttcatgatgaccagttgctgggaagtggggaggatgtcatactagtaattgtccacactgtctacttatcttgtgcctcttctgaacacagtagtaataaatagatgggaaagaaaaaattacatgaaaggtctgatgagtccattgtaaccaatttgtactatgtccaagagaatgagtccctaaagtttggacccttctttatccttcattcgttgaccccttcccagagtttagaggctgtctttatcctcccaaacctttcaagaccaattatcagtatgattttcttcacttctcacatatttattcaatcattcatttaaccaaaattagttgagcacctacagagtcttggactctgcaagacagagcaggggaggaagtttgggagggaaaggtgtgaagaaagccttagatgcacaaaggtgagtaagatacagttctcaccttcaaggaactcatggcctatgtataaaacaaacactccaaagccaacaaagattagaagaaagatcacacgacgcattataaaatggggtgtgggcaagaaaccaagtaggaaggaagtagccagctctgcttagaaaaggtgggaagttatctcaaataagaaggtgcttgatttttagggctacaagaaaagttgtgattcactgggtgacgacagggaaaagaagaggccaggaagcagctcgggcagaggaaatgtcacatgcaaagacaccaaggcctggaagaacatcaaatgaatattgcatgccttatcatgtttacggttggaatgtagtttgtgttgggcagaactggatttgcaaacatagcaatggcccaggtctcttcagagagtcacaagtaatggtaaggtaggaggccacttatgaagtctgctcatctgatttcctgcctgaaggaagggaggaagagtccatagatgcaacagccttcaggcatttaaatgaagaacgtgctgattttctttaaaaatcagcttctgggaattctggaagatagggagctggatattatctcctgttttgcctatgtcacatccaaacatcttaaaagagacaattcttaatgttacaaagaaattatatgaactcatagtcactttgttaatatcatagtttctctggatatatagcatttacttacacattacctaaatcaaataaattaatatattgtgctaatgacatagaaatttgcattaaatagcctttggtctaataaatattgctatccacctcaaatcctgccagtcaactatcctgaaagagagacactgtaataaaataatgaaatcagccttttgcacttgtgactgtgtcaaactaaatgcaagacatatctccagagctggaaaattatattctcatttatttaataaatagttactgctgacagaggtatcacaaggttgggtcagaagacacttttcctgtcctctcggagtttacaggataatggatttaaatgaaaaataatggaaagaaaagaaaggcccttgaacagatgtcactgatgcctctgcatatcactgaagctcctatctgagcaggcatttaagaagctgggccttgaagaaggaaagatggaagcacattcaggcatagaaaaagcaataagccaagcctatgcaaatagacccagagggttggaggttgtttctgaaacaatgttgaggccactcaaagaggcctttttacggctaaatttcagatcaggaagacaaacaaactcatgcaacttagaaggagagttgcccagttaggagaggtaagagtggaacatggtgatctctaccagatagaccacatcttggactctcacgcatcctgtaagctccttctccaatgaaaatcataggactcttcaaagtcatatttgaaacaacagcaaagtctgcagtaaacactgtgatatttgatcctgttccatctacataatagagctataaaaaatgatctggattaggcctaccaactttaaatctgataggactcaatcagtgcaggttttcatggctctgctatatggatgaaaaagggacaatgatcatagcatttacttttcttctccagtttctcagaaagcagcatgagtcagccttcttcaaagagcgaagatggaatctgagttggtaaacacattgtgtggtggacttttgagcggcactgtgcctcttcttgcccatcaatagagggcaaacaaaaacaacaacaaaaagaatgtgtgctaaatctggaagtattgttcatgaagctaaactaccaagcaggtgaagcaccttaatcccagactccaccacctataaaatctgcccaattccttcagcatttgtgaacaacactgtaagaggaattcttaggacaaataaatgggggtggtgtgaattaaaagagaataacacctgtctctgcagctggtcaacagacctcactttaatgtgctgtctactgggaaatggaggcgtctcatgttacccggaggccttggcctacactggagtctgcagaaaggaattctgtgaccagaagatgtgaggcttggtccgtggccaaaaacaatggtgaaaggtacaaaatgaaaagttctgtcaggacaaaagcactcaatcacagaacaacacacaacttggctgtttgaagaaatgaaccccaaaccaaagtcacaactggattaacaactggttgatccccttttaccttctaatgcttctctggctgtcggacacttattgaaataggaatgaagagattacagccgccagcagcatacagtgtcttcatttagggctggttctggctggtcacggaaaagcaacttgcaagatttatgcttctctgccttctatccatatttttttccattaaagggggaatttagagcaaagttaccaatgtaactccaacccagtgctggagaagtcctcgctgacttgcaaaataactgtggcttcagcagaattgggtgcccaatggtaacagaggtgaagcccataaaaatggtgtgcacatattttaaaacaggagaaaagaccctattattcagtccacattggctctagtggttggtttgtcccatagaacacatctaagtttgaataatgggaacaaataaagtaaaaatggattgctctttccaagaaatatataaaagggtttatatctgtacatgtagagaaagatgtttatgtaatgtataggccacagatcagagaagctattaaagttctttgaagaaatctggactatgaaaggaccaaaagttaaagaagaaaagagctgctggtggttttaggtcacagggacttgaacgtccatcataggcctgggagtgaagacaggcttgtgtggttaaagcgtgggcccatgacttctacgggccaggaagagactgttgctttctcccctagacactgatgcctggaaatcctctaatagggatagagctatacacatacctatcagagcctggaaaaaatgcagaaatgttagaaaggtacccgtaaataaaaatcacaatgagccctaactgactgaaattgatctgaagtacagagaagggtggtacaggaaatcaggaatgcctcagcctcatgaaagaatggagctttaagagggcacctcagagtggggtccatgaagcaggaagtgaagctgtagacacaaacatcaaggtttttctctttgactttggatggatgtgggttctgacagtaacagacagaatttattgggtcaacactacatgaattgagaaggaggcctgcactcaaagaggaatcaggtgccccaggtgtccagtcccaaatattttggcagtgaatttagacaaaggaaaaaaatattatttattcatggagaactctcaatgaactgttttcaaatgccaaaatatctattgctactttctattgtaaaaagatataagcaaaatttcactgttagcttgaaaaactgatttcacttcattacagttttgcttaatattagcctaaagacattaatgacagagaactcattcattaaaatacatgattataattctaacaagaaaacaagtatttgtttttcaacgacactctcctccttgtgtaacacttgaggatatttaaaccattttaataactctctttctcattcacacgcatgcacacacactctaaaatacagaatataaattctgttcatgtctccttttgcatctgtgaggataccctacccccaccatcataagaaataaagtttactccttactctgcttccataaatatactcaaagaaaaaaaaaacactctattatattagcaccgattctactgactgagatattgatcagcttgggcattttcattgagtttgaaaatgcagcattataagtctacctaattgatgaattacagctacgcatttgatatacgtcatttactatatgctctgtctggtgggaagaggaatggggtcaaataacaattaaagcatgggcactttcaagagttcttagcactttccagtattacttattttcatcaattcttctgccaagtatcagtttgctcatagaaaggcagtattttggaaagaaagaaaaaagttcagaaattcatgatttctttaaggctaagcctactttgtaaagtcacatatttctcactggtattcagatttcattacattcaaggaccctgataattcatttgagacttgagaattgatacatatttcaaatatttccctactacagagaaaacatgtcacaaattcaacatcgcattggcaataatcagctgaaagtatcaaacatgactcttccaggtttgagaccatacaaataaaattacatttttaaaaggcataatatcagcaggaaacataaacctcatttagtcacaagcttagaatttatttccttaggaccaaaattttatgacttactcagctccaatatgtccttgaaggtgaagattgcaaagtagaccatcacccctaatagcaagtcacttatttgttttatcgatatagctgactgtctaaagcagacctaatttacaggcagacccaagattactgtgcatttttcagaatgctgcccacagactatagtcacaaaatattaagtattgagtctaacttgctcccccctattcaagaaagtattcactaggtctttctcacatacaaagactagaggtccaacttcagagctatacctgaagaggtattcatactatgaaacggagcaaaagtgatttcacctgtctcatagattttttttcccctgtgaaaatgtagttctccctcttgaaaaactaagtctgaactttcaaaataatttattgtgatcaggcaaaccatggcacgtaaacacttcaattccataaacaaggattaaacacctcatctcaccagataaaatcatggatacaaacaggggaagacagagctacgtaagtaactgtgaagcaaaaatgttttaaatgctttttgaatttatacaaataaatttgaatttataaaagcatttatcgttctgagaacccagaagaatgataattctctgttgaagtgaggatgtttttaggaggaagtaacatttgacctgcctcttgaaaatgaatagaacttcaacaaagtggagatagaagagggtctgtgccaaccctcaatggcagggagcccaagataatcgcacttgaaaggaagccttgctgctgccatcttttataggatactttgcacatcaatagaggcagaaatgtcaaagttgccttgtaataatgctccaagagaggagtaaagtgtagtggcccgtggtctctgtaactccctacatccagtgccaaaggcaagggtagggctgctgccaaggtggcccatccaaggggtggacctaacaataggtaaatgaagaaagcaacgtagcttccatctcacccttccactgaaagtgctctcaccaaactcacaaattatatcctcaagactaactccaatttcttaaaatgtaactcccatttctaccattggctgcatttgacatttccaactttttctaatttcaatggcttctctgagtttcctaggaccacctagtcctcttcttttgacaatgcttaaaatattggcatttctgcaggtcctgtcttagatactgtactcactctacagaccctctctgagtgatctcatctccttccataactacagctaaacctatatgctaatgaatctcaaatctgcatcttcattcctgatctcttttctgagctccaggcagtataacccctacccattggcaccggccatcatccattctacttaattttgtatcattgacaataaagcaatcatgaaatcattttgtatgcctgttttctaagtcagttcacatttctctgttcatgtaacaaagaatctgcttttaagaattttagcaacagtttctaaacattttcagttcctctggtcctgcctttccattttatccttcacactgcaaccagaataattcttcccaatagaaataggatttttttttttttttttgagacggagtgcagtgtcatggtcttagctcactgcaacctccacagtttttgtcttattattctttatatctttggtacatagcctagaatccagcatagagcaagtgtttaattattataagcatgaggcaaggtgccttattgtatatacttcagaatcctgtatttcctctagcatagcatctaacacactatattttattatttttctgcactaggactgtgaaaattacgagaagttttcatcttattcatctttatatctttggtacatagcatagaatccagcttagagcaagtgcttaatcattatttctaaatagataacatggagttgtgcaggtcaacttccagaactgttaggcttttccccatttccccatactctctggtaaccaccaatctattctctattttcaccaccataagatccactttttggctcccacatatgaatgagaacaatctttgtctttctggcttgacttatttcatgtaacataatggcctccagttccatctgtgttgctgcaaatgacaggatttcgttcttcttaatggctgaataatattccattgtgtgtatgtatcacattttctttatccattaatccattaatgggcactgaggttgattccatattttagctattgtgaatgatgctgcaataaacatgggagtgcagatttctctacaactagtgttttaataattttgaggtatggttggaaaaatgaagtctggaaaaagagattgatccaaaatatgataatgctaatccatgaactaaggagggttttacaatttttaaaacatattttaatcttattttattagcaatctgagaagaaagcagatttgtgtgtaggaaaatggtgtagacagacctaagcttttagaaagagtaatgatggcaacatagagaatggactggagacaagagacaccaatgaggcatctagttaaaaaccttaaaagagagattgtggaccagtgtcatgacaacaggaacaaaaaagaggaaacggctatatggagataggattggaagtactgagagatcacctgggtatggaagatgaggaaaaaagactattttaagatgagtttaaggctccaaaacatgatcaatatgggggacacaagagaataggtcattcaagaaaggaacaagataaggatttattaagtcccttttcatactttctcaattcaagagatgtccaacaggtcattagaaatatagatctgggctgggtgtggtggctcactcctgtaatcccagcactttgggaggctgagacaggtggatcacgaggtcaggagttcaagaccagcctggccaagatggtgaaactccacctcttctaaaaactacaaaaaaatagccaggcatggtggcaggtgcctgtaatcccagctactcaggaggctgaggcaggagaattgcttgaacccaggccgaagagattgcagtgagttgagttcatgccactgcactccagccttagtgacagagcaagactatgtctcaaaaaaaatagatagatagatagatagatagatagatagatagatagatagatctgaaatgtagaagaggaaaagagataagttttaaaatatgcatttgggttctatcgataaagaagagatgattgaagctacaacataagaaaaaaaatgagaaaaggaaagtggattgttcctttaggacattcctgcatatgaggaaaacagaagaggaataagtggaaaagtaggagaaggaatgttagtagatacaggaggaaaagtaaaatggtgcactgtagattaacaacattaaaaagattttcagagaagagaaatgtgcattaagcacaattacttcagagggattgtataggataaggacaatacaatccttgactttaaagtcagcagagtattggttacttagagacagcaatttcaattatgtgctgctatttgaaatgacattacaatagactgaagaagtagaaggtgacataattgaagcagcagatgtagcctactcttctttcttttgtggatgataaaagaaagaaaagagatgagagtagaatcaaggaaagactttaaaaacacttgaaaaggaagaacacatttggaagctgaagggaaatatctaatggaggtggacaatagcaagggataatttcagaagccagatcttaggagagaagagatgggcctgaaatgagtctcctatggaggaaaagaacatggagcaaagaagcgaataaaataactcaatctgtagttatatgtcataggagttgaagtaaaagtgagaggcagagaaactttcactcttccaggataaacagaaattttacacatgtgagaattagcattccagggagaagtattgatacttagcaaaaacataaaagcaaggaacatcatgttgggcatgataattataagtgggtcagtgtggatgctgattaagtgcaaagtagatggtaaaaagagaaaacataaagcatgatagggatcaagttatattggagctgttagtaagcatggacttcagtcttgtaggtaagaggaaattcttgaaaaggcttaggcagtggattagtccattttcacactgctataaagatactacctgagactgagtaacttataaggaaaagaggtttaattgactcacagttccacatggctggggaggcctcaggaaacttataatcatggcagaaggcaacagggaaacaaggcacattttacgtggtagcaggagagagagcaaagggggtagtgtcatgtttttaaaccttcagatctcatgagaactcactcactatcatgagaacagcgagggataaattcgcccctatgatccagtcacctcccaccaggcccctcatctgacatgtggggattacaattcgagatgagatttgggtggggacacagagccaaaccatatcagcaagggagttacatagacaattatatgctgggaagatattactctggcagctatggggaggagggattgaacaagtataggaagagcacatatccaattataagtctgcatagtagtctaaaaagaagcaatacagaatagaatggcacaacagagtcaacaaatatttggggaaaaatccataagactttgtgattgattagggattctgaaaatgtgagaaatcaagaaaaatcttgagtttctatttcagattattagacagaattttgtttcacaaactaaaggaacagaagagcaaatcaggtcttagagggcaaagatgagttcagttttgagaatgttggattggaaattctttttgggcttttggatgaaaaagtttaataggctgttggtttataagtctaagatttataaaagtgggtaagatcacagagataagtaagttggtaggctaagaatgtaacccaagaaacactacaaattaaagagagtaaacagagggaaattagacagaggattggtcagagagagagagggaaatcaggagcatgggaggtctaacaacccaattcgtgtagaaagatctcccagacaaggacataattcacagtatcaaacagcagttgtgccaagtaagctaagctccaaaaagggcccattggatttgacaaattgaacgtcattttgggtttgggcaagagtagtttcagaggaatagtgaaagcacaagccagattacagtggaccgagaagtaaacaagacataagaaaatgacatagtgggacaataagattagattgtcttagggattctgtgtgtgggacagacccacaagaagatgaagcctgaatagcctttgaggaaggattagatatcttctaggtggactgaagagaaggctttacagtggagaacacaaacaaagcacagaggcgttacacagcttggtttgctgcaacaacccaagaagtttagcgttgtcaaggcattaatgtgaagggaatgggtgagtagaacaagagatatcctgtggaacagagacaggaatcagatcagaaaagcctttcatgctatgctaaggaaaaggaattttatcctgaggcaatcgggggacactgaaagactttaatcattctatttgtgacttcaccagcagaataaggaatgagacaaggctgggggcagggtgagcagagcagaaacacagatttcagtagcagaggagggacatgaccacacgaatcaatgggagaaacaggatagagtaagaattaccaagagttggtgactaagtcacataaagaacaaagtttggaagtaggaatcaaagaaaatactactatttctggtttagctgattgaggagaggggaattaccaccaataatgaaagtgaacagatagggagattgagtttggagcatgataaatcattatttcagtttggaacattttacatttgagattcctcttaatatttaaacggaaaaatccaggaaagtctttggacctggtatacctagtgtattggacaggtcatggaaatttagagcttgagataaaagataactcgaaatcagggtggaggtctgggatttaattcactgccttgaggagcttcccagagaaaaaggatggcaatgcttaactactctggacacagttgaagctagttcaaactccctctacagggctgaagaagtggttctagaaactgaatcttcaatagtgggttgggggagatggaatgagatcaactgtgggttggagtaattgaaagacttggaatcaaatagtaactaatcagtccttaaaatctctcttgctctactccctgtggctacttacaacaagggtgtaggaattggattgtgaacctgaacccagagcctttgggaactccatagaaacagaggactaagggacaccttgaggagatagccagtagagaagaaggtctcatcatcacaatgtattgccaaagcagcctaagattaatctacttgccatcaccaaggcaaagcaggtcattctgcccttgcgtttccacatagcctccttatgccatgctgtgaccctgatattcatattaccctgatttcaactgcacactcattttgggaatgaaagactcatttcatgagttggcttttacaccattatttctctttccccatggcttttccaggtcagtgtgaaccctatggtgaatcttcagatagagggtataatttacttggagcctagggattgagcaagaaagcaacctcttctccatttcaaacacaagtgtcattttgctccagaataactcaaggcaatttctcatgtgtttttctccaggcatcactctatccacataccctggtagcatttccagtgggaatttcagagaccgtaagttgcagtcagacagtaatttttcatttagaaggatgagaatcactgaaagattttgggccataaaagaccaaagaacaaacaagggtcatatgactgaagtaagaatgtcccagggagatgttttaggtcactgagcagaatgaaattcattttaggtttaagctctttgccttatcttggcattacctttataattaaaataataatagaaaaagaaatcatgaaaaagatattgtcaggatatgatagcagttgatgaaaccaagctcacctatgctttcacttgttttaatacaacatttaatgtatgtacccaaagaacatcaccgtattttatactaagcatggcgatatgaaattttacaaacttaaaacacaataactataattctggcaagatctaaaatttatcattgccaaatactttccactctaacctcatttcttctcggttgaaatttgtacaaatgctttctctctctaaggggcaggggtttctctgctcagaggtgagatgaatgtctaaaaagataatttgaagtcttctgagccactttttagtcataagcacaaaaaacaatcacccatattgaacctttaaaatataaagattcttgaactttaaacacaaatatcaatgatgtgggaattattttattcttcatataaaattttagaagttttaagaatggctcaaaattatgttagaatattagatgtagttaggataactgagtttaattttaaacagtttatagagattggtatgtacatacacttagcaaaaagaatcctgtgtgaaacatattttagtagatcaaaatttcaataaagttaaaaaataaaaatactaaattagactagcaattttcattatgttattttatacatgtacagatttttccatgtcaaattattttaggaaccttatccagaaatcagaagtctctgacttcactttaatctggcctgcttctcatcagaagtaactactgacaattctttagtcaggtatatgcttccacaattctaaataacatacttttcctgttacctcttcacttataatttttaggcattatctattgaatttctaaagagaacaaaaagcacccttaacatccctcatcctcaaatccctttctctacattctccagcagttatgtcatacttttgtgatgatcatttgaagcatgatttacttcattttttctgctgctaataatcatatctatttgtttgcgttcatgactttttatcattgtaattaatgcttcctaagctctccaaatgaattaaaaacacccatgaattcaccttgtcacattgccaagcacatccaggaagctaacagttcaattttcttttttccttctagcctattcctggtcctctggaaattgcctccttgcccaatctggaaattgctctatgtctactcaacagttgctgaagttgagtagttcagcagtgaagttctataacttcacttactctgaattctcttaggtctggtctttcttgttcttcctttgcctccttgtcttggtggagtacatcgtctaatacagtgccatgcagactagagagtctgcaagccatttctggtgcacagactatcatcgttctgtgatgagagggatccagaaatcaataggaagcattcgaaggcttttataatactttgatagtgctactccatgcacacatttgatcaagggccatgttcacaattagcacatagcaaattctaacttggaacaaatcaacccagcgagtattttttttaaaactttttagtacaagttgagtattggtcatatatggctaatgtagtaattattttaaaatgtgtaaaaattaaagaaagctttttcattgcagaaaataatttacctaggtttgcagtctagagtataaactataaaatattacactttgtatcaatatgtctatcaataacataacatcttttactcaaaaagtcttattttttactcaaaaagctatcagctgtaaggctaatgtattatattcagcttattctattaattatggaacaataaggaaagtaattgcaaacagcttttttgtatgctgaagtaaaatggttatcaaggggaaaaactcactctagactaaattgaaatagggaatcaactctggtgctcctgaaaaataagaaatttgttgggtcccccaaatttaaagacaaaaattgaacacaaattttacaaatttgcttatgtgtttaatatcactgatatttctaattatctgactactatgtgaagaaggaatgcaacatacttttcagtggtaaatcaaattgaaaggcaatggaaaaatttacaagttagagaatttttgcaggctgttatgatatatacttcataatttaacacaattttccataaagtagaaggtaatcttgatattatacgtctgaaaaagttaaaactgaacacctcacaaatttgatagaacattttaatctctattttatatcacaaaaaaggcaacaggacattcatgagctagaaccttgttatttcattggaaacaaaacgtttatattttaaggcatagattgttgcaactttctattggtgaaagattgaaaatgattgttgaaattgtagcatcatttgcttcattttaaataaaaggtaaaactgaatatcctgagcatgctgaaactgctttgaaatttcttctttagtttttgtcacatattctggaaaactggtttttctattatgaatgtaattttttaaaaagatagaaacattttagatatacatctttccctagaatactgttgtaatcagtgcaacctagaatggatacattaacaagcaaaaagcaagcacatctgtggcattacaaacattaaatatttatatacatagtgttcatttcattctaaatacagatgtttaaaataagggattactatttcagtaataactgtaagttacaaatgtggagcaactacaattttcaagtgtaataaccaggaagtgttatgtttccagctttgttctttcttaagatagctttgactactctgggccttttgtgattccaccatatgaattttagaattgtttttttctatttctgtgaaaaacactattgggattttcatagagattacattgaatttagagactgttttgtgtagtatagacattttaaaaatgtaaattcttccaatctatgaacatgggatctcttcccatttgtttgtgtcttcaatttctttcaacaatgctttagtttgtagtgtacagatctttcaacttcttggttcaattttttcctaagtattttactctttttaatgctactgttaatgtttttttaatatcgttttcccttagtatatagaaatgcaactgatgttgacatgttgtttttctatcctgcaacttcactgaatttgttagttcattttttaaatgaggtctctttaggtctttctatacaaaagaccatgtcatgtacagagacaatgttcatcctttctgatttcaatgccttttatttcttgcctactctggctagacttccagtgctatgttgaatggaagcgatgagagtagacatccttgtcttgttcctgatcttagaaaaaaagctttcatcttttcaacattgggtatcatgtgagttatgggcttgtcatataaggcctttattatgttgtggtaattctttccatccccaatttgctgagactttttgttatgaaaggatgctgcattcagtcaaatgctgcttctgcgtttattaaaatgatcacatgatttttaaaattcattctgttaatatggtatattacatctattgatttgcatttgttgaattatctttgcaaaccagagataaattcaatttgatcatgatgtatgatcctttcagtgtgctgttgaatgcagtttgctagtattttgtagagaattttggatctacatttatcagagatgttggcctgtaattttcttttcttgtagtgtccttgtctggccttggtatcagtgtaatgctggcctcataaaatgagtttggaagtgttccctcctcttcagttttttggaagagtttgacaaggatttggtgttaattcttttttaaatttttggtacaattcgtcagtgaagccatctggtcctggttttttgttgttgttgttgggaggtttttgattaccgatttaatccccttacttgttactgaactattcagattttctatttcttcaatattcagacttagtaggtttctagaaatttttcatttcttctaggtcatcgaatttgctggtgcaaaattgttcatagtcctacaatccttgggatttgggggctatcagttgtaatatctcctcttccttttataattgtttttacttgagccctgtcccttttttcttggtagtctaactacaggtttgtttatcttttcaaataaccaactcttcatttggctgatcttttctattgtcttttaattttctatttcattaatttctactcaatccttattttttcctttcttctgctacctttgagattagtttatttttttactagctccttgagatataaaactagactgtttatttgagatttttctgcatttcttaatataggcatttgtggttttaagctttccttttataactgctattgctgcattgaacaactttaatatgctgtgtttccattttcatttttttcaaaatatttttaaatttccattttgatctcttcttttactctttgattgttctggagtgtgtttaatttccacacatatgtgaatttttcaattttcctcctgttattaatttacactcactttcaatgaacaacacatacagatgttgagatccttttttcccgatgttaggtttgttcagatcatatttattggaatgtaatttaatgtgtgtgcttatgtcttaataaaactttaatttttccagtaattcattttttactgaatttcacaaaagaatcttatatttgaggcactgctgtaataattttcatggaacagagggagaaaggatgatggagggatggcaggtgagatcgcatgaaattaagtgaatttttggagactgcagttctgaaaatacctctactctatcctcttactgtcttgatatttgtcaaggtacagaattctaggagaaaataatttttcttgaagattttgaagtgattgttttatttatttatttcgtatttttcccccctatggtgctcttaaaaaatctaaagacagtctgattctgagcttatatatttccttgttatttatgtcttctttttctttctttgaaaatgtttaaaatctctattctaaaatttcataatgatgtgcactggagtgggctttttaaaattcactgtgcaaatcaattggtggatcttttcattccagaaatgcatgttccttgtttatagtttctacctgcctgtttgaatctttgaatcttttacatcacaaactcccaacatatgtttgatgatatttagctatccagtcacatttgagaggcagagatttttaaaaatttgattcaatggtttaaaactatctcagcatcctaggaacctaatggactatcctaaatctaataatatctattttaaaacctaagcaaactttatacttattgataaaatattgcaaatattccccttgatattgagaatgagacaaggacgccgattgtcaccacttctattcaaaaatatgctacaggctctgggcagtgcaaaaagacaagaataccaaaccaaagtcatggggactagaaatgaagaaataaaataaagccatgattattcatgcataacatggatgtgtaaattaaaaagattaagtgaatcttcagacaaacacctaaaataaataagtaaatctactaagatactagatacaaggtcaatataaaaaagcacaatgtatctctatataccacacggaaaaactaaaaaatgatatttaaaatttaaaaaattcataaaaacttaaaaaaattgactggaaataaatttaagaaaaggtatgtgggattccctcactggaaattataaaacattattgtgagaaattaatgaagtcccatataagtggagtgatattctatgttcttggattggaaaactcaatgttgtaaaggtccaaatataactagggccatccagaaaagaacaaatttagtagactaacactactatgcattgataattattttaaagctgtctatttacttaatttataataattaagacaatgtagcactgaaacaaggctagacagactaatggaacagaacagagtcctaagacagacttgtagctatatgtcaccttaattattacaaaggtgacacagcagaacagtgggaaggggttggcattaatttaaaaataatggtgcaccaactggatatacttactgggaaaaaacatgtcttcaccctctagtcttatatcataaacaaaaatgcaattctagattgttttgtgaaaatctcataagaacataaattgaaaattctaaaaccaacttaattttacatattgttgacagtaacaaaaacacttttacatattatttcattttatttttatgcaaacccagcgagggatgtatcgtagctattcttatctccattccacaaatgaggaaactaaattttaaggaagacacttgttgaaaattagtcttaaatgaatgaaaaagagtgtcaccctgtccaatcgcaataagcttagagaaaaagagaaaccagcagattcaaataatttgcctacatctaaaccctgtgcttccatttcttctttcgtagtatgttgaaaaaggttataatagaaatagtatgataaatgtgaacatgtctcctataatgcctcccacttagcagccacttaataaatgtcctcatctgatcttagcccatcctgaagtccggtggccagtcaggagtttagatagccccagaaaaaatgtctccagtgcaaggcaacattccctgctgcttctgataaatgatactgataaggctcaagaaactatttttagtgaaattggccacctgtgcaacgtgaaacttgtcacttatcaagcagcaaaatggaaagttgttagaaggtgacaggatattttatagaaccaaatgttccaattttcaacacatttcacaaagtgttttcttcaggtgtcttcatttttttgtgtgtctgggtctaatttttaaaaaatgtgtccttgtcgcttttgctctggcttagacttcagagcttctcagcttcctctcctgaccttccagtgacagcgtcatcattgtcctaagactgtgattaggactcgtgatgtttgcatgacagaccatcccaggggagggacgctcacttgttccagagcatttattctacttcagtgaacatgaccaagaatgacttcagagcagagctgaccattacctagaagtgttgacttatttttaaatgggagggaaaaaaagaaagcttttttccccttaaactcatcacatgaaaatcgtctgtatacagataagtctggggcattttctggagatgtatagatcataaaatcattaaatttaaagattgcaaatgactttaagaaatttctagttcaaatttgcaaactcaaatgcctatgagagccaaacaagtgacatgagtgaagccaagtgtgtgacaatcacagctttctgggagttgttgtgcacaaaatgcccagcatagccttctttattaacagaaatcttatttcacttaacacaactacttagttaaaatattcccctcttgcagctatggcagtcatgtgacatggtcctgaccaatttaggagtctgcagggtagacctacttggaaaacagtggttttccagacagaaaggacagacccagcaggcacatggcttttgccttttgcccgtttttatctagaatatagttatgacgcccggaagcagggcagccatattgtagacttggggccaaaagccagaaacaaacacaggcaacaaatagtttttcagtatttactatgtggcaagcactaaggagacagcagaactctattctgatagaccttcaattccaagggttagtgaggaacagtcaataagaatgccaggtactgagttctttgaagaaacaaaaagtgagatgagagggtagaaattgatgtgggtgtgatagtaagttaggtaggtgggaacaggggaaaatctctctgatagggtggcgtttgaagcagagactccttaagatgtggcaaagatccccgggcctgtattcctgacagctctgaggaaaacaggggttgtgactcactatgtttgagaaaccctgaataaaacacccttgaataccctgaatggggaggaagtcatagtgtatactagtatataaaagactctaagtcatgctgaggagaaaaaaacatatttgactttgtttaatatagaatttcccagagattcattggccctagaacactttgttggggataggtctaccagtcacctctggagaagttccaagtcatagtctttgggaaatgctgcctatgattagcataggagggaaacaatcactattgctgaggccctctcaggaattaagtgaagctgactgatttgtttttaagttcttatacataaacatttttattcaaataaagttaaggtcccatttcatggagttccgttatttagcaaacaaaaataggcaaaccaagaaaaaaaaattaaatgaaagctagtgatactgtggtaaatgtaagacatgtacggagttaatcatggtaggaaaaaaaaactactaaaatgtctaatatttcagggagaataatactgctccctaattgtccacaaatattctgcattcatatcctccactgcattttctattcttccaattttcaggggaagatcgacaggtttgactacataaaaagtacaatttctccatgatgaaatgcattttaaataaagtcaaatgacaatatggggaatcatttgcaacatgtttgaaagataaaggcctaatacctttagtatgaaaatatacttttataaatcagtttgtaaaaatataaacccagattagaaagaaaaacggcctacaaatataaatattcaatccacacaggaaaatataagtatcctataaacacaaggcaaaatttcaaactcactagtaattaaatataacatttttaagatgagatattaattttagtccatcagattgccaatgatgacaaagaagaattatgtctagtgtgggtaaagatctatattttctcatttgtctctaaacatgtgttctttatatatatatacacacacacacacatatacatatatgtgtgtattcatatagctttttaaatatgtgaatattataaaacgtaaacaccagcaaaatctataaatgtttataggaaattagaactaatgaattagcacctttgacattaaaaagtgatttttttgcattcagataacctgtccatccatatgaaaaaaaaaaaaaagattgttgaatacaagagcaagaactgtaaattttccagtgaattttgtttgcttatggagccaaggtcaatgggagtaaagtgattaaaaaccatgcccaggaaatgattcttctgttcaatatgcactaagggagcataatagtggatttaaattcacctatatctttatatttatttcagtaccagacttttctgactaccatggcttttcaatgaattttaaaatttccttcaacattcatatttttcagatgtttctgtataatcagatattttcttttccacatcaactttagaatctgttgatcacattctagaaaataaacaaaatatctttagattttcattaggattgacttaacatagattcattaaaaaatttgacatctttggaaaaccgactgtccatattttaagtcttattttatgtacttcaagaaaatatttatagttttattcacgaaggtgtcatgtgtttcttgctcttcttagaacattttatttttgtttccaatatatttcaatggattattgtcaaaataaaaatagttttgtaaattaatttttaaatggcttatttttgctgaactctgagtagttctaacacccctccctccacctggttgtcttgggatctatagacatagaatcaaaaaataaaatactgacaattgtaccttatttttttctgtccttataccacttcctttttttattcttttttaatggactggtgagcttttgaagaatgatgttaaaaaacgatgatgagagtaaattcacattttgttctttattttataataatccttctagtgtgatgtaagacattagttgaattttattagttttatcctattaagaaaaatagaccactttaataagtttcaactgaaatggttatgaaattttatcaaatttctttattgagttacatatttttcttcttcatcctattaatatgatgagttatgtaagtagataagcagatttcctaatagtaaaacatttttgcattcttgaatgaactttacataatcatattttatgctatttcagtgtaatactgtattataatttctacaggtatattaatattagaatatatgttccttgcattgtttatacagcactgtgtttaaatgcccagaatgttgtatggaatactaaatgatttttttttttaatgatgcttataatgaaacttcgggacattgaaagatttaccctggtaagatcataaattggcagtagcatctttttctatcggcaagttcctataagtcttggttcatgcctttgctctctgaccacacatttcagatggagtctctgtaatacaaattaatcatgtatttaggataatgcgagatctcctagatatcaatgaactattcaattgatactgatcttttccttcccaaattatcttggaagctgccagcaataaatttaaaggagaacacagtggagctattgctcaatatagacacatataaacattttttacaaactattctgaacaatgaagaaaagaaagttggcagacaaccaaggcattgtgttccagagccaagaatgtgattctggaacttttccattgtgaatttcacttcagagtaatttgtactatttggaaagcagaccataaaactctatgtgggaacaggttatttgaggtaattcctctgtcaaatgagaacaatattaataatcttaggcccataggaggtcatgtattactagttattaaggctaatacaaaagtaaaaggttgtttcacatttctgtgtatttgtgtatattgtatatgtgtacatacgtgtttatatatgtgtatattatatatatatataataatgtgttatatgattcagtgacataaagacactttatgtaatcttaaaatatcctgctaataatatgctaatggtgtgggtaaagaataaataacaactcctccttatcttagaaatatatttttaataggcatattgactgttcatattcagattctactgcagaaaagccctgcctacaaaagatgaaatgaagagagtttaaatgagagacaagattttaaataaggaaatttacaattgtatctatctgaaattgcattttgtcactgtggattcttgggacctaatagttttttattgagtagtaggtgttctcatttctaatcatgtcttttagctgcattttgaaggttgaggtgaggttaaaatgtgggctggcaactataaacaagttgggtgacaataagtgcaggcttctgccaaagctgctttcagcaaaattgtaaagcaagtaagtttgtctctactcagtgtctgtctccttctgtgtccttgaacctcttctgtggcaccatcacctgcacctgcacttcaagtggttaagttctctccctgaaccttttactgtcttatcaaaaccacccagattcttcattcagaagatgaggatgcagtccaatttaatgaggctacctcctaggcaagcaacacctgaagttgctattaatcatggtcacactctgcagtaacaatggtgctatctctgcaaagtaaatacactcattgttgtgttttttgtttttgcaaaacaagaaaaaggatgctcttgcattttaacaggacttgaaaccatacattaaaaaagggtaacttaagtgaagaaaacagagggtcaacccgacatgtagacatgtttctgaagaggcaggagtagagagagtttgggagaggggcaggaatcagaaccttctagaatctttcaaaacccatcacatgttaatgactttacctgcctattttcaagagtttagatctatattgtctgttttctttagttttctcaagtgtgataaagatataggtgtctcaagaacaaaatgataactatagctccagctaaacctcaaaaaatcgataggaattttttttctatctcctgggtagaattggttaacatttctgagtatcccagaaacaaatcttctactcatgattaggatgagaaagctaatatatatttgttgctttatttaatacagaaaatggccaaatatttcatatcagttctttgtattttcttgaagagacaattacatttttctaacattttgacaattttgccactcttgagaagattgaaaaacataacaaaaaacaatgtattgaaattatataatcaaaatgtttcagccccaaaaggtacaatatttcatctatcttttctccccaataaagtgggggcaaatattcttcccactagtagagtagcagaaattattaacaagtacagaatgtggaacgtggaaaggatttcttgtaaagaaacagtagattcaagctagcatcgggggtaagaagagggaggacattataagaggcttaattttaacaggcttagatgggaactgtgagaatagttttcaaaggctagttaggactagttttggggaaagttgattaccagtccagctgaaagattgtgagaaagaaattcataataaaactgaaaataaaaaatatcacaagctataaaaaatcaaattaagaattccaaatattttcaaacgtaagtattacccaaataacatattattcataaattgatacttggggttataccacgaacaaatttgatgtttcatctgaaaccacagcatatttctgtagcattcatcttaattcccagtctctcttacagccccattttctattttcatctttatttgatcaatctggcatttgtctggcctgtcattttaaatggataaatactacagacatctgtgattggcttaagaatagtgagaaagaaggactcaattcatttcgggatctctggctaaaatgtcatttttgtggcattagtcagtcaagagcttttaaggaaaagaatctattctcaacgcaatactaactgattaatctccatcactggaatttttcaggaatgagatgcagaaaagacagccacattacctagtgttccctcgagatcttaaagaaaaagcaatttcactttgggataagagaaacagagaataaatttgcctacattcctattactaaatgttaattattaaagtttggaggctatggttgctatcacaatagagaatttggagggagaaaatgtgagaaggaacagaagctctcctcaataaataggcaggggatgtttatgaaagatattctagcctaagacaaatatggttttctcaaaaaagctaaatctgtgctcaaaccatgagaaagttgaaagtgtcccaaatggtgatagtgggaaaaaagtgggggatggtgggaaaaaagtgagttgagcagaatggaagaatagagctgaacttctgtgtgtgtgtgtgtgtgtgtgtgtgtgtgtgtgtgtgtctgtgtgtatgtgtgtgtgtgtgtttcattttattctttcccattttattttatttagattcacttgggattttccccttataatgcatactttagggagttttcttaaatgctcactatggttaggatgtgctgttcttcaagcttaaaagttcttagagccgagtgggaggccatgatgcagaatagagtaactatcaaagggcatgtcccattgagatggcatttataattttcaccaagagacaggctccactctcctctccattttctccttcatgttctgaattcaaacaagaattatagtaagaatatttatctttctttaatgcaaatgtcagttgacaatgtgaaagaaagtaatttctatataatgacatccagcttagttaatctagtaagctaaggaaccagacagacccggaaaatccaaactctactctttaccagctgtgtgactttggacaaattactcaacatctctgtgccacagcagctcatttgtaaagtgaaaataatgatacttgtctcatatggctgtggtgagtattaaataactagcagacctgtgcttggcacagaagttggcacatcctaagtgatcaataaatgtaagctatcagtattattattttggaatttatatgtgattttgattattagagtcagtagtgctagaacaagccagtaatgcttacctttttaaggaacttagaatatttcagcaataggaatttcttaatcctaagtgattttcatttaattgtgaaatatgaacttgtttttttccagtggaatgcaattaaaattcacattataaacatatttttttttgttcagggcttaataaaaatcttcctagtgttataaatctcaccttggaatttcgagttccaatttgcacaaaccaatcaaaaagcaattatcataaacagccaatcaacagtacgaactaaaataaatcacctatcacccagttatgagtgggtgatagataattttctctaaaaaagtcttgcatttatttttatcattctgttataagataaagcagttacaacaaaatgtagagtgtagatagaatattttcctaatattcactaaaataaaataacaaagaagcattttgatatttcgtatgtgcttcatttgcagtaaaagctcagttatttttaatataccatctctggcttgctagaatgtttccaaaattgttatctccagaattttcaataagagctttgacacaactgagatgtatatctgaatttttttttcttgtctggaacataagagaaacacactgtttattcaaagaacaaataagtgaatgagtgaatgaatgagtactttcttctaatgtttaaggcctgtttaagtttcaaaattgtcaccttcctaattcttgcccacaagtggtcccagagacataaaatgttttcatgctcgagggaaaaagaaaagataactttttaaaaataatctacgcagatccacactgcagtggtcatcagaacataggcattctccgaggccaccttttcccatcctcttccttcactccccacctcctgcaggcctcagctatgttgtgctaccttcctttccttcctcttcctcaagggggcgctccagactctagacggctcagcttcagcttcacctccatacaacaccccgagtcttcaccatcttctaattacgctgtctggaatgactgaaaaaaaactctatatgcaaccccaaagtcacaccataggaggaaacattcagaagtacatacatgatacaatttggcatgaagtgaatggcagtggctgagggtgtggggggtagattatgatacagtcagcatttcctcagtgtctctctgcggtatttaaatatatagtttgttccattttcttcacttaaatatttcaccccttagctagttgttacgtatattttatttattcatctcgataaaggataggatcctcaggccgacatttcctttaataataataaaagggctggggcttgttacctcactcctggtgctctctctagaggttccttacacaaaggacaaaaatggccaagtggaaaatgaagtgcagtttaccggagttactgaacactctataacgctcctcatgcagggcttctctggaaaccactgctgaattgcaggactcaggctgaatttcaaagagctgtttttcaccgtgtctgtgaatctaggatggctgtcctgtgggtgaggctctgggtccagttacagagtgagtcacatggataaagatggcgagcctggcctagggcccatgtcctgcccctggagcacctagggcggggagggagggaagcagagggcacttacagcccagatgtttgaagtgatgagagacttgcctggtgtatctcctgatactgacagcgtaacagtccttccagaaacctgggtttgtgcccataaaactttctccataggcaagaatagccagatgagattggagaggggcatccttccctcccagcttacaattgtcgactgcttaccaagtgtcaagcattactctaatcaatatatctacattgcttcatttaattttcataacaatcctgatagataaatactactattgtgtccattttacagatgcagaagttgagatttaggggagttaaaaaacttgactagagtcgtaaagctgccagcaaacagaactggctttctcatccaagtctgactggtggagtctgccacttctagacattatgctagataccctgtttggcaaatggttgtcaagtatctatgttccatgtgaactcattttgaaaatttccactgtgtctaccctggcaaatctactgctttatttcatcattcaacaaataaatttattaaagacctcctctttgccaattaccatgtgaggccctggggaaccaagattgagcaagagagaaaagggccctgtccacgttgaagcatgcccatctgggaagatggaaaacccaatcaaataaaatgatagtgtctaacaatactttcccctatattgggaaagcacaagtaccattgggcacttagcaaccatctctatatcaatctacagtgcttggaatttataattcttaagatgcatagaatattgttttcttaacactgaacttactgtgctaggtagtgaaaggacataaagatagcctctcctctacagaaaacaaaacttagttggcgaaagagaaaccaaccaaatggttaatgggaagagaaaaaaggaatccttgattctataagtaggaattgaaggctctttaggacaactaacttcttaatttcatgcattcaccagagaaactgtgtttagtgaaaatgaggatcagatctgcctcccattcctatctgggtttcctatacccctgcttctttttttttttttgagatggagtctcgctctgttgccccagctggaatgcagtggcgtgatctcggctcactgcaagctctgcctcccgggttcatgccattctcctgcctcagcctcccgagtagctgggactacaggtgtccgccaccacgtccagctaattatttgtatttttagtagagacggggtttcactatgttagccaggatggtcttgatttcctgacctcgtgatccgcctgcctcggcctcccaaagtgctgggattacaggcgtgagccaccacacccggcctacccctgcttctttttaaaatgaaagaattgaataagaggatcttaaatgatatttctgactctgacatgccatgatagtaatcttttaagaaagctgataaaatcaacatttcacctttgatttttttttgatatgtccatctgagccctatctttttatatgaaaaactttcattcttcttatagtagaaatctcttttgaatcatttctgaaatttctcagtaagtcagtatcttagcattcctgtttgttttaggcttcagtatttaataccctgaaaacaaaccttcttatcttataccactaaccatgctactaaaaatcaatccatcaattaatgaattaaaagataaatatgaattcaaatcaggaaagaaagaaaaattctcatttttccaaaaatgcaggaattcatatcattctactaatactaactaaagtcatggaaaccttttaccctacctaggtagaatatcacaactacatgtttgagtggttctcaactacgaaaaaatttacttccaggggacattgaacaacatctggaggcatttttggttaccatatcaaactgctattggcatccagtcagtagaggccagaagtgctggtcagcattctacaatgcccataacagcctctcacaacaacaacaacaaaatcatgtttcaacatgtcagtagtgccgaggttaagaaaccctggtgtaggtagattatgcatttctaatggagggccattattcaaggctatggtaaaatgtatgctaagattctttacttttttttttttcaagtttcttatttggaaagtcctgactgtgtcttgataagctctccttctttatgcttagctttcgaacaaatgttagttctgtctccccttcctctctcccttcacaaagttcataaaactaacctgattgctaccacctgcaaccaagacaggaaacagagggcaagagggtccgacccttgtggaagtgtccagaataaccactagaaccttaagctggaattgttcttccagcttcctgagccaatatgagtccaggcagtattacaacccacccagagcaagaatggtggtaaccaacttcctgcatagacctgtggtacagagcacagactctagaaatgtcctgggttcagatcctaccccttctgtctttttgctatctagctttggccacttaatctctctgtacctcagttttatcatttttaaaacagggataacaacagtaagcctaccccagagaattactgtgaagattaaatgagctaaaatatgcaaagtgcctggcacacagtaagccctagattcaagatagtagttgttattatcatgattcgactctgcaatagtgccacgtaactttaagttacaggaggagattgacttttgtctcattactttctgaagaacaaactttctctagccattttctctgaattttcattagaggtttcagattctactgcaaggatccttgtttctggagcccaacctgcaccctacattcctaacactttctatgattgtttcacctctaaatcttccctactgaagcaattctgtttctgctatttatgacattggtctttggccatgcacacaaactttccaagagtcaatagcatcaaaagtgatgctttttttctatgagtttcaagttttaaattatatctcaaactgtaagaaaatttaattttgacagaattttattagccttacataactatatactcttctattctgggcaactaaatgcaattaactgataaaagaattttaagaaactattccatagatacacagaaatgcctggaaatttgcacacttgttcaaacaatgtgtaattcttcatgctatcatcggggtaagagagaattttgtatttagatctctaataattaatctgtactgagatatcttataaaataacttagatacatctcttagttaataaaattaagtaagcgtcaatgaaattttattgggtttctctgcaacataatatggttagcaaagtggacatcacaaactcccacgtcttattcacaacttagcgattaaagcttctttttttcacaaaaaaacctaggtgtcaacaaattcacctcaaataaccatagaatcaactctttgaaacaaataaaggcaatattaacccaataaaagcctaccaataaagggcctgaaataatgtgcctgaaaatcatttaataaacccaaaaaggggaaaagaatcagcaaatgaattcttcctctttaaaacaaatgaacaaaaacaaacagccttacacgaattcacaaaacagttaagccacataaaacgccttacaaagaaattaatactacacttcagtttattggcccttttacttcctcatcaagctttgtaagcatttctaaatagagcgtcatttccacaagtaaacattttttactggaacataattttagcattacaatgagttccttccattaaaatgattggtttcacttgaggaagtttcccaaatgcaagcatttgttttcatcattatggctgaaacaaatattctgttagaccttgctaactagccttgctacatatatgtaatatgagaatgtatttgctcatctttcctaataggaaggcaatgtgtgtccttaacatgtttgcatgaagtcagtgtacatttaaggttgtacaaaagattctaaatcattgttttaaatatcaactttcaactatttctctgtcagcccttctgaaaacatatggctatgttatgtcaaagagtttgaaaatcttcacactggcactggcctgtcatactaagatctatttcaagaggggtatgatttcatctccataataaagaagtgagattggcccggattcatgggtcaataaggagatagcaaagaagcgattgaaaaatccatttttgatgagaaaggcaagtagtaatcctatcaaaacatctttaatctctaattagatgtcaatgtctacttagtatgtacgatttttggcacctgaaggcatcacaagttttgattataatactatgttatgatatagcctaagataaattactttatacctaaaatgtgattctgatatgatgaataagttagcaagactgatctaataagttagcgaggctgatctccaacaaatttatgaaaaggtggagacctcctgggaggcctcttacacttaggtaagaaggaaccacctagaaggaatttgaactagtaaagaagtgggagaaggatcaatcctaaatataatatgatatttggcacttgaatgttcctcccatatcaaccctacttggactgaacagaaggattatacatacaagctaaaagagctgtcctacagacccttgattgatctagcccctgccttcctttctggtcttatgttatcgcatcttccccctcaagccccattatttaggctctacttacatcattgcactatgctgcatcagataattaaacctttatccttgctgttgacatcaccaaaacctctttgcttgaatcttgcccaattctctttctcactctcaagcacatgtcattggggtatttagaaacacctgcatggagaggaagactggtgtttaagaagacagtgagattctgggtctgcaggcaaagaaaagagcctgtaaaacttgggttactctgtaactctgaccccaatctggccccacaggaaaacaaggtctggaaaactggggttgtactttttaaaaactggggttgtatttttttaaaaaatttgacttagaactgtcactctcctttcctccctttcttttcccctctctatcagaaagctgtgtataggacatactaaaacacttcttctcatctaagttctgaacctcaaattggttcccttcattaacgatgatatatagaatcatattttgcaggtgtaaagatggacattgagaaatcctatgggctaagccaaaaaaaactcaggtcccaggaggctgaataattgctcagaattgtacatgtagttgctggcactcagattaacattcaaaggttagttcgttgcacttttagctttcagttgaaagaaaggtgatgcttcacacaatggaattaagctaagctgagctgacctataattaaaaatcaaagtcatgccactcagcctatctactctgcttaacatgcctgactatcacaggtgtatctcataaattacaattatttctttggccccagaaatcaatttggtaaatagatgcaccctttatacacagaatctcacatttacatttatctcaggactaggtgtgaaggacagggttgaatacagctaaagggcatacattgagggaaatgaattacatatgatattacatatcttactataatatcaacaattttcatttttcaagcatattgcatataaagtgggcattatgaactccatgcaccacaagcgaacaacagaagcttatcatatggcaaatgattaatgctgccacctccaagttaccttgggcacagccaggatgcatctcaaagatgtgttaaatatctatcaacaccttctgcagtgattgctataaagagaagataatgatgaaggcaccaagcttgtctttcttcagggttagattcacggaaggggaaaacaggttagattcataggaaaaaaaaataattagcaagaatttctgataaatttggtaacttttgacacttgtaaatttattcattcatttctttgttcattcatagaacaaatatttgtaaagcaaaaaaaactatagtatgtcaggtactcatctgtgttttagacatagagcaggattcagaacaaagccctttcttttaaaggaatttacatacttttggagaccttagagaaatgaatttaaaatatctggctgtaagaggtaagatacaagggaacaagtgaaaagtttatgggagaacaggaaggagggagtgtggctctgtttctatgctagtcacttgcataggatggcagcatggctctgggagtcctgtctaataagaaggcatttcttcagagcagtgaaagaagtgagggactgaggctcacagatgtttacagggagatatttctaagcagagggaatagcatgtacaatgactttgacagagaagagcagttagccttggcatgttcaaaaaccagtaagtgggcagtgtagctgaagactagtgtgtgtgaatgtggaagaggaagaagagagattatttacggccttataagttgagataaaaacacattaccactgtatgaaaaaaaacaaaacttgccaaaatgatatgatgtgtagacaaatacaaatttatagtctttattatagggcacttcacggaacagcaggatcattttttataccattttctgaaaacactgtaatctgcaactgccatttaataatttaatttcatggaaatatattattgaatcagacttccttaatttaagtaactgtctggcttcgtttaattatttaatctctctataccttaatttccaaatctgtagtctacggatcatagaagaaactaacagcaatctctcttatgagcataaatgtaagtatatgtacatatataccaaactaatgatagcagtcaaattcaaaataacatattttaaaaattacattaaagaaatgcaaagtcagctaatattcaaaaattgattcatgtgatttacccttttatcagaaaaataaagaaaagtcatatcattatcttcatattttaaggaaaatcaatcaccctccattaatttaaaagcttagcaacaagaaatagaaaggcagagttttcttaacctaataaagagaatctacaaaacaaattttagctaacattatagataagacaagactgttcattgtccttatatttagtcatcattgtgctggagattctagaaaacaggcaaaggaagtttttttaaaaaataaaagttataagaattggaaagataggaattatagggtcattattttcatacgaaataattgagtacataaaaaattccatagactattgatatttaaatgtagaaaattacaacatgaaagatctatataaaaagtttctacatagtactaaaacaattcagatacaattttttttaaaaaagatactatgtacaatagcaccacagaaacaatacagaaacatcaaatacctatgactagatctaactaatgacatgtacatgacataaaactacaatatcctattgagagaaattagagaaggcttaaacagagaaatacatcatgttcacagatgagaagatacaatattgttaaaatgttgattctctacaagttgttttacagattcaatgtaccccaatcaaaatctcaacagaaactgtggtgacaattgacaagcgagttctgaaacatgtatgaaagaacaaaagatgaaaattgtgaagtcaaaaattttggagaatttgcactactggacatccagacattattggctcaccactgtggctcacgcctgtaatcccagcactttgggacaccaaggcgggtggatcatttgaggtcaggagttccagaccagccttgtcaacatggtgaaaacccatttctaccaaaaaaacaaaaattagccaggcagggcggcacatgcctgtagtcccagctactcaggaggctgaggcggaagaatcatttgaacccaggaagcagaggctgccatgagccaagatggtgccactgcactccagcctgggcaacagagtgagactccataaaaaaataaataaataaaaaataaaggaaaagaaaaagaaaaaatatattattaaagtacaataattatgttccattccaatccctatacagtcagtcacctgttttatgcaaagattttgctgcaaaatggaggaaaagatgtcctttttagaaaatgatgctgaatcaaatcagtatctgatatattaatagtttggatgtctatcctctccaaatctcatgttaaaatgtgattcccagtgttggaggtcgggcttagtaagaggtgtttgggttatgggggtggatccatcatgagtggcttggtcccctccccatagaatgagttcatacaagatctgattgtttaaaaaggagcctgccacctcccactctctctctcttgcctcttctctcaccatgtgacctgttggttcccgtttgccttctgtcatgaatgtaagcttccagagcccctcaccaaaagcagatgtcagcattatgcttcatatgtagcttgcataaccataaaccaataaagctcttttttctttataaattacccactctcaggtattcctttatagcaacagaagtggactaacagtatcaatataggaaaagtatgcatttcagtagttatcttaagccacatataaaaatccattccaggccaggcacggtggctcacgcctgtaatcccagcactttgggaggccaaggcaggtggatcacgaggtcaggagatcaacaccatcctggctaacacggtgaaaccccgtctctactaaaaatacaaaaaaaaaaaaaattagccgggcatggtggcatgctcctgtagtcccagctactcgggcggctgagacaggaacccaggaggaggagcttgcagtgagtcaagatcgcgccactgcactccagcctgggcgacacagcgagagtccgtctcaaaaaaaaaaaaaaaaaaaaaaaaaaaaaaaaaaaaatccacttcagatacattgtagaactaaatttgaatggtaaacaataaatcttctgtaagataaaatagaaacaaatcttcatgattatgaggtagtatttggatggcaaagtaaagcaatattcatatagcttataccctgaagccagcttggggcaccaggcactagggcagctaatgtaatttgtcactaatctgccagctctcctggttggcctggggcataaatcagaccttcaactccttctgctcccactgtctcctctgtcagcttcttagaggcatgaaccaagtccatgaacatctccatgcaaatacagcagaaaaatccagatgaaactgcctctacctaccaaaatactaaacccatagcaaatagcatattttttagggacttcaaggataagagccaccaagaaggtgtaaaggatgcagtatggtgatactaccacacccgcattcaacacacccattattttggcctgtgcaagagacagatgggactttgaaaatgacagtgcattactgtaaacttaatcaggtggtgaaatccattgcagttgctggcccagttgtagtatcattactggaacaatcaacacacccctggcatctgcaatctgaaaatgcatctatctctttctctccctctgctctctctttgtgtgtgtgtgcgcgtgtgtgtgtgtctgtgtgtgtgtaaagaacttcagaaacaacttgcttttccctaacagagccagtatcatattaaacctccagtcttatgccataatctactcctcagggacttctatggcatcttcattctacagggcatcattactctgataatccattacatttatgattcgctgattagatcagatgagcagaaagtaactactgctttaggcatcttccaaagatatatgcatgagagaagaaaggaaataaatcctacacaaatttagggacctgccacctcagtgacatttctaggggcacagaggaatggcgtgatattttcaaagtgaaagatcagttgcttcatgtgcacccttttatcatgaaaaaagaaccaaaatgcctagtgcaccactttagagtttgcagagccataaacctcacttgggcctgctattcagaccaactcattgagtaacttgataatctaccaattttgagtgtggccaaggaaaaaaataataattcttcagctgccctactagttggaccagatgaccctgaatatcctcatgatgcttgacatgtctgtgacagatagggtgcttcatggagactttgacaaaacactctaggaggctcacagtacaaacatttaaaattttggatcaaagctatgtcatcctctgcaaacagctattatagttttgaggaacaacttctgtcttgttgctggggccaagcaaagaatgaacattttatcacaggctaccaaattaccacatggccttagctgcctatcatgaactggttgctgtctaaccatcaaaccaaaaagcacagcagcacttcatattcaaatgacatgtaagagattcagcccagtcatatcctaaaggcaaatgtaagttgcatgagcaagtggcccacaggccacattcctgatccaatgcctcctctttctcaacctgccctcataaccacatagagatttccctatagctggttgactgaaataatacagcttcatttaaagatgggagcccctttcagacctatttggggtggccttggaggacaagggtgaagggaaggcctccagtggacaaaactttgagcagtgaatctggctgtttgctttgcttggaagaagatagggccagagttgtgaatctacaccacttaatgaacagtggctaaaagattagataagtggtcagggacttggaagaaacataattggaaaattggttctgtaactaggcacagactatgacaatatttgctcttcatctgaacacttacaaaacaacaacctcaaacaagagaattttaatgatcatttagacaaaatgacccattctgtgaaggtaagtcagccacttctgtccttgtcatgagtgagcttcatgaacaaagtggtgatgttttagggctagagtttaaacttgggctcagaaacataaactatcactcaccaaggccaatttagctaaagccattgctgacctaccatcaacagagacaaatgttgagcccccatttttgcaccatttaccaaggagattgctgaggaacatgctgcaggtcgattgcatccaagcttgtccaactttccttattttgttgttgttgttgttgttgttgttgttgttgttgttgttctgttttgttttgttttaggcttctagcagctcgaagccatggatttaactgtctgtctctagtaatatgcagaaaggaggatgaagaaggggctttactggccaaaccagaaacagaaactaagaacccatgactgtattctctcccttggaaactcctgtgagaccattcataatggaagatgtaacaccttgttctcattggaatagatattactctgaatatggatctaccttctttgcccgtaatgcttctgccaaaaccatggcttctggccacaatcgtgaatctgtgccacttagtggacagaggctaatagataagtggacaggggcttggaagaaacataatcagaaaattggttctgtaactgggtgcagactatgacaatatttgttcttcatgtgaacccttaccaaacagcaacttccatgttattcacttcatacatctttgcttctgaccaagggacagtcttatatttatgcaattcactggtcttccaatgtttcctatcactctgaagcagtagtatgatagaatagtgcaatagcttttagaaaaatcagttatggcaccaattgggtaagaacaccttatgaggctgagataatgtcctccaggatgcagtatatgctttaactcagcagctatacatagtgctgtttccccatatccaaaattcatgggtccaaggatcaacatagttggaaatgagaggaactcttctaactattagccctgatattcccctagttaaaatgttgtttgttaacaaaactttgaattctggtggtctctagaccagataacactgttccatatttgtgtaattcaacatggtagccactagctacatgtggctattgaactcttgaaagatggctacttcaactcagataatataattaaaaattgatttaattcaaaataatttaatttaatataaatagccacatatacctagtgactatcatattagactaatgtttatctcaaagtctacagttttaaaagattaatactttaaccaggggattgtaatgtttccattacactaaaagttgaaattgataactgtccattttaggcttctaagagaatgatccaacagttactaggctgcctggaataatgattcctgattatcaaggggaaattgtactactacatagtgagcataagggaatatacctggaatgtggaatatcctttggttgtctcttagtactcccgtgtcctgtcattaaaataaatggaaaattatacccaagacaggcagggctgtagatcgcccagctctttcagaaataaatatttgaatcaccataccaggaaaggaattacaaccagctgaggtcttgcttagggaaaaaataattatgggactgacattgagaaaacgggatattcataggcataagaatgaaattggatccttatctcacatcctatacaaatatcaactcaaaatcaattaaagacttagatgtaagaccaaaaactgctagaagaaaacataggggtaaaactacacaacattgctctgaacaattatttttttgatttgacttcagaagtgcaggcaacaaaagcaaaaatagacccaaatgggattacattaaactataaagcatttgcacagcaaaggaaacaacagcatgcagagacaacttgtggaatgagagaaaatattggtaagccatgcatttaataaagaatttatatctgaaacatataaggagctcaaacaactcaacaacaagaaaacaaaaaactcaataaaaaaatgggcaagggacctgaatagatatttctcaaaagaaaatatacaaatgatgaacagaaatatgaaaaaatggttaacatcgcaaatcattagggaaatgcaaattaaaaccacaatgaaatatcatctcacagctgtcagaatggctattataaaaagatgaaagatagctagtgttgatgaggatgtggaggaaagggaactctagtacgctattggtgggaatgtaaattagtacagccactatggaaaactgtggcatttccacaaaaaactaaaaatagaactaccagaggatccagcaatctcacttctggatattgatccaaaagatttgaaatctgtttgttgaacagatgtctgcactctcatgttcaaggcagcactatccacaatagccaagttatggactcaacaaagttgtccatcaacaaatgagcaaataaagaataggtagcgtatctaaacaatgaaatattaaccagccttaaaaaggaaagaaattttgtcactttcaacaacatagatgaatttggagaacattatgctaactgaaataaaccaggcacagaaagacaaacactggaggttctcactttatgtaggatctaaaacaatcaaactctaggagcaaagagtagcatgatggggttacagaggctggggcctgggggcaatggggcaatgatggccaaacggtacaaaatctcagacaggaggaatataggtttttttaatagttctatcacacagtgtggtaaatatagttaataatattgtacatttcaaaattgctaaggaagtaaatttcgaaagttttcaaaaaaatgtaagtatttgaggtgatgaatgcgaactagcttgatttaattattcacactgcattcatgagtcataacatcactttgtaccccataagtgtatacaaattataattaacaattaccattttaaaaagaatgatactggttccaactgtgtgactagttgtagaaatgatgactagagtagctatggatattcttctttattttgatatgacggtgtttgtatttatattaaccatgtttttcctttttctctccctattctctaccacctactataatgcatactcatagaaattaaatttaaatacaggagttaaaaaatgagaatttgacttagctaaagggataaatagtataatccaaaaatagattcaactattttatgttcccttttgaagagaaggatagcatatttggggttatatgagagatagttgcattatgttagatagaaatataattttgcttctttttttttaagaattaaggatagttgaaagagagctggaatgtagtggatttttcctttgtctacacaaataatctggaactgcatttcacagaagttctttccgcatgtgattctttgttagccctggttggaaaagacattctaaatgagatttagaaggggctcaccagaggctcatcagctatcactgagtttttctcaaaggtttccgtttttccccaagcgttctaattctgccttgtgagttccagtttcttattgttctcttttaaaatcaacatttcttcttgacttctggtctagctgttgcagaataatttgaattttgatactagacagggggacagcatcctcaatagacagctccactagtttccacaattgagtaaagtttaatcatggtaataaatctcttattatatattatttatagtggcttgaggtttctgatgaaatctcaactgatagaaaatttttgtcaatacctgctaaagtggaacctatgcatgccctataaatcagcagctatattcctaaatatccacccttagaaacaagtacctatgtgcacaaaaatacataaacaagaatattcatagctctttatccatcatagccccaaactggaaacaacccaaatgtctatctacagaggaggaataaatccagcatgagatagccacacattacaatacatatcagggagaaggagcaagcttgtttcatgcaacaacacaaatgaatctcaagacatgctattgagaaaaagaagcctaacacaaaagaatgcatatttataggaagttcattaatcaattgtaataaaactcagaaaagtggttgcctttaggaggaggcaatgactagattcagtatggggtgagatctggaggggtactcaccagcattatctaggaacagataatttcatctgggggaattacataggtatattcactttgtaaaatgttgtaagttgtagacttaagagttgtacgttctactatttgtatatttgtacaaaatgactagaaataatatctacctatctcataatatgtggagattaaatgacatagctcatgcttaccatgataaaatttcaataaatactacatagcattactttgttcttacaaaaactagtaaaggaagatgaaaagaaaaattttcactaggcaaccttacaattaggaaaaatgataattttacactagagaaaaaattggacctaaaattataacatcagaggtgtagtgtccattgtttatataagatcacaacctcacattctaatttgaaagggtattttacagcaaagacaagaacagagaaactagagatttatgcaggaggatatctccctgtctgatctccattgttctcaaccacagctcactctattttcttcgaagaactcttaaaaaaagttttggggcatatttattgtctgatttgtcccattaatatgtaaactccatgaggacaggtaccttctctgtgttttctattttttcccagagctatggctaatgactatcacacagtcacttcccaagtaagtaaagtgtagtaagtacagtgatacacagagcttgaatactcatgacctgaacataaaaagccggcatctatggcatgtgggccagccatcttgatagggttggcattcctaacttacctctcccctagctcctttcttgttgaaagccttcctgtcatagttaagagttttagatctgtagagttcgaagggtgatttttttcaaggtcgacgatatctgaattgacatttctgatacggttgcccttgtacttttcttgatgaaatgacaccaccacaaatcctttccaaaatgaagtggaaaatgaaggcgaataaataaataactaatgaagtggccacagatcaactaattatgatcacaatatcagaaagttcatgttaataagaagtgtgtgtcattttactttgcatttatttataatctggaaaatgttgacaggacattcttgtgtcatcaaaaattttatctaataatcaatgagacagaatcactataaataatttaaaactattaactaaatacaaagatttaactgagttctgccaatgaggcttggggcacttagccatccccacagcagatgggaactgtcaaagcacataaacattcaaagttgcaagacacactttcagatgacagaaaccagaagaattcatgcaaatcaatgagcccaacacaccttatttaaaagagaacatttgacaggcaatagagaaaaccattttgaatctttgcttttggagatatcccaggttttaattatcaaatgtcaccatttcctaaatggagatttttctacagataacccttttaaaaatctatttaaaaacagcatttcttctactgatcttggtgttaatgttatgccaaattatgttttcttcaccattcagaacttcactttaatgatatccagtaacacaataaggcaactataaaatttccttaatagatttggccaatttaattttaagctaatctgtttgggatggattttgtttaccacatgcttgtagctataagaattttgaacataaagatggcgatgtctctccaatttcattataagaggagcagaaacatatttggaatgtatgtattgttcaggatgtatgacaatgtgcttgcagagcaagaatactatttttactcagtttatatatccatttggtgttccttgttgagagatgatgatagagccttaggggaagtgacaatccaagcaccaccactggcaaatgagatttccactgaaaatgtcaataaaataactgacatatacatggtacttgctcatttaaagaatgacttcctatgcgtgagttaatttgttcttgaagttaatctaaggaagagattaagaatatctttattggccccatttacaactgaagaaactgacagttggggaagttgcgaaaccaatgacagatcacaatcacagttaactcaacatccaaggacaagaaccctttcaacttcaaatttgtctctttcccacacatcatagtgagggaaaaatcacatggatcttctgaaaacagcataatatttcaaaagaaactgcattgatattgatcattgcattttcaatgtgcaccttctatacctcttttgttaggaccaggtgatgccatggagaaggagagactcggtctctatcccatatctaagtggaaaggtgatttgcaggaccatccctctaaaaagtgataccatgtagttcctggaagaagtggaatatctcagcccagatctcaaatttgagcaggagttggcctgaagaaggggcaggatgttctaggcagaggaaattgcacatacaaaggcacagagacaagaaagtgtgacacaatcaaataactgaaataaatccagtttggtctgagtgtactgagagactggggaatcatgacagaggtgaccaggggaacaagcaggcaacggatcccagaggaccttatacatcatttttaaagttttagactttaagagcaatgggagctttgtaagaggtttgagcatttcatgtgtattgacaacattgttttaatgtttgtttgcatttgtaagggaagacctcttttggagcatgttggaccttctttggaaagctgccaatgagtaagattgcaaatggccagatgggccttagaaagaataagatttctgattcaaactgatataaattttattcttgatataatacaaatgcatactgacataattggccttaaagataattaataatataacaagcccataggttttgataatgtaattgacctatttctatttggggtatctttttgtactctacttggttttacagactaaatggtcttggttattggaaataactttaaataatctcccaaatctaggcaagatccccgggcaattagaagctgagatatttgcatgccaaactgtaaggttcagcatatggtcccaaatatttgcataaataaaatcttaagatagcattttcagtgaggtacttttatttttgtctttcattcacaacacctaaacagtgtttctttcaaacacagattatctccttatacattgtcctcaagtaatattttatgtatgttattttttcttatacagaatatacagccgagtatggtggctcatgcccataatcccaacattttgggaggctgaggcgagcggatcacctgagatcaggagttcaagaccagcctggccaacatggcaaaaccctgtctctactaaaaatacaaaaattagccaggcatggtggccagtgcctgtaatataccagccactagggagactgaagcagaagaatcgctggaacctgggaagcagaggttgcagtgagcagagatcacaccactgtactccatcctggtcaacagagtgagactcccatctcaaaaaaaaaaaaaaaaaaaaaaaaaaaaaatattgggtgttaaaaatagaaatgtgcaaaaagaaaaggtaaaataactcacactagggcaaatatcttaacttgttgatggttttacaaaaataaactcatatcccatatcctgatttatagtgtttttaaatatttttccatttaattacatctcatgaagctttttaatgtgattattcatctgaatacattttagtgagtgtagtttcccatcttatgaatgaaactacttaaccaattccatattgctagagatttaggtttctttttttaattataaacaacactgtaatttatgatgtatgattaactaacatctagtggcataataaaagtaaaaatatgctagccatggcataataaaagtaaaaatatgctagccaccatatatatatacatatacacacacacatatatacacacacgtatgtaacatacacacacacacacacatatatatatatatacttttttcgtcttcttttttgagatggtgtcttattctgtcacccaggctagaatgcagtggcacaacctacagcctccatctcctgggctcaagtgattcaccaccaaataatatatttatcagccccaaatatttctgccttttccacattaatatgacaaaagcaaagaagtatcttttggccatcatatgcctaaataaaggtattaatatagcatatatttaattattttaagaaatcatatttatctacacttcaaggtcattggagaacaggacaaaactgtcagtccacatgaatttatgtgactgccataaacaatcagtgcaagcaacataacctttaatattgcttatggagctaagtaaatagccttaagaaagaactttttaaaaatatatatagtcgcttagtttctagcatagaacatcttgagcttcaaggcagataagaaattttccttaaaagattaccctgaggccaggcatggtgggtcacgcctgtaatcccagcaccttgggaggccaaggctggtggatcacctgaggtcaggagtttgagacctgcctggccaaaatgatgaaaccccatctctaccaaaactataaaaattaaccgggcatggtggtgggcgcctgtaattctagctattctggcggctgaggcacaagaattgcatgaacctgggaggctgaggttgcaatgagccgagatcgcgccactgcactccagcctgggtgacagagtgagactttgtctcaaaaaaaaaaaaaaaaaaaagaaaacacacacacacacacacacacacacacacacacacacacagctagaagagtaatttagcattctgaattcgatctaactggatgtcctcgttcccggctggagtccatagtagcctctcccagtagagaaacttggtcagtggtcacaatggcagacatctgcagatcattgtggtgatctagaaatactggtttcctacctgagaagttaaaatattgagccttataaccttgaccaaatttagtttcccagattttgagtctggtctctgaaatcagaccacctgtatttgaatcagaagtctacctcttgcaatctgtttgaatttttgaaaaagttatttggacctcagtttccataggagactctaagcagttgatgggaggtttaaacaaaataatcagtataaatcacttagttcagtatctggctcacagagcatacttggcaaatgtgaggtattgagttctcaaatttgtaaacgtaaatagagtaagaaaaacaaatgtcaactccctatcaagacaatgtcttatttgtctcacttgttacccaattcaaaatgaagtggagacaagatcttaaaacagcttggtatgtcaaatcttatttaaaagtggaggagaaagtagaaagagaagaggagaaaaagggggagcaggaggaaggatgggaaggggaggaagagcaaatgcattctagaatatacattagatgtacacttagatacacttagatacacagattacaaattcatatattaaaaaggaataaattatagctattgaaatgatgccactgatagaagaaatgtctaatatcctgagacatcacatcatacaaagttattttcttctagaaaacagaatatcaacttgaaggtgatctctgtaacttaacatttctaggtgttattcttgtcatttgaagagtgagaaatttaagtagtaattttttaaaaaacatggttatcaaaaatgcctatgatttaatgaaacaatattaaatatgataaattccaataaaagcaaagaaattagagctcctttaggaaattcttcactataagaagatttacttaaaggaagataataacaaacatttttccttctgcttgtataaagatcactgaagctaaggaaagcatcaacttaaaagaaaatgtattttcaaggggaaatggcacagtgttacaaggaaatgagaaaatgtgatataatttcatatctgaaaacaggctatattcacaacaaattgattttaacttattttaaacatgtttatgggtcttttattataaaaagaaatgcattatcattgcaaacaaaactacttgaaagtgaaaaatatgatacttcagtgatataattaagaattctaaactactgtaaatatcaaaccattaataattttcacttgtaataattaaactgggatggaatggcacattcctgtgtctatgtattgaacaactgctcatgtctaaatttaaggtatgtattaaaaaaataaaatcatctatggccccaccatctacagataatcactagtagcaggtttgtatatctcctgcccaagcttactcattctctctctttctctgacatttttgggggtccgtaaactgttaagcattatttttcatgtaatctttcaactccaaaggaaagattagctaacggagtaaaggatatttgaaataaagaataggagatctttcagaaaacccaaggatgagagaacagctgggcatcaagaaataccggcatcaagaagaagagatgctgggaaaaccactgtcttccattacgttcttctatctttctctggggccactgaaactcatgtctgcttctttttgcacctttgcttgtcactactctcatcgttttggctttctcacagttcgctcttgtaactatttcagataaactagcacctcttaccccaattccatattctcagaagggagaatctctttgactccatttgtattaggaattgagaataacatactgcagttctcaagcaaagaagcatctggtcttggtaggcactgtagcattagtccgctgtaccatgaacatcttctgtatgaataaatgaaaatctaccaatctacatcattgattgactctattttattattattattattgtgtgtgtgtgagagagacagggtctggctctgtggcccaggctggagtgcagtgttgtaaccactgcagcctcaatttcctgggctcaagtgttcatcccacctcagcctcccaagtagctgggactacagtcgtggcactaccacacctggctaatttttgtatgttttgtagagacacggttgttccatgttgctcaggctggtcttgaacttcctaagctcaagcgatctgcctgcctgcctcggcctcccaaagtgctgagtttacagacattggccgctatgcccagcacttttttttttttaaatgttagcatcattgcagaataattgacaaaaataactcacatgcatttaaggtgtacaacattttaacagttgtgttttgtattccaaaacattggtaatacattttgaacattcttttatcgatgaacatttaaactatttctaattcttttaattaaaacaatgttgtataaaaattaatgtatatggagacttctgctcctatttatttttccccagctttattgagttataattgacatagattggacaaatttaacgtgtataatatgacactttgatattcatatgtattgtgaaatgattatgacgatcaagttagttaacacatctaataccccattgttaccactggtgggagggggcaggtggtaagaacatttaagatctactctgaacaaatttgaagtgtaccatacagtattgttaactacggtcacaatgctgaatgctgaatactagatccccagaatgtattcatcttaatgactgaaagattgtgcctttgaccaacatctcccattctcccccagctccccagcacctggcattctattgtttctatgagttcaacttctttcaattccacatataagtgagatcatttttttctttgtctaacttatttcacttagtacaaaaccctcaagttttatccatattgtcaaaagtggtaggatttcattcttttgcatggctaaataatattccattgtttatatattactatatatccataggaaagaggaacattatagatgtaattgttaagctaatatgaagtcatactggagcagagtgagccctagtcccacatggctggtgtccttataaaagagaggaatttggatacaaacttgcacataggaaaaatgccatggggaaatgaaggctgagattgggatgatgcttctacaagcaaagtaaccctgaaattatcagaaatttaccagaagctaggggagatgtatttaacagtttctgcctctcagtcctcagaaggaccaaccctgctgacaccatgatctcagactttcagtctccagaattatgacacaataaatttctgctgtttaagacgcctagtttttgtgactttattactacagccctagcaaagtaatgcgagattctgccatgttggtacaaacatccatagtttatgtgacagttaatattgagtgtcaacttgattggattgaaagatgcaaatatttgcaaatcaaatactggatagaggacttgttttcagaaaatataaagaattttcgaaactcaacaataagaaagcaaataaccaaatcacagtggtgcgatcttggctcattgcaacctccggctccccggttcaagtgattcccctgcctcggtattgttcctgggtgtgtctgtgaaggtgttgccaaaggagattaacatttgagtcagtggactgggagaggcagacccaccctcaatctgggttggcaccatctaatcagctgtcagtgcatctagaataaagcaggtggaagaagttggaaagagcagacttgctgagtcttccagtcttcaactttctcccgtgctggatgctctctgctcttgaacatcaaactccaagttcttcagcttttggactcttggacttatgctaggggtttgccaggggctcttgggcctttggccacagactgaaggctgcactgttggcttccctactttagaggttttgcaactcagactgatccaccactggcttccttgctcctcaacttgcagatggcctattgtagaactttaccttgtgatcatgtgaatcaattctctttaataaactccctttcctatatacatatatcctattaattctgtccctgttgagaaccctactaatacagtttgtttctttttattactaagttttattccattgtatatctacacaatgctcatccattcaccaactgagggcattttggttgcttccagtttggggtgatcacaaaaaaagctataataaacatttgagttcggattttttatgtgaacataatttttcacttcctttaaataaataggagtaagatttctggggtatatggcaaatggatatttaaaagtaccagaaactaccaaactgtttgctaaataagcttccccattttgcattcataccagcaatatattttactttgcgtctttgcctgaatttggcactaccattttgttttgttttttactatcattgtgtatgcagaagggtagccccttgtggttttcatttgcttttctataattattaatgatgctgtgcatcttatcatgtgcttatttgccattcttctattttctttagtgaagagttgattggatctcttgcccattcctttatttggttatttgctttcttattgttgagttttgaaaattctttatattttctgaaaacaagtcctctatccaatatttgatttgcaaacattttctgacagtctgtggtatgtctttttcatttgctttctttttttaacttttaagttcaggggtacatgtacaggtaaatttgtgtcatgggggtttgttgtacagattatttcatcaccctggtattaatcctagtacccattagttactttccctgatcatcttctttcatccatccttcaccctctgataggtccctgtgtgtgttgtccttctctatgtatccttcttatcttttcttttttcttttctttttctttctctttctctctctttctttcttttgacagagtcttacttgttgcccaggctggagtacagtgacgagatctcggctcactgcaatctccaccaccaggtttcaagtgattctcctgcctcagcctcccgagtagctgggattagagacatctgccatcaagcctggctaatttttgtatttttcacagagacagagtttcaccatgttggccaggctggccttgaactcctgaccgcaggtgatctgcctgccttggcctcccaaagtgctgagattacaaggatgagccactgtgcccggccgtgtccatgttttcttaacaatgtcttccagaaaacagaagactgttcataatttaataaagttcagtttatcaatgtatcctttatgaaccatgcttttggtcctaaatctaagaaatctttgcctaatttaagatgagaaagattattctcatgtgttttcttgcagaagctttataatttttggctttatatttaggaatatccatttggagttaatattttatatggtaaaaaacataatgtttaaaaatttcaaaaaatacttttggtttggggttttgatttgcatttagatatccaattgtttcagcactatttcttgattggctaaatcttgagttgctgtaggcttcttttaatgcctttatctggttgtgctattaggccaatgctggcctcataaaataagttggaaagtattccttcttttttagctttttggtgaagtttgtgtaaaattggtattttttcttcttaaatgtttgaaaaaaatcaccagtaaagttacatgcacctgaagttttctttgtgggaaggttttgaaccacagattcagtttctttaatagatacagaatgttcatgaatctatacatatctatgtctatatatatcatgtttatacatatatgtatatctacatcttcttgcagagctttagtagtttcagtttttcaaagaatttgtctatttcacctaaactgtagaaattgacataaatttgtttgtaatatttccttattttcctgttataatatgtgtaagttctacagaggtctttcctctgttattcttgatattgacaatttgtgtcttactttgttttcctggttagtctgacaaaagatttataagagtatcagcatttggtgttattgattttctctattgttattctatttcatattttagtagtttctgctcttgtgtttattatttcctttgttacacttactttaggttcaatcttctcttaattttctagtttttaaagatgttacaggttttcaggatttttaggttataaatttccctctaagcaatgctttggctgcataacagaattgcttttatattgttttcatttttcattcagctcaaaatattctaatctcctgttttagttcttctttaactttgctgtaggtttcttaattctcagactttggagaatttttaaagagaactttctgctattgattgctaattttataatcatcataaaatttattttgtattacttgaatacagttgtccctttttatctgcagtttctctttctgcagttttatttacccatagtcaaccatggtctgaaaatattacagaactttgacagcaaagagagagactacattcacataacttttattacagtctattgatataattgttcttttttattataatttttgttaatctcttactgtgctcaatttataaattaaactttattttaggtatatgtacataggaagaacatagtgcatacagggtttagtactatcttcagtgttaggcacccactgggagtcttggaacatatcctccatgaagaaggagggactactatacttttaaatttactaaaacttggcctggcgcagtggctcatgcctgtaatcccagtactttgagaggttgaagcgggaagatcatgaggtcaggagatcgagactatcctggctaacatggtgaaacctcatctctactaaaaatacaaaaaattaggtgggcgtggtggtgcgtgcctgtagtcccagctactcaagaggctgaggcaggagaattgcttgaacccaggaggcagaggttgcagtgagccgagattgtgccactgcactccagtctgggcaacagagcgagattccatctctaaataaataaataaataaataattatactaaaacttactttgtagcctagaatatggtctgtctcgaaaaatgttctatatgtaattgaaaaaaatgtgtacaatgctgtattgggtaggagtaatagtctctaaatgtcaattagatgaaatagatgaggacattgttgaagtcttccatatgtttgccaatacattttttggtgttcattttctagggattattgagagactggtgttatctttggctatatttgtgaattgctttatttattatttcagttctgacagtttttgctttatgtgtttagaagcttgttattaggtacataaacattcatgattggtatgtcctcacgattaactgactttattttgaagaaatgactttacttatctctattaaactctgccctgaaatctacattatatactattatgttggcattccaactttcttttcattagtgttacttttaacttacatgtggcattaatgtaaagtcagtttcttataggcagcaagtagttgagtcttgttttttaatccatatgacaaattgacaatctatgtattttaaaagggatgtttaggccatttacatataatgtgattattgacatggttttgtttaaatctacaatcctattttttttgtttcttttttgttccatctgttctgtttccttttttcctctttttctacattctttaggatttagtatcttttataattttatctctatgatggattattaatccgaacctttgtgtgtgtgtgtgtctgtgtgtgtgtgtgtgtgtgtgtgtgtgtttagtgctcacttttagggtttctagtatatacacatttaatttattatggtctaccttcaaattatattacatcactttatatacaactgaatatttccatttcacctatcccagagtttttgatattatcatacattttaattctgtatttgttatgaactttacaatataatatcatttttactgaaatcattagttttgaatttcaaaataaaaaaacaattttatatttacccgcatgcttactaattctgtgctcttttcttttttgttagatccatatatctacccaatataattttccttctgtgaaagacttccttttacattcctatcgtgcaggcctactggtaattaatgtttttcatttttttgtattctagaaatatgttttattttgtcttagtttttttaaaggctttatattatatataaaattctaggtggacaataatacctccttttaaaactttaaaaatatttttccactgtattctggtttgtatttcttcctaagagaaattgtttgtcatcctgatctttgttttactatatatagtgtgtcttttttctctagctacttttaataattttctctctattatccttagtaggctatttgattatggcatgccttgcagttgtcttaattttcctgtgctttgtttattgaatttcttggataaatgtatttctactcctaatcaaatttgggggaaattttaattatttcttcaaagagtcttgtatttttttaacattcttaagattttttttctaggcttctcaagtcatttgtaaataatttcctatttttgaaacctgcctctaagctttacaagtgggaccagaaaagtctttagttcaggcctcatttttcctcactgctaaggcaataccattttctaacattctactcaatgctgcatgttttacaaggggtttctattctgattattgagaatatcaacttttaaaggcttgttgtgagcctaagattgttccacctgctctttacaggtagtcctttccctggccttgctggctaccgcaaatgcatgcaccaatttcattcagctgaagacagaggggggaatccttggcaggtctttgtagctcattttcccttcatgcaactttctgttcaccattactctgtcatgggaactctagctccttgtcctctcctacctttcgatgctgtctccaaaatgcaggtaaccaataggtttttcttgcactcccctccctggaaaatctcaaggcagtactggggcagttgcaggacctagcttgcttactttatctttctctaatgttacagaacttcattgcctgtattccaatatctgaatacttacattatatatatatatatatatatttaagttttttcctaaacaactaaaaatgtgcttaatactggtggataaaactggtctcttttacttttgctataagaagtacagatgttgactttaaaaataccttgctgcattctgcagaatctataatgtagaaactaaggagctttaacaattgatttcacacaccattgctgtgtaaagaaagccacacacaaaaattagtttcttttcttaaaaactttttgcactgtcaaaaaatttagtaaccaaaaaacatttgatttagtaagtctgtaaacattcttcatattaaatgtctgtttggattttcagagaatctttgggtccccaggcttgaaatttaaaaatgagattatgtgactatttgcaattcaaataaaataatattacttacaggaacaaagtctgaaatcatctgaatttaagaaattaaatgtaatcttttatgagtgtaaggcaataaaatgatagaatacaattagctcaaatttaaatacaaatatcatctctgcctgcaaatcatttacatatatgtcaatttttttatgtgtactcccaaaagattcagcatacacaatcaagataagtcatttaggagatgttggaaaacatacagatggacaagtgtttttctggtacatttcctcaccttttggttagtagttttcagaaaaactgctatattaggtttgtccacagggtgattatggagtctcataaattttgtttagggggtttttagttgagttgttctgagaaaaatttgagatgaataagtgaagccaagctctggagaggaaaaaaaggcaattttatccaaatctggcacattctgaaggtggcttgggttgaaagtgaatctagcatatgtatttggctatgagatgcttcatgtcaacctttccttgctcacacacaaacttctttgatctatcctgaaaagtctgtttatgccaacatcccatattgctatatataaagttttgcaggaacttctggtgaaaacattactctaaatacagtgggtgctgtgtttacctagacatagatatgtgaattatgtttgatgattcagtagtaggcaacataccaggttcagaactagatcagaacaatcgtaaattagctgtgccctataagcaaacagaatgaataagtgaaaaatatctattaaaaaattacttacaaaaccagaggccaacttgggaatcatactattgcaaagagcatttatttcaactcagagaattaagagctgtgagaactacaagaaatgcattatgatagtgaaccctagttaataatgtcattcatagcagccaaggttgacaaacagaagtttgccctcaagaagtatttgataatatgtcttctgtgttttcctgtttcctggctagaactggatattcaatatgactaatgcttctttcattaaaaaagaaaaaagacagacttcgaaatatttactcacttcttcaagaatgtagaaaacacttaatgataacatttctgttagctgcggtggcagaattatgtatttacatctaacactttttttctgtataacagggattacttaattacagagtactcatatccaaggaaattaaagttattttaaaatctgaagaacattttgaaattaaagttgtatttactgtttctgaaacatatattaaatgtcagaattaccaactttttaagaattgcatgtctcatacacaatttatatgtgtgtgtacggatgtgtgtgtatagtaattttacctttaaaaatgtaatgaacatataacttacaaggcaaattttaaaagacagtgaactgtttagttcaaacaacttaagatctgttatggctataattacaacagtggaaaattggcagtctttaaactatgaacctaacgtgagttggtataaataattacatgtttatatagcccaattgaacaaggctactctggcaaaagccatttcaaaatacaaaattaaaaattgaaactataagtatactcaagcaactatagtaattaaaatccatgttaattacaaatgatccagaaatattcttgaagaacaaacctgttggacaactacatgccaatatatttttagacatatatggagatagtatttgaaatcacaagcatgtttataagtcctggctactctctaagtttatgagattatacggtattatggtctattattatattacaatatgtgctagttaatttttatgttaccatatggatgtactttttgtagtgctatagaatttaccaaccagttccacatacattttcttattcaattcccttaacaagtccacaagccagcttttaacttagttattattatgcccttttccagttgaggaaacctgagcctctgaggggctatgcatgcctgacacagattgttgggttacaagtggcagaggtttgctagaattcagtcatctaaacctattatttaattaataaaatatttcagacaaagtacataattatattgtatggtttttattgtctaaaaacagtgtttgtgaactgaatagtaaagaggaaagatcctgctttacgagcagttttaatgaaggccctgttagaaggaatttattcataattttctggttgtattcatcataacacaatctgaaaactgatctgaattataaaacaagcttctattttgtatgtgttatgtattttttgttaaaaaatgtgctgttaaaagtcagacattgcttttaatttaggtgtaaagaaacaaaaatatcaatggacaacctcagaaataatctagagtattttttaaatgatgccactttatattctgacacatccagcagaaaaagcgaaatgatttgggttaaacaattagacgtgccctttgtttccttctttgagctttacctattgaatttgcctgtgttttatgtacatacaactctagacacgtgctaagacacaaccttctgacactttgccagaaacatgcaaattaaaaacctgaaatctaatatgcaataaatcgaaaataaatgtgtcaggggatttagcacaggcagctcataaggggacaccttcttttcttaatctataaaaggcaaatgtcacggttgaggcatctgccaaactgccatggagaatgtattcactgcatttgctaagccaggggtaccagggctgtcagcagagaatgaaggatgggtacacccaacttttaactccatcttgagaaagaaagaaagaacgaaagaaagaaagaacgaaagaaagaaagaaagaaaaagaaagaaagaaagaaagaaagaaagaaagaaagaaagaaagaaagaaagaaagaaagaaagaaagaaaagaaagaaagaaggggaactttctcaggacacaccaacagggtaagtaaaaaaggctttgggagatttaaaaatacaagttgaaatccccagaaaaatgcttctcttagagttgctaaagacatccaaatctagaggcttagagagccctgaagctggattgggtatgctgaaattaaaacctagaggctaccaaaaggattatcagaataaaacaatgcttctcaaagcatgagacaggttccactgctaagatattattatttattattattatcattattgttattttcaagacggagtttcttgttgcccaggctggagtgcaatggtgtgatctcggctcaccgcaacctccccactcctgggttcaagtgattgtccggcatcggcctcccaagtagctgggattataggtgcccaagccaccattcctggctaatttgtgtatttttagtagagacggggtttcgccatgttggccaggctgatcttgaactcctgacctcaggtgatccaccagcctcggcctcccaaactattgggattacaggcgtgagcctctacgccaagctaggatattattttaagtggcacacagaaatgcttacttgttgattttattttacttgttaaaaatttgattatacatttaatgaatacctattaaaatataagaagcgtattaaacttctgtttgaggactgcaaggatgaaaataaaataaaactaagtttcaaagagttactctgtggaaagtagtgaaaataatggtttaaataagacgaggatttgaaaaacaatgttaaagttggcacccagaagactaaggttgtgttaatgctggaacagagagtacaagcatttataaagcaattgtccctctttactttgctcttctttctctggagataggggatattgaagatcttcctttgtcttaattcatcatgctattattccttatctttgccatcatgcctcccattttatactctgttcttgtccctcacacatcctcacctctactggaatgtaagctcccacagggagatagtgtctaccaaatatttagcacttaatacatggaagaatgaatgaataactgctttatccccacacatttctggacttgagacccctccctgctcacaggatcggtatcaactctgccctttagatcaaagtatttctccctcaagtcacctttaccttacttttgagtaagaacttcaaattttggttcctttagacttacaactggaagcacacaagtccactatgggattaaggattgcagaactacatatagggtatgtgctggccttcccaacagtccccttgtcattgtatagtgatgtgatttgaaaaatctttcaatgcagcagggttggcctgattagtgtacaatcaggctaatcctatcaccctttccatagtgattggatagggatgggaaggtctatgtcaatggcaaagggcattcctcttcctacaaaagttggttcaggaataaggagatgacccagttgccaaaggaaatgacaggaggtgtttgcttgagatttctgagaaagaagataattctcacttctgagaaatttggaaataatctcttgtttctcactggctccagatatgtcctgatatgagtgtgggcaccactgtaaccattgggttgccaacctgaggttggagtggcacacagaaccgagcagaatcagagtctgatgaagaacaggcttgctggcttgatctcaactcctgttttgacctcatctaaacctctggatcatggccttagctttagtgaaacaatgattttgacatgctctgacattttaaaaaggctttcgttttctttaacttggggcaatatatttatacaagttataaatctgttactatacaacccacattatctgttgagttactgaaaaaattccaagacagtagaaatttattacttcatttacttggataatcttgttttgtttatttattgctttttatgtttccttactataacaagaaactaaatagtaattagtattattaataactaacccttattgaacatttgctttgtacctgacaatatgctaatgatcaccacatttaatcctcccaacaacctttcgaggtaggtgtgtcttagtccatgtgtgttgctataaaggaatacctgaggctgagtattctctgggaattttatttggctcacagttctgcaggctgtatagggagcatggcgccagcatctgcttctgtgaatgccacaggaagcttccactcatgatggaaaaggagcagccatcatgtggtgagaaaggaaggaagagagagagagaggagggaggtgccagactgtttttgacaatcagctctggtgggaatgaataaagcaaaagcactcattcccatgaggacaccaccatgacattcatcaggaatccaccctcatgaacaaaacatgtcccactaagccccatctccaatatgggggatcaaattaaaacacgagatttaaagaggacaaacacccaaactacatcaagatcccaaatttattcccatttcacagatgagaaaatggagcattggcatgtttaaatactttatggtctaagattgaacatcattgatgtggccaggacatctttatgttgaacaattctgactactaagagaaatcctatgacattttctattaaaacttgtgtttactcatcagcaaatgtaaaagaacagaaatcacaacaaactgtctctcagaccacagtgcaatcaaattagaactcaggattatgaaactcactcaaaaccaatcaactacatggaaactgaacaaactgctcctgaatgactactggctaaataacacaatgaaggcagaaataaagatgttctttgaaaccaatgagaacaaagacacaacataccagaatctctgcgacacatttaaagcagtgtgtagagggaaatttatagcactaaatacccacaagagaaagcaggaaacatctaatattgacaccctaccatcacatttaaaaggactagagaagcaagagcaaacaaattcaaaagctagcagaaggcaagaaataactaagatcagagaagaactgaaggagacagagacacaaaaacacccttcaaaaaatcaatgaatccaggagctggttttttaaaagatcaacaaagtacatagaccactagcaagactaataaagaagaaaagagagaagaatcaaatagatgcaataaaaaatgataaaggggacatcaatcccacagaaataaaaactaccatcagagaatactataaacacctctatgcaaatatactagacaatctagaagaaatagataaattcctggacacatacaccctcccaagactaaatcaggaagaagtcaaatctctgaatagaccaataacaggttctgaaattgaggaaataattattagcctaccaacaaaaaaagtccaggaccagacggattcacagccaaattctacaagaggtacaaagaggagctggtaccattccttctgaaatgattccaatcaatagaaaaagagagaatcctccctaattcattttatgaagccagcatcatcctgataccaaagcctggcaaagacacaacaacaaaaaagagaattttaggccaatattcctgacgaacatcaatgtgaaaatcctcagtaaaatactggcaaactgaatccagcagcacctcaaaaagcttatctatcatgatcaagtcggcttcatccttgggatgcaaggctttttcaacatacacaaatcaataaacgtaatccatcacatacacagaaccaatgataaaaaacacatgattatctcaatagatgcagaaaatgcctttgacaaaattcaacaaccttcatgctaaaaactctcaataaactaggtattgatgaaatgtatctcaaaataataagagctatttatgacacacagcacatatcatactgaataggcaaaaattggaagcattccctttgaaaactggcacaagacaaggatgccctctctcaccgctcctattcaacataaagttggaagctccggcaacagcaatcaggcaagagaaagaaataaagggtattcaattaggaaaagaggaagtcaaattgtctgtttgcagatgacatgactgtatatttagaaaaccccattgtctcaacccaaaatctccttaagctgataagcaacttcagcaaagtctcagcaaagtctcaggatacaaaatcaatgtgcaaaaatcacaagcattcctctacaccaataacagaaaacagagagccaaatcatgagtgaactcccattcacaattactacaaagtgaataaaatacctaggaatcaacttacaagagatgtgaaggacctcttcaaggagaactacaaaccactgctcaactaaataaaagaggacacaaacaaatggaagaacattccatgctcatggataggaagaatcaatatcatgaaaatggccatactgcccaaggtaatttatagattcaatgctatccccatgaagctaccactgactttcttcacagaattggaaagaactactttaaagttcatatggaaccaaaaaaagaacctgcatatccaagacaaccctaagcagaacaaagctggaagcaacatgctacctgacttcaaactacactacaaggctatagtaaacaaaacagcaggtactggtaccaaaacagatatatagaccaatggaacagaacagaggcctcagaaataacatcatacatctacaaccatctgatctttgacaaacctgacaaaaacaagcaatggggaaaggattccctatttaataaatggtgctgggaaaactggctggccatatggagaaagctgaaactgaatcccttccttacaccttatacaaacattaacccaagatggattagagacctaaatgtacggcctaaaaccataaaaaccctagaagaaaacgtaggcaataccattcaggacataggcatggacaaagacttcatgactaaaacaccaaaagcaatggcaacagaagccaaaatagacaaatgggatctaattaaactaaagagcttctgcgcagcaaaagaaactgtcatcagagtcaacaggcaacctatagaatggtagaaaatttttgcaatctacccatctgacaaagggctaatatccagaatctacaaagaacttaaacaaatttacaaaaaacaaacaatcccatcaaaaagtgggcaaaggatgtgaacagacacttctcaaaagaagacattcatgcagtcaaaagacatatgaaaaaatgctcatcatcactggtcatcagagaaatgcaaatcaaaacaacagtgagataccatctcacgccagttagaatggcaacaacaacaaatgctggagaggatgtagagaaacaggaatgcttttacactgttggtgggagtataaattagttcaaccattgtggaagacagtgtggcaatttctcaaggatctagaactagaaataccatttgagggagcgatcccattactgggtatatacccaaaggattataaatcatgctactataaagacacacgcacacttatgtttattgtggcactattcacaatagcaaagacttggaaccaacccaaatgtccatcaatgatagactggattaagaaattgtggtacataaacaccatggaatactatgcagccataaaaaggatgagttcatgttatttgcagggatgtggatgaagctggaaagcatcgttctcagcaaactatcacaaggatagaaaaccaaacatcacatgttctcactcataggtgggagttggacaatgagaacacatggacacagggtggggcacgtcacacactgcggcctgttgcggggtggagggctgtgggagggatagcattaggagaaatacctaatgtaaaggactagttgatgtgtgcagcaaaccaacaggcacatgtatacctatgtaacaaacctgcacgttgtgcacatgtaccctagaacttaaagtataataataatttaaaaaaacaactagtgtttatattttcccagcatgaatcattgtttgattttacttccttgttgcctgcctgcttggctaccacaagcatcagaatttttagaggaagaggtttgtcagtttatctcaacaccttggccagtatctagcacaacaaatgctcagtgagtatggactgaatcaatgactaatgaattaatgaacaaacgaagaaacgtgctgaaagctgtggaggtagtaaggctcacagctgactcaaaggctaacactgttgaatgttatgatagccataaaagtgtggcagctactctatgctgaccacttccagcagaatgacatcagcattttcattaagtgtatcagatacttcttacatttaaaacccacagtcatagactgaatcttcacaatagataaaatcatacagcacctggggagcatgcactataagtagagactatccaaaagttcaaatggtttagtttactttcttgtggatttttgtttcctagatttttcagttttccaaaacaatgccttaaaattagctattaatacaattgtaatcctacaccttccatctgtacaatactgtgtagcttctaaagcacatccatttgtattctctaatctaagcccattacatttcctgcaaccagaaacacagataccagtttacatgcagggaggataagactccggaacttgaaatgacttggttcttagcacatagagagtagctgatcagctgtcctgagagcctgctccttactcttgtcttatttttggcagcttctccagttccatcgagggttggaaaaatatccagtaagccaaatcttcgagaccacctgccctgagcaaatgtcgagctgacatatgagaattgaacctgagcagaggtagccattactatggcaactccctctgattcatgtttggctgtaaccccagacatattgctttcacctaaaattctcctctaaaaacaaaagttgaagccatggtgatggagagagagatggctgccaagacagtgagggagggctttgctcctgtcctttatcatccctcagcaaatacataacccaggtcagtgtcacctgccatccctactcaactaaagggtacagccaatttaggaaacatgtagagtaactctccaacatgccgggatgcaattcctgccattatatctgtttcgagtttgctttaggttgattctcttgtttaatctttttttgctttcttcgtatctcctctttctccataccttctctcctttctttcagttattttcatttttttcatttctttcttacagtggagctcacttttagtggaaaaagattttgagatgtattaactaatggtttataaaattgataatctattcacttgtgagctcctatttaagtctgaaaaacatacaaaataaaacagtatattttgttagagtggagaattggtttattttagaggtattttagattgcatgttatcacagaaaattaaacattgatttaaaaacaaattatttaccttataaattttaacaaacaaatataaacatgtctctagataagcgtatctctcttggctaaaactataatatataataccaatgagagaaagtttatattaaaaataggcattatacatgttcttgttaagtcttcaacacatcaaaattattatttttttccaatgataaataagtagttagaggtcttcaggattgaaggtttgaaaaatactgtgccaaagcttgttctaattaacactctcagctcctgttaaatttgatagaagttaaaatgtgaaaattgaaagagagaatatatccatagagcattctcacaaacagtaaaattgccaaagaagaaatcatagctgtgctatttttgatttttaaaaatatattaggcagatttgttattccttatcaccaaggtacctgactacattcaaaatgcttaatgaaaagatgagtctgtgttgtattaacaaaagaattgtgtacaagcatgtactgtggaagagataaacaaattactttcagaaagtgctatgtcaaagagattaattctggcacagatgcacatgttggcactagctatagtacaagtattgtataattctttcaaaattgctaccattccatcaaataaataaatgccatttttaaaaggctacatattttgagtaagactttgaatgtttctagcataaagaaatgacaatcatttaaggtgatagatatcctaattgcattgacttgatctttacaaattatataaatatgttaaattattgcatgcacctcaaaaatatgtatgtctattatatttcaataaaaaataatgatgataataaatactggaaacaaagggtgcatttatttatctggtcatttatttttaaattcataggttattgtgcatttatacagtatgtggtaccactgtcttacggtttttacgggccaaaatggacaattatcagcaattcagacgtttcaacttaataaagggtctattatcaagtaacattaatgttgattaattgtccaattaacataggtgacataggacaaccttagaaatctaaattgcaaaataatgaggcttgagttacaatattaaatgggttccaacatagaattaaatcttatactctagttacaaattcttgtattggctattatctacctcttgttgttgttgttgttgttgttgttgctgttgtttttgccttatccaatcaatttcatttgtgggttaaaacatttataggtatccatgtgatatcatgaacctaatattagctttcttttaatcatgatgatgccagtttcacattggtcacgtcttcataaaatttctgtgtcttattcatatgatgatctaataaaagtttccatgggggaagttataatttatgagttgtactttgcatgaaatgtctttatttagtgattttacctgcctactttggtgttgtacaaaaggaatctacagaaatttatactagaaatgagagaactaaaatcttaccattgggctactggaagagataaaacaacagacatggggaaaaaaaaaggagttgtaagataagaacccatcttgccacaatattatggaggaaaagagatttactgggtgttctctgaagctccctcacccacccaaactctaccctctctcccacagtgttccctggtttcctgtggggataaaccaatggcaggcagaagcaagaggcttaaaattggtaatgggggtgaaggtgaggaaatttcccctccacacacaccctgctgctagtcctatccagtcttgatgcacataggtagtgtcctttctcctctatgttccagcttcaggtgagggacccatcttccattgttttaactcttgtcagattccagtaacacttttccctccccttcattcagccctagtgatgacaatggcttcgtaatactactagtgtctgagtgcatcaccatcccttgtcagttttcttccccctgcttatgtctgtaatttagattctaataatattaaatatataaatgcacattaacctatgaatttaaaaataaatgaccagataattaatttagagtataactgaaagttaaactccggtgatgctatttgtttatttaaaagatcttgataatcacaaaagcacaacacttttgtttaagtttctgatactgtttgtaatatttacaatacagtaaataagtaggcaaatgaacaaaagatatatacactaaaaaacagacttcacaaatagttatgaagagctctggaaattccttaatcaaccaaccaggaagatttcaaagcagtgtttttattgtattagttatcagactgatttttttgcaacaagataaatcaagaagttattacaaaggggaaatttgattggagtgtcttcatgcattcaaaaaataactagtgatacagctataaatgaggcaagtaatgcctggtctcagctgtaaataaagcagataatgcccggcctcatcctgctagcaaaatagtctataaacaaataattacactaagaattacatatatgtcaattgttgtattacaaaatggaaatatgagactattttgattcaaaggaaacgatttgtaagtgaggaactgaaacatgagttatctaggtgaagatgcaggttaaaaatctgcctaggcaggacaggtcagacgtgcatgagggctccatggtgtgaaggggcacagaaaaattgaaaaatcaaaaggagtccagggtgactatatgacagagaatagggtggggaatgatgagaaattaggttggcaagaacaatacaaatgatgtaatttcaatacctgcagtctatgttaaggattttaaaggcttttctaggagcaatgaggaactccattgaacagcagaagaagaatgacatgataaaagtttgtttttgtaaggacatctctaactgcttacagaagaaaaaaatagaggtagaggttgagggagcaacactggataagaggaaaacaagtgaaagacattgttaatttagaatacgatgttacatatgaagagaggtaagcaaaattgaaagaatggtgattaatacaatgcagatgcggggagagggaggtagtaagtttgataaccagaattctacattgagccaaatgctggttgatggtgtcatttattgagatggagaatcctaggaaaagatcagttttgtgaagaaaaataaataatttggttttgaatagttgagtttgaagctattaatacacggatcaagtcagcagttgagtttgagggatgaaagaataaaatcttgcctggaatgagcactagagagagaggtcaagcttgggatggaaatgtcagcatttgaaaattggttctaaaagaaagagatggcaaaggagactgtcacggagtgaccagtgtggtaaatgaaaatcagaacattccggcgtcagtgaagtcaaagcaagatactgtttcaaggaaaatcaaatgcattcaatgtgattgggatgttacttagaaaataatggaagatcatgttttagattttgtgatactgaggttgtaggtggcattagcatggacagtgttggagtggaaaagtggagacaatgtgcctggacaactcataagaactttgagtgggaaaggaaggagtgtaaaaggcaggagtaggaagagattcaaatcaaggaaaggcttttttattttaagatgagagaagcaaatttagctgagataagaaaggtcaggtagagagtcacaagttgaagacacagaagacagaatataaaaatctagtgcaagaggaagagaaggacatgaacagagtttaaggaactgggcttgaataaataaatgtctatcacttccatttagcaggcaggcaaatttgatttcagaaactgaaagcctttctccctgatgatttacactttctttgtacagcaagaagcagttatctactgacggtgaaaaggggaggaagcctagaggtttgacaatactgtggaatattgaaatagacatttatgttaaatggaaccacaagccagttcaaaaaagtagtaagattgacaaacaattttgaaggtgcatgtaacactggtaatcataaatttagaggtatcaactgctaaattttacataatacctcttcaaccaagtacagtgtgtctgacaatggagcatgatttgctggatgacaaagaacatctcatctcttgctatatctccaagaaactttgtgtatagccctgagtcttagtcagttcagactgctagaataagatacattaaattggataatttgtaaacaacagaaatttattgctcacagttctggaggctgggaaatccaaggtcaaggcaccagcaaccttgagaaccaattaaatttgtcacaagggatatgggtgagaaaaataaccaccattacacattttagtagtacaggtcctaaaaacgtagcatgctattattaatctagaactagaacatttagagtaaacctttacattcttcaattatatatattggaatattacatgtatttttaaattcagaagttactctgtggaaaaaaatctatagacatgaaaaggaggtgagagaatcaaagatctaggctggaaatctggattctgggtcagattatcaatcatcctggtttgtccaggcataaaaaaagattctgagaatgtagggctttcagcactaaaatgggcaagtccctggaaaactaggacacattggccatccacagatgcagatgattttgttcattcttaaccaacacagcccaagtgacatggtttggctgtgtctccacccaaactgcatcttgaattgtagttcccataatccccatgtatcatggaagggacttggtgggaggtaattgaatcatagggatggttacctccatacttttcttgttatagtgagttctcatgagatctgatggttttataagggattttccccaccccatcactctgcacttctctctcctgccaccatgtgaagaaggacttgttttcttccccttctgccatgattgtaatcttctcaaggcctccctagccatgctgtactgagtcaattaaacctctttccttcgtaaactacccagtcttgagtatgtctttattagcagtgtgagagcagactaatacacacacacacacaaaaaaaaacaggttctgtctgcataatcaaatgtatgccaaggaatcattttaagtaataatgactaaaatttgttgtaactttactctgtgataggcagagagatgaacattgtcatatgtaatactgtctttaaatttatccttgttttaaaaatcttccagaacacaagaggatgtttgggtttgtgccaaagactagttagtttaaatgaggacaaaaagacagtagaggatatcatgttcctaattaattcttgtccttttaacatttttttcaactaacacagcctcgatctcatgtatattttgaaagacttgttattagtgttcaagtttgaactgaacaaccattttttgggctatgtggatttatacatcaggtaagagtacagatggatgactactaataacctttccaattagattttctataagcctatgaatttctcaatgtatacaaactctgaattttaaaaacatcattttcaattctatacataatgtaaccccagaattaagccttaactggcatttatgaattggactagagcattgcatttatttctacattgtatttattttgacagaagcaagtatttgaagtgttggaaaggcttgggaagtctgtaaaatgagaagagctgttttttacccccagataaaatatggattttcttttaaagtaagaccaacaaaaaggaaacaccatctgtgaaattttaaaatcaggtatttatcattgtgcttcaaaagtataaaggcaacccagatggatgattcactgggacagcatcactgaaggcaatgaggtccaatactgaatacacctgctgtaagtaaaagtggaagggaagactttttaaaaatcttgtatttgagtattatccagcaatatgatgataaaaatatctggagacttttccatatagcccaatttgactaaagatggagagttcgacttcattttatttcagtttgtatgatgtgtccacccttgacatcaccaaagtcacaattctagctgcaatatttcagtcaaatggtatgattcgctaaataaaagcaaacagggagctaaaaattttttacttaatcattcaaagattaaactcatctatcacccagtggaatcaatcgctttatgcatgcaaatgtagcttttatttataaaattctcaaagagaattgaggttacatgaagaaaaaagatggcaactttgattaagcatcgtcaagaaaaatgcaacttttaagatgagcaatgagccaaattattaagagtaggaggtgggacaggaggaagagataaattgattttaacttccaactctgatttgactctgattttgggcacttactatttttcacacccctttccttttcctaccatatggaaattagaaggaaaagacaattaggatgataggagagaagagacaaggtgctttagagaaagaaggagaaataaagttagaaccttgtccaggagctctctcccaacatgaaaactgaaagagcaatattttgtccaaggaaactgggcatttcctcagcttgttcctccctggttattttactgctagcacttcagtcaccactgtcaccatctggagtcagtccatcacttggtttccccccaccgaggaatatgctaagctatcaggaagttcaccagcaaggctcatctgcctccctccatgttggatgtagacaatttggaaagctgtgatagaattgcattctcagttttgttcctgaaaattcttcaaattacagtttacctgcatcttcatctcctttccttgcttcagattattgcaaaattttcaggaaagtcttttctgactgacccatttaaaacagcagcaccagcctgcactctgtgctctcctaccttgttctcttctcacactcatcatcagttaatgtagcatgtagtttacatatttgtcttacctattatctgactctccctactctacccatttccattaaaatctgtgaagcggaattttctgctgttttgttccttgttgtgtctgcattcctggtacactcctttgtcttgatcactatacctggttacatcaaaatgtcccactttgcctgtatttctttgaggacaagatatgatataatggttaatttagggttcatgtgacagaagggcttactgtggatttggaggctgaagatgggagtttgtatcatggtcacactacaacttgagatttggacactgatcctcagtttccttccctgtaaagtgagaattaaaataatactatttttcagtgttattgtaaatagtcaataattaatgtgaaaaaaatgtatacagttgactcttgaacaacatgagtttgaaatatgcaggtccccttatctatggactttcttctacctctgccattcctaagacagcaagaccaacccctctcctttgtctcctcctcctccttggactactcagcgtgaagatgatgaagataaagacttttaagatgatctactttcacttaataaatagcaaatatgttttcttttctttataattttcttaatattttcttttctccagcttattgtgagaatatagtatgtaatacataaaacctacaaaatatatgttaataagatttttatgttatctgtaaggcttctaatcaacagtaggctattagtagttaagttttcagggagtccaaaattatacatgaatcttctaccatgcaaggggttggcacccccaacccctgcattgtttaagagtcaattattcatagtaaaatattaaagagatattgattattactattaaaaagaaaatctggccactttatctgaattagcaaggagcagaatgaggcctgaaaatgatattaagacatttgtactacctggatataatctatattactaattggctagacatgtgaaaggatttaaatgatttacttatatttccaggtagttctttcttgagtctctaagtttagagacttagttggtcattttagctgaattataatagcatctatcttttctacacgttatgatgaactaaaatttcatcacaaccttatatgcagtatgcattgttcatatcatgcaacctattctttagcaaaaacacttaactttaaaatttgaagaaggaaaccattcttctctttggtatgtttattgtcacttgggaaaattgatgtggtaagtttattgtttggagagaaaattgttgactccataaaatagcctacttttcataccattggtatagcacttcattttagaaatgtggttttttaacattataggagcatgaaaaggaggtaattttagtaaccacttaagaatcatgaactcaaaggacatctaagaagtgtttaaggaacaaaagaggtgaaaatgagaggggaatggctggatttttttccttcttatttaaagtccttccgatttcacttctttcttgattcggattcattgtatagcattaattctgaggctaagcaaaaatgtttaggctgtaggaaaagctgcaacaagctgataggcatatgtgtgtacactcttatacctaagaaaaaattcagagccattggcttttattaatctcggtgatcactctttaagtccctccctcaaaacctaacacaaaccaagagtgtcttgctggagctgataccgctgccaatgactgcatgtgttcttgcctgattcttgctattattttagtcactcttcttgctttggggacccttctcaaaaagctgatagaggcttcaaatttcatctgattgtattaatctgactggatgtagaatgactgacagaaaagcaaccataggtaatgtaggatacatagaggtcaactgatctaatttgctcactttacataaaaggaaacagaggtccaaggattggctcaggaagtgagaaatgaagatgaaatgaagtgtgaagtctctacgccaagcttaaagatctttccatataatattctcctctacctgaagtgttctttttaaactatttgaatatttttaactattagattacagcaacaaaccaattcattacatatccatcaaataatgcaagggcaagctacagaattagagcaattgaggcagatatttctgaaatgggaaattacacaggaagtgtttagaccactggctggcattcactagttactttgtgagtaataatttacatacatttattcagcactaagattccctgagtaacaagatctgaggtatttgtgaactatcttagaattggacaacatgaattatttatatagccacattagcacctgtgacattagaaaatctatacaatttctgactcactttcttcatctatgaaaagggaaacccaatattaatccatgtttcacaatacttagaaattaatagatccccataaatggtggttttcatcattaaaatctctagtatcctcatcatgatagcagctaatgactcaatgctataatccacctttgagaagctgaggtagtctgagattgacaactatctggcttctcatgagctcttagcacaggcaaagattctattttcctgaccctctggaagttaagcttggccatgaaactttactctggccacggaactttcctctgggcactgacataggggcagaagtgattcatgtcattcctgggtggaagcacataagaaccactgcatgattctttaccctccctttcttctgaagtgttgacagccattctgtgtgttcacagcttacatcagcctcggcccctcagcaacaaccgtgtggagcagagcaccctgccagtgcaaaatggacatgtatcatgagcaaaaataagcctgtcttgttttctgcctctgaaatttattttctcttattgcactttaacctggactatcatgattaacacaagaagaaatttcaaagttaagtcttcacaactatttacccaatatcacccacataaatcattactattgaacttttgctacaattccatgtaacattaaatctgccccttaaataaatcaatgaattcattcaataatattttctgagagcacctgtgtatacagcactccatattccctaatctgtaagacagtgacttacacatggcagccatccaatagatgcttgttacattgaattgttgaagtaggtcatgccatgaatacttcaaagactacatattattctgtttcatttaggataactcttagccagatcttgagctctagaaaaaggagacagacatctaacaacctgaaatggttaggcacagttgcacctgtaaacagaaaggtgccactgatgtcatgagaattcccctttgtaaactttgaggtctgtagatggttgggctgaattcaaagttaacatagaaaattatataaggcagataaatctgagaacacagttttcaatttatgtttaactctttcctgaccctctgtcactttctaccttcctagtcttcctcaaactctagatatttatgtagtggatttcatctgccagccacagggcactgtaggtttccttgtccttgatcgtggattcaaatccatgcagttcagccctagcattggccaatcaaaagtttctactaacatgacctacatgactgattcagaaatagttaattcaagcagagtcaatcagtccttggatgcatgctataaaaattaggaaaaagaaattatcttgctactggggggctgaagcctaaggcttcggctggcatcttgccacagtgacactatagcttgcctaatgagtcaactaatgtgtggaaatacattgtgtgtgtgtgtgtgtgtgagagagagagagagagagatcttttcagtcttctctccccttttcagttcaccaattcattttccaaacttggagatctgaaggtttgccaagtctccttgccctacaatgtaaaccattaagtaattttttccgcagttctcttgagaagtagggttactcttcctgctgcttttgcagaacagcagggaagtgcatgggcttgctcctagtcccaaatcagtcccctccccttcctatgatactttctctccactggctattgcaagtgttccctattctctccaagctcctccttcctagttctacttctaattcttcaatccctgaagatggtttaccttcctaattcagataaaagtagagatgattaggactaaattcattcaaggtgacattcccaaaattgaatatatttatatgtgatccatatcttttttccttgtctcaatagaaagaattgtctcttctacttcatgttaattcctccaacataggattttatcccttcctattgttcctatactcatacttatttattcattctctctctctctcactttctctgtcttattttcagtctttctctttctgtctctgtctttctgtgtctctttcttttgcttttcctctctctttctcaccctgaaccccatccttcatctattaacacatattcactcagctactgagttgctaaatttaccaaatgaaaacactaaacaatgtattaaatttcatttaagcaatgaaaaatgtcttaatacaagtgtgtcccaaatattgcatgatatatttctacaaaaagtattagactttttaaatctaaaattcaaatttcactggacacctcgtgtttatcctggcaactttacttagcagcaatgcaactcaacatctacaaaatcaagtaggacagagagggtctccgcttttctcattgcctgtgtcaagtcactccagaggaatggtcttggtttcaatatggcaatatactgacaatctctacagaccttcctctcacaaatattaatctctcagagcatcactttgatgtcactatatcaaaagatctatttcttcttatgagtgatgactgataaggaaaaaaggctaaagaaagcagaaaatctgtcctaatgcacacatatgtacaagtgctttacacacctcactaacacacaccccccaaaacactcatctctagatctcattctagtcattgccgtctcttttttcttttgacaccgttttcttttgtaatccatttctcaaccccatgggttctgctgttttcctatcattcccgtgagtctgttgaaaataaggttatgaaccaaattttaatcataaaatccagcaggcacattttgccttgaccttactctgctctgtttcttgtgttttaccttccttcttcctgaattgtgtccacccaaaagatacattgaagtggtcatttctagtacctctacatacaaccctatttggaaaatgtctctgcagatataatcaagtcaagaagagttctttagggtgggtcttaatacaatatgactgaagtcctcataagaagaaaaaaaaaatcagacccagaaaaaaacacggagaagaataccacgtggaaacacagacacagagggcagacacccatgtgcagatggagacagagactggagttacacagctgcaagccaggaaattcctggagccaccaaaggctggatcaggcacgggagaatcctcctttagtggtttcaaagggagcatggtcctactgacacgttgattctgtactttaatcctgaaaactatgagagaataaatttctcatgctttaagccatccagtttttgatactttgtcatgggagccccaggaaatgaacacactcacctttaatgctcatgaaactattctctaattcctcctacttcttttcaggtttttaaaatcttattccttcactgaatatttacatgttgctatgtactggaatttggctttcagccttttttttcttctcgttttccataattgccttagatgacctcatctaccacaaagctttcactaccatctacatactatataccacgtgtaaatacaacagtttactacaattagtgttagcattattgaacaacaaagagcagaaattatggttctttttatgactgggtcttcagcacaaatgacactatattggaaacaggtcacatttcatttatcttgaagaagtggaggaatctatgactgaagaaatgcatgtacctcgaaaagatgtccatttgctttttgtgtcaaagaagagagccagtcagcttcccgatcctagctgtcctgagaatcattaagatatttaattctgaatgcactataaacatttattctggtaattattgtgtggcataatgagtcatggaatgaaaactcttgacaaagtctaattctgaatatcttcctaacaggctggagcagctgatttcagcaccaaagagcctgagtcctcactatgattattttattaccactatgaaggcaatatggattgattgactgattgattcccatttcattcctttatagttttgagctatttcacaagaatctgtgaaataaaacaataatgatgattaataaccttatgaagtgcacttaataactagggtttcatagagtgctgtgtgggtgaaagaagaaacatgaaactagactttatattctaaagcaataaaaagatgtaaggtattgagtttgagaaaacagtagttgctttttggagaaacaatagtctctctgagtgacttaggactagatcagagtaccccaaatcgaatatgagtgcccaatctgtatgcaactgatctgaatttaacaattggccttgccgcctctattcgctgaaagggagagggaaacaagctgagatcaactaaccttcaggaacagctggaagagagaatgaaatgtgaacaacaaatagccagaaaatgagtgtctcttttgtagatgacatttttatattactgaagttcaggaggattatagagacttccccaatttctatcgtatcaacttgcttagtcttctgatttgtttttaacttaaggaagtgcttattaccctgttacataagtatatatataataggttatgtatatttgaaaaataccatcatagacagccaatgcacattggtcttcatgatgaatgcatcccattctcagtcacctgttcacacctccaagcacatgattccattatctcagatgcaatacatcctgtcactcttctaacattttggcacagaacttacctagtatatctctgaatggcacatttcttttttgcttcttttctatcaaagtgtattcttttaggaaaacagaaacatatctagataaataacaaagcactctgccatgaaagacctttagcaaagcaagagccagccaagatctgtacgtgttgattacagccaatacattcaaccaacaaacagatgcaaatgggtgttagagggacacaaagcaataaagttttctattgtgctgtgctgcacagcactgcaattataggcacatctgcagtcaattatattttctgaggattgaatggaaaggctttcatttcatttttctacctgcactgaaagccagatattgccattgcatacatttcagcatcctgattttagatctttcaaatctagtcacaagacgactttctactctgacagactcccctccttacacagccctacccttgtgatggccagcaaacagatcaatgctcttttcacagattctgagaaaatctgctgactggagaatattttttcacagtaagcagatgaacaacaacaataaaaaaatggatggaaataatgaaataaaggataaaggaattggcaaccaggagcttggctaacagaaaataatttgctagttaataaattgagcttgaacatgacagagttgaaatgtaacctttgcaagtagaatctacaggaattcaaatgtgaaatgttggaaaatacagtgacagagctgcctttgtttaatggtcatcccaatgttttaaggagaattgcaaattctatgaaagtggaagagagagataaaaacaaaagaatatcttctccatttttttctagaacaaaatggattctaaaagtatttgtgagaacgcttagataaatgaacaagataagatacacatatatgtctaccttgaatttacttcagtaaaatgatttttaaaatttatacaactcaaataacttttagtagatctgcccacatttctagatgaaaaaataatatcatatactaaggttaagttgtacagtatggcttgaattataaaagcagctcttcagacatcttcttttatgtatgtgcttcctgtcgactttaaatttgcaatttttgtagatatttttctactctgttgagtaggttataaaggcttagattaggtaactgccctttctttttcaaatggaagaacatggtaatttataatagcctcattagtacattgcagaaaatcactaaatatcttgtctccactgtaaactctgaggctggtatcagaactatagaaacatgaaatatttctaacatccagtgttaataatctaacatccaaaagggaaacctgaaatcccagaaggatatttgttacagaatgtagcacaaattgacattaaacatttaaattgcctttagacaaaaatcttcccaccacaagtccttcagaggcctggtcaagcattatctgttttacttatgaattgacaagctaaagatgtcatagtgactcagagatggagggccaactagagaccaagtgatctattaatagatggagacattaatagattctgagacaggaaactttttccttaaggctacataattagttaacacattaaagatggagttgatgagcttctacccaccattccatagttcatctggagaagatataattcagtcctattctcagtccaatgaactttgggaaatgtgcttacctttcatgagggatgacctactgaaattgtaagatcaaaataatttattctataaatgatgtgagacaaataattacttctctgtttatgtgtctgtcttttcctctctcccaaaataaaaaattaggtcaaagcttcctaaagtacaactttttgaattaaggtttgcaagatttcccagagtgtaatatggggatcagtgatcagacgacatattctgtgaagacaaaaggccctatgattaactatatctaggatataaaaaagtttaaaatgttaggtcctattatgtatcctttttatattgtgtatcattttatcttattgtttatcttttttttttttttttttttttgagacagagttttcctttgtcgcccaggccggagtgcagtggcgcgatctcggctcactgaaaccaccgcctcctggtttcaagtgattctcccgccttagccttatcctttttaataggacataaaaagctctgagtaagctctgagtaagagtcttgcttaacttcatatgttcccaaattcacctgactatgaaagccttttttgctttactcctatgagaataatttgaaactactgtccaaagaaacagtttttgagaaatatgtagctaaaaatgatgaactgggaaactacacctccaatctctttgtgtccgttgcttcatttctgagatgtcatataaatacattaaaatttaaaacccagctgtctcaaaaccccatttcaggatgatgccaagttttccgagacatcaaggcaccctgcctgtgctctgatctggtagctgtggctggctaagcagggtgctttgttgatgaagatggcctcttcaaggaatgatcagatctgtccactggaaccaagcacattccccagtagtgggaattgtacacattaatgcaggaataaaattaattaagtaatgaattctctgtttataagtaaacagaggggagaaagatggacagcttgctggtcatgaataagggtttatcactgaaatggaagaagtaagcctacaagcacagagcagagacaagagagggcaagtgtcagagctcccatctttacatcaacagctctcaatcaggggccacagcccccccacccgccaggagaggcttaggaacgtctggagaaatgtttgcttgttgccactgagatgaggtgaggtagaggtaccattggcatctatttgtagaggtcaagaatgtcacttatcctacaaggcacaggacagcccccacaagaaaagaatgttctgtctcagatgccaatagtgatgctgttgagaaccccttgtctgtactgagctcattgtttttttcatttggacaaagtagaagtggtcaactgaggtatttttgtgtaatggcaaaggcatatgcaacattgcttcatgagatgcagtataaagacttccccattgttttgttttcgtgtttctatgtgatgttctcttctccaagggagaaggcttcttctccaagggagtcattattagagactgcacaaccaagcctaagagcaaacatgcataaaacaactaataatatgaaatacaagcaatgccatcaagttctcatggtgataaatcactgcttagaggagaaggtttaaatgctctaggaggattttgcaattcttctattgatttattgccacttcctcagattgtcttttagaagattgaaagaaataagtctataaataatctgattgcaaataaaacatatttgattaatgtctatcaacagtgtgaatagcaatgaacccctcttatttttaatatggatttgtgtgtgtgtgtgtgtgtgtgtgtgtgtgtgtattcacacaaatacatgcatgctattcttaaaatatctatttcttgagtttcccaaattaagtttaatggttgatgcaaaaattatgacactgcctgatgtggttctaaatgtatgtgaaagaaatatttatgaaaattatattataaatagaggaagataaaaggataagagttctatatcttatttgaactggtaatatgacactaataacacatatatatatataactttatatatacataatcttcatacacacatacatgtgtatatacacacacatatataaagtaattcttagagcaactaatatataaaagctgtatgttttggtctgtttaggctattgaacaaaacaccatagacatggtgagaaacttattttctcacagtcctggatgctggaagtacaacagtcactggaatattcagtatctggtgaggactagctttctggttcacagacagcatgtttttactacgtcctcacatggcagaaggagcacgggcggtctctgggatctcttttataagggcactaatcccattcacgaaggctctgtcctcgtgacctcccagaagaccacctcctaatactatcacatgggaaattacatttcaacacatgaattttaaggaaacacaaacactcagtctatagcattctacccctggtcccccagcccttatgcttttaaataatccattgtcaaagaggaagtctcaaaggaaatttaaagaatacattgaactaaatacaacatatgaaaattggtgggacacggctaatgtggtgttgagagggaatctgtagcactaaatgcacacattagaaaagaggaaaagtttgaaatcagtcagtaagctccctcttcaaaaaccaaaaacaaagaagagcagggaaaaaataaaactaaacagaaaggagaaaatagtaaagactataaatcaatgaaactgaaaagagaaaaaccatagagaaaatcaatgaaacaaagagctgaaaagatcgataaaattaccaaacctctagcaagactgacaaaggaaaaaagagagagagaacacacatgctatcaatatcagaagagaaagagaagatataaccacaaccctgcagatttcaaaaggacactggaggaatcccacaaacaactctagccacataaatttgaaattttggaggaaatggatcactttctcaaaaaccaaaaacaaccaaaactcacccattataaaacagataatttaaatagccctatagcttaaagaaattgaatttgtaatttaagaactcctaaaacagaaatctacaggcacaggtggtttcactgcagaatgctagctaaaaagtttttgtagattttctttctaaagctaaggaagttcccttctgttcttagatttgctctttaagagaatcaaaagacatgctacagagtgggagaaaatatttccaaattgcatatggagatgaccataatatccaggaaataaaaagaactctcaaaactcaagagcaaaagaaaccaaacaattcaattagaaaatggtcaaagatatgaagaaatatttcactgaagagaatatatagattgcaaataaacatttgaaaagacagtcaatatcattatccattagggaaatgcaaattaaaactgcaatgagatatcactacaaacctatcaggaaggctaaagtaaaatatgttgacaacaccaaatgctctgaacgatgtgggcaaactacattattcatacattgctggcaagaatgtgaaatgggacagccactctgggaaatagtttagcagtttttaaaaaaatctatcgtgcaactattttatgatctagcaatagcacttttaggcatttatcccagagaaatgcagatttatgttcacacaaatcctgtatgcaaatgtttatagagattttatttgtaatagccccaaactggaaacaactcaattgtttttcaatgggtgaatgattaaaccagctctggtacatctctgtcatggaatactactcataaacaaaaaataatgaaaattgatacacaaacaacctgaatgaacctcctgagagttacgctgaatgcaaaaagtgaattctaagttatattatgtatcattccttttatataagattcttaaaatgacaaaaattatagaaatagagaacaggccagtggttgctatgggtaaggggtgtagagaggagggaagacagagtggttatcaaagtgcaacatgaagtatctttgtgtggcagaaatgttctctatcttaattgtatcaatgtcaatatattggttgtaattttgtaccctagttttgcaagatgttaccattagtaaaaactgggtgaagggtatatgggatttctctgtattgtttcttgcaactgtatatgaatctacaaatatctaaaaataaaaagtttaacaaaaagctatgtctgcattcattatgtcaaaattctattaattcaatgcatatatacctactttttttttttgacatggattctctctgtcacccaggctggagtgcaatggggcaatctcggctcactgcaacctccacctcatggatttaagccattctccagcctcagcctcccaagtagctgggtttacaggtgcccaccaccacacctggctaatttttgttattttttagtagagacggggttttgccatattggccaacctggtcttaaactcctgacctcaggtgatctgcccacctcggcctcccaaagtgctgggattacaggtgtgagccaccgtacccggccccatgtttacctatttaccaagctttgactgtttgtcaatttccactcttaagaggccattcaatgcccaaatagaaagcattttgaatctcaagccaaatggtcagttagtggtgtcttcccagagtactttgttgaactgtgttgtgagtctacatatcagccatgcaagagagagaactatcatagatcacctccacaatcagttaggagataaggggtggaagatgaaatgtgtgatctgttgagcagcataaacacagaaagagaaaactacaacccaagaggaaaaataataataaatagaggtcataagtacttgtgtctaaaaatttaaggaagatatcaaaaggtgtttttataaaaggcataaagaaagagaaagaactttccatagagagaaaagcacatgcataaatatggtgagatgtgctaggtagttgtaacatggaagtcttacataaggatagcaggaaaggaagcaaaacaggcaacttgaagccacctggtctaggactctccacactacacgaaagatttcaattattcataatttttaatgatgcttagaatcaagggcacattataattttaatgattgtttttctttttagaagcacatagccaaggtctttatcggtatgtctttatctgagccctcaccatcaccattttcacacacatgagtgacatcatatgcagtaaaatagacaggacaaatcagctgcatcctggagtaccagcaccatccctggaaaagtaagtgttttcctgagtgcacgttgcttgttcaaaattgtcatagatgagaaaaacttgagaaaagttactttaaactgaattaatttttagacttggtcatagagatgcaaacatcatgcctttgaagagttgctcatgatgtgtcacgtaggtcactactggatttcatagtatatagcatttggatacatgataggacaatagtttccaacctcgttgattatctttattatccagtgatatggtttggctgtgtcctcacccaaatctcatctcgaattccagctctcaagtcctcatgtgtcatgggagggacctggtgggaggtaattgaatcatggagatgggtttttcccatgctgttctcatgatagtgaataagtctcttgagatctgatggttttacaaagggcagtttcgctgcatacactctctggcctgccaccatataagatgtgcctttgctcttcctttgccttccaccctgattgtgaggtctccccagccatgtgaaactatgagtccattaaaccactttctctttacaaattacccagtcttggttatgtctttattgactgtgagaacagactaatagagaaaattggtactggtagagtggagtgctgctataaggatacctgaaaatgtggaagcaactttggaactgggtaacaggcagaggttggaaaagtttggagagctcagaagacaggaaaatatgagaaagtatggaacttcctagagacttgttgaatggctttgaccaaaatgctgatagtgatatggacaataaagtccaggctgaggtggtctcaaatgggagtgaggagctcattaggaactggaataatgtgattcttgctatgctttagcaaagtggctagaggcattttgctccttccctaaagatctgtggaactttgaacttgagagagataatttagagtatctggcggaagaaatttctaagtggtaaagcattcaaaagtaagcagagcataagtttggaaaatttgcagcctgatgatgtgatagaaaagaaaaccccattttctggggaagaattcaagctgcctgcaggaatttgcataagtaatgaggagccaaatgttaatcaccaagacaatggggaaaatgtctccaggacatgtcagagacctttgcagcagcactttcatcacaggccccatcccaaaggcctaggagggaaaaatggtttcttgggtcaggtccaggaccccctgctatgtgcaccctcgagacctggtaccctatgtcccagccactccatccatggctaaaaggggccaaggtacagctcagttcatggcttcagaggatgcaagcctcaagccttggcagcttccacatagtgttaagcctgtgggtctgaagaagacaagaattgaggtttgggaacccagatttcagaggatataagaaaacatctggatgtccaagcagaggtgtgttgcaggggtggaactctcatgcagaacctctgctaggctaatgcagaaaggaaatgtgaggttggcacccccacacagagtcaccactggggctctgcctactagagctatgagaagagggccaccatcttccagatcccagaatggtagatccatcaattgcttgcaaagtgcacctggaaaaggtgcagacactcaactccagtctacaaaagcagccaggaaggggcctgtatcctgcaaagccacagggatggagctgctcaaggccctgggagcccacctcctgtatcagcatgacatggatgtgagacatggagtcaaaggagagcattttgtaacttcaaagattaatgactgccctgttggattttggacttgcatgggacctgtagccccttcattttggcctatttcttccatttggaagtggtttatttacccattgcctgtaaccccatgctatctaggaaggaactaactggcttttgattttacaggcttccaggtggaagggacttgccttgtctcagatgagacttggggctgtggagttctgagctaatactgaaatgtgttaagactttggggaattgttgggaaggcaggattggttttgaaatgtgaagacatgagatttggcaggggccaggggcataatgatatggtttgtctgtgtccccacccgaatctcacctggaattgtagctcctataatcctcacgtatcatgggagggagccagtgggaggtaattgaatcatgggggtggatttttcccatgatgtcctcatgatagtcaataagtctcatgagatctgatggttttataaagggcagttcctctccatatgctctcttgcctgctgccatgtaagacatgtctttgctcgtcctttgccttctgccatgattgtgagtcctccccagccatgtggaactgtgagtccattaaacctgttttcctttataaattacacagcctcaggtatttcttcatagcatatgaaaatggactaatacatccagagaactttaaaaatttcaattcccaggcaggactccaaatttactcaataaatctcttaaggaagacctaaggatgcagttttaaactctcaagtagtcttaaagttgaccaagtttggaaggcactgtatgaaactttaggcttgttatggactaaagtttgactcctcaaaagtcatagttaaagctctaactccctgtacctcacaggtaaccatatctggagataaaaccttgaaagaggtaattaagttaaaatgaagctgctagggtgacccctagtcaaatctgactggtgtctttataataaagtaaaggaaatttgtgcacacagagagataccagggaggctagcacacagagcaatgaccacgtgaacacagtgagaaggcatatgactgcaagccaagagagtgctctcagaagaattatgcccattggacttaaaaacttcaagaaaataaatttgtttttttaagcccccagacctaagcaccaccagatattttgttatggcagccctagcaaacaaatacaaggctgaagccccatacattgttgaataaaatgacgtcagagtgcttggcctagtggcaaaagtgaagatcccagcaaaagtggagaaaactttgcaatagccataagatgaaggaattgggaatcatccactagaactggggtgtgcaaactatagcctcctggccaaatctgacccctcatctattcttgtcaataaagttttattagaaaatacaaccacaccatttcacttatgaatggctatggtagctttcagcaataatggcaatgttgagtagttgaaacagaaaccatttggtccaaaagatctaaaatatttactatatagcctttgacagaaaaagtttgtcaattccacactagaatgtcaattccatactagaatatcaacagcaagaatgcagagacatgcagctctgtcagtataactgttcgcaatgatcaaaatattctaaatctgtgctattggatagccacacatgtggctatttaaatttaaattaaattaattagaattaaataaaattacaaattcagttccttagtctcattaggcacatttcaagtttgcaatagctgcataaatggtcacaggctaccatattgggcaacaaaggtctagcctcactttacccttgcattctgagtgcctggatcagtgcatggcaaataatcaacaggtattcccgaaagaatgttaaatgggtatatgaatgaatcagccaagaaggagaatgacgctatttttttattcatatctaagtattacaagtatttacatttaattaaattccaaatgatgccactataatatgtagacttgcaaagacatacactgattcctatttcctagttattcagcattgatctgggtcctgctatgaagggactttgcaaatgtaattaaggctatggatgttaagatagggagatgatatggtttggctgtgtccccacctaaaatctcatcttgaattgtaatccccataatccccatgtgtcaagggtgggaccaggtggaggtaattggatcatgggggcagttcccccaatgctgttctggtgacagtgagtgagtctcaggagatctgatggttttataagcatctggcatttcccttgctggcactcactccatcctgccaccctgtgaagaaggtgcctgcttctcctttgccttccaccatgattgtaagtttcctgaggctttcccagtaatgtggaactttgaatcaatgaaacctctttcctttataaattatggattcttggttatttcttcatagtagtgtaagaatagattaatacgggagattatcctgaaacagccatgtgagcccaatctaatcacttaaatctttaaaagcagagacttttctctggctggagctagaagagggatgttgcagaagaggaaggcaggagacatgaggcagaagggggaggtcagagaaattaaaagcatgaaaaggagttctcaacctcaacccaccactgctggtttgaaagggttcacaagcctttccaatgcacgtggctgccaggagctgagaacaacctcagccaacaaccagtgaggaaattgggacctcagtcctataactgcatggcactgaattcaccagaataagcctgaaaatgaatcccacacttacatcctgtgaaaaagggtgtggctatgttgtgagactctaatcagggaaacagtaaagcctcattatacctgaacttctgacccatggacactaagatagcaaatgaatgttaagctgctatgtttgtggtaatgtgtcttagccaaattgcagacattaaagactccaaaaattaggtttttacagaatgattatacataaaacgtaaatatatttgagaggaaagttcacctctgacataccctccagctattccttctgaagacatttcagggaaaggcaactattgagcccatgtgagacaatcctgcctggtacaaaaacatatcttcagggcctatgagaaagaggaaagttgcagtgcagaccaaggcagagggagcacaaaggcaccagaacacacctcctccaagtctccaaaccctaccaaatctgatggtaatcagggctttgtaaagaaaacctcaagacaggttggactgaagaaccactttctaaggtgacacatacaccaaaaaaaaaaaatcacaaaccatgtcaccaagtccccttcttatctttcatcttacttcctctggagtcatcagttttctttcatatatctcttgagaaatccagtaaattatgtttaacacacaattatgtcattttcaagggaggccaaacaaatatacatctggcaaaattatatgtaccaaaaacacttggcttctagtaaattattttcacatgccattaagataatgacatacatttagaaatataaattactttactgataatctagtagcccataaccctcttccaagggcacatacctccctccaggacaatgttagacttagaagcaccttcttttgctctgtgttcagggattttcctattactcaactcaacctttgggtatttcttgatcctcacatctttgtggatattctcatgtaactttcaaaggaattgctgagtttttcctatcaaatgcacctattagtaataaaagtacagagacatttataaggtcattcccaaaaaagaaaactggctattgtacctcttacatgatgtatgttgcaatttcatatttttctctactctctttcagtccttgttcctcgtcttcttggcagtaaacttcaaaccaataccatagagggcatttctatgttctaaagctctgtctatctgatacataatcaagctgttcttatctttgtatcatatgaattatcatgaattaatgaattatatgaattattatgcaattatacaaccttataatatatttaatctggtaccaatattgggactatttagtcctgtcactgatgagtggcaaggacttcttaaaagattaaagttaattccttgctgttccagatagagtgatttataatatttctgatggttttatttttctctatattgtattataagttaattcatatttttaataaaatataatgttcccatttcccatctctgaagtatcttttaatgtttttggacattcttgattggttcatttccaagcaagaaaataaggaagtaacttaccagaaaaaaagaaagttcaatatacgtggtcttaataattacatatataaaatccagtatgatttaaatatctgagaattataacaatgtgattgaagtagaacttttgttggtgagaagtgttcatgtcatgattttagtaatcagattattgataggatttataagaaaaactattcatgtctattcgaaaatcattttccaaagtatctgccacagaacactcacatgagacatgttaatgggtgctcctcatgaaacggaactcacggttggataaatttgataaattcttcaggctatattctattcttggaaagttgcagttgatattaatgcattaaattccagaatagtctgtaaggaagaaaaactctttcatttagtgaaatccagggtttttcaaatttatttaactaaaatcttcttcccaaagatcatctactaatagctcagagacatagtcttaaacaggaatgttctacaagagttatcttgtgtaaacttctttctatactcagttatatcccaatttcaaactctacaaaatagtgaacatttcctattacacacgttccacggtgggtaaataaaagtgttcccaaacttaaagctcttggaagataaagggaagggttttcatcaggaggtatttcatccatcactctcattccagttctccgtggttcccttctatgcacacaaaaacaagtggagggaggtgcagtgttcaccagcagaagagaattttgctcctgtgaatgtatgaaagaggcttgtaagctaaatattggtgggttttgtacaagcccaaaccaaataggaacttgtaaggaaagaaaacacaaagaaaagtcagagaggaaaggaaacaccagatttccatgattattttgaagtttagacatgataatgcatgttagctcttagtaaaatgcatcctgcatgctataggctaaaattattattactgctattattttcagagaagagtctctttttttctcattctccaacccatttttttggccaaagaaaccaaaagcacgactctttctgggagatgatgtctgatgccaactgcaacctatatcttgcacccctactcccatctcccaggaagtaggagtaacttgcctgatgcggccatggatggccttcatcagggcatgttgccctagtgggcagaatcactgtgtctcatgggagaaccttcccctgccagttccctccgcctgccagtgttcaggcatggaggagcagctgcttggacccctcattagttgtactcttgagcttcctatttctgtttagtatagaaactgaaccattgatctcttgtattttctctcttgtgagatagacccacagcccacatccaagtagctggctgggtccagctgctgtcaatacagagaggagggagtaggagaatctatgtaattctaaggtcatagccattttctcaattccagtttttaccagaaagtttcatagtgtagggtgctttcagctgcatagaacaaaatatccaacaaaaacaacttaaacagtggagatctgtttgactcacctacaacaacaaaaggccatggcagcccaagggttaatttgggaattcactgccagctggggaccagctggactttcctgagcttccgtgggctttgtcattgaattgtaaggtttctgagacagcttgaagcatcacatctacatcttcacatgatgttgtccaagagcagcaaggcaagggtgaggtcctcctttaacgagacctcagaagacttctccaatcctctggccagggcaggtcgtacactcatgccgtagcaacaggagagcttgggaaatgttgtatgcagcatttctagctgctggaatgacgtgagtcttgtccaccaggaagaagggagatgagaatggtggtggggtaagcagccaagaaaatctacctggatgtatacatggtctaataaatgttgtactactttaccaattgtctagagaatcttagagtgaaccatcatccaggtccctgaagggaagattaaataagtggtagattcttaaacccttacattagaaaggaggagaaaggggaagtaagtgtttacaggaagcagcagaggggaagatacacaaatgaagaaaatggtatccgagagtgaaggcagatcctagagccttcctactggagcctatcagtgctccacccagattccctttactgggctggtgcatccacctcccagctgcagtgagtgttggtgacagggactcccagccacaccattccctggaaaattgcccttagccgaaagggccccttctcaggggatctgcagtatgggtggtgggctgcaaccactgatacaagggtacaaatctggcctctgcctcaaagtggaaaagtttcatggtaccattcataatccagaccccctgtgggtcagactcaggctagatgtcagctgaaaccccatctagtggtttgcttagcatcttcccctgcgctctcctgcttcccttcttcactctcttccttaagggcttctgctgggaacaccttcatcatttatttgtacaagaatccttatctcagatccggcttctaggggacctgacctagggcagtcaggagtacctagctaagaagtttaaattgtattatatacacaatggaggaactacggaggttttagagcgactgtgttttaaggtcattagtctgacaacagagaggctgtagaaagaattaaggataatagatgccccaccattatgaattacccacgtgaaagacatggtcttaaaattttatatttggggcaagaaaagagaaaaaagaagggagagagaaggccaaagtgttaaagattcctccactgtgattctatataaatttacccaatagagctgtaatgtttctcattacaaaatctctggcaagaatctctgtagctattatttgccagaagcctatgggttaaaagtttgcttttgtgtcatgcaaatagccttaaagtactatttttccacctcttctcatgacactgaccacccatatcttctaaggattaaacaaaataaaaaaagaatttacctttagcaagaatgacttaagctaggtatagatttgtttgttttaaggcatgatctagacttaggagcgaaggaaagcccttctagattttctgaccctgaaaatcctttaaaccagactataaaaacacctgtgtttgatggtttaggtgttcattaacatgagtccatgaccatactcagagttcccttggaaatatcctttgatagctgattccagactaattgacagagcttaaaattttggggcctaagtctatatcaagcataaaatatatgaaaaaggaacatatacttttatcatataaaatgtttgcagtggatggtaaatggatgttactatttaacatataatatttgtattatatacaaatatataatgtatttgctagaagttgagggaagaaaaaatgtgttcctgttcagaggggtttcaaacaaattttactatcataaaagtctaaaaataacaacaaatctattttgctttatccctccttcccacactccagtgaaaactataccaatttagcaacaaaagttgagtctagtattcacatcaataaatattataaactatttacaaaggtagctatctacctgggtaactttcaaacctaaggacctaagaacaagccctgaatgaaaggaacaacaacaaaaaaacacgtacttactggattcagccaggtagtcctggagtgtgatatttaaagtaaaaagtgctgggagaggtgccttacgcctgtagtcccagcactttgggaggctgaggcgggtggatcagttgaggtcaggagtttgagaccagcctggccaatatggtgaaacccatctctacaaaaaatacaaaagttagctgggtgtggtggcaggtgcctgtaatcccagctactcaggagattgaggcaggagaatcgcttgaatcagggaggtggaggttgcagtgaactgagatcttgccattgcactccagcctgggggacaagagtgagactccgtctcaaaaaaaaaaaaaaagtaaaagtaaaaaggcaagtacttgcagtttcaatccctagacaaaattttactaagcccctaatatgttcatcctcttaatttgttagtgtgggcttatgttatagcaaagatttacacatcgtaagtacttaagtgtttattcaccagttttaaaacattacacataaactacaaggagtgttgtttttcaaatctaacaataccatgctacaaagcataagaagtttttaatgactccaaataccctagaacttctaatcttgtaatatacattggcaaagcgagttcttcattcatccatttattgcacgtgtattttttgagcaactatatttcttaggcactagagatggagcagtaagcaaagaagacaaaaattcctgccttcataaagatcgcattatggtaagagagacagacatcaatcaaaataaataagaaatacatatatataggcaacaaataatattagtataaatattaatgcagggaaaaaagtaggttaaagctgggatttggagaggggaactagcaatttcatatttgaataaggccatcagaagtaactcaggaatggaaaaccaaacatcatatgttctcactcataagtgggagctaagctatgaggatgcaaatgcataagaatgatacaattgactttgagaactttggtgaaagtgggggaggggtgaaggataaaagactgtgtattgggtaccgtgtatactgctcaggtaatgggtgcaccaaaatcccacaaatcaccactaaagaatttatgtaaccaaataccacctgttaaaatgaaataaataaatagataacttaattaggaaaattcggtcttctcaaatgaaatacctaaagaaggtaaaggagtgaatcaaacaaatctgggggaagtaattatcctagcagaagaactgcaagtgggaaggagaatgcacgaaggctcaaagcagaaccagcataaccactctggccttagtcagtgaaaaatgtagtaacaaaaaattagagagataatagggccaagatctggtctggccttttcaggaactttgattgttacttgagtcattagaagccattgcagacttttgaacaggttcataacccatctgttattttaacaggataaatctgcttactttaatagaaaaaccagtgaggtttaaaaaaagaggtctatggtttttgctataattgaataaaaaggtgacagcaactttgactagggtagtggctatggaggtaaaaagagataatgatatgctatcaaatttgaatgtaaagtcaaaactatgttgcgggaagtcagggaccccatgtggagggaccagctggagccgaggcagaggaacataaattgtgaagatttcatggacatgtatcagttcccaaataatacttttataatttcttatgcagtctttactttaacctcttaatcctgttatcttcgtaagctgaggatgtacgtcacctcaggaccactatggtaattgtgtcaactgtataaatgattgtaaaacatgtgtgtttgcacaatatgaaatcagtgcaccttgaaaaagaacagaataacagcaatttttagggaacaagggaagacaaccataaggtctgagtgcctgtggggttgggcaaaaagagccatatttttcttcttgcagagagcctataaacagccatgcaagtaggagagatattgctaaattcttttcctagcaaggaatattaataccctgggaaaggaatgcattcctggggggaggtctataaacagccgctctgggaatgtctgtcttatgcagttgggataaggactgagatatgccctggtctcctgcagtaccctcagtcttagtagggtggggaaaatctctgccctggtaagtttgtggtcagactggttctctgctctcaaaccctgttttctgttgtttaagatgtttatcaagacaatacatgcactgctgaacatagacccttatcagtagttctgcttttgcccttttccttgtgatctttgttggacccttaccagtagttgtgcttttgccctttgccttgtgatctttgttaaacccttattagtagttctgctttttgccctttgaagtatgtgatctttgtacctactccctgttcttacatcccttccccttaataaaaacttgctggtctaagactcgggtaggcatcacagtcctactgatatgtgatgtcacccccggtgacccagctgtaaaattcccctctttgtactgtctctcgttatttcttagctggccgacatttatggaaaatagaaagaacctatgttgaaatgttggggttgggttccccccaatcaaactacgagattcatttttttttttttttttttgagacagagtttcgctcttgttgcccaggctgcagcgcaatggcatgatcttggctcactgcaacctccacctcctgtgttcaagcgattctcctgcctcagtctcccaagtagctaggattacaggcatgtgccaccatgcccagctaattttgtatttttagtagagatggggtttctccatgttagtcaggctggtcttaaaatcccggcctcaggtgatccaccctccttggcctcccaaagtgctgggattacagacatcagccaccgtacccggccccaaaactatgagattctaatacatttgacggtagtgctgactagctgtagagagggaaagaagtagtgagggataatgcctgaacatccaggaggtaaggttttccacatgagctttgtaaggatggagttgccattaactaggatagggatgaccattgaaggagcaaatttagagtggatatgaagaattcagttttggacactgtatgactttgctagggctgccagtacaaagtaccacaaatagagtggcttaaacaacagaaattttgccttatagttctgaagcctgtaagtccaaagtcaaggtgtcagcagggttattttcttccaaggaccatgagggaaagacctgttccagatctcttgcttcggtttgtagacagccatattttcttacatttcttgatatggtcttcccttcttgcatatctctatgtccacatttcttttataaggacaccagtcatatgggattagggcgatccctaatgacctcatttcagcttgattacttcttcaaagacacattctctgaatagggccacattctgaggttctaggggttaggacttcagcatatgaatttgaagggacacaattcaacctgttactggcatggaaagaagttgacaaaatgctatgctatctgtgtccactgcaggctgaagatgattctgaagccataatatcaattctggaaacagagtgtccacaatgatgttaaaatgcatttcttaaagacagaactcatcattctttttgcttgcttcattggtctttaaattccacacaccaaatagcatcatgtcttgcaaatagtggaaaatattatctaggaatttttaaagctgcaattcacagaaaaccttgctaacagaagcttttttaataagggcagttaatcttccctaacaagatgtatgaagtcaggcagcataggattgaagaattcaaccacacaggcatgtcaccatagacactgggatgttcatatttcacttctgccattcagtgtggctgccatcctctggctgtctccttatcgctcctagatgcctgctacagctcctgctgctatatgctcatatgatcatagccacagagaagaaagagagtgaaacggtttggctgtatctccacccaaatctcaccttgagttataataatccccacatgtcaatgtgggataatgataattgaatcatggggatggttcccccatactgttctcgtgatggtgaataagtctcatgaggtctaatggttttctgaatgggaattcccctacacaagctctcttgcctgccaccatataagatgtccctttgctcttcctttgtcttccaccatgattgtgagacctccccagccatgtggaactgtgagtccattaaacctctttcctttataaattacccagtctcagatatatctttattagcaacatgagaacgggttaataagagagtcactcctaagaattccttctcaccatggtgccaaaccttttctagaagcttcacatcctcccactcttgtagccttctttttggggagtcagaattcactcatatgccctaatttcaaggaaaatgaggaattgagtatcttgtcatttccatctttaacaagggcgagagattctgctctcaactcacaagagatggaaaggacagttttttctacagtaaattctccataaatgcttaatgggcagatgatatgtaatcatggtgatagaaagtcagtgatatcagtgattaccattttcttagagctaactctagactccatgaaatatctctttgtttaatatcagatatttgacattataatttccaatcatagaacagatagcataagctctacctccaatatactttagttaggttctccatttagagttgctggaaaaaacagcataggcagaaaatcaggaatgaggtgagacatcatacaacaaatttaaaaaatgtcaacaggcatgagtaccatgctttttccaattactgccagtcaaaaggccatttctaattaatagtcacctttggctttgcactgttaacaatttaattgtctaatatgtgtactattccttttctcactggaaacaaaaatctcatagcatctcggttagggtgattttgccaaatctggagacagttttggccgttgcaattcagggataaggagcactattggtatctggtggatataggccaaggatactaataaacatccttcaaagtatgtgatacttccttcagcctctgaaccataaggtcaatagggctgagattgagaaactctatttcacagtaatcttcaaaattcatcatttaacatgataggcatttggattttgtcaattgttaaaattaaagacttagctgtgaatagccgctaatgtctttttaaacatttcattaatgtgaactattcaggctgaacagatttctttatgcacggaaatttcagtactccccaagaatgtagagaccttctacctcactcagttctaagttgactgtaggtgtactggaaatatttgctgagaagaattgaaattagtttgatttcaggctaataaaattatctttggccccttgcaaatatctctgctactggctcaacttagttgaaagggattgaactgaatgcaaaattatgttgtgagattctaacagaagtgctttttaaaaaactgttaaatgattacaaatgacacattcatttcagtttccatagaacatctgagaaagataacaaagtagtttcaagcaattcccaccaacaatttgaggaaattagaaaagatgccggaaagccacacagcagcagagaaaaatgaaatgcatggcttccctaaaagaccaggaaagggaaagtgctgtgttctcttgctgttctgaaggccctttcagtgatcagccctttattctataaattccatggaaatagtatttagacttctcattctgaccaagtgcctggtgtttttcaatttccagcagagggtgataagaaggatacttgttgtgtgagtaggtgttctgtgttacactttctggtaatttgcttgatttgtttgcaattttcttaaaatgtgaaagaaaagggtgggggagataagagtaaggtttttctccactatgttcaagtgtttggccagaagctcccctgagattttgtgatagctcatttataatatggtgcaattggatcatcattatacttacataccatctgttcacttctcttttttacccactgatttcagttttaactattttcatctgaagtgatacacatttgctaagaaaatcccaagcatattggtgtaggaggacttctggacaagtggctttcagagtattggaagacagaatttcatttagcacacatttatctatttcatttagagctgatttttttttaagtccctgtatttgggaagttcattaactgcacatttcacagttttgctgttcttttctctttaaggatgctatttggattcaggcacacattcaggagagttggaatggagccagtttgtgaaatttggtatctgaatttctaatcaacgtagattatgaattctacttcacacattactttctgtccccgatacacatatgttgcattgccaagcccgtgtgctacagactgatccttctcaaccaaattttaaatacaaagataagctaggatgtattccttcatggtcatgccttctggtgcaaatcctttctcccacccccacaagaaagtcattggtgccgctgtatttttcagagaagttagtatttttttcctcttgcaatcaataatagtaaagttgaagaactccagtattaagcattacatcagatgtgttacctggccattaatcaaataataaacatgatagtgatttatacaatatattggggcttctacatggttggtattatgctaagcagttcacatgcattctctaatttgttcatacaagaactttaggaggtggctaatagtattttcatcatttatttcaaagaagaatattgagatttagtgatagtaaatcaccaagatttcacagctagtaaatcttggcacaagagtcaaaaccagacttttctaacctcaaagccatactcctaacaagtaactaaattctaattatctcacatgatgcaaggttttctatcagtagcaataatgctgtcactgtctcaaggaatttgcaccacaagaggagactaacttggtctctctctttcccataaccaagaagaacaagcataacaactcccctaaagtaaaagaaagcaaaatagtaaaaaggaaagtccttcagtgaaaaactgaccttaaaaaattagatgttgagtcacatatgtaagtgaaaacaactgaactcaaaatgctgaggttgtgggttcctcttcagaaaaactacttggtccttcaatggattctaaaattctatgtatatatttttacctaaagctatcagttaaatcagaattaaaagttattagatgcctgtaatcccagcactttaggaggccaaggtgggaggatcatctgaggtcaagtgttcaagaccagcctggccaacacggcaaaaccctgtctctactaaaaatacaaaaattagttgagtgtggttgcaggtgcctgtaatcccagctactcaggaggctgagccatgagaatcacttgaacccaggagttggaggaaaaaaaagttattggacattagtgtgtttctgtatactaacaatgaataatctgagaagaaaattaagaaaacaattccatttaaaatagattcaaaatgaataaagtacttagtaataaatttaattaaagagataaaaaaattgtatactgaaaactacaaaaaatttctgaaggaaattaaggaatacataaatagtggaaagatgtccaatgttcgtggattggaagacttaatattgctaagatgtgaatactacccaaagccatctacagatttaattaataccaattaaaatcctaatgacattttttgcaaaaatggaaaacttcatcacaaagttcatatggaatctcaaggaacctcaaatttccaaaacaatcttgaaaaagaacaaagttgatgattttacaacttactacaaagttgtaattatcaaaacagtgtggtactggcataaaggtggacatatagaccaatgcaatagaatagagagcctagaaataaactctcatgtacagtcaaataatttttgacaagggtgccaagacaagtcaataggaagagaacattcttttcaaaaataatagtgttgggaaaactgtatatccacatgggaataaatgaaattggacccttaacttacaatatatacaaaaattaatcctaaaggcatcaaagagttaaatgtaagagctaaaactataaaactcttagaaaaaaacagaaggagatcttcacaacactggatttgaaaataatttcttgtatttgacaccaaagcataggcaacaaaagtaaagatcaataaattggacaacactaaaatgtgaaaactattgtatatcaaaatacacaatcaacagagtgaaaaggcaacctacggagtggtaaatatttgtaaatcctatacctgatatgtgattaatacccaaaatttacaaagaactcctacaactcaacaacaaaaatctgatttaaaaatgggtaaatgtcttgaatagacatttctccaaagaagataaacgaatgtccaataagtatatgaaaagatgctcatcatcacaaaccattatggaaacacaaatcaaaatcacaatgagatatgacttcacatccattattatgactactgccaaaaacaaaaccactatcacaacaaaataacagaaaataataagtattggtaaggatgtggagaggttaaaattttgtgcactattggtgggaatttaaaacgtgcagttgctatggaaagcagtatggtagtttcacaaaaaattaaaaatagaatgaccataagattcagcaattcctttctgggtatatattcaaaaattgaaaacaaggtcttaaagataaatttgtacactcatattcatagctgaattattcacaatatccaaagggtagaggcaacacaagtgtccaccaatggatgaatgaataaagacaagatggtttatacatactgtacaattaaatatttttaagacacaaaaaggaagaacattctgacaaatgctacaaaataaatgaaccctggaagtattacgccaagtgaaagaagacagtcacaaaaagacaaaaactgtataattccacttatatgctatatctagagtagtcaaactcatagaaacacaaagtggaatggtggttgccaggggctagagacatagaaaaaagggtgttgctgcttaatgtgtatagaacttcaattttgcaaaatgaaaagcttctggagtttggttgcacaacaatgtgaatacatttaatactgctgaactgtagacttagagaggtgaggccgggttcggtggctcatgcctgtaatcccagcacttcgggagggtgaggcaggcggatgatgaggtcaggagatcgagatcagcctggccaatatggtgaaaccccatctctactaaaaatacagaaattagccgcacgtggtggtgcacacctgtagtcccagctacccaggaggctgagggagaagaattgcttgaacctgggaggcagaggttgcattgagccgagatcatgccactgcactccagcctgggcaacagagagagactccatctcaaaaaaaaaataaataaataaaaaaagagttgagatggtaaatattgtgttatgtgcatttttttcactcatgtgatttgtgaagactgcatataattatgaccctttcatcattggaaggataatttaaaatagtttcaatactttataaaatacagcaagaaaaaaaagagagttgagatggtaaatattgtgctatgtgcatttttttcacatttggagttgataaagtactacccagctgaaaaaactaaataaaaatgccccacaatgatggagatacatcagagtgatacaagtgccaactaagagttcaaattgaaacaattggagcaacaaacaagcaaagtagtattggtctctaatccaaagtacaaaataaatattcatgagtccattgtgaagacagaatatctacataaattatttgaagttcttctgcacagatttgtctattctcctttattcattcattcattgttgattaattgttgttgttgttgttgttgttgttaaagaccttgaccgttttgaggcatattggtcagatattttgtagaagaaccttcaactgatattgctaatatttgtctcatcattaggttggggtatcaggtttaggagagaaaaatcacaaacgtaatgtgtgattctcattatatcatatgacgggtacatactattaacatgacttatcactgttggtgttgaccttgatcttctggtttaggtagtgtttttcaggtttcttcactttaaaattactctttacatgtaaggacattctgcaaaatacctcaccagtgctcctcaaaactgtcaaggtcatcaaaaacaagttaatcctgagaaactctcacagtcaaaacgaacctaaggggatatgctggctaaatccagtgtggtatcttggagggaatcttgggacagatgaaggacattaagtaaaaactaagaaaatctatataaactatagactttagttagtagtaatgtatcaatattaattaattaattgtgacaaagattccataatattgtaggggtatttatagtgggggaaactggatgtggtatgtactggaactctctgtacaacctatacaaaaattctgtaagtctaaaactgttctaaaatgaagtttattttaaaagataaaaaaaatgttgtgatttaagtgtgaggctaaggcaaacattgttgtgcttaagtaatactcatcaactcaagccgtctcgcacaacattttgcctacccatctgccacaagattcagattgaaggacctttgatggaggggaaaaaaaggcagtaaattaaatgagacttcatatttgaaaggaaataacaaagctaaaaattaaataatatacatttaatgacaatggtagaagaatgattatgaatatgtttaagtcacctttgcacacgtgtcaaaacctttctgagtttatgagtaagggatagaaaagagattaccattcctaccgtatagagctgttcagtgaaaatcagcatgttcagcagcctttacacatgatttcagtttcaacaaggaagttaagcaaaagtcgagtgtgagcattgtggctttggacaacctgtgtagttagaattctgaaaaattggctgaagcattcatttcctttatctagcaaaccttcacaacaacccacagtacacctgctttctataaactgtaaggtgatggggttttgcatcaggttatcaaccacctccaccatttagttatcactctttagtaatccaaagtgatgtcaaacacactaactaccaccagaacaatttcagttcagctaatagcctctcagtttgcaaaagccataaagactgtatccattggcatttctcttctccccatctcaagaaacagtggctttcccatttgcctggcagcttgccaaagaaacaggcagttagttaacacagagctgtcaataatccatggtagctagactttataaagtaatcaggaggggatatcatttaatcaaggtcttcgaaatatggagaagcaattgggattgctaatcaggtaattgcaggggagaattgctcagaaataatttgtattgaactgatggaacagcaagtccaggctacaatggggagcaggaatttttatgctagtgtcatccttactataattggtaatctttgtgcagtgtgcaaatgagatgggaatccattcttccatggtgcttggctccctaaatgtcacatatctggcttgtgcaagtcacagatattgactaggctgtctctggagaaaccagacttggctgaacctttgaaagaaaatatggacacaatggatcacattcaaagtcacttacatattgacctgattatatcaaaatatgtgattatgaataacatgagcttctaccccggtagggaatttaacatcctgtagacttttctcaaaaattccaaggaaatgtcttacatggactcttcttgattcacaatacatcttcagtaaggatccctaggaatatgaaaattggaagtaatacaacactaaacatattccgatttttattgactcacgtgatttgtcaagactgcacataattatgaccccttcatcgttgcaaggataatttaaaagagtttccaatactttataaaatagagcaagatagaataaactcaaaaatcagctagaatatgaaataaaataaaacattaacagtattaatgattaagaaaattgccatttcatttatttatttatttcactggaaaaatagtgaacatttgctctgtaactagagagagtgtatgctgtttttctccactgaactttttgtggatagctcactgtagatgcttttactcttctattttcctaatttataatattctactaattttgctgtatgttggaaaataataaatatggagtcagactctatagtggaagactaattcaccacttgctagttatctgccttgaggaaagttgattacatttctgattatttgtttcctcctagaaaaattgggataaaaataaatactgtcataaagtttcattgttgttttaggatgtaaagtaattgaccccactgcatggaatatagtcattagttaataaattatagctattaacaatgcttcctatttttttgcctacttcgtttctaaggtatactgcagaaaactgcaattctttccttaagcaaaagatgaaaataattactaatgccttcctcctttgacagatgccaatctgaattccacagcttgatatgacctagacagaattttattaatctgtacaaaggtaacaggaacaaaattatttaatatggaggtactctcagccttaaactatctctggcctgttcatcctacctgtcaaagagaatcttggattttcccactaaacctcctccaatccctgatctttattctctaaagaagagttctacatgactggcctataaaatcatgtgatgcaaacttgggagtatagaaaggactagaaatgaagaataaaaatgaaaaggtaacaaaagagaagagagacattatggatgcaacagtatcagagaaaaacatgttgatggagaatgaagactatgaataatgagagaccctggagaagtcgctgtgctttacagaatagatgaacagaggaaaaggacatttaaagagttgtgtctaagattatttcttgaatccgttttaaaatcattagaaaaatatgtaaaggttgaaattgatgtttaataatactgattattagacagtgtttctttcagaaaaacatactgctaatactgaaccatgaggcatcttgaattttatttgggttacacaaaacctcccactcattcctttcttttctgcataaactgtcatcaaagagagctaccgatctagaagagaactacaggactagcccttaactggtgctttgtttgcaagggaggaggaagttgaaagatagttgttatcttgcaaactgagtgttaataatattctgtgttattctgtgatttgtagaaaaaaagtctttgaaaacaagtattactattatgctaaatttaatgtgctatcatcctatgatcctgacttggatagacttaaagagggactggttttaagtccctcttcaaagactcatgctttcattaggaactccacagacggttttctatttattagcctacaaatatttattaataattttgtggtgacagtgaaactttttaaggacttaaaattagaatatagctttcttttttttaaaaaaagtctataaacagcacagaaataaaaatttataaatgtccttcgctcttattcaggctgaatattgatctaaagcaaaggaacttaccattttaaaaagttcatatttttccataagaactttccctatgatatctcaaaaagccctacagaacattaaagcctctatatccaaataacacatgttactcctggctgtataattatacttagattgacaaatgattctaaattttatctgaagactaaatacaaaaatagccaagagcattaagaggaaaggaatataatgacagggactttaccagctgtttatgaatatacaatcagatattaaagtatattataaatgcacaacaatcttaaaggtatagtaatggcacagaaagagacaaaacagaaagaacaaaagcaaactctatctctatcgtgcaagaatgttgacatttgaaatcagtgatggaagagtagataaatggtgctgaaaataactgggtaaatattggctaaaatgatcatcccattttcatgcctttcatcacaaataattcttgatgaaaaacaaaataaactacacattcacattagtagaagaaaatggttttctttcaacattgaaactctaaaggaaaatattgataaattaaactatgtaagtttattttaaaaggcgtttttgaattaatgagaaaaataatggcttataaaatgtaatgacacaattgactaaccatatgggggagaaaatgaatctgatacctgcctcactccttatcacaaaaagcctttcaaatgcaccagaaatataataatttctatttataataaatgaagattcagtaaagattatatttttaaaaaattgttctatattgtaagactaaaggataagaaggaagtgacaagctgggggaagtatttgcaatatatgttcaaatgtactacttttataatcagcgaataatattcatttttgtaaactactaatgatgacatcagtatttccattttgttaacttttatttgagatgttgatatatttggcgcctggttttccccagatgagtcatttgaattgaggatatagtttttaatagtgctagagttccttttcaattctgtaaaagtactacccttatttaattagtttctttagtcatgttatgaaatctgtgacttgataggagaaaaagaggaacttaatctcagaaatttccaacacacttataatactttcctctcaactttccccccttatattatcacgatttttgattcccttcactcttttcttcttccctccatcttagaataagagggccaccttcattttctttcctattccaaaagtaacattatttcatagtatcacttttctctgaggttcagctcatcaaatttgaatagttcgctattttttatagcacttctcagggcaggtctagtctctgtaaaattgaataatatttggcctatcaaacacagtgatctagagcatagagcttgagaccgtttagtccaactttactgtttttcagataaaaactgagaggtctgcaaaggttcagtgagccaacagtcatccatcttgttagtgacagaactagaacttgaccctgaggtatcctggtcttgtccccttccacatatggctgataggcagcatttaacacagataatcagaccctcaaaagaaaaccatcttacacttccttttatagatggaaaagttgaggcccaaagaagtaactagaactagcttacggtcaagttgttattgttgacagagacgtgaacagaaatttcacgttctattctcaacacacagagaggttgtgtacaaatgaggggaaaagctgaacctggtgcaatgtggaaccctgcttcctagtaacaaatcacttgggaacattctgaaaactcagtgctgccctcatgaagactcacagaactcactggtaaattaaattaaggtcctgagaaatcctgcagcaaatgaacttattatgctttgtataacccagaattttccaaatgcacgtgaccaggaaaccctttgtctcataaaaactgtgatcatccggcacaaatagtgtttcactggatattttgtgatattttttggttgagagcaaagaaacctgagctttaatttcacatctgctagtccctgtccaggtgcccaggggtaagtctcttaattcacttaactttgtttatgtgtaacaagaaagaagaggggaaaaacaagttccaaagtctctctcatctttataagtgctttgtagcttcatctgttgtacatattctaaggaaggatacacacacacatacactccacacacaaatacacacatatgtacataaataagattactagtcaacatccataagaatgtgtgtttatgtacatatatgaaatatttctagtttcaacatgttcccttttctcttctccgagttagtggaggagtagaaagaattgtacgtggcacaagacaattctgctcacatcccattggctagaactcatgcccatgaccacacctaacttgggaaaagtggtctaattgtgcattcaggaggggaatgtggatcttgggagcagagaggagcagtctctgaagttgtttcactggatttgatgtcccatccaattgtaaatctcaatgatcataagatatcctagagtaccctaaatgtgctcattatacggcttggggaaggatatatacttaaaaataatgcacaataaactagttattgaatgagtggtgtgaggtgctatatgatgtagactcatacaagacttaaaacattaaatgagaattcagagacctggctcttcaggtttggtatgtaccagtgtaggttgcttaatatttctctgtttcagttgctttaaatataaagaaaagccgggtacagtggctcacgcctgtaatctcaacactttgggaggccaaggcaggcagatcacctgaggtcaggagttcgagaccagcctagcgaacatggtgaaaccctgtctttgctagaaatacaaaaattagtcgggtgtggtggcgggtgcctgtaatcccagctactcttgaggctgaggcaggagaagtgcttgaacctgggaggtggaggttgtagtgagcagagattgcaccattaaactccagcctgggtgacagagtctgtctcaaaaaaaaaaaaaaaaaaaaaaaaagaaaggaagataataactactttatctatttagtaggactattctaaagatcaaataagacacatatgtaagagattttagcactgtaaagcaattgtgaagaaatcattatgctatcatatttctaatagtggatataatatatactaactacattagtagaatttttgaccctatgaactaatctctgaatactaaatgctaaaacgatggctttatatatactatattagtaatcatctggtaaagctttaactaaactttttgtgttatatttaacatttggagggcctgatagagtttattaagaggacaaaatgagctaatccatatgaattccttaaaatcgcaactgcactaataagttctgaataaatattactattgttattaggagaactgacatggctgagaattcatgatacccaaagtgccatgccaagcatttcatatattatcttatttaattatcataataactctatagtgtagttattattatcccattttctagattaggataactgagactcaagtaggataaataattgaaatgtggattttaaacttcaaataaatatttatacctctttattctgacattgctgataagcaaatattttttcacaaactaacatctaacacacctgagcccacttggattccacaatggcgtgtcactgtcctgtactctgatctctttgcagttcagattgtgatgaaaacaattcactagatgctcattgtggatgatttctccattacttttcctaattaatgacttttatctaccttgccctgggtctcctggagcaactgacagaggcacagaggactcaggaagttaccaagtagctgggggagacaaacttttgctgatgaaagtgctttcctaggtttcttagcgcctgtggttgtgtgtttagcaggtgaaagtcaggaggctgacagtgattttctttttgcccaacacgtcagcacaaaaattacaccatcatagatggagtcttcctgatctctttttggggtgtgtgtgtgtgtgtgtgtgtgtgtgtgtgtgtttccttttttttgttattaaagaggaaggacatagttcttggtgacataaaaacatttttgtttctgttcagggattcacttgtcctctttttcatattatggtgctatgtgacacaagcattgaaagtacaaaatgaaagggtactttatatatttgtacaacatactatgcaaatatttggtcaaattgggacagtacatttggaagtgaaggagaaaacttcccctgaacactcataaattcaccttgaagctttatcgccgagagcctgtgctattttccttttacttgtgtactatgtaggtccagattggacactcttgttaaaaatgtgtttaggcaattcagaatgaatctaaacttctagaagacataggttactttcatcagaatcatggtcaacagcagttagttgttcaaaatagttacctctgttcattttaaagttaatcattaaaagaataaaatcaaattggtttacaagaaaatcatgtgttcagttactcacacaaaatatccattggtttagtagttattgagaatctcctatttttaacaccctgtgtgaatctgtgataatattacataaatacataatacaaatatataatatcgaacatacatacacatatatattataaatattcgtatacacccaacagaaatagcagtaaatgatgggaccaatgacctctcagcaatgtcagcaatgtgcactgggagtacaaagaaggaagtaatgacttctgattgagacatggggagtgctttctcatatctcctgaagacactaataagtgaaaaacccaggacaggaatcccagggtgggagcagcatgagtaaaggcaaaaaaaaaaaaaaaaaaaaaaagtgcctactacaattgaatatagggagtaataaagtatagatagtaagggaacaaaactgtaggatgttagactgtagaaacagtctagaaagagattgtcaaagacaatatgagtaagtcccccagatagcaacttcaaatctcttgataaacctaaagatggggaatctactgaatggttactgtccttatgttggcctacagagccctcccatacaatcatatgtgtatatctaatttaagtatgtgtttatcattatctgtaacattattaaaatatcaatgtaggcaatgaacctggggttaaaaaaaaaaaaagacacctgtacagaagaacagagaaggatctcagaagctcttgactgtcagtgaaaagtaccagaagtgcaatttgcatgaaatatactcagctgcttggaaggaggaatgttccctgaccattagagtaaagattcaatgcaaacaagataagccaaaggttgtctttcagctcctcaggagggttccctggagaggcaaggatgaagagagaataggaaggatgcgtgcacagctgtgagacaccagacatgtgtcatggggagcaggatccagtggagctgccctgaatagctaccagatgtgctcttttgtcaatgacctcatctgaaagagttccaaaccggatatatcaaggcaatcattttaggactgatgggatcatatgagttgaaccaaaagaaccaccattctgagagagagaattctttctcatggcagaagttctttttaacagaagtgtaggaaacatttcattacccttggagatgtgaatagaaagaaaattatgaggccaggtgtggtggcttatgcctgtaatcccagcactttgggaggccgaggcaggtggatcacttgaggtcaggagttcaagaccagcctagccaacatggtgaaaccccatctctactaaaaaatacaaaaattagccaggcatggtgttgggcgcctgtaatcccagctactcgggaggctgaggcgggagaatggcttgaacccgggaggcagaggttgcagtgagctgagatcacaccactgcactccagcctgggtgacagagcaagactctgtctcaaaaaaaaaaaaaaaggaaaaagaaaagaaaattatgaattgagtcttgttggaaggagattggagtccccattgctcaaagggcaagagaaatgtgggcacagagctgaggtaggagtaacaaattattctaaagaccctaggtccatgccattttctcttgtgagaaagcagagagtacaaactatttttttccttagcacttggaggagcaaaaattgtagccagagagactggtagagatggaattctcataaaactggttagagaactgattgaaagccaggtctctatttttcccctcacaaatgtagtctagaaatcatggtgtaccaatattaaatgttattttttagttctccaaaaaaaactacagaatgaagtgccaaattattatattttggaaaaactgccattggcaacatatgggtaaacaattacaaactcaaaaactgatggtaactctatcagctgcaatgcatacatttgttaggatcaacattgatatatatttattttaatctttcagcaccactgtataaatatagcctgtcaatgttacgacacactatgctgaataccaactgaagcccgacctttagtttactgactgcgtgaaccatgaatgcaccataacgttccaaaggacataaggatgttaaatcttctctacattttaaagtttagacggatttaacttccccttcaacttgtattcattccagccatgcagattctgcacaacccaatggaatgtgtgaggaaaagggtcaaagagagtgcatcacagtgaaaaaaatcaccaagtgtaccacgagtttccagaagtagattttaccttctgcattaccatttgggttaactcaggcaatcatgacttcagggaatttttgtctttatttataaagtgaggaaaggtaaactaaagccgtgggttaaaatttaaattttgatggtgtatatactctagaaaacagaagtgtgggaagccaaaggaaagcccagaagaagatggagtggaagtaagagtggacctaggatgtcaaacctgtgttccactagtttgcagaacacactgggttagcaaatcccaaaggtttactccttgtctagaatcctataaccatgagattataaatttctacatcccttgctcatgaattctcctggtaacataggaacctatctttactgccaaaagattgtgcccttcattttgtttgtttttaaaactgcatattcaatgcctaaaataataccccaaaattgtaagtggctctttgtaaaagaaattctaaacagggtctttttacaatttttatttaacttgcttagggaagaaattgaagtccagtccacatgcctatttggcagatgctatttggatcaccctctttagaaagagtggcttacttataaaccaataattctaattttatttcagcagttgggttggtgttgatctttccttgaagtttatacaaaaggtctacagtgtagaaaccattctaagtagtttcaacattcccaagttacagatggatctaatattctcctttccctttattctacttatctttattctgggacaggggaccctcacaatatcatcctttccccatttgcccatgaatttaacatctacattcatttcttttatatctattagttgagcgcacactgcatgccagacactgagctttatgctagagaggcattgcttcacaaaacccaaaacacatgttcttggccctccaagaacagggagtccagtgagaaaagccccaaaagaggtcataatgccaacatatactaagtactcagaaagtgatataatgccaaaatcttaagtaccagaatgttatgggcacccaaaggagagtcacccaaccttttcttagcaaggctaagtagatttttccaaaggagatgattcctaaaataagaaccaaaggacaaatagaaaccgactttgctgggagtggaagaagtctggccaattggctcaaccaaggcccaagactgagataatatgcagtcctcagaaatacaagtacaattttaaaaaagtatagttttggggttctagggggagaaaagatgaggctgatgaaatagagcctaactaaagtacggccatttaagtatgaacacgatatgattagttatacattagagagattccacaaagagtcccatgacactattcagctcatgttcaatatcagttatacattgtcacaataatgccaagtaaccaactatcccaacactcagtggcttaaaacaaagtggttatttggcacaggagtcttcacatgggcagttcagacaggataagcctgcacattctcctgggctcagctgggttcaccatgtctggggggccactgaccatgaattggctgatctaggctggcttaggctggggcaaccagaaagactcagctctgcttcccaattctcaactctgtgcatgttctcatgcgaggacagaggaacaagaagggaagcagaaatgtataagaactttctcaggtttctaaagagtcatgtctgataacatccttttgttcaaaataagatgcttgtctaacataacagactctgcctgttgcataagaggctgtgtaaagtcgcatggcaaaaagaatgttttcagagctagctgaagtgttgtagccagtactgctatcaaactattacacatacaatcgctgctggtggtagattctgtgtttcctaagatgacaacaaatctaaaagactacagtggttttatcggatggggtcattccttaaatcgatcactcacctacactccaccaccagcacacacatgaggtgctttgtcttcaattttctgagacagtggctttctgtctccaaaacagtgaaggtagtggctgcactttggggtaaattagggaaggagcaaaaataaataagatataaatgtaagggaaatatgtttgtacaaagagatttgttttagcaaacttaggaaacaatttcatgtaattaaatctaaataaaagtgcatcatgtgagaataaataatgtgctaagtacttttacgtagattacatcagtgctgtctgacacacacacatacacacacacacacacacaaagacacacacacacatcagataaatgctattgttatattatcctcccaattttactattgagaaatctgaggctttgtgaggttacataataagtaagcacctgaagttgaaacccagcagtttgattcaataacccatttgcttaaataatgtacgtcaaattgtcttatcccaaaatgtcataaatcccacccttaagaaaagagtgtgtttgaaaagatatcaccaaagactatctctttcttatatacttttcttaaaagtaaatgccaagacccatgaacactttctataaatgaataattcagtgaaaacctcagaaatgtatagactagtgtcatggaaagtctgctttcctaacaagtctatctttgatcagtgattcatttacatagattctgtctacacgtcaatcctcatgatttgtggcactgcatattttagagcttgacatatgtattcttttcacaagccatgtttcacagcagcctccattgtctatgataatgaagaaagcacgtcagtaataaagcccagtttctttcgagactacattaagacagacattcagacaagcctagcaattactctacctttgtgtgtatcaccagcctgccaggtttactgtccctttccctatgggttagatattcattcattcattcattcattcattcaaaggatatctattgagcatccactctgtgtcacgcactgtgctaagcataagaaatacaatggggaacaagtcacaaattcataatcaaatggggtaaacaaaccacaaaatcaagtaaaccaacaactaagaataattgcaaatgaaaataagatgtatagggtatatctatacaatgtacctatacctatatgcctataacaaccttactttcattagaatgatcaggaattggaaatatcggagctccctctgaaatgctgaaaagaatgagaagacatgtgcaaggagctgtctttaatcaaaatgctcagggagggtaggatctgagttattcaaatattctgcaaattgagagttgaccaggaagcactcttgttttctcctttattgttggaatataatagcccactttcctgctttggttacatacactcaatcaaggtgaactgtgttctggttaatcaggtcttcacaatgcccaaggtcatgatttccatcttcaatcgaggcttgataatatctctgggtttgcagggatctccaaagtgacagatccttcctccaacccaatgctggactctggcatagacttgaaagcatgacaggcagagacgagcaagagctcatcctaaaccatatcatggaagttgtcaggctttccaaaatcaatttttaatgtaggcttttaaaaaattagcttctttctctgaaaatttgactatgttctttaaagcaacgtgaaaatgctggttacttgagtttggattagtttaacagacatgataaaataagtctaaacatgcacactggtcaaactgtcttgctagtaactaaggtagtttttctttcttttggtgagagtttttgttttgttttgttggaatattttttactcactgggctaagcatttataatagcctatcatgacttttaccagagttcccctttcacttcagcataaatatattagtatactgtaatagaaaatgccaattcaatgagaaggtaaagaacaagtagcaggcagcattttatcccatttttattttcacccaagttttagtttctctataggcgatttttatttagtgccaaactattctggactttgctttaatctgtgtaagtttaccaacaggctttagttacaatgatgctttacaacaaataaacatgccaacaaagaaaaaggagagaaatgcaacatgcaaaatatcactgataagccatgtgtaggcttgccgagaatatatacgtgttatgtcactttggattgcttctgtctgtaccttcatgtcccctctcaactactgttcaccttgctgtctgcccagggacactgacctgcttggaatgggttctggttgggttcaaccagttggaggcatcaatcagcagagaagagggaagaaggaggatgcaggcaggatatttgtgtcccagggtcactttagttgtgtccctggactgaagggcacagctgttcttgtggcagcttcctaccttccttcttccttctgggtctcaggtcagtaagttctgaggttgctcctcccacattactgcactaccctcatattttgtccttatctttctgaatagtccttatgtaaaaccctacaaaaatgaccttaaggctaggtgcagtggctcacgcctgtaatcccagcagtttgggaggctgaggtgggcagatcacaaggtaaggagatcgagaaaatcctggccaacatggtgaaacctcttctcttactaaaaatacaaaaactagctgggcgtggtggtgggcccctgtagtcccagctacttgggaggctgagacaggagaatcacttgaacctgggaggcggaggttgcagtgagctgagatcgcgccaccatactccagcctggcgacagagcaagactccacctcaaaaaaaaaaaaaaaaaaaaaaagatcttaatatgcgtgttgtttatctgtttcttacagggttcttaactcgtattatttttttcagatggtttttcccttttcctcaaatatttcgacaattgctgtgccataaaattaaatcaattgtaccttatggtagaaagtaactatgtattcaattccttttctcatacatttctttatttgattcgccaaataactctaagattggtagaacagttttcaatggccctatttatggtttggaaaataaaggcttagagggaagaagtaattggactatagtcagcatatagatccaggaccccttaagtttatgatttcttcttcaagactctgttccttaaaccatgctatgagagtatactgcaaacacctacacaacatttgattatgaccacaagataacaaccataaattctgcgtatgcagaatctaaaagagggctgcaaactatagtccaggccaagggtacctgttgcctgtatctataaacagaattttattaggacacagctgcacacatttcattcatttattgtctatggccaatttgccgcctttttttttttttttttttctgagacagagtctcactctgtctcccaggctggagtgcactggtgcaatctcggctcactgcaacctccgtctcctaggttcaagcaattctcctgcctcagcctcccgagtagctggggctacaggcctgtgccaccacgcctggctaatttttttgtctttttagtagagatggggtttcaccatgttggtcaggctggtctcgagctcctgccccaaaatgatccgcccacctcggcctcctgaagtgctgggattacaggtgtgagcaaccatgcccggcccgccacccttttgagtaaaggtagagaaacacacatgacctgcaaagtctaaaatatttattatctggtcctttatagaaaacacttgctggcccctgacctaaacaaacaaacaaacaaatccaaactttctttacagttgcctgactgtggtgctcaaattaaataacctaaatgtgtctgaagcctctccgaaattacatattaaagattaaataatttcaggccttatttttgtaaaatatccatgaagggtattttgggtaactctaagttaaccagaatattaaaataatcatagcatgtcattctatgattaatctggaaaacagaagaatttctcagcttgttatattattttttaaaaaacttctctttaaataatgttttgaaaataaatttactccaaagggatgctagagaggtagtttaactttcctttctacttccagaaaatataccaagcaaaatatggaacactgagcccaaagaccagaaatttttaagttaaaagttggttttaacttaaagaaaagaaaaaatcaaccttgagggtattttgcatacaagtcattaatgcatactgcatcaaatatttgcttcaataaaggtgtttatcagaaaaaaaaaagtttattgctacgtgtaacctaactattttaaattagtgaaaacaagtaacagagagaggctagaaatctatttcttattgtgaggcttctggaagccagggattatagtgagcagctctaatttttcaccagtcccatttccacccagcaggaccatgaatcgtatgtcctggcctcctgctccagggggctgagtatgttattcccattggccaattagcataaatcactttcccagccacagagattgagtcacagatggacctgttagccaagcaaggccaaatcagaatcttttgttgggaatggatattgatattgatagcataacacattactatcttctgagctttgacttttaaagaccttatgagcttgaaatggccactggtcattttcaccacacaagaacaatctgcctgagcacggagtcaacacaaaagcaagcagagtagggacagagggagtgagatagcctcctggtagcctctatctaagtacccagatcaaggccacaatggaaattagccagcccctctatttcccttttatgtgactcactgcttacttccaccttccatgtagtttttggtaaagcagtttgaatagggacttgtcacttacagttggaagagtcctgactaattcatggtgcaaagaagagtgtataaatagagacgtttattcattgaacatgtatatatccaatgcctatcatggacaaagcccgaaaactagatgtttccactagaatgatataagcgcatagggaaggctggtgggagaggatggagttaggcaggtggagcctgctattcagagaacattgtggcatgtactgaatggcactgtagtatcaagaggcacatttgctcaggcattcatcaaagaattattcatatcaatactcactctgtgttcttggcacagaggagacaagggagggaaaaatgaaacattgccccttccctcgtggagcttacaggctcacaaggaaggtagaattcaatcaaataacctcacagaactaagtacaactgcaatggaatggaacagaagggaagggaagggaagggaagggaagggaagggaagggaagggaagggaagggaggggaggggaggggagggtaaggagagagtgcaatgctatattaagaaacaagtgagaacagtcatttgacctagttcaggaggtcagggaagatttgtgtgagaacgtgtccatagccattggccaggagaagatgagtgggaagagctcatgtgaagggaaaatgagtagcaagagtgaaagaaggttggcatgtctggagcactgagaatgtgaggggagttgaaggtagaggagtgtcatcctcctgcattctagataaagtgacctggggcagttcccatccacacctgcggtccctagtaattattaagagtgcccttttatctcaaaaaaaaaaaaaaaaagaatccagatcaaacattaaatactatagtcccgtgatcaaaaaccaaattaggctaatggcaatgtggtgaaatcctaataatgtctggagtccagttattagtaatgcaccagtgctaatttgtttgttttgacaaatgcaacccagagtgatttaagatattaactgggcaagggatatccaggagtcatctgtactataattgaaatttttctatgaatctacaagtatcccattattgtttatttaaaaaataaaacaacaccagcaacaacaaaaaggtagaatgaccaaaggaaagaaagttaaggagtttcgtttttatcttaaggagaagagaaaggtactaaagagttgaagcatggtggagtggcgaggagaagagtcctcagatctgtgtttaaacaaagccactctagctgcaggtggggaacaaactggagggtgcctgagtgactacagtgagattggtctggggccatcttagtagctcaaggagcgatgacagtaccttggaccaggagataaagagaatggctagatacagggccattttgaggatgaaataagcagtagtttttgtggactgcatatgggatgcaggagagggaggagtcaggaatgaaacctaggtttctgtacatttgtttacgagtaggagtctggggggaccacacacaggacccttctgtgagaaggccatccaggaagttggggaagggtggatgggtcctgatacggagctgaagggtgagaggacagctatcaagcccctgcaaggattggcaagagccagacagcacctcagtttaagcaccagtggaacatccagcaggttatcaagacaatgtgtcaggctcctcagagcaaagggagggccgaaagaatcacatcaaagtcctgctcctcaaatgggaacccaaagccatgatagcatttgccaccatagaaacagggttcagtgtggtgatgagtcctgctctgtgaacctccgtctagcctcagcctacatatccagcatggagtggggcagatctacaaggaggaaagaacttctgtgaagagaggcattgcctaggggtgagggactttgcaggcccccagacctctagggcaagaccccagaacagtacctggcacatagtagacactcaatatcagttgagggaaagaaggaatggataaaagatactgagcattgatcccctcacctgtgaaatcagcccaataatatatcactgatagtctgaaaaaggctaaaattagttggcagtgttgtctgcagggctgagctcatgaaaagcactagagaagctatagccatgaagggatgaaggtctgggaaaaaatatacgtcatttttgtttatttatctgcagtgaccaggacattgcctttaattagcaatctaattatatattgggacattaaaaatgtacaaatggggcatgaggattttattccttgtggacaaggccacaagtgtattattcaccactgcatctcaggcaatgtaatccactgcatgtttaacaaataactgacatagaatttatttatttaattcctctcctgcagccaacagagtatctctcttcgggaaggtgacctctgtagttcttttcttcccccccaccccttggctggggttgtttttctctccaattatagtgaaagtgggtggaaagtattggttctctctgtccctgaaaggaattcacttacttcactgtcatggtccacagtgaccaagctttgcctcataagcaccacagcttcccccaagccctgggaatgaatgaattacccttggggtgggttgtgcaagaagaaaagcctgcctgttccaggaatagcctccacatccaggagaagtgacagcacctgttggtgactctcagagagttggctgggatggcaaggcagactgagaggcacaaattctgaggctggtttttgagcctgttaagctcctgaaggggaagcccagtggatggaactggctatgatttgttgctgcctggttggaatatgagttgggctccctggaagctgcaaccctgcttaatttacctgtcagatagcctgatgaatttgcccatagagtttttaaatagaagataaagcccttcactctgtaaggctttcctcttcagtggggaacatagccatcacttgcgtggatcgatgtggctaattcagggctcttcagccccaccctgttgagtactctacctcagctctgtaaatataattctttggaatggaattcaaaagattgcccattgtgtgctcagtttattttccagtgaaggctccaagaagccaggtcaccagtcgccgctagctggtgctctgctagcgtgccccgtggcagtagctgagtgccatccaatgaaagtggctggactcagggacccagaggagctcagggggcaaggagagctcacacaggtagagtgctcagccccacatcatgactgttcactaattttcagccttctttggcccacttccctaaaagttctatgcaccattcctgtcctttcattagaaaacatgtttttgggatagggattaaaaaaacagacaattcttggagatacctggtctcctctgtccttccacatgagagataaggaagaagaaacatggaattctaggttcagggcacccattaatctgcaatacttggactatgcctttcaacaaaaactgaagaatctaatttaaagtcactaataaacacaaataagtctgttggattcatgattctatagcaactgttaagtactaatgtaaatttacataacatcatcttgatcttttctttgccagcaataatgtataattctattcatctcaacaaagtgcattgtatacagaaattttcccatttaataaaatattaattttgcctcttttaaaaactgctcatttttttcagtaacaaatggataattcagtttcttctggtggaaaaaaatattaagaacaaaatacttatgttcatatgatcagtgtgtaattgtttttaacatctatattgatataaaataaataattttaagaaggtaaaaaatacaaagcactttttaatcctctttaaacaatacataagtaggttaaggggtttcctgaaaacagtttacattttaaaattttataacaattaaaaatatgctccaaagcataaacacatgttcttaatcaacattcttttaataatgaactaagacagaatttttctttttttctttttttaccatggttccaatattataagtcataaaggaaagattgggtagagtaaaatgaaaagttttgtaggaaaggaaagaaaaaaatacagaaagtcaaaaatcaaacaacaccctagaaaaccactggcaacttaagacagagtattgctatctttaacatacaattaattctcacatatcagtaagaaacaaaaatctagccagcaatcacaatataaaaatagcataggaagttgtaaaggcaattcaccaaggaagtgcaaatagccaacatattctggaaatatactcactaataatttaaaaagctaaaattcagatttgcaaaaatgtaaagaattagtatgcatttgaaaacaattagtacacatgtgaaggattggtcatgttcatgaattattgatacacgtctcaattttatttgtttctggagagcactttaggaaactgaataaaaacttttacctatctacattgtcacacaaatttcatttgtaggaatctattctttaaaaaatatttaggcaaataatagtcaaggttgctcagtgaggtattgttgggtacattgtgaaaaacagcataactgtccattaatagtgatttgatcaattagttatgatactatatgatacatacagggatatatgcagccatttaaaatgtcattaatctataggtattgaaacagatatttctttaaggttacaatgcaaaaaaaaaaaaaaaaaaaaaaaaaaaaaacctattaagaaacagcacatgttacttatggtttcagaaattgaaaactatgacttatcaaaaaaatccaaaaattattttaaaaaaacatttaggggaaatactatcatccaacagattttagtttctattattccccagcctcaaacaaatatacataattatttgcatattcaatttgtatttatttcttaagtaccttatttaaaagatacttacttatccttttggcagggacagatttttaaagattttggtttatatcttgtttgtaatgatattaagtttttatttctaaggggactgcaaatgacagccctgtgctttccacttgagagtgatgctgctgacccctccaccaagtttcaccctcagggaagtgaaatcactatggatgctatttttttcatttgtgaactaatgttgattcacttatattttcttaaatgcctgcatacatgtataaataattaaacagagtcaataggatttaattaggggatacatttcccctatagtgactaaaatagagtgaagaacatgaggacttggtatgtaaggacaatgttcaaaaacattggctggtatatgcttttgctttgcagatgagtgggcctgaaagcaaggacagcaacaagcatattcacaacctagatggtgatctatctcattttccattaaagagaaccaaaggttctcagagaaatggctgactctaggactgggacaaggaatacatatgataagcctggaacattttgttgtgccagaaattaagaaagtgttaaacacgccaacacacaatcatgcacaatggctgcatatctcaaagggatacagaggacaactgaaagaactcccaatggccaaagctggaacaatttgaacaacaaataaataccatagtactggattctaacccaaagtataatatatatagggatgagtccatactgatgtaaatatatgactgaataaataaataggagaaaagagacaatctcctatgcagaggaatttcaaacaacttagatagatactctgtacccaaggagaggaagcataactccccactccacaagtgtgagctgattacagtgccatgtttttgaaaggtacagtttggaaagtaaaaacaataaaataaaaataaagagtaattttacagtggagaaatctgacacacactacctcagccaggtgatcaaggacaacataagccatgataagtcatgttcatagggtgtgtccttggtaggatgtgatgagatggaactttacctctgtgtttttcactctctaagcatattatcacagcctaattttgagaaaaaacatcagacaaatcccaatggagagacactctacaaaacaaccaaccggtatatgcctcaaaattctcaaggacatcaaaaatcgggagagtctgagatgtattcatagtcaagaagagcccaggcagactaagatgaaatgtaatatggtatcttgtagcagatcccagaacagaaaaaaagagccttggtaaaaattgacaaatctgaataaagtatagactttggttaataatgatgtaacagtatttgctcattggttgtgacaaatgtaccatattaatttaagatgttaaattaggggaaatcagtgtggagcctatgagaactctgtgtactatctttgcaacttttctgtaaatctaacattattctttaaacaatttttttttattaaaaacagcatgtattgcttttggttccagaaattaaaaagtgagcaacttaccaaaaaattcaaaaattattaaaaaacatttaggggaaataccacacacagtccaactgattttaatttctattatgtcccaaactcaaacaaatatgcatagttatttgcatattcaatttctattcatttcttaaataccttatttaaaagatatttacttacctttttggcagggacatatttttaaaggagatttttatttatatcttgtttgtaatgatatttagtttgtatttctaaggacactgcaaatgactgattaaatgaagtttatcctgatcactctaaaaaataactaccctgaccactcttttaaaaattgttatttttttaaaattgttatcttttaaagagtggtcagggaagttacttttttaaatgattgttattttaaacaattgttttaaaaaatgttattttttaaagagtggtcagggcagacttcatttaagcattcatattgaacagggatgtaaaaacagtaaggaagccagttgtgtggatatctagggacagcctgtgtaaaggcagcatgtgactggctcttcccttttaaggggggaacagagagaccagtgccctagcagtggtcagggttgggagctggggatggtagtgagaaaagaggtcagagaggacagagggcagtggggggtagcatatataggacccatagcatatatagacccataagccatttcaatacctttgcctgagtaagaagagtggccactggaagctttcaagcagaaaagcagaacccaactccctttggaaagattcactctgtctgatatgactgtgaaaggcaaggatgaaataggctgttttggtcattcagttgagaggtgatggtgactgggaccactttaacagtggaggtgataagaagcaattacatttgataaaagcagttatatttcaaagttctttttatccaattagatataagataagagaaagagaagcatcaaaaataattcaaaaaacgaccaggcatggtggctcacacctgtaatcccagcactttgggaggccaaggcaggaagatcacttgagctcaggagtttgagaccagccttggcaacatggcaaaatcctgtctctacaaaaaatacacacacacacgcatacacacacacacacacacacacacacactcatacacacacacacaaattagctgggcttggtggcatgcgcatatctgtggtcctagctactaaggggatcatttgagcctgggatgttgagactgcagtgagctgagattgtgccattgtactccagcctgggtgacaaagtaagaccccgtctcaaaaaaaaaaacaaaaaaaatcaagaaactatgttttgtgttatgcatttacaccctaacttatatcaaagaatgttaggggatttgccatatttcacaaatcaacatgtaagtcccttcattaatgcaatggcagttatgctctgtccattgctccactctgtggtttggtatttcctgcatccagtcttagggcttcttcctgcatggtatgttttgtcctattgtttagccttgaggctccagtaaagcaacaagtgggctgaaagcaactttcccagaaaggacaaagccttggggtgcagagagatcttattagtgggaaactgctcctaggagaggaaaacactatgatgcaaaaagcatgtgttttctgcttttcctgaataaaacaagaacctacacattatattttcaaaggcagaaatatgtgtaaatgtaatttcaggaaaccgtgcatttatccattgaacactcaattcaggctaatgacacccattcttgtcttaatgaccatactaggaaattttctttcattattattaagtaattgaactttttaaaaaaaattattatttttcattttaaaaatgaagaaaatattttaagttacacaaatagacgctgctctatggacaaaagttccaattttcctgaaattgaactgtaaacatatatttggcactgccatattatagtttaaaatattcattgaccatgtgaagaatgaaagtctgaatgggacatgcaagtgacctaaggtaacagtataaaagtaggaaccacacaaagggaagctgcacagaagttgaggatagcctatgtaaagctggagagaagttcgtctttgataatgacaggtgaattttagctcctggcatttgtttgtttgtttgtttgtttgtttgagacagagtctcgctctgtcgcccaggctggagtgcagtgacgagatctctgctcactgcaagctccgcctcccaggttcaagccattctcctgcctcagcctcacgagtagctgagattacagatgcccgccaccacgtccggctaatttttttgtatttttagtagagacggggtttcactgtgttagccaggatggtctcgaattcctgacctcatgatccgcccacctcggcctcccaaagtgctgagattacagacgtgagccaccgcgctcggttgctcctggcatttttaccttccctcggatgggcctgacaaattcacgcttctcaggaacattttaatactggccaccttcgagcaaataaatcaatttaaattgttgatgtagtctccgtgttttgaaaatgggcataatcatactcagaacttaaatcactgtaaggattcagtgacattatatataaagtatttaacgctatgtcagatgcatgttcaacaaattgttaattacaatagcaattgaacaattatcaattacaatagcaatagaaaacttataaattataataacagttgatataattatcaataacaaattatcaatcattattattagttgtgaaatttagggcactttgagaagaccccaaaagactgtcataacatactttatagacaggagaaaaatccttctaataaaactgtcctcaatataaactacaaccccgcgttcagctacacaaggacacggaacagtgacatgagagacaattatgtcaatatggccaccatccctattttccaaagtcctgatttcagacactgcctttgcttgtttccatataccatatttcagtgtcaaacagcagctcccagcttgcctctgacattctgaattagcataaaatattgttgtcaaatcatatgttcccatttttaattgtcaaagaattgtttgcaataatatcaagtttaatggctgcacacccatcacgtcacctgacatatctgtattccatttaacaccccattgtctctgcattacagaagtaggctccaagaaagaaaggaaatcagcccgtacatctgagctttcagtccaaaggcagagaagcagtgcagagcaagcaggaaatgcagggtgctactcgcagcctagagcaatcaatgcaaatctatgccaccgttagaaggtgtttaattccaataatagacatcctgtgattgatgaatctttcgcagctgttttctatgtagctgcttaattaaagcctgctggcagagggggttactcacttcagcaagttgctgaccccagagtatcccacttggctgccagcagattgaaaggagtggctaggccatacgttggggcctaagagttggtgtgaagtcagtgcataatgtgatgcgtcaatttccatcagcttcctaataacaccaacacactgacaaatacagcactaggtggtggctaattccatggtcatttctgtcttgcctttgacatggtcacctagaaatgcttccctagtgatcaagcttaatcccatggaaaggctttgtcaagaacctcaaactaaccgcccttaggtaatatcataaccacatcataacatagtatcataactagtcatcagagatgactgttgcttgcacgtaaatttatttgggtactgtcctgtactccaggtaggaaaaaaggttgacacagccattctgaaaaacaaatttgaaaatacgtatgcctcaaaactcagaaatcctaattcttgccatttactctagagaaaacacagcacaaattcacaggaaacatgtacacagttgcttgttagagtattgttcatgctgtaaaacttatagtaacaaaaatttggcagcactattcacaatagcaaagacttggaaccaagccaaatgtccaaaaatgatagactggattaagaaaatgtggcacatatacaccatggaatattattcagccataacaaatgatgagttcatgtcctttgtagggacatggatgaagctggaaaccatcattctcagcaaaccattgcaaggacaaaaaaaccaaacaccgcatgttctcattcataggtgggaattgaacaatgagaacacagggacacaggaaggggaacatcacacactggggcctgttgtggagtggggggaggggggagggatagcattaggagatatacctaatgttaaataacgagttaatgggtgcagcacaccaacacagcacacgtatacatatgtaactaacctgcacgttgtgcacatgtaccctaaaacttaaagtataataaaaaataaaaaaaaatttggaaacaatctaaatgctggtcagtggaggaataacaaaattgtgatataactgtgccgtggaatactatacggcagttagaagaatcaaggtacatttgtcattataaatgtcaaaaacgtaagggtaaatgattttgaaaagttgcagtatgtatagttcataccaaataatgtatttgtatgaattctaaaattatgcactaagcaatactttatgttttagaatatatgtatattaagtccttgatgggagatagatagttaagtgttcagattagctgccaatgcacagaaagcggtggaaactggaaaaagagacaaaaggagtcaacagtagtcatggagttattatttgaacagaaatgacattgtgttggtatcagggtagatgattgactgaatccatttgattctgtgtacctaaggtcccgcatggagacaagaagtttaggaatgtcttgtgaggagtgtggctttaaggacaaatgcagtacaagaaacttgagctctgtgtcagctcttccaaccaacctcccctcctgtgcctgccgcagtctgtcctcagaaaagggagctggaggctcagacgtcatacatggtttaggcattggcttctgtgtgcacactgacgacaaggactccagtttcaagaacagcttggtgatactgtcaccctgtgctgcaagcacatccaaaccatccactcactgtcacccctgccaacactgaagatgtttcagagactattagactggacccaggcatttactatccatcataccatcatgtcctctgtaatgctcttctctctggctctgagaccagcctggctaacatggcgaagccccatctctacaaaaaatacaaaaataagccaggtgtagtggcatggatctgtagtcccagctactcgggaggctgagatgtgagaatcgcttgaacctgggaggtggagtttgcagtgagccaagattgcatcactgcactccaacctgggcaacagagtgagaccctgtctcaataaatagataaataaataaatagcccaggcatggtggctcacgcctgtaatcccagcactttaggaggccgaggcaggtggatcatctgagatcaggagttccagaccagcctggccaacatggtgaaaccccatctctactaaaaatacaaaaattagctgagcatggtggtgggcacctgtaatcccagctacttgggaggctgaggcagcagaattgcttgaacctgggaggcagaggttgcagtgagctgagatcacatcattgcactccagcctggggaacaagagcaaaactgtctcaaaataacgtaacataacataacataacataacataacataacataacataacataacataacataacataacataacaataaaataaaaaaaataaaaaataaataaaaataaaataaataaataaataataaaaatagaatagaatagaatagaatagaataaaacaaagatgtctcaatttgcttccattgacctaataaaagaaatatttctaaaaacaaccacagtggtttagcagctgtctttattcaccttttcagcaatgcagactaaatgcagctgacattcatgttgaaataatttgagtataaattactttcaaatacttctttcttaaaatagagaagggtctgtccttcatatttgaagatgacattcattctggttatccacaaggcagtgtggtgaaatggttttgtaacacttattttagttttgttggaatgtctttaacagttaagttcttgtaaaagataacatagatttaactctaggcctgataatggaaatttgtttgcctccgagctaagtttataaagtggaacagtaatagtactaaatgaaataaactcatggggaaactccatagaaaggacagaaaatttcaaaaagtaacccctggtctatagcttctgtgtgtttctttttggggggatggggggaagctcttccattttacttcatgcattaggtgaatcactcagttgtgatttttcagaaccatgtggctgttatgcagatgcacctcttacagctgcaaggatacttctaaaagcttggcttccctctgattatctacccttagtcagcctgctctcttttaaccattctatggctaccaacttattggatcatttcctaaaataaagccaaggggatccctgtagtaactagactcatagaaagagttttccagcagtggaaactcttggttcatccctttggctgcttttgattcagataatgtgcaaggaacttcatcgaccaatctctattacaaccacatggtcagttccctgagtaaagccaactgggatctttttcattcttccaggttaaggctaaggaaattcacatcttgatggtctaaaattgtctaggtataagaattaaggcaagaaaagctgaaggagaaaggcagacttggccataaaacaggctcatccacagcttctagtgggaagacaagagtctgttggaaaccaaagtagaatctctgcacatctgcaccaagagaaaccttctgagaaatggagagctcagctctgcttattaaaataattattatgtctgtttaatcattaattctgaatagtgttcaaatcactagttctgaatagtcatcaaattaacaaagtattatacaagttaatactaattcaattgtctttagagtcattaaattgatttcagcagtaagtagaagggtgggggtattttatcacaaaagtatgaaaagaggagagccccaggaatactgaaaacaacaataaaattttctcaatcttgccccatgaaatcctacttaaaatagctttagagggttcactacattctctattctccttgagcaacatttgggcaactttttcccattggccatcagcaaacacatggaggcatgtttgagcagcctaaaatgatgatccatacatattcaggaactccctaattatttccagttaggcccacaaaagtgaaagactcctgagatgggctataactcgtattgttctagggcttagttgttgtaactttcccaaacaaagaaatggctatgattctgtgcatacgacagaacttctccatctgccatatctaggacagtcatattatctgataatattaatttttgttaatgcattaattattaacaacatttaattatttaaataaaggtggctttgtaactcaggaatggaaaaccaaacaacatatgttctcactgacatgtgggagctaagctatgagaacaaaaagacataagaatgatacagtggactttggggacttggggttgaagattggaaggtggggtgagggataaaagacaacatatatggtgcagtgtatactgatcaggtgatggatgcaccaggatctcacaaatcactactaaagaatttactcttaaaccaaataccccctgtacccccaataacttatggaaaaaaataaaaacaaaggtgatattgaattattgaatgaatgtaattccccaatacgttttaaggaggttggagggtgctaaccacagggcattttgcaagcattgtaataagttaggagaggcaaattctacatataacgaagatgagggatttgtaaaatttgagaaatatttgagagcaggagattacatttagggaaatctgagtgctttatggaaggaaaggaaaagagacaaaaagaacccaggaacaacaacaacaaaaaaggccactatatgaacttttctaagttctaaatttttttatgagacaactcactcctctgcttttcctagcagatcttcagtagattctatgctgaccaatgcttgcttctctcttattagaatagcagagaacatagacagatagtttcaagaggataatgaaaggacaactgacatctgggtcacctatggtgtgtttcagtagtttccgccatacaccatgtatgatattaagccaattctccaacagatactccattaatagctgaatccctttttctcatccattatcttacattatctacattggtcaactcttacatattctctcaacaaatatccattgaacactaactttttaggggatacttagctagatctttgagaaagttagagttgaatcagccatttattttgcctttgaaaggaaaacaatccaataggaacagtgagacctaggcactggtaactataatccagtgtagaaattgagagatgccgtaagaatgggagattaaagcatttaatcaaagggaaaggagttaagtaagaatgtgtagaggatttaggacttcagttgattctgagaggagatttaaaatcaatcaaaatcaatgagtcaggtgtttccaataaaacaatgatctgcaattcagaattttgttgtgctgatggttactgcaataaaatgtttcacccccttgcaaggctcatagtctaaaggtataagatttggatagtagaacaaatccattatgtgattcacactcctacctatagcaaccaaatgtgacatgaagaataacaaaaagaaaaaaatcccgtacttgggagacattaaacgtacatgttttattagtccgtttctacactgctataaagaactacccaagactgggtaatttataaagtaaaaatgtttaattgactcacagttctgcagacataacaggaagcatgactggaagccttcaggaaacttgcaatcatggcgaaaggcaaaggggaagccagcacttcttaccatggcagaccactagagaaagagagaggaaactgggaagtgccacacactaaaaaaaacagctcatgagaactcactcactatcatgagaacagcaagggggaagtttgccacttgacccaatcacctaccaccaggccccacccctgacacatggtgattacaattccggatgagatttgagtggagccaaatctcattccagatgatagccaaaccatatcccttttattatttctaaagaatggagaggactgggtgtggtagctcacacctgtaatcccagcactttaggaggccaaggtgagtggatcacctcaggtcaggagttcaagattagcctggccaacatggtgaaacccaatctctactaagaatacaaaaaaaaaaaaaaaaaaacagtagccgagcgtgttggcaggtgcctgtaatcccagctactccggaggctgaggcaggagaatcgcttgaacccgggaggcggaggttgcagtgagctgagatcacattactgcactccagcctgggcaacagaataagactccatctcaaaaaaagaaagaataaaaatactcattctctataatcacataaaatatgtctcctctttccaaaactatggcattgcccttccaaagtggaaatcaaactagggaacagagacttacagaagctgaaaactggtaactttagggtagtaattctactaaaattttttaatctaactgtcattttaattataaaataataaaaataattagactacacagaaaaagataaactccaatttaaaatacaactgtaatgtgggagaaagcaatttttctcaaagaatattattctaggcccttactgaatagtgtggatagcatttaaattcctttatcacagcttaaactggtgctgctttatagaagtgttcatatctgtaatgaggctcgaaccccaaacacgaacacattcaagcacaagataaaggcaattgctgaatattaatgaatttattgtaggaagagctactgagttttcacacactgtcttattcaaagctgactctatttcagcagaactctgccaccatctgtcatgataccaaatatgactgatcatgaaataaataaatgactgaaaaaatgtgttcaattatttcctttggagcttaccatacagcaagggtcaatccaggccaacgttagtttgccactttttctagctttctaaggctctcaccaccactacactcctaataattatatatttcctaatatcgctagacctaattttgtgtttatgcaaaacagaaatgcagatcctgcagaagtgtctcacattatataaattgtagatacattagaactgattattaagtcctggtttcttttccctccccgaccacaaacacacacacacacacacacacgcatcctaattactgactacatttgggcatgctaaataaaataaacaaatgagtcaaaaaaatttaagctccttatgcttatagaagggacctaggagtaaagagtcaagaaaggacaagcctggatcatgggaatatcgtgcctggagacctcacatgaggtcagtacttttgctggattacttttagctgtcatgccacgagccttgtcttatgacattcctatttttttgccactcagatgttgttgagaatatttttcatgataggcacaaaggtctctctgtgagcaaccactggagaatgttttttttttttttttcatttctagctccaacaatagatgtatttctcataagttattagctttgcttttcatcctacaggcgatgtaagttgtgaaattcatcacgtttcctttttttatatttactgctatgaaacccaaccccagacaagtccatgatccatctcttctgaaaacagtctcccagatgcctagagcacagcaatcgaggggccgttctcaggatgcctcgctagcctcagattctgacctcacagcccagcaggtgtgcagcatgattgctaactgaactctcagttcaccttatttttttctcagttcatgatttcctcacttccatgtattattattttgtaggcagttttaatatatctatcttcaatctgaggagtgtaagtagattgtttaaagctatagaaaacccaatgctcatcaaaatttcccagtcaaatttatctgctgtattattaggactttcagagagatcatgagcctacactggtatctgtatcatgttcacagatttgtgcatttataaaattgtttagctaacaaaaaagtgagactgcatattgcaatgtttaaccaagcaggttttagagccagtttaatggagttcaacttccagctctgtcatttaacagctatgagaccaaaggaaaattacttaacctctcttggtttcctcatcacataaaataagaataaaagtagtaactacttcataaggttattatgaagagcaaatgaattaggtgaaaagatttagcatagtgcctggaggctggtaaataatataaaagcatttatgtcattggtgtatcaatctaaattcttctttgtgttgtatctggtacatttaaaacatcttcttaacattcttacctattatgtaagtattaagcatcattgtgaatagttaaaaaatgaaagtaatctgcacagaaaatgaaataatcccccaaataaaaaagcgacctacataatgggagaaaaatatttgcaaaccgtgtatctgataaaaggttattatccaaaatatacaaggaactcaacaggaagaaaacaaccaaattttttaaatgagcaaagaatctgaatagacatttttccaaagaagacacacaaacggccaacaggcatacaaagaggtgctcatcatcatgaatcatcagagaaatgaaaaccaaaaccacaataagatatcacctcacacctgttaggatggttattattaaaagaaaaagagataacgagtgttggtgagagtatggagaaaagggaaccttgtacactgttggtgaaattgtaacttggtatagccattatggaaaacagtatggaggtttctcaaaaaattaaaaatagaactactccagcaatcccacttctgggtatatatctaaaggaaataaaatcagcatttttgaagttaagttataagatgttatcttttatataaatattaccatataagtttatagtatatttatagtttataattttataatatattatatattaaaatatcttttatataaatattttaaagataaaaagatattttatcatgtaaaatcagcatctataccaccatgttcattgcagcattattcacagtaaccaagatgtgtaaactacctaagagccgatcaatagataaagaaattgtaatataccaagagatgaattttttcttttcacctcttggcataatgctatttaaaaggcttgtattttctctttatacaattttcacctttactttcaaagtgttttgttgtatttggctattgcagagaacgcattgtcctatcatttgtaaacttggtctgctttctacgttcatggtatggaaatgatgtgattctttgtacagtttatgctgatgttccttgtaatgcagtagaggctattttgccttccctcttctttctcatcattttgtaaactccataattatgaagtgattgcttgagaaaataacatataaacatagaatagagtagactgaccaagatggtttacaatttctttttttaactgggttattctgtatttctgaaccacttggcagagaaattcgcaatacttaatgttcatattttgagtaaaggaagctaaaaccatcttttctttttggtactacatgcattagcaaaaggttaggtaagtttgtgaagtcatatttaacatctcaaaaaataatcttgcgtgttccatagttttgtattaaatcggtcatgtcataggcactacgtcaagtacaaataggttgtttacttgtttacagtcgtatagtaacaaattctccctcacagcttcagattggtatctatagacttatagttcaaatacaatacctgaatatcccaagtagttcttcctaaacccagttgagcatagaagagatgtaacagggaggtgcagtgtgtggaagctgcaaacaagtaggccaaaatgaaaggaatctacacagaaaatgaaataaccaacacaaaaaagaaacctgcagaatgggagaaaatattttcaaaccatgtatctgataaagggttattatccaaaatatacaaggaactcaacatcaagaaaacaaataaaccaattttttaattgggcaaagaccctgattagatagagtttgaatcttgcactggtaatataccagagccctattagtttagtgattaggtatgaggataggaaacactttctgtaatcatatgaaaaagctgaataaacttaaagtgaacatttttttagacccaagtaaaaggaaagaataatcacccagagaagtctccacagaaaaggcctagagaaaaagaatttaccagaaccttattcaagccaggaagacatctgtccccaactagtcctctctagctttcctgtctcactagggaagggaaccatggaaaaatacttgggaagatcacagcccagagacacaagtcaagaaaaataccaaatcaaggacactagagaaagttaaaacctccagtcctacagctacagcaaacaataaacacagcacagttaccagccatattcatataaatcatcacactgaaggcccagttatctcagttcctgttacccgatgcaacatgtccagcttccaagaaaaaaggataaggcattccaaaccaagaaaaaaaaaaaaggaaaaacagtcttaagaggcgtagtaaacaacagaaacagactcagacatgacacagatgttggacttatcaggcagggatttaaaataattataattaatgcatcaagggctcaatgggaaaaaagtagacagcattcaagaacagttgagtaaagtaagcaaagagaaaaaaccctaagaaagaaacaaagggaaatgttagatattaatttctttgataagcacattaatactctagacatcaggagacagaattgctaagaaataatcaaaagcaaattctagaatttaaaaacaatatgagagtaataaaaaatacctttaatgggcttgttaatagactgagaaaagaatcaatgagcttgaaggtatatcactagaaacttcccaaactgaaatgcaaagagagaaaagactaaataaaacagaagagaacatccaagaactctagcaacaatttcaaaaggtgcaatgtgcaaacaattaaaatactagaagaagaaaaaagaatggagcataaatatttgaggtgacaatgacctagcacattctaacattaatcaccaacaccaaaccacagattcaggaagctgagcaaacaccaagcaggaaaaatatcaaaaaactgacacctagcatgtactatccaaattacagaacaccaaaaacagagaaaaagtttgaaggaactagaggaaaaaaaatcttacctataaggaacaaggataagaactacaaatgtaccataactcacctaccatcaaatatacaatttgaacagctctatagctatcaagaaaatttaactcataattttaaaacccctaaaaatgggatctccagactcagagtttcagtggagttttatcaaagattgaaaggagaattaacaccaattctacataatctcttctaggaaataaaaaaaagtgaacactttccaattaatcttaggaagttagcattactttgatacccaaaacagaaaaacatagtacaaaaaatgaaaactacacaccaacatgtctcataaatgtagatataaaaatccttagcaaaatactatcaaaaagaattcagcaatatataaaaataattatgcatgataacaaagtaggatttattacagataatttaagcttgttcaacactggaaaaacaaccattgtagtttacctcatcaacaagctagaaaagaaaagtaatatcataacatcaattaataccaaaaaagcatctaacaaaatccaacattcattcatattgtaaaacttctcagcaaactaagaatagaggagaatttcctcaacttaataaaaaaaaatctatttgaaaaaaacaaatccctacagatgacatcatacatataatgagaaactagacattttcttcctaaggagggaaagaaattaggccagaatggggtttgaatcatgatcccaaaaggcacactcccaaactccatactctctaatgttgaaatcttctctaaagatcaaaatctctaaagcccagatccttgtaatctaaaatccctaccatgtaaaatccccaaaatcacaatcccaaaagattaaaatccctaatgttgaaatcctaaaagctggattctggaggaagattagtgtgttttcagctgtacacacaattagttgctgaatgttagacacaactattactttgttgttgtctttatttgccagttaagtataatttaaggagatatatatgggtgccaaactgacagtaggtagatttgtgaacttaattttaggtgtcaacttgaatggataaaggaacacctagaaacggaataaagcataattttgggtgtgactgtgagggtgttcccaggaaagattagtatgtgagaccaggtaaactaagcggggaagatctgccctcagtgctggcaggcaccatctaaacggacagagtcccggagagaacaaacactgaaggcaaactctgagagctgggacagatttcttctgctgtctaggacatcagaaatttgattccattaaagtacattatcacaatgatgactttgtatgcaagcattgtgtgtatacgtgaaaacattgaaactttctcaataaatgaagagatgttctttctatacaattgcatttgtgaaagataaaatttcttgagatctcacctctttggacaaatggtggtgacacacagcagtttttgatcatcccattaaaaggttgttcactacagtatttcagatgaccacatagtgatatgtttatatatatatatatatataattttttttttttaagagacagggtctcgttctgttgcccagactggagtttagcggtgtgatcatagctgactgcagcctcaaactcctgggctcaaggaatcctcccacttcagccacctgagtagctaggaacaccagtgccaaccactatgcctggctaatggttttttttctaatttttttgtagagatggggcctcattgttttgctttaggctggtttcacctttttcttcatcaatacagctcgtctgctcttaactgttagacctgcgtgactgttgctaatatgtctaagtgtttatgcttgcaaaaatatgtcttattattttctattttattgtgtagagtggcctatgaagtgttctgttgtgtttttgtttctcaggtaaatttcctttaaaaatggaaatacattgtaaagaatttttaattattttttttccaaaattacatatacgggaatttcatctttcaggatttcagcactggggattatggcatttgggtttgtgcctttcaagattatgaacagctcccacaaggatgttctctccactgcccttattaaatgtcatactagaaggcttagctattataataagaatatataatgaaataaaaaatatacaggttcaggccaggctcagtggctcacgcctgtaatcccagcactttgggaggctgaggacagcagattacttgagctcaggagcttgagaccagcctgagcaacatgatgaaatcccatctctactaaaaacaaacaaacaaaaaattagccaggtgtggtggtgggcatctgtggtcccagctactcgggaggctgaggtcggaggatcatttgagcctgagaggcaaaggttgcagtgagccgagatcctgccactgcccaccagcctgggtgacagagtgaggcctcatttcaaaaaatatatatagagagagtttggaaagcaggaaatgaatttgtctttatttgtagatgacacaattctctatacagaaaatctcaaaaaatcaacaaaaatatcttgaaactaataagtcattatagcaaagtcacagggtaaaaggttgagatataaacatcaaatgtttttctaataccagcaagaaacaattaaaatttaaatttttaaaagtacagtttattgacagtagctcacacctgtaatcccagcactttgggaggcaaagggagggagatggcctgatcccaggagttttagaccagcctcggcaacgtggtgaaacccagtctctacgaaaaatactaaaattatccaggcatggtggcacaccctgtagtctcagctactctggagactgaggtggaaagatcacctgagcccaggagacagaggttgcactgagcctgtttgtaccactgcactccagcctgggtgacagagtgagaccctgcctcaaagaaaaaatacaatttacattaacaccaaaatgaaattaaacacttaggtacaaatgtaacagtatatgtacaagacctatatgagaaaaactacacaattctgattaaaggcatcaacaaagaacaaatgattggagagttaatcagtttttatggactgactcagtattagtaacatactatttctactcaacttaatctatagatttaatacgatctcaaactcccaacaatctgttttgcatatactgacaaactgattctaaagtttatattgaaagacaaaaatcttccaatagcaaaagcaagaccaaagaatagcattgaaagactcacagtacctgactgtaagacttataaagcttcaattaccaagaaaatgcggcattagcaaaagaacagacataaagaattggtgagacagagtagaacatgcggtattagaacacacaaatacagtcaactgatttttgacaaaataataaaggtaaattaatggggaaaggatcatcttttcagcacatagtgctggaaaatttcagacagatcccaattgagcgacagactacaaaatatctaaccagttttcctcctaactctcaaggccataagaaacagtctgagaaattgacaagcaagcgaagatttaagaaccatggtggtgactaaatgtaatgtgatttcctggatgagaccctagaaaaagaagtggaatttaggtttaactaaagaaatctgaataaagaatggattgtagttaataataatatatcaatattggttcataaattgtaacaaatgaactatactagtgtgtgttgattatagagaaaactgatgtggtatatatggaaagttttatcttcataatttttctgtaaatttaaagctgttctaaaagaaaacatttatgaaaatattagtaacatatcctctaataatcagcaaaaaatcagttaacattttgacatatgtatatgatttgtctatatgaaaatgtattttttcacaaaatgtctttttatatgtactgcttcatactcatctatttttcacatttcaatatattataaatatccttaatttcaataatcatagctattatcatttcactgtatgattatataataatattaccgaattatcccattacattatatatctcactactctttgaaatttctgttgttcccaattatttgctaaacaactctgtaatttattctacaaaatatttagtctgtcacaattaactctcaaggagcatttccagaagcaaaatttaggggtaaaagtttggatttttttataattacattattcaaaaattcatgttctcttatatttattaggaattttgctataatactattgataaaataaaatatctttaaaataagtaaaatgtatacagaagtacttaggtgaaagttatcagacatacaaatgctaattgtcacccctacactgtatatttaagtggcttaaaggaagcactccagtgatgctcacaatattaaataaaaaaaaaaaaggaaggagaaagcattgacagaaagaagtaagggaagagggagcgaagaagactagggagaatcggaggaaccaacatgaaaaagtcgtttgcaagagattttggcctatgatcgtataaaacactgagatgacactgaacaaaaggactgtctaaacagtttaagaaaattactgatcacattctatttaacatctaaaaaatagttatggcaatatgttagcatttcattcttattgtctacatggagataaatgaataaccaaaagtcaaatatctattgactatttatctctccaagatgtctttctagcattccacatatttttatattatgatgtaattaatatgcatgttcacttattcccaggatagccatattttagatgtgtgtatattgtaaagacacaattttgcataacttgtaaatgggtctgtgtgtgtgtacttatgcacactaaaacactggctatgaaacaattccatctgtagctcctctcttatttgaaggatgtattatttgcgaggtatataaatatactgtacgaggtgattgatgtcattagggaggcagtgaggcaggtgcttaagagccagtctgtcttggttcatacattggtttcatcattcaatagttgtaccacttaacccctgtattatcaaggtccttacttaaccttcctgtgcttcagatgcataacctataaaatggggacattaatagtacctaccttgtagggagttgctgtgaaggcttgtgattacatattatatagtatataatatgacattgtgtttaacatatacttttatatataacattatgtattgcatgtaacatatatgattacatatacttgtatatagacacatgtatacattagtacagtgcctggcaaatggtaagcactcaatgtatgtttgcagttattatcaaatcgtcaaaaacatcctgcaagtattgctgtctctgttttacagaggagggagccaagctctgagaatctttatgactttcctaaggtctcacagctagtaaaggactcaggttttgtctgaaactaaagcatatggccttgctctgaagtaccacatttactatcagtagtaactaatgtgattatagtacagggatgcatttcttaagtttattattggaaaaaaaggactctcatcataaattattttcatcaaaataaagctcaataaggatttgttacagcattattgacagcttaagaatgtttgcttaaatagtaaaaagaaaaataacattggaaaaattccatacgagtaatagacaccagaaaaagttactgtccgtgagccagaaaccaggatttcttcaacacactgtatagaccgatctaaaattaaggggatgattagccaacatgcaattcaccatatattaaagaaaagaaaagctccctacacatgagagaaggagcaaattgacttgatcacattggcacatcacaacttccaaaaaagggctgtcagtgaagtagggctggggactattgatggggcggggaaggtggcatcccagagcccaggagtatagcaagtacctacaacaagataaggcatttcctcaaaagtgttcattcaaccagatgtaaattcatcccaaaccgatttattagccaaagagtggaggcaatgccacaatatatcctaatgatgagagctaggacagagaatggaagaattgtctaacctcaacaagaaagagaaacaaaacaaaacaaactccttggcagtggtgaagttgctactttcactacctcggctctcactacgtctcacaatacatattactgcctggtaaatataattattatatatagaaattgttcctttccccttctctgagtctaaaacatccaagaaaggaccacaaaatattggttagaaggcaccagaattttcaatattaggaaaacttgagcatgtaagaatgaacagagaaaaatatcagacacataaaaggagcttcaagagaaattagccaatacaaaataatacaaaaaatcaaataaatattcctcagttttatcatcaatgaaattttctgcaataaacgaaaaaatatttggggaaaagtaaaagagaacattacatctatgaacctatttagtcaaacacttagaagaagtcatctgagatctggaagaaatgcctattttcagatttaaaattgtgatggaggtggtgaaacctttattagaatcacgtaaaaccctaacctattaaagcagaagatgtgcttcacagattagttagtaactaagaattaaggatgaatatataaaaatgatgagagaaaagataagagacatggaagagataccttgaaactacggcacacatgtaacagcagttgaagaaaaagaagataaaggaaaaagatgagacataatattcaaaataacatgagaaagatttcctgaattcaagacatgtttgaggtttcaggtcagagggattctaattgccaaacaaaagaaattttaaaaacttttttttttttttttttttttgagatggagtctcgctctgttgcccaggctggagtgcagtggcatgaccttggctcactacaaccttcgcctcccaagttcaagcaattctcctgcctcagcctcccacgtagctgagattaaaaacatgtgcctccacgcccagctaatttttgtatttttagtagagatgcggttttgccatgttatccaggtcgctctcaaactcctgacctcaagtgatccgccctcctcggcctcccaaagtgctgggattacaggcataattacaggcattaccgcacccagtctcatatattcttataatatgtgtgactgttaattttatctgtcaacttgatgaagctaagggatgccctgttcacgggtaaaacattatctctgggtatatctgtcagggagtttctggaagagatttgcattttaattggtagtctagagtaacgcagatggtcctcaccactgtgggtgggtattatcagattcactgagggcctgactacaacaaaaaggtggaagcaagttgaattctctctgtcttcttgagcttggccatctaccttctcctgcccccagacatcagcactcttggttctcaggcctttgtactcagggatttataccaacaatcccctcagttctcaggcctttggatttgagctgaattacaccaccagctttccagtttctccagcttgcagatggcagattgtgggacttctcagcctccttcattgcaggagccaatttccatcataaatatcctcttttatatagatacatcctattagttctatttctctggggaatcctgactaattcagtatgactgtatttcaaaaataaaggaagcagtaatctgagagaatacaggcagaaaataaaaaggttgtctacacaggataaagtatgagttttacattaaaatccttttcacaatgcaaaatgacagaaagcaatgaagcaaggtccaccaagtgttgatgaaaaatggctgtgaaacaggaaattggtagcaagatgggagaagagaaacagaaagatattatcaaacatggaaagcctcagaagttattttaattaaatatactttctaaaaatataagtctaattaacctaagaaagtaaaagaaaacacaagtactaagccttacatattgtattaatttgctagggcttctgtaacaaaataccagagaccaaatggcttaaacaacagaaacacattttctcacgttctggaggccagaagtctgaggtcaggtgtgagccggataggtttctttcaacgtctctctccttggtttggatgtggccctcttctccctgtgttctcctgctcttccctgtgtgatctgtgtcctaatctcctcttattttcttaaacagctttcttgaggtgtaatatacaaaaactgcaatgtttaatgtatacaattggctgggtttgaatacttgcatcagcccatgaaactatcaccataattaggtgataaatagatccatcaccttcaaaaaattccttgtgtttttgttttacttttgttttgtggtaacaatatttaacaggagatctaccctcctcataggcacaccagtcctattgggttagggtacactctaataatttcattttaccttaattatcctttaaagaccctatcacgccaggtgcagtggctcatgcctgtaattccaggattttgggaggccgtggcgggtggatcacccggggtcaggagtttgacaccagcctgaccaacatggtgaacccctttctctactaaatacaaaaaattagccagccatggtggtgcatgcctgttgtcccagctactcacgaggctgaggcaggagaatcgcttgaacccaggaggcagaggttgcagtgagacaagatcgcaccattgcactccagcctcggcaacaagagcaaaactccaactcaaaaaaaaaaaaaaaaaaaaaaaaaaaaaccaccctgtctctaaatacattcacattttgaggttactggggttagggcttcaatatatgaattgggaggggtggacagcacaacagctcataacagacctaaacaattatacgcagaagaaaagttttaaaattaccaattcagtgatgaacaaatttttaaagaaaacataaatgttaaaatttgactcaaaaaaatggaaaactgagattaataatgatacaaaatgtatcaagttgtcaaatgaaatgcagcagactttactggtgtttttctgtgcttagacttccaagtcacagaaaaatattaaacaacaaaaaccatttaagattacaaaattaataggaaagctataaatgccattctataaaactagcataagcttggtcctaaacctgtcaagaggcctagagtagaccaaagactgggctgccatccccagtcataggcaatgtgatttggggatccaagccccaggcctgaccactcagagacagcatctttactgccataaggattggttagaaatggttagatgatccagtctaagccaatcaagctcccaggaagacttttgctgtaattatatgaaaaaaaaaaaaaaaagtcattctctcctgagatccaagattttaaggtagattaaagcctggaagcagagggccagagccaaactggctgtactatctgtggaatttagtgcaaaatgaaaactactaggaatttcaaggtgttgattattatgggatgactgtatctcccccgaaatttatatgttgaagacctaaccctcagtattccagaatgtgatcttatttggaaacagggtcattgaagatgttattagttaagttacaatgagatcattagattgggccctaatccaatatgactttatccttctaaaagggggaaattcaaacacagagacacaaaacaccacgtgcttttctttcttgtttttttttgtttgtttgttttcagatggagtttcactcttgttgcccaggctggagtgcaatggcatgatctgggctcactgcaagctccacctcctgggttcaagcagttctcctgcctcagcctcccaagtagctgggattacaggcatgcgccaccaggcctagctaatttttttttttttttagtagagatggggtttctccatgttggtcaggctggtcttgaactcccgacctcaggtgatctgcctgccttggcctcccaaagggctgggattacaggagtgagccactatgcccgacttgtgttttgtattagtttgttctcatgctgctaagaaagacatacccaagaccgggtaatttaaaaggaaagaggtttaattgactcacagttcagcatggctaggggcctcaggaaacttacaatcatggtgaaggggaagcaaacaaggccttcttcacttggaggcagcaaagagaagtgctgagcaaaagggtgaaaagccccttataaaaccttcagatctcgtgagaactcactcactatcaggagaacagggtgaaggaaactgccccatgattcaattatctccacctgatccctgccacaacatatatggattatgggaactacagttcaagaggagatctgagtgggaacataaccaaatcatatcaaacacaaaggcagagattagggtgatgcatctacaactcaagggatgtcaaagcatgacagcaaaccaccagaagctgggggtgaggtatgaaacacattctccctgacagcttcagaaggaaccaaccctgccggcacctgtgagacaatcaatttctgttgcttatggccctcagtttgtggaattttgttgcaacagccctagaaaatcaaagtaacagcagagcattaaaccaagcactgtgcccttctcagcatggcgcttggtgtcagtgcacaggttgcatgcccatgaggccaaccctctctgcagctgtctataccactgggtccaaggaaggcacacctgaggagaagaaaggaagagtgaaaggaagtcttgaagccaaggtttaagctttaaatctagtgtgtgacttcaggtctctgcaaaggaaatgccaaggtttgattagacatgcaagtgaagtaagtcttcagggaaatgtctctgaagggtaaataagggtggagggggcaaaacaggagaaggcagggagaggcttccatctgcattgctggcctgacaccctgaaagcagtgagggaaaggaagagaactgggtaggagactcatgttgcagagaagctcagagaaagtcctgaccaggctgatgaagagctctagagcaaagtactcaaaggaaccctgcattaggtaggaattgcccagctcactacacctgccctgctcagtcattggctgggagcggccaacagaaagcatgaccaccacttggacactgtggggaattcaaaaagtggcccctggaggctttctgtgaatgaccctggatccaccagctactcttaaggtaagatctgaatgatacatgttaatgaccaccagcaaccacacatcagacgtagccacttccgcacacatttgggaaacagctccactacagtgtctagagcttctcttcctgaagagaaacacaggaggaagagactagcaggataaactgcagccccatctctgcatttggacttgagggcacacctggtactcattatcttcccctttcactatctatttaaattttccctctcctgtgttaccacctcagcaggtcttaatggcttacctggtggtgggacccaaacccttattctctaggggtctgaacactggtcatcagaccattctcagcctggggttgccaaacaaatcagttcatggttacaacggagcaaaaaaagtactagttggtgcccaaatgagtcacctgggttccatacacattttcctattgggtaatgccttacctcctcctcctggtcagaatcagttacccatggaatgaagatttctcttctcccctgctcatctctgggcacatgaacttcccggtgccttggaagaagctatagcttatggtctgctggactgtatgtcccacatggcagaactgcttataccacagcttgacctattatagagtcctttcttccttcaagcctcacccaaagtcaccagccttccatgtcacctagtatgtgagccaaggcagaagtccaaagacccaggtacagaatatgatgcctccaggacctgaggtggtttataaggagctgtgctacctgtcatcttagtaatgcaggatatgaccatttggcttttattttggaggttatgttctggaaatcccttgacacctagatccctaagatgtttactgaagtgacaggtccttgacttatcattgagtttaccccctcatacccctagaatgcatgtatcttatgagggtgtccaacatactaacaacttcttgctcatgctgccacatcaacatgatgctatcaatgtattgtatcaatgcaacgttcctcaggatatggagatgttcaagatctcttcaggttgtattatgacagaggaagggagagttaacatagctgtgaggcaaaactgtaactattgttatctgttcctcatgaatgtgaactatttctggccatctgttctgagtggaacagaaaacaatacattccacaaatcaatggccaaatgtcatacacttgaggcctggataaatctactctagcactgataccacatctgtacagcagctgtgattagggatacttggctgaccttatctgtagccattctttagggtccatttagcttctgcaagggccggactgtgaatgaagtgggaatataatggggaccaccacccttgcatcttccaggctttcaatggtagcattaagctttaccattcccctgggctgcaattttgttttgattcactcttttggtggaggatgggacaaaaacagcccacactcctgccacacttggacattggctgagagcagaccagtgacagcgtggccactgagtgaataagaagaatccaaattggtggcaggtgagggtgtctgccagctactcattgtagcctgaactctcaatggaagaactgatctacacacctctatggtcactactgctagacctatctacatttatacatcgatctctacatctccatttatatcgaaatacgtctattttaccatactcaaggtttatcacaagaattcaaagacatttattcatattagaagatattttggtgaaattcacaaaattacaaggtatgggtggggggcatataagtaaaccaaaaaatggaaacactttttaaatttctttggtgcttttctgtgtgtttaaaattttcaacatgcaaatcttttgggattgcattacagattcatagttattttcaaagagaattaagaaacttatctgctggttttttgcatctagaaataatgctttcagaacatgctgataatcatatgctttggccaatcagaccaatcaagtgtcccagttctgtccagttctaccacatgcacagtgacatgcctgccactggattactgtcatctgcattgcctctgtagtatcccacccgtaaaggataatgtgcaacttttccaagggactcagcatggtctctttcccttggagcaacaacagaaagaggcatgatagatagtatcaagaaatagttacctactttgaataatcaaggactttataacctgaaagaatattgccttcacatagacagtaagatttaattcagtgttttggagcccagcaaacaagttccctgagagaacgctttctttaaacacagcaactcaggcaacttgcacatatatgaaccaagaaggcctggaacattcaacaagctgggtacaagaggagccacaagagcaaactaagcacacttaaaaataacaatacggataagaaggataataattataatctctctggtgagatagaagatcactgtgaccaccagacacaatgccaaatatcctgttggcagggtgcttccttggcccttgtgcatttgtgagcccagagccaggctgcaggcaggcaccagccccagctttcacttgctcaccatcaagtgactgccatgagctcaggttacaaatttgtttatatttagatgaacaggtgtgtggctcagttctaaatcaaggccgtgtcctgcagttgtcatcttaatgtgcttcatatagctggaatgatttaacgtggaaaagggcgacactcctaccctgacttacgcttagggctgcacccagcttgtggaaattttgtcataaattctgttcgagattctgtgcatcattccctctttgcataaatctgcaaaggttttttgtactggttggtggtttcctgcaggaaaaggaatgagaagcccaggtttctaatgtggcttcattacaagagcaggttacctcttccctcttacctttgcaacctggggatattttaaaattgccgatttccagttggcccctcatgaatacaccaagattgttgtgaaactcaaatgataccatttaggtgactgtgcttcataaacactaaagtagtccacaaatgcaaaatcatatgatgcatataaaagagctttatgaagctaaatacactctacagatgcaaactagtacagtggatgaaagtgtcctgcaagcaacgttataaatgtcagaaacacgagggaattcaagaccaggagttctcaaagatagtggcttttcagtcagcttcttcaattgtcattttattaagaatgctgatgaaaatataacatataaggaagtggaaacactggttacactgtaattattctgttaagtatttgagctctggtacttacacaggttttcattctaagaattccacataccgggtgacagagataggctgtgtatcattctgtaacaaccctaaaagaagtagctacaaagtgggaggcttttcaatgagggaaggaaaataaaattttgttcccattcagatttcacttctgtttatattatcataaggatcattatgtgttattaaaagtgatataagtatttcatacaagaaataattctgactttttataaagtagcttcatcataggtatctcttaataaaaagtttcctgtctaccaagtgactccttttgcccatattctagtggaccttccactaaataagtgaacaaatgcacaaggatattggccttcccaagcatgcatgacaccatgggccttggaatgcacttgagtttttcttggtcattctatcctcacttatgtttaaagtctccttaattgctctgaaatacaggcaagtagagacagatgtgtcactacagatatgcttacctaacagacacaggattcccagcctcagaaaatccctgggagggcctctagttctccccttcccccacaacaggaaatctccctgcaactgcctggccatggctgccctccaagtcagatctctactcagccaggcccctgcttagtgctgtgagctgcctgggggatctggccccagagtcttgtgcactgaccaatctcctatgttttgggagggttggttggttggttggttggttggttggttggttggttggtttggttagttggttttgagatagagtcttgctctgccacccaggataaagtgcagtggcgtgacctcggctcactgcaacctctgtctcccaggttgaagcgattctcatgtcttagcctcccaagtagcagagactacaggtgcatgccaccaagcctggctacttttctttttttttttttttttttttgtatttttagtagaattggggtttcaccatgttggccaggctcgtctcgaactcctgatctcaagtgatccacccgccacggcctcccagcgtcctgggattataggcatgagtcactgtgcccagtccaatttcctctgtatttgagcgaagctcagactgcaggtgctaatctattagagcctgtagaagtcctaattcctctgtctctctttcctgctaggaagcccttgatgttttatcataatgaaagggaagaaatctccatttgctgctgccaacctgggcagtggcatgtctaaaatggtttcagttagatctcagggatttgcttttaaagaagtaaaacatttctcctgcctactgttacttatctttttaatccagaggtataaaaattttagattatttaaaacaagtgagtaatgaaatatgcattttaaacagatcataacaaactaaagaaggacactaatgagactgatggccatcagtggaagatggtggggaaaaatagaggtggggtgatagaagcagacaaatggagacagtggagtgatggagagagaaggccagcagaaagaataacatgcaaacagaggaggaggacagaatgagagtgaagaaagaaggaaggaaagaaaagaggaaggagaggaaaggaggaaagaaggaaggaagggaagaagagagggaggaagaaggtaaaagccaacagaaagacagaattgcaaacaaggaggaggacagagagggagtgaagaaaggaagcaaagaggatgcaaaggaaggaaggaaggaaggaaataaggaacaaagaaaggaaagagaggagagagaaagagaaagggagaaaggaagaaaggaagggaaggagggaggaaggaaagaaagaaggaagaaaaaaagagacagagggaagggggaggagcaagtttgaagtgggtgattggtcagaggtaaattacttattagactccaggtaacttgctataataataattgttaataataacatttattgaatgtttactatctcccagatactattctaagtactttacatgtaatactcattacaaccctatgagtttgactcaataattataattttagccatcagtctcaggcataagaaagccataccctagaactctaggtaatgactggcagagccagggttcaagctcaggtaggctggctttgtacctcttggccacttgtctctagtcccctgcagctgcctcttattctccaggctaaccatgcattgcactaccactgagatttccatgagccttgcagaagttgaaagcaacacttatctagtggtgttagcagattgcaaagtccattgtagaatttaagtttattttcttcagtgatgtttcaaaacatactttagaagtttacagatgcttggcaattttctagctgtttcaagttccttcaacagtttcaagatttttaattgccttattgttttgcttagagtgatcagaattgctttattccttgcaaactagaggttttaaataaaaccagcacttatttctacttcagaacaaattcttgttttgtggtctagttaagactaagtaggaaatgtgagagaaaagtttttaaaagctaggaataaatgttacatgtatataataaacgcaaccagtaaatgtttagtgaataaatgaaattgattaagtattgcttggtaacagcttttaaactacctccagcagtttaaagaaaacctgctacaacctgttctagaaacgccttctgaaaatacttgccagtagaatggttcctaatgattaagataaaagaagtatcacttattttctatgagtctgctgaaattaagcttagcatccatccaggaaaattgagttattttaggtactttaaacagaggagcattaatggaagcaattaattatttaaagagatgttgcataaacatgagatgcaggagcaaaaaggaaacagggctcatacccagagagtgagaacagatgcccaccactgcccttgagctgcagttcacaggctacatccactgctgagctgttggagttgctgtcagtttcaagaaagcaagtagagcagggcaactgcagagctgagaagccatttagatctcacctgtatagagggtgtctagatgagtgcattactacagcaaaagtatatacacaccacccttccatctacctaaaaccccttggttggaccttttaagtagcctgtacacaccaattgttctccagaaaataaaaaatagaaggcatgcaggaatttggtgaagggcattttataattgtctaggtacttaaaaataaaactagggagcgtttttcactgcctacaggagtttttaaatatgttttcttgtctattctatgtttgatttttaacattgtcaacattaatttttttttgccttaaccttaacaaccacttttcaaatttggtgacttaccacattttccttcatcttatacagagaataatacttacctgccctttaaatggattatgaaagtaattattgagtgaggggtattaagctgttaggaaagagtttattaaagaacaattctgattgtaaagtgccaccaagactctaagaatatcatactaagtcacttaatgcagtcagagatgatgttcacatgttttatgatagctcttacagatagcagttatttcaaggagattgctttattctgaacccttcagccgattttgaggttgatggcatttaattttatgtatgtattcagagagaaatgaaatggcttgatggtgacatacatttcaggatttctcttttattggattgaaaagcaggtacttagacttgcattaacgtttgaagcaaagaaagctaggatcggcccaagtttcatgttaggaaaaacagcgacactttggaaattaattaagcttatctggaactccagctgcattacattaaatttgatcaaatgctgaatgtcatctgcagtcaagctaatttcactaagggccaagaagatggtgttacattgaggcggggctagtcaagtgaatcttgtccatcagcacagtggggaatctgctaagcttatagatttaaaatcctcaaaacaatttccctctccttagaggttttcctaaatgcatgtggatttgggctgagattcctccccgctggatccactaaaaagacttttcctctctcttgttgacagttctcaacctgtacataaaatacattcaagaaagtgtgatgtgaagggttaggttagttcatggatcatggcatttaagaggaagaatcacccttgaaaggttaagttcaggatttgcttgcacgtgtgagataaatattgactagtaatcaggaagtaggcaacattagtaagattatttttaaaataaaccaacctctacagtacagaatgggggtgactttcagtgaattcttgaaaattcctttgaagtggcatagcatcatgattagaaacatgggagctggacacaggtggcttgggtttacatccttgctctatcacttagtaaatgtaagatttagagtgaattgcttaaccattttggggctcagtttccctataaaatgaatataaaatgaaaccctataaaatgaatataacaatagtgcctatttcacagagttattgcaaggattaaactagttaaaatctgtaaagagcttggaatggtgcttggcacatagtaagcactacatacgtgtttgttaaataaattcctttctcgagacaagaacctcactcctagctttgtacacataatgcacgcaagctccaatgctgaagcaatcaatccttctgagaaagaaaatcacagattcccagagccttattttcagaatcgctcatgttgcttccagacattggctatttaatccttccagaacaaccgagagaatttacacaaataaacttctccttttacagaagagaatgctgctgtacaggaagatcaagcgttttccttgagatgacccacggaactcaaccctttctccatgtttattcctttactatatcacttgctgttgggcataaagtaatcctaaattgatatgagatttaaaacaaaaaacttaaaaagtgtaagagtcaaaccaattttaaaaagtcagggtacgtataagagaaatgaatccactgtatgatatttatgcaatttttcagaagctggatcttttcttctgactgttgtgggaaactaacaaagtaagtactgctgaatggacttcagtttccactcatatttcctaagtgagaaaggaacagaaacacatagctggggttttttaaaataataagttatgcatgtaagttacatttaaatttatagaaacatgatttgactctgccaggtcaagaaaaaaaaattattattagggtgaacctgggaacatggagagcttcgaggcccctcattatcgtgggatgtaaaacctggtcaaggtataagaagggtagaaatgaatgtgagaagagcgtctggtggggatgacagacatgttcaactttcccctccaaatagctccttgtcaagttttgaaaaacaatctttgtccataaaagtttcctcatgccaaatcctgtttgtgcaagaatccttcaactttacccagtccagcaaagtgtcttacaggcaggagagagggaggaagggagaaaggagggagggaagataaagagatgaggaaaagagagagtgagagcgagacagcgaggaggaggggggcagagagagaggagattttcaattatttccatgttaagtcatggtttgaaaaaaaaaatggtaacttctaatgctaataatttccccaaacaccaaagcaatatatgctcattgcacaaaactaggaatttttttaaaagacaaaagaaaatcaaacttactaaaagtatttcacttcactgtgagtatgtgaatatgttgggctccatcatccggtgcctctccccaatacacacatacacacacacaaacacacaaacacacacatatctgttccctgtgcctatgaatgcatatagattttttaaatcacattagtatctaagaatatagctttttggcttagttttactatttattatatcatgagtcctttcttatgccctgcaatatgctccatagattttgtctctagcataatttctgcaatgagttaatgcaatttattaaatcagtgacatactaatggatgttgtttctattattttcttaaaataagtaatatgtatatttgtgaatcttaatgtaattctatagttatttccttaggaatattttctagaagtggaaattctgaatcaaagtctataagcattttaaagcatctaatatatgatattgtgttttgtgttttctctgattttagtgagatttgaatattaactcttttctcaatataaaaatccaagtttattaagtcaactctttttctatttaatttataattttttctttgttctgcaatatgctatttcctccactttcctctaggttattttctataattacctttttgaaggattaggtaattcatttttattctttctatagaaacattgctaagtacttcaagtgaaatatctaatttaacccgagcaggaactcagtagatattattcttagctccagtttatagctgaggaaatggacttaaataagttaaacaacttccaaagttcacagagtaaacagatggtgaaatccaggcttgatctcttcacatattgcaaagattcaaagacagcgaacttccttacctgtgagcacaaggctgtgggaacaacccatgagatggatgggtcctgttcttttttgggcttttcttaacatgaaggataatttacatgttctacctaggataatgttttctgttttattttgctagaaatagcatatattaatgcaattttaatggcaatttctaatatcgtatgacaaaatttatcaaggagtttcctactgaaaacttatcaaagagttttcatgagaatgctatttttaatgattcttacaaatgttacagaaatatttggaaagagctccattctctccttacacaatagactatccattatatatcagataagttgaatttattaaattttattcacatttattttactcaatttttacttaactttttttttttttttttttttttttgagacggagtctcgctctgtcgcccaggccggactgcggactgcagtggtgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctcctgacctcatgatccacccgcctcggcctcccaaagtgctgggattacagacgtgagccaccgcacccggccttaacttttttattttactcaatttcaattattttcatagacttgttttgccccagcctgagaatagtgtaacgtctctctttcaatggcttcttaccttaagtcttctgtgtatgatattaacaatgccttctccactctctactcgcctaatttatctttgcctttccttttatttccaagattttcttgtcatttgattttatgtgagaattccacatatactactctttggatctgagatctttttctttttaatactcaagattaatccattcacatttattctgacaactaatgtgcttggttttgacttttgttctttcttctttttcttttttcgttttccttttcctctcacatttcccaaatgatgtgattccagattttatttatattacatacagaagaaagctccagccctttagcttggtatctgtcttagcttgtttgtgatgttgtaatagaatacttgacactgggtcatttataaagaacagaaattaattttctcacagttccagaggctgagaagtccaaagtcaaggcaccaggcatcttgttaaggacctttctgctgtataatcattgcaaatggcagcatggcaaaaatgaaagagagagtgcacactcttccaggagcccttttaataatgggattaatccatttatgagggtggagcctttacaatctaaacacctcctattaggcgctgtctcccaacactgttgcattggggatcaactttctaacacatgaatttctgcaggacacattcaaaccattgcattatctataagtctttctgggacctggtcctaactatttctaaaacctccaggcatctgatcctcccaccatgacttccagtacacctgaattgctttgcattcttgcctatacaacgctgctttatgctctagctttatttgtgttgttcctcttctgttgtaatgctcttgctgtagtttttcacctggctaaatttcattgcctttcccagaattattctgtcatctcctccagaagctttctctgaaatatcctctgagccttctaatgtgttctcttagcaacctgcatgcctctccctgggtgctctctcagaatgcctcttgccagaagaagtttatcaattataaataaatgaatgtcagggagacctctgtttataattacactatttcttcatgagaaatttagcaatttactaataaaaatgtagaactttcctttaaacttaaaaacagctgctgttacttaggcttacaagctaaatggttctatcaattcagacaatggacatgatcataataaaaaccatgaatacagcatcacagtgatagccacttccatggaagtataaagaacagcatctcacatgcacaggaattgatttagacttgaaagccacctgtctgctgagccaatatattgaggtccataaacgtggtgttctacattatccttaaacagctccgctcctcttagcaattgctctaacagtcaccagctgctgtgtcagaggtgggcaccaagatattacatctatgccaacagctcagctccagaataaacaaggaagccctgagaagccctttcttaactttttctttcttagttcaggtatgactcatatcatggacttagcttagcaaatcccacttaaagcagagactgggagctttagcaaaaatgacagataacactgggtcctcacaaaagcccaacttgtgacccaggctgtttcaggctgtgtgccatgtgcacacaggacaggtacttgtgcctttatgcattgagttctttatagcataagtaaaatagatcttcacaaatcttcacaccctgagggaaacaatttgaagggtctcaccaactaggcaagtggatctcactaggatgctgtgctgacagatatcacctctctcttcagaattcccacttttcagtgcaacagtgaaaaacatttgtgacttttgaaagagtaagtgcatctgtcaaagcaggcacacacacacacacacacaaagagtaagaagatgatacaaggggccatgtcagagaacaacaaagattggacacaatcaaagtgtgaagtgggggagaggttgggattaaaacaataataccagatacagtatgtgccctctgggtggaaaggagaagaaaagaaagaagggagggagtaggtgaaagaagagagagctgtcaaaaggaaagaaggaaggaaggaagggagggaaggagggagggaggaagggagggaaggagggagggagggaggaagggagggaggaacggagggaggaaggagggaaggaggaaggagggaaggagggagggaggaagggagggaggaagggagggaggaagggagggaggaggggagggaggaggggagggaggaagggagggaggaagggagggaaggagggagacaggaagggagagaggaaggagggaaggagggagggaggaagggagggaggaagggagggaggaggggagggaggaggggagggaggaggggagggaggaagggagggaggaagggagagaggaggggagggaggaggggagggaggaagggagggaggaagggagggaggaggggagggaggaggggagggaggaggggagggaggaggggagggaggaggggagggaggaggggagggaggaagggagagaggaagggagggaggaggggagggaggaagggagggaggaagggagggaggaagggagggaagaagggagggaggaagggagggaggaagggagggaggctcactcactaaaaagctcagtatttgggtcagatctaggacacaaatggcatcattacagctcaaacttgctctcctcatccctggactccaattttatcttgtgtggccttcactctcagtcaagcatttcattttgtgtggcaacagactttcaagaggtacaccctatattcttaggaacctccaaaagaaaaatagtgttttttccctaatatgttcaaggaacctgaagctccttagcctggatttgtctggctggggtcacctgtgcattcctggagctccactgataccacatgactgtagagaaggttgcccaaagagtaaagaggccctgataccataagaggaggtgcattttagaagagcagaaataacagaataaatattttttcgggtcactgtggtttgaggatgagctgacatggagagtttagaggaagttggtctggttgtctgctgagcatcctatctctgtcttcagggaacaccatctttatgtgcggaacttccctacctcacaaggtctagtggaactgccaatcacaaggctctgatcacagcagtgaatatgtgactcgagttagccaatcagttttcctctcctggaaaatgtaatctttagtactgagacacaaagcgtggttgcagctgtgttatccaaagatagagccccaaatggagggcaagacagcctgtttctaaactgccagttacccagtggtgcctcagttcctgcccttccagaaggctagctgctcaactcttccttcaattctgtggcttactcagtgtgtacccataggtgtcctattgttgcttgtgttagggccagtttctgcagagtacagcctcagagcctgactacagtggggctagcttcagaggctctcataatagtccatattaccttagatgtccgggactggacttaggtttttgtcaaatatgatgcctggccctgtatggaaataaatgaagaccattgctgttctgctgtagaaagaacatgagaggctgtggtctccacatatatagttttctgactgacttcaaacctggacttgtgctgtgtactccttctcagatacgtattccttggtatgttgaaatggaaaatcaactaatgaaaggtaaggcaaagtgttcactgattttcctttcatatcttcattaattagatgatgatttatttattaagcaccttttctgggaaaggtactggagacaccatgctggacaaaaatactcattcccttaactgaagggccttggtagggagagcccaaaaattgaaaatgtgtatacacattatagtagtcacatactgggtgacttaacagaaacttactctctcacagttctggagggcagaagcctggaattaagatgctggcaaggctgtgcttcctctgaagttttttttttttttttttttttttccagatagagtctcactctgtcgcccaggctggagtgtagtggtgcaatctcggctcactgaaacctccacctcccggcttcaagcaattctcatgcctcagcctcccaagtagctgggactacaggcgtccaccaccatgcccagctaatttttatatttttagtagacatggggtttcaccatgtcagccaggcctgtcttgaactcctgacctcaggtgatccacccaccttggcctcccaaagtgctaggattacgggcgtcaggcaccatgcctggccttcctctgaaggttctgagagaaaatccttccttgcctcttccagctttggaattccttggcttctagacattttcactctaatctctgcctccatttttacatcatctttttctctgtgtatctctgttttcacttcttataaggaaatcagttattggactcagggcccactctaaatccaggatgattttatgtcaagatccttaactaattacatctgcaaaggcctttttccaaataagatcacattctaaaggccccagtgggcaggaatttttggtcaacactattcaacacaccacacaactcaatacgtaactgcaaactgaatgaaagtaacaaaagaagagtatggttgtatgagtacggaagaaaggaggagtatgaactagcctgtgggtatagtagttttctctcacattgcaccaaccaaccacaaagttagcagcttaaaacaatatctacctattatctcaaacttgtgtaggtcagaattccaggaatggtaggactgggctctgcactcagggcctcagaggctaaaatcaaggctttggtcacactcagttctagtctggaggctctgaagaggattcacttagaacctccatttggatattggaaaagatctgtttcttgcacttacagtaacgaggtcctgtttgctcgctggttgttctgcactgttgaaacctccaatgtgactgcgcttggacagagggcctttggagggaattaaggttaaataagatcctatttgcctattgatggccttataaaaagatgaagacagattctctgtctctccattcgagcacagaggaaacgccacgtggagatacagtgagaaggtggtcatctgcaagccaggaagagaggtctgaccagaaactgaccctgctggaccttaatctgggacttccagccttcagaactgtgagaaaataaatgtctgctgtttaagcccccagtctgtggtgctttgttacagcagccgtgcagactaacatacaggcttactgctggggactgtggttgtatttgtccattctcacactgctatgaaggaatgctcaagaacgggtaatttataaaggaaagaggtttaactgactcacggttccacatggctggggaggcctcaggaaactaacaatcgtggtggaagtcaaaggagaagcaggcaccttcttcacggggttgcaggacagggtaggaacaagcaggggaaatgtcagatgtttataaatccatcagctctggtgaaaactcgctcactaacacaagaacagcatgggggaaactgcccccatgatccaattacctccacctggtcccgtccttgataccttggggattatggggattacaattcaaaatgagattttgggtggagacacagccaaatgatatcagtgatgaattcctagaagctacccacactgtgtcacacggtctccaccatcatcaaagccagtaacagagaacctccctcacgtagtatttcttacctgatttaaatctttttcttctggaagagcccacaccctctttagccattacttgattgggttaggctcaccaagtgtaagctcctcatcttaagatccactgatttgggaacttaattatgtctgcaaaatctcttcacagcagtacctaggttagtttctgtgaataactagaggatgtgagtataccaggggccaaggtcttaggggtctgtattagggctctctagagtgacagaacaaataggatatatatttatatcctctcacatttttctcacattgcaccaaaataccacaaagtatatatatagtatgtatatgtatacacgtatatatacacacacatatgtatatatgtacatacacacatacatgcatatatgtatatacgtatatgtatatatacacacatataggtatatatacatatatgcatatatgtatgtgtatacatgtatatatatgtatatatgtatgtgtgtgtatatatgtgtgtgtgtgtgtgtgtgtgtgtgtgtgtgtgtgtatatatataggggagtttattaagtagtattaactcatacaatcacaaggtcccacaataggccatctgcaaactgaggagaaaggaagccagtccaactcccaaagctgaagaacttggagtctgatgttcaagggcaggaagcatccagcacgggagaaagatctaggctgggaagttaagtcagtctagccttttcatgtttttctgcctgcttttatattctggctatactggcagctgattagatggtgcccacccacattaagggtgggtctgcctttcccagccccctgactcaaaggttaatctcctttggcaacactctcacagacacactcaggatcattactttgcatccttcaatccaatcaagttgacactcagtattaaccattgcaggatcatcttagaattttgctaccacagtaggtcagggaaagcttgcctgaggaacagataacagagctgaggcctagacaatgccttagctagatgaggagggagaaggaacattagaggcagagtaagagtgtgggagaagagttgttctcatgaaactgaaaggaagcccacaggcaagagcacagagaatgaggactggtgagagatgtgagctggtgagaggtgtggatggatcacctggaccagatcttcagagccatgcaggtcacaagaggacactggacacaggtcacaagagtcctcctctctgcagggtgctgtcaaagccacaggatgcaggagaattactgtaagccacctagagaatttgtgactctgggtaacactaagccaacaggaataatattgaaaatatttaataactgcttagaccaggataccgtgtgggccatgctcccctccataggccctgactatgtggacattaacctaccgccaactatttgctagtttgtaaagaggtccaagggggtgtaggttacaatttgtcacccacactgggacagttttgagaatgacaggtgtaaaccaggactttcctggcaaaagcaagaattagagtcacctcagccttttggaactcaacgcagtgaatattcaccaaccaaaaagaaaactttttaaaaatatgtcagctaagtctcacttgtgcatattgactctacatcacctctatgcactccaagttaatagacttgagttcactaactaatctggcactaattgtcactctggaaaattgttctcgcacctcaatttccctaccttgaaagtaagcttattgctgtttctaccttaattcattccatgtgaatttcatttaaatggatttataaataagcgtttctttctttgtcaatgtgtaaattgcaaaatatctcctgtggctttacattgtaatagcactggggagaaatgtgatgagacaaataaaaattcctgaatgaacaatagtgagaattgtgctgacagattccatatctttaaggtctgaggatgtttaatcctagagtataaagcctcaaccgtgtctttagtccctgtgtacaaaagctgttctctgtaggaagtcagccagctgttgcttagctctgttctagagaagaggaaatcgccactgatttcacaaaggtgaatattccacccttctgcatatacccatattttcccattcctgagaccctgtctcaaatcccatcattcttgggaattcctggctcatgacaccagctggtggctctccctcaagttacatattttgtgccttttgtatgcatcacaagatgggtattttatcccataacatcctgttcagtaagtacctgtgtttaacagtataccatttttgtatgacttcccaccaccaaattctcaagtataacaaattgggctaagcagcttgagccctagctctgggggccctcactgatgctggggaaggtggctaaagtttcatgtggcaagaatgaagggaaagctggctggaaagcagatctgaggttggcgaacactccatcagcaaattataaggatcctgcaggcagcagctgagaaacatcacgccgggccctgccccttcaacacacaccattaggacacatagacctttttcttatcatctttcaacctacactcaaagttcatcttcatctcaacagttcccaaagactatggggagacccactcattgtagtctaccctatgactgtaaattctataagtattgctgcctccaactacctaagcaggggtttatagtacctctaagtattgtagcctccaactatctaaagcaggggtttataaactttttctgtaaatggatgggtagtaactgtcttaggcttgaaggccatatgttctctgtagcaaatactcaactctgccattatagtgggaaagccccgtagaagatgtgtaaccagtgagcatggctttatccactaaaactttgttggtaaaaacaaatggtgggttggatttagtccctggaccatagtttattgattcctggtataagctgtgcttaacataatatcctaccagtatgtaagcccaatgaagtacaaactgcatgattcataaaatgctttaattttgcttttttcaacctctcttctttcctccctacactaggtccttcgtctctccataacagtaaacatacattttacaggatatcctgtaagtccagcctcataggaaaaccgtatacttttccacccacaattcatactttcccatttctacaaaccttaatgccacttataaggaaagatctaatacaaataatttttatctctggagccatttgaaactacaaacacatgcagagaagattgctagttttgaacattcgttgcagcacactagttgggggatgtaaccccattactgctaatttggtttcccatgtgtttgttgccttatcacataggaatgagtgtgaatgcaagcatttgttttgctgtccttttaatagaattattccagtgtcgctggatgaatagaacaatctgaatttcttttttattgaagtggctagcatgatttctagatttcagtaagttacaggattaatagaaaaatgttggatctctgctggaactccctggaggtggagaactttcatgctcttcctatcttaggggaagtcagggaatcaatgaaagtgaatttctgagtgtcccccaaagcctccaattacttggtctttttctccatcgccctgaatgcctcaagtctcgttcttggggagattcatttacaaggaagcaaagcagttctaggattgtttctctgtaaacctaatggttttgtcctcttcctacgaaatcagcctcattgctgtcatccttattaatctgtatttttttgcccttttatccttttcttgcataggttatctctttcaacttgtttctagacctttttctccctcacattatccagctcctattagatggctttctccctaccccaaagcagtgtccctccaccttgtgactcttttctcaaaacactgctgtgcttcaaccacagtgcattaaactttttatcataatcatgcccatgtcaaaattctctataatgactaacagtcaagcctgggacagaatttgcggggaaaaagcatgagtccctaagttacatgttgaacacactgaagagcaacttttcacttaattactccctaaactggctctcactctgggggctgcttagctccagggtcaaaaggcagagcattcaaatcacccttgcctttgacaattcatacctatctttctgctggtgagcaggccaagtacaaaagctaaaatcagcaacagtagcaccttcaaacataaagcatgaagtccaaaccactttgaactccctatgggaaaaagtgttactgaggtcaaatgggttttttgtggacccagggaatcttacgctttcttgagagacatagaagacattttactataaagaggattgcataaataatggttattaaagtgccaaaaatagtcaaatgatagtcatacaacacagaacccttgatgaaattttaaaacaagccgccctcaccttaataggaaaaacatgtgtttgttaaacccatgggaccaattctgcttttagtgaaaacttagaatttatgcctaagtcaataaagcctgttcagaattgtgtgcatgtgtgtgtgcagttgtgtgacgtaggtgggtgttctcagggtaacaaagaagatgcagatgggcagaggagtaaagtaaccttttaagggaaaggttagaagctggaatgaggaccagcctgtgttcagtaagtactcgccacaccagtatggccatttatcagttgttgaagggcaacatccattctggttgatcaatactcatccattacactgattacctatttctaatatcacacccaaagggtatcctaaagtttctcagcaccctaaaacctaactagtctaataatttaaatttactagagaaggtgtcaaaagcaattcattatttaaagaggggttttaaccccattttatagggactatttctcttactctcttttagtcatttactcagtgtatctttctttcacattttcacttgtccatcaagaaaaccctattgagtgttggatgattaaatgccaagtaacaaataaaagtttacttgtactagttcaaagaaagaagatcgtttggagtagagtcattaggtatcagttcatttagcataattattattatacctaaaataaacatataatatgcagtgaaaatataaattttaagaactgaactattctaagaatgaggaatatattcagtcaaatattcagagatagagctacaaagtacccaactctgtacataactcagtcgagaaagggatttgctggattcacatagatattggagaagcaaaggtcttctaaactaaggtatgacaaggacttaatgtctagggcacagtcagacccttctcttttcaaatctcatctccacatctctttgcaggtagatctctactctcatgcctctgcttggtgaaggttatggcttctgacagttctaagatcacatctttacagccttttgccaaagagcaaaaatgactctttctttcccaggttcagtctttaatatccaggggaaggatgaggattggtctgaacagacttccattccaagtgctacacttgaagcatactaagaaaacagcttcttgtcttaacatgtggtatttaatcattttattcattcagcctttgagctttgacaagtctgggtctattggcaaatgtcagtaacctataactaaacgatacagctactatactgaccaaggatgcaatggaacagaagacaggtctatagaggaaaatgccagagtggttcatgtgagtgtgtttgggagacaggtatcctgggtgtgaaagaagctttgctgttcactgggtatcagactctgggacaagtgctgaacctctccaagccccaatgtcttcagatggcaggcagtggtgctacttgcccaaaaaagggattgtaaatccaaatacagatcctctatccttttcttgcataggttatctctttcaactcatttctagatttttttccttcctcacattatccaactcctactagacggctttctccctaacccaaaacggtgtccctccacattaagattcttttctcaaaaccctgctgtgctccaaccacagtgcactaatctgtaaaacctccctgaaaggttacttgactcttctgtctacccatatcttctctattaccctaagaacacacaccacacacacacatgcacacaatcctgaacgggcttcattgacttaggcataaattctaaattttaactgaaagcagaaaactgaaagcagaccagtacctgatacttgaatcagacatacatcaaaatatcacattaattaaccctccttttaagtgttataactttgctcttaaaagctatccaaatgcaataggaatattcccctccgggatcaatgttagcaaaccttggtggatatatgatgtccactgcgttctgatccacctcatccctcatgctccctcatatgaccacaccaaattactagcccttctctgaaccagaactgggttgacttcaagcctctgggcttttgcatttaaggcgtctctgcctgcattgtcctctcaggccagagttcccaagcgtatcttatgcatcttggaagtcctagctcctattcttcttctggtttcccagagaaagtgcagattgccttctcctgcattttctgcaataattataacaatcatcatcttgcattacaatctccgagaactttttttattctattagaatgagaaagatgacactgtgccgtgtgcttttcattttattcctagagctcacaatgactagaatatagtaggggattaataaatgctattgaaaaaggggagggattcattttctttcatttcaaacttcgcttcagtgaagcataaagcagggattgcattttttttaattaaaaaaaaatactacaagattgtcaggtccaaactgatttgggcacaaaggtgttgttgaacagtggacattattatcatttaccctctgaaagtcatagcttttttctagagttcacacctaagaacttagtacattactccaccagtccttaaggtaatatactctttcatctaagaggaatttcccccttgttttaacaagtgtgatcagcccctggaaatattcacaaatctcagtcagaaagggaacttgttatagcacacagacaaactgccatatgtgtgttatttcatgcagtagaaagcaaaatactatagggctgatcagctcaaacatccctgtactaatatgtccaacagatgttgggaaccttctctctttctatagggtgatttagataaatgtgttatgctattccttagaataaaaagatgttttaaactttcatatatatctatatttgtcttatatataatttttgctaaactcctatttgacactttatagctccttgccttatttgttttttttctctgtccacactcataacctaggattaaatgtgagaattttcaagtaattgctctgagaatacatttaaatttcatttacactaggcaatttgagaacttagcatctttataaggtaagcctaagatcttacaacacttgcctaatcagtatgaagcagagaggaataaacagcccactgcatttccagagtgtttaaaaacaattttcctcttcaacagctccaaagcaattatacctcaaaagatccctaacctcacaaaatatgcattaggttaaaacttctgaaggaaaaaagctttaaaaatgtaacataccataccgactacatgaaatatttgtactatgtgatactaagtgaccatccattctccaagacttatgagaataaaattgggtttgtttttcctacaaataaaactttgtttctaagtagtataatgttaattctatgattaaagacataaaactttagctattttttcacatatatgcaaaagtaattttaactaaaatcttttgagatacatcattttattcattcaactactttattctgtacaagagctattctaagaccccataacagatattgcagttatggttaaaatataatctaaaaaaatacagtctggctttcaaaacagtaaatataagacatatccaggctgggtgctgataatcccagcactttgggtggccagggtgggcagatcacctgaggttgggagttcaacaccagcctggccaacatggtgaaaccccagctctactaaaaatacaaaaatcagctgggcatggtggcgtgtgcctgtaatcccagctacttaggaggctgaggcaggagaatcacttgaaccagagaggcggaggttacagtgagccgagatcacgccactgcactccagcctgggcgacagagcgaaactccatttcaaacaaaacaaaacaaaaaacaaagacatatctaaaaataatgataaggcaaaagattttctgagcatcaaataagaggcatgaacaacaagcactaccagtggtgtttagatgaggccaacacactggagcaaggcaggctctggtggcccccgtgctgggtactgaagggcagggaagatttctggttgaatgagatggtgacagaacattctacacaaaaggaagagtataaacaaaggtagatagctggagaaacatgaattatactcaggattgagacaagaagtctcaaaatggaagctcacaggccaaatccaacccatggatatatttttaaattatgctacagattaattttttaattcaactgacagcattcaaaaattgataaatttcatatacaaattcaagtgcctagctttatgttaaaaaattaaagatccagcaatggtcagcaaacattttcccatgaacaccattggcaggaacttagtagaagtatttacacacacccctgcttgccagtttcttcctctccctttcgcctcatagttcccagggtactcatttccatgacccaatggccccttaggtattgtccgaatggatagcctcatgtaaaaatcaattcaccagaagagatgacaagggaaataatgatagataatatttgtacataggaaagaatccaagttacagaaagcatctaacaccatgctaaagactttggatttaattaacagaaatcagaaacaaaaagatcttaggagtaacatgatcaaggttgtgttttaaggaattccatctggaggcaaggacaggatgtcttggaatgcagagagaggaagccagtaacaacaataacaaaagccgtcatttactgaattctaccaatattttcagaaactattaaaacttaatacataccatcctcgacagcttgaaatcccagctctacctcctactagctgtgtgacattagatcaaattatttaacctctctcagtcttaatttgtaacctgtgaaatagtgcctaacataaatatatttgtgagcattaaatgcattcacccatttaaagtgcaaagaacagtgcttggcccatataaacagtccaactaattgtaattatatattcttttctctttcattctcaaatatggaatatattaattttctcattttattggagagaaaaatgatattcagtaatttgaaaaattttgcccaagagaaacagctatgacacggaagaggctcatgtccaaagcaagccatgatctgggctcttcactgcattatgtcactttctattgacaaagctttgggagaatcactgagtctcattttccaaatggcaggttgaactggctcactggatgatcgagaagatccattattatcctcatgctctgactacattttttttctagaaattggcccattctggatcatagaacaaggaaaggaaggaaagaactagactacttcttataattaggtggttttattgagtctacctctcatcagcccctcccttgacactctagatgtcactgacctactttagatctttattaccaaccatggagcctaggaaagataaggcaaaatcgtgaccctctccttcttaaacactttcaatggttatccacttttttttttttttttttacagagaataaaatctaaactcttcagcataatgctcaaatccccttacaatcttattcaccctacaatgcagattcttaaccaggttcttccttactttgacattcatatgactttactgatccttctatctttatctatagtgcccttttctttcttttttttttttttttttttgagacagagtctcactctgtcgcccaggctggagtgagcgacgcgatctcggctcactgcaagctccgcctcccgggttcaagccattctcctgcctcagcctcccgagtagctggcactacaggcacccgccaccatgcccagctaattttttgtatttttagtagagacggggtttcaccgtgttggccaggatggtctcgatatcctgacctcgtgatccgcccacctcggcctcccaaagtgctgggattacaggcgtgagccaccgtgcctggcctagtgcccttttctttataccatctatcagaatcttgcccactcttcaagaactcacacccaacatgagccctttacaacctactccctgtgtccccaaaccccaacacctttcttctctctcccattgtccatagcatcccatcagaacagccagaacagtctgtgtagctgagatacatgtgtacaaccctcccctccccactttctcaccaccagtctgtgagcacgttaatggtgggacaaaatgtcaatcatctctatttcctgagaatcttagtgcatttgttgcatgcccaagtggaattccaggtgccactaactatagaatacaaaaaaaaaggaatatattggggtagcagaagaataaagataattttagattttataatgctttatcctactaacacttaaacatatattgaaatattttagatcccaaaatagattttgcaaaccattaataatctcacaatttttaacaacaacaaagggataagaaaggcctaatgaaaaaaattcatgtatgacttgtgatatctgtttcatttcagtggaatcacagcttatctatatgagctagaagtttgtgtgtctgcttgtgtgtgtgtgtatgtgtgtgtttgcacagtgatagggacagaatttgttatgactcacatggaaaaaagtacacccctgagcaacttggctggatcaagtacacaaataaatattttaaaaggcattgccaaccctgctgtagaagaaatacactgagagtttgtttatctgcagccatctatccttcaaagtgaatctggaagtggggtcaagggaaggaaaaaaataacctattatgataaataaacagaagatctaagttcagtgttggtcccaaagagataaaatagaaaaccgtattatacggcagcaaaaattattcctctggtaattataagcatctcatctattccagattcatgatgcctagggttatgagtttacacaatgggtggttccctatattcagtcctaaatccaaatattatatagatcctaaaagagcaaagctttccctaatgtatgtgtgtttatacttcaaagtaaaaaacatgcattttaaccaactttaatggagctcatttttcttacatacatgcagctcattttgacatacaagctaggcaactgccaaatttgtcttcccaaaatagaatctggctctgaaatctaacatggcagcaattaacttaaactgcacatcagataactttgactggtcataaatctttgtcatttgctttaaaaagcaacaactgatagctaataaaactggatatgcacctagctgtaaacattagttgtttatcttgctatcattagccctctttccttgagctacatcatccaggactcacagactcttcactggccatatctctggatattactggggcagctgcaaatctcactttttaccctcaaattatctttacatctcttatttatttatagtgaaggatggaagagaaacttttatttctcaaatcatttgggagtgatgactgtctgcttcttaaaatgcatggtctccactgcattctctccttaccacttccactgtctagctctgtgtattctctgagattctctgttattttataaatcatctactataaaatgccagtcccagggaatgctccactggactacaattgagtaacttaaggaattgctgaacattgactattcttatggggaatattctcatgggagaaaatctgagaagtcctaccataccaaaacaaaaaacagaaaaaacctaaattgccttggttttatatgaaatctttgtagcatatttgaccatagagctctctctttcttttgtttatttatttatttatttatttatctttaggtagcacctattaacatcctggcagaatctgcatttctcaaatcacatgctggaaagcactgctccccattggagtctagctcctcaagttacatgtcaagcattatcctctccttcttccacatccccttcccaaaacaaagtccaatcaatttccttttccaaataattccagcaggactactattctgacaggttttaggttagacaccttgacttttgctttcttgactgtctataatcagtctctcaggaaggcttatgtttccccttatatgaaaagattccctggactcaccattctcctccccatctcatgatcccatagtgactttcagcactgtgacggttaattttagctgtcaacttaactgaaataaggattacctagagaacaggtaaaggattatttctggctgtgtctgtgaggacgtttctggagaatattggcctgtaagtcagtgaactaagtggggaagatccgccctcggtggatgcacaccatccaatcgactggggcctggaaagaaaaaggtgatttcctctctctcctgcagctggaacatattattctcctgtccttggacatcagaactccaggctctctcgcttttgggctccaggacttacaccagtgttccctcgggttctcaggccttcagcctctgaatgaaagttacaccatcaacttccttgattctgaaggaatcttggacttggttaagccatgctattggcagcccaaggtccccagtccgcacacagccagtcactggacttctcagccccgtaatcacatgagccaatttccctaataaatccattcttgtatctctttctctctctctttgtatctacctatctatatcttctattctatctatatatacacacacatatatatatatatccacatatatatatatcatagatagatagatagatagatagatagatagatagatagatagataaatagatagatcttttattggttccttcctctctggagaaccccagctattataagccctcatcctctcatcaaagcctaatggttgaggcaaaaagcccacagcaaccattcttgtccattctttagtgtcaggctcacccggaggctcagcatctccatgtcttttctgatactacaacccaaaggaatcacacctttacctaaattcctatgtaggtgttcagtaccacaaaagcttacctctaatcattctctaactgggaggcaggagggctgcattgggcatcctaggtagattataaatttattgatgtatctgagcttttattttctatatttcacaatgtatggactagtgttgggtgcaacatttgtgtatgatgaatacaatgatcgatgaaaaacaaaaataatttaaaataatggagtgggaacatgaaacactcacttaggatgccttccttattcctagacaagtaggcgtcatttcctttatttaggcactctcctaggaaggatttctacagaaacactcagactgagaatgtttcagggcttcaatttcctcaaaggtgataaaacgaacagaacctgaagcaggtattaaggctaaatctagaaccagaatccaaaaacattagaaattactgtgggggattcatggtgatatataaacaatcaataaatgttatagactttttttagaaggtggcaccaaattgctctcaaagcccattaaggctggtctttgtcctccttcgccatccccagcgttttcaacatccatcaatcctgggtgcctgtgtcaggtggcaatgctttcttccaagcccatgggtatatcagcttaggctctaaagaaaactagtcacttcaaattcccgaaagcctctttctcacagttttcctttaacactaaaagtttgagctttacaaactggccttataaacaaagttttgacacagactctataagaaacatttcagattggttaaacccttatactgaaatacttgggcttcctttggctcagagattacactttatgtaaaactatccacattctacaattatctagaacaaataattttattataaaaagtgaccattttcaattcaggttaatcatgtcctcacaatgttctctgttttgttgttccttccatgaagttcattcacctgctctgtgccaaggactatcctcaatgatggaagcacaatatttaatacaaaagtctctgtccttaactcacaattaaataaagtttccagaaatcacaacagagtacaggtcaagctactagaaattgcagatgttcaaccatggctacaagggctacagaaacagccatttcaatgacttagcctaatacagtatttgttttatgtctttaataaagatgtataagaagtcctgagtgctgtagagaatgggatgatcaattgcctttgggaaaaagtagagaaagttctggaaagccttttcctaggaggacgtgcttaagttatatcatgagagataagggaggaaagggaaatccaggaatgaggactgtcaactgcatatgcgtgaaatggtcaatccagtgtcatttcagcatggctggaaaactgcactaacagagaggcagtgagagacacagctaaggagacaggcaaaggacagtgttctgagggcactgcatgccatgaaaaagagtccagactttattccaacaagaaatgggaagtcattgaagggctacaagaagaggagtagtacgaacaagtacactttaagagctccttctgaaataatgcatagtaccaattatgggaaattgagactagaaacaggggaagaggagactctatagtaatcaagtaaacgcatattgaggacctaaatgaagacagtgaaatttagttctgtagggaagagggcagaggctcatgtggggtttaagagaaagaagcagcagcatcactaatcagaggtggaggaaagggtgagaggaacacaggaagtcaaggaaagtgtcaaagatgacttctaggcaggaccagcgatgtgatgtgtggggcccagtgcaaaatgatattatttgcaaattattaagaatatcaaggtggagatggctgagaagaagccaagcacagggtccttctgagcatggcacctgggcaattgcacaggtcacatgtccatgaagctggccctgctcccagcttctcactaaagtgcctgagtagatggtgggatcattaagtaggatccagaacacaggagaaggggtagatgagggaagaataaaatgagatttggttggttatgttgattttaaagttcttgtgacatagctaaatggaaagctagtataaggtagtgattaaagcaagggcattagaatcagacagagctgggtttaggtcacagctgttgtaagccatgagatcttgagtgagttacctacatttaatgtgttttggtttcctcctctgtaaacctcacaggctaatgaggatcaaatgggatcacattttaaagttattagtcaagaggctgatatatggtgtgtgtaagccattcaaaaaggacattcattattatttattactattattatatccagtaggctgttagttgagtgagtccagagcagttgatgaggtttggagaattacagctacactattggctcaagatggtggcagcaaaagaaaatacacagtaaccagaacagaggcctgaggtggaggcatcaatgctgaagagcactgacacttgatggggaaagaaagaaagaaaaggaaagggagacaaaatgagttctggaccctacacatgcgtgaagcttaaacaaagaaatagattactaatagtggaatttcacaatagaaagagacctgtgaggaaatacctggggacaggatctcccagtcaggcagtcatttattccatcaatagattcctcagccctgcttcccagatatatgctgcaaaggttccagatgtttctttttccctcaagtcatttttatgcagttttctagcatgtttattaaattataaaaatctgcctctgcttctaagagaaaatagcatctgattagatttacagcactctacaatcctaaccgttcagagaaagttgtccatttttcatttcatcaagggtatcaagaatccttcatattacattaagcgagtatcactgtttaaagattgcctcactcttttgacaatctaacttctaatctaatctttaacctacaagatacatttttaatttgtttttctgaatcaccttagtaacttatgaatatattcatttatcctaagtaaaggaaaatggaacaaaaatcttcaaatgctctgctaactcccttaaatttatttaagaacataacttgggactccattctgtaactgtaataccctttccaccagttcttcaattatgcaagttcatagtcttctgggccctttagtaatttagcatctggtttttgagttatgtgatttttttccatgaataataaaaaattttaagttaggtatcagttcacaaaatttacaaacttaacaggcaacctttgataggaatcaagtaatattttcctctcaatgactgtagcagacagtgactgggtaaagtatgaccaaaaataatacgcaaattaaaagcacattgctgcatctttagtgcagggtaaaaaaagtttttaattaattttattgatggcaatattttgactttctacagtggaccacccctccttcaaacccactcaaactttctgccatactcatcatcctcagcacaagatttttccaaggcaacaagtatcattaagaatgaactccttcaggctgggtgcggtggctcacacctgtaatcccagcactttgggaggccgaggcaggcggatcacgagatcaggagatggagaccatcctggctaacagggtgaaaccccatctctactaaaaatactaaaaattagccgggcgggtggcaggcatctgtagttccagctgctcgagaggctgaggcaggagaatggtgtgaacctgggaggcagagcttgcagtgagccgagatcgcaccactgcactccagcctgggcaacagagcaagactccatctcaaaaaaaaaaaaaaaagagagaaagaatgaactctttcaatttctctccctacctccacagttatctgatagccactcatctctaggactgtcccctccttccttgaccttttcattgagatgtctctggtcaccttatctgaaattaacaaccataacaccaccatcctgtgcctctgaaactttccatcctccaactgtgctttttttctgttttacttatcattctgtaacatgccatatattttacttatttatatcctgtctccaatgtcagaatgtaagcttcataaaaccagtttttctgttttacttattgctgaattcttaacatctagaaaagtgctgggcataaatatgtgctcaataaatacagttgaataaatggatgtctggctttcagaaacaaacaaaaacttatatgtgcttttttctcaaggcctaacccagtgctcatgccctagatcccagtttttcctttggcctctggaaattgcattcttgattacctccatcccttcccttctctctttttctcagtagcaaaacttctctttgcaaatatacttcactctcccattccaaaagaaaaaaaaaatccttctcttaacactaccactttactatagtctaacctttcttcctttccctcttactgtgcccatttatataccacccattcacatctaatttcttgtgggaatttgtgagtttttcctagaacatacaagacctcttgtggaaggtcatccctagggcccacttcctagaactctggtttcctttctatcccttctccccttctatcagtgcttccttaaatcttctataagcactttcccacccacccccaaacttcttgttctataatgttagagcaatccagctgaactttctaatagaaattttatatctctgtgcttttctaacacagtagccacacttgtctattgggtacttgaaatgtggctcgtgtgactgaggaatgaaattttgaattatatttaattaactttcattacattatatttaagtttgcatagcaacatgtggtggggtctaccacattggtcagcactgccctagacaatatcatctaccctcatagcccccatcacctaaagtcattgtcaactcttccttttttcagctaaatctatgttgagcatcaggcattgtgccagccaattaagaaggcagacatcaacaaacagttctcagtctagcagtgcagttggattggtattatgagacagcaattatgagacatgtaatatcactgctgataggatacacatgggtaagaacagagaaagaatatgtacatcagcctgacagaattagggaaggaactagttatccaggtggacaaggaaggtaaaatgccacagacacagagcagcatgatctgaagcacaggcataaaagaacacagcagactcaacatcatgcattcatagatctcccctccaaccataactttgagtcttccaatgtacttgcttaattatccttatggaaacattgtctgacttcattaaagcccccaattcacccatcttactttctctgtccctggtctcctttgtctttcttttcttttttttctttgagacagagtcttactctgcagtgatgtagtcccagcttactgcaactcctgcctcccaggttcaagtgattctgctgtctcagcctccagagcagctgggactacaggcatgcaccaccacatccagctgatttttttgtatttttagtagagacaggatttcaccatattggttaggctggtcttgaactccaggcctcaagtgatctgctcacctcagcctcccaaagtgaaacttccataggttgggataatacatccataaccttgaattaacccaagaattcatcttctccaatatttgcattattgaagcaaatctttgctaaagaaaatcatgcatgtagtaaaactggtgtcaaattcatgacagtcaatcacaaaaggacactcaaaaattattcttagtttctatgaaaggttatctctctccctccttataaagtttatttcttttctttccctcactactgtaagctctcacctttccttctcacaacattcatttgattaatttgcctcattccataggacagggttccctcatctgccctaattagttctagaatagattgcattaatggcccaggttcttcactggtccccgtatgcacactctttgccatgtaactttgtttgccctaactctgactctgaccttgaccatgtggcttgtttggccaatgggatattatcaaatattatacaacagaaatgttcacatgattggactcctgctctatttgccaccactgtgagaagatgcctgaactagcctctagaggatgacacatgcgatccagctgtctccagcactccattgaagaaccagtcagccaccagatatctgaattagcccagctgagagcagaaagaacacccagtggaagcagcctgtgtctgctcccatcttttcttcctccctcaacagacaaagtattctcttacgatgtcatttctccattccttcccggccaaggactttgctcctttggctagcctcactctgctgcatcagctgtagcaacctttctactcaatcctcagaatatgtaccgacatattctactttcttcagtataaaaaaacatgccacatgtagtggctcatgcctgtaatcctagcattttgggaggccaatgcaggcagatcgcttgagcctaggagtttgagaccagcctgggcgacatggcgagatgtcgtctctacaaaaaatacaacaattagccggacatagtggtgcgtgcctgtagtcccagctacttgaggggctgatgcgggaggattgcttgagcctggtaggtcaaggttgcagtgagccaagatcatgccactgcaccccagcctggacaacagattgagaccctgtctcgtaaataaataaataaataataaaaaacaaaaacaatatgcctgtagctaccacctcctttcttagctccctttcagatccctaattctcccctttcattcgctcttcacctccttgcaatatgatttttaccctaacagttctctcctctgaaaatgctattgttaatgtcctcagtgagttaactttttcagtgcacatgtttgtccttgtcttataattctaagaacctctggaaaatacttcctccctcttaggatactttcttctctttggttttctccttcttactagttgccaactggtatcattcattttggccagtgctcacggttcaacccaaactctaagaattataattaggtcccttctattatctctacacttgcttcttgggtgtgcacatacattctcacagctttagacaatgcacttatgatgataattctcaagttcacatctctaccctaaatttctcctcagaagtccaggcctgtattttcaaatgcttactacatatgtccacttgaatgttcccaaaacatttcaaaattaacatgtgcacaaagggactcttgatttcccatctaaaaatgtcatcccactctgctcttataagttaaatgtaaaactacccatttagtgcttgggggttttagaggaaggtggaaggaatcattaattattcctctctttcccactgtacccctatctaacccatcagcaagaactatgtttcctatatacaaaatatattgcaaatctttccatttctcactatttctacagtcaccacctcactctaagacatcatcatcttttatggaaactttaatagattttttaaaagtcttcttgccttctgtactgctgggattctccacccagcagtcagaataatctgctgcaaatataaattaaaacacactattctcctattctcctccttggaaattgtctcttgctgcactcctggcaaatccaaagacctgactttggccgacaaggtctacacaggatcaagtcctctgcttggccctttacccacccttcagggatcattccctttttcccccgtgcccaagccacaagggctttttccaagttcttcaaatgagaactatcttctctgcaatagattcagtgttcatatagctccttccacttgcaacattttcccatcatatcctttagtctatgttgacaaagcagtttagttaatctttagtggggcctcttctggccatcctatatagggtaggcctcccttaacgtgttagcctttctctcggtgtcttatttatttatctctcaattctgtataccaaaattgtttctttcttttattctcttattcaatacatatgtatgaaatgcctactgtgggccaacagatgtgataagcacttgggacacagtaatgaacaagtcagcaaagcttcctgctcatatataacaccaattctgagaggatattgataataaacatcaacaataataatatataaagaaattacataaaatgatagaaggttataagtacaatggaacaaaacagtgcaggttaaggaggtgtcaggagtaatagggaggtaggaagagctacagctaagcagaatggttaatcattcaattaaaatactcatagaaaggtgatatttaagaaaggctttaggacacagatggagtgagccagaatgcctatggaagcatacctgggcagaaggaacagtcagttcaaaagttctcaggtaggagcatgccttctgcaatcaaggaaccaaggatgacagaatggctgagataaaatgagagatggggacaccagtggaaagtgtgctcgtggagttaagaggccagaggaagactttttaggaccttggaggccctcataaagactttggcttttatgctgaattacatgggaagccaatagaagtttttgggccaaggaatgacatgatctgatttgtttacaatgtctatgtacttgtttatgtttttgtttccatcattaaatgatgcccctttagctcatcactgagcattcagtgactactacagtacaaagtacataaatatttgttaagtgaaaaaaataaatgcatgacattaccctatgatatttagcatgtctatagaaaacagagtatatttgaaagaagatgagaagagagataaatggaaagtagggattctactttaatacatactatatgtaaaatgagatatatgtttttaggtaagttaaagcacattaaatatttttaaaaaaattattaacttgcaacaaccagaaaatattcaaaagtacataaataatatgtgatgattaattgtatgtgtcaatttggctgggctacagggtgctcagatatttagtcaaacattattctgggtgtttctgtgagggtgtttctgaaagacattaacatttaaatcagtgggctttgaataaagcagattgtccttcataatatatgtgtgcctcatccaatcagttgaagacagaaacagaacaaaaggactggcttccctgaggaagaaagaacaccctagcaaaatactttcagacttcatcttcatcatccgttcttcctgtttttacagcagacaccactcagacttgaatggaaatatgagatttcctgggtctccagtctgccaggcttagactggaggtagtaactgaaaaatacagtaactgagataaaactcattgagttgactcaacactagaagacaaagaaaaggatcactgaacttgaagatagaatagaaattacacaatctaaactggagatccaggttgccaacctgcgggccaaccctgcagatattaggttttccagtttccataattgtgtgagaaaattccctataataaaccccagtctctctctctgtgtgtgtgtacacacacatacacatcctattggttctgtttctctagagagttctgactaacacataatatatattttccctgtcagccacataatagatctcactgggtaaacttggaaaagttttaattttttgttcaatgaatccaaatctaagtatctctatcacatttatttgctaacgatttactcaataactgaaaaattaaaagccagtgtagagatctctacttccagtcattataagtggtactacattatgcacatgtaaataagtttgaaattggacaaaaaataagaggcagttgttttcaggcactggtctacaggcatctcagaaccatgatccttaaataaaggaaataccatgatcgttaaagaaaagaaatgtggtaagccccatatttttccagcctttctgtctagggcaatggtcaaaccacaatggagaaaaaaggcctaacaagggggcagtgacctccctgacctgaagaggcaaagactagagcttgaggttgcagaagcatctagaatttgtagggaaagtacaagagagccaagaaatatacagaggtggatctaaggagcctgtatgtggaatctctaagattattgaccaaaaatcaggatacacatattcggggcaaaactatgcatggtccagcacagaatgactggtatgggactgggacataacagaggtcatccagagccaggaggttatacgagtctccacccagcccatataggggaacatgtatgggctgggtgacattccatgatataggttctcgggcattccgtgaaaaccctggaagggccataagtaagagtaagaactaggcctgagggtaaagccctaagactagaaacaaaattaaaattgacctaccctgcctacttctgcatcctgaaagatggagtcaatgcacttttccctcttcctctctctaaatacagcctaaagccctagacattatatattaagtaaacataaaaagacattaagaggtggagagtagaaaacaagctggctaaagacccaagggacagaatggcggtgagctccttaggttttctttttgtttcacatatccaggctgggtgttggagaaaccaacaatgtggaattgctaatggacacagacaaaaaaaaaaaaaaaaaaaaaaaaaattcccaaaaagtctgctgtcagtcattacaagaccagaaatggggcagcctagcaagacagaaaacttttagaccacaatcagtctactccaagcaaatagcaaagaataaaaactgcaatcccacaccaaaccccatcatcaaaagttgaatggagagtctagactgacatggtcacctgactgtaatgaagtatccctacccctcttcattcaggtggtatcagagaaggccttgtagcacctccagtaatgaggtcaaccatctgccatgtcattagaagccatatagagagcagtaaaaagtcactgctgctcatcccagccagggtagtgtcagggattactaatgaggagcctgaaattccacccctgcccagcagtaatgaggcacctcttcccctttgagtgtcaatggcggccaagtggggaactgggagttccatctctgtgaggcagtgagtaggcagtgagtggccacttctcccaccagcacagtatagaggaggcctattaaaggaggtgactttaataagatccaaagtcttatatcaaaatactcaaaatatacaagaatcaattgaaaattactcatcagatcaggaaccagaaagataacatctcaaattgaatgataaaagacaagctgtaagtgcctacactgggatgacatatattttaattagctgacaaagattttaaagaaatcattataaaaatgcttcagtgagcagttacaactgtgcttgaaacaaaaaatgtttcataaaaaaatagaagacataaagaaccaaatgaagatattaaaactgaaaaatacagtaactgaaataaaaactcattgagtgggctcaacaccagaagacagagaaaagaatcagtgaacttgaagagagaatagaaattacacaatatgaacaacagagaaaaaatagactgaaaaattgaaatgaacagagtatctgcaaaatatatatctgccaaaagacttaagtccagaatgtacttaaaagccatccaagtcattaataaaagattaacaacctgataaaaagtaggcaaaacctggagggttaataaaggaaggtattctaatgacccaagtagatagaaaaaggtactaacgtccttagtcatcaatgaaatgcaaaataaaaccacatttacatgccactacacaatcactgcaatacctcaaattagcaaaacactgaaatcacctaatattggctaagcaattggtaatttcatactttgatagtagatgtgtaaaatggcataactactttggaaaaccatctgacaatttcttaaaaagttatacatacatccatcatatgacacagttaatctattcctaggtatttgcacaaggacaacatatgtctacaaatggaattgagccataatgcttacagcagctttattaataagagtgaaacaaaagaaaccttctaattcatcaacagaaaaatgtcaataaattgtaaatgatgtatttgtcaccaataaagaaaatgaactgctgataaatagaacaatattggtaaatctaaaaaatatatatgtcctgcaaaagaagctggatgcaagagtgctaactgaattaatccgtttatacgaagttcaacaacaccgaaacgaatctatggtgatacaaatcagaacactgcttgcccacaagctgtgggggtagtggttgactggaatgggacctgtgggaagtttctacaggggtggaaatagtctaggtattgattggggtgttaagtatgccaatgttttacatttgtcaaaataataaattgtacacattaaatctgtgcttttcactatatgcaaattttaccccaacaggaaaaaatttttactatagtaaccatttcactgtgtatgtgcttatcaaaacatcatgttgtgcaccttaaatatatacaatttttaaaagaaaaaatattcactatgttgcagaaataaaaatcacatgtctggcaaggaatgatggcaggtcaacaatgacctgcttactatgaaacttaaaaatgttctgttggcaacactatttgacttatgagagattgagactatgtgtcaaaatcagaggagccacataaaaaaagaagaaaaaataatctaatacagtaaatggaaaattcacaggctgtgttgtttgatatcttaaaatgtagcacttaacgtggatggaatttgtgaggttctatgttgatttgacttttgagtaagaggtacttctcagaatgtgcttaaagaaatgtaaattgtataatgtttattatttctgtgtaagaacttaagagataatacagttgcaaaatggtattttttggctgggtgcagtggctcatgcctgtgatcccagcactttgggaggctgaggtgggcagatcacttgaggccaggagttcaagaccagcctggccaacatggcgaaacccatctctactaaaactacagaaaattcgccaggtgtggtggcatgcacctgtagtcccagctgcttgagaggctgaggtatgagactcgcttgaacccggcaagtggaggttgcagggagccaagaagtcaccagtgaactccagcctgggcaacagagtaaaaccctgtctcaagagaaaagaaaaagagatggtatttttttcaaaatggtttttattataattactattgttattgtttgcaaaatagcaattaaaagaaaacatggatgaagagaaagcaacaatgatatttgatgaaaatgccctttcccttacttatctttctataaagttatgttgcactttcagattttatttgtattcagaatttgaggagattttctcagtggtaacatattgataattgtatgttttcatcaatgacaatgctttataattaaaaatttactggaaagctttttttaaaaaataacatatttctcatttctaactataccatataagaaatgatgattacatattaggagaggaatttatcctcatcttattttcagctccaacagctcctatctaagaaaagcattaatatcattgccatgcttctttaaatttgtatgtgtgtgcacgtgtgtgtttctgtacaaacatgaccctctgttgagctccttttatgtgtaacacactattccaagtttttaatcaaattatcccatttcattcctaagaattctgaaagctgttttatccctacttaacactgggaactcaagcttggataatttaaataacaactctaatgtcatacatgtgataacagatgaagctcaaatttgaatctgcttttatttgactctaaatccctttcatctaaattttcaaattgttctcatacacataatttcattggaatatcccagtatcaatatgaagcagaaaaatgaaataaaattctaatcaatgtgggaatttgacacacacacacacacacacacacacacgagagaaaactgaagcttgatgagcttaattacctaagatttgctgtgaacccaggtcttatactcccaaaacattttgattttattaaatactttagaaattggagattcttttatttttaaaagaataaaactacacgaagtaaaatcaaaatcaaactccactatgcagacattttttatttctctagatcacccatgaatctatcatcctccctatgtccaagaaacacgtctgccttacggaaaagactacctctcaatacagaatctgagaagctatggcacagagttataacccaggctcccgcaatcagatgaatcttccctgaactatgaatctcatgataaagatgcaagaaaacagactccacatagaatccattgtggtggactggggacagggcagaagcagcagaatgagcacctgcatccagtttgtagggacagaaatgcccagaaggtgttgatggcactgggcgccatgattgtgtgcagtggtaatgctgtaatagctttatgtgtagtttagggcattgctcctgattgcatatcccacaagtcagaactctggtcctcttgaagacttaatgagctgttacgtatttcctaacaaatttctttgctacttaaattagctcatttctgttgcttgccattaataacgctgtctgatacacccatgattacaacaaatttcttatgggagtcttatttggctgtttaaacaggtataactcctgagtttaaatatacatcggagtactctttttaatattggtaaggaaaatgtctttgtcacaaggagaaaggaataaacatatcacaaagcagccaagttctttaatctcacagatctactacagatgtttaataaaacttctcatcattccttttgtaagagtgtcctagcaaatatgttattactacggggaaatttttaagcataagtgattgaaatgactacaggattttctggcatcttgaaaacagtaactgcaaccaaaagtattttgaaattaacagtaatatccagtcaccctcaggaaattctactttttaatctttcaccttcaaaattatgacctttagtgtctgctctttatatgtgggtgtgtgttcctttgattttaatgtttaatcagcttaagggatgactttcagttggaaatctggaattttctctcttgatgctattaggattttaattacaagctgtattttccagaatgtctaggcctataaaaacatttttacaatagttttttctggaaaaaaactaaacatgttactaggaaaattaatctttattttgttggtgaacagtaatgtatatactgtttttcttgaatgaataaattaggaggctcctggaaatttcactggctatgaattacctttatcttcctcaataatttagccaaaattcaattttttagttgctttatgtcttcttgctttgtttagaaaaagaaaaagaaagaatgagaaaatgaaggaatataggaagccagtcagggttaggtaaactatcccttcaaagtgccactggagggcctgggaaagtttctgttcatctttggctagaccatgatatctataagaccttccttgttccactatcctccatatctgtgtcttacctacctcttcacatcccaggcagaatcactgattttgttctaccagctttctattttttttcttccccatggctctgttgaatcaaatgactctcccagtacctgtacacttgcacttggcctagggactcacattctgcttaatgtctttccaaatgggatagctgtttattcatttttgttgttgttcattttttttccttcaatcaaagtttctcatctacccactatgagccaagcattgtgtaggtgttctacatcccatggtggacaaaataaacatggacttcactattacagaatgtatgacttagtaaagacttttaagtaaaataacacataaacaattatatagatagtggtaccttctatgaaggaaaagaacagagagccaaagaaaagttggaaaatgtatagtaacagaggaagcttaatttatgttgaaagatcagtgaggatctatcagagggggtcacaagctaaaacctgaatgattagaaaggcccagccatactgtgagttagccaaggtgaaggtctgcacaggaaccttcaatgagccaagagttttgtgctttggggaactgaaataaaggcagtggctagagcagcaaaataaataagagttcaaactgaagttctagagtccagccggggctataccctgcatggtcttgtagacagaagttaggagtataaaattattcgaagtataatagtaagctacagaataattttgtacaagcaagtgacattatccaattaatatttaaaagactattcacaatgtggagaatatgctttgagggtatctgctttacctatgaactcaaaatttagtaagtacaaaaaattctatggacctggaggatttctcttctccgactgctctcaggagcaaccgtgcagcaggttgtgatactggtgccagcatgtcatggcaaatcatctcaaatgaatctgtttttctctccactgtcatttggaaactgcttttgaggccataatagcattttgagaaagaagtagcagtgtggcaaaataggcattgtgggattattagccaccttgtgccaacaggacaagcttgagtcacgttccatgaattcaacttctacttgatgaaggagcacccatggcaacgcttggcttcatggctcagtcaatcagatgaatctgaatgcatgatggacatagcttggatagcatggtcaccttgcattttgtctctatgaagtcccagtaacaagctagggtctgtctcctttaaaaaacaattacttgctgagaaaacatggctttgctccaaacctctgtagagcttgccacatgctcaaaacaacaaacatagtttccacagatactgtatcagttaggtaagaccactgctatagcaaataactcccaattctcactagtttaacacaataaaaattaattgtttaatgtcccactgcaatgtgagttatttgagggcagtgagaagagaagactctgctctaagctccttttgcctctcactccaccacatcctcagagacctcctgattccaacagcagttagggaaaggggttttgggaattttagtgggctagacccataagctatacacatcatttctgttaaccccactgggtggaactcagtcacttgactgcacctaaattggaaggaagacgggaacatgtagtctagatgtgtgaccaggaagaagggaatgtgaaaatggatgagcactagcagccatttggcaaatatttgagctcattagatccaatgagtcataaaggaattggtgacaacatcttattaggttctaattacattattctttctaaacaactctgagctttgccaagttaaaagacattttatcaatgttctatatttatgataagcaatggctgcagattgctgatcagaccacacacagaacaacatccttccctaggcccagtgttctattaccacagaaagaactttacaccaaagctccactccaaatctttagacccatcagtgcccatatctccctcttcttggccatttttggcttctagccaacatacaagtcctattgtaatccactctctcccaaacttggattcaaaccctgcttcatcaaactcatcttccctttggtctagcacaatgcaggtctgacatgatctatgcaagaagagtgggaagataattgggtaggaggagcctcataccatagtgaggttctgaaaaatcttgtagggctaataaaagcccctaagcgaaggatgaccaggagaggactcccatgtctggcagaactggtctgggtccagttctctcatcctgcctagttattggttgagagcagccagaggcaagagtgaccttgctgtgaatgtctcaatggatcccaaagttctggtagccagaggctgctagatgactctgtttcctatagcaattctattgaaaagagagatgagagacataaccccatggctgccacgtgggtcctgtcaaattctagtatctcttctgttttgtctacagtaagagtcaacacaaatctctgtttcttccttacaccaacctcatatttattatgttacatctaaactgctgctgatgctattcataatatcagctaagaccaaattaccaaagttctcttacctggaattctgtctatggtaggccaatgaagcatacctccacaaggaccagaccagtcttttggaagagaataattgccttaattgctagttgccttcattctatcttgaggaaagaatacagttgatactcaatgctctacagaaatcaaaagtgtaactaaaggggacaaatgaggtcaaatgggagcatctaagctttcaaggatcccgttcttcttgtctagctgaagttcagtctaagatgcaagagaataccttcaaacccatatgtagatcccaaactactatcctgaattttaaaaatattcaaaccctcctaagcatgactgcttctcccttcttgtcctatcctagctaatgatcctaccatccatttccaattgcccaggctagaaacctaggaaccactcaagactataccctttcaatcctcccctaccctcaagcaatcaccaaatcaaaggattccatctttcatatctcttatatctaccctcctcacaattcacttggattagtacataagtcttctctccattcttgcctccaggattggcacttttcctttactgtactgccacagtgatattttctaattgacaatctggtaataaaactgtgataaatccttcaatgactccctgcagattttaggatcaagttctaacaggaggtgagtgcccaaggcacttgtgttagtccattctcatgctgctgggaaaaaatactcaagactgggtaatttattttaaaaagaggtttaattgattcacagatctgaatggctggggaggcctcaggaaacttacaatcatggtggaaggcacctcttcacagggtgacaggagagagaatgagtaccaagtgaaggaggaagccccttgtaaaaccatcagatcttgtgagaactcatgcattatcatgagagcagcatgggggaaccacccccatgattcaattatctccaccaggtcttgcccttgacatgtgggaattattacaactcaaggtaagatttggatggggacagagagccaaaccctatcagcactaaaggtctagatctgccaatattcctaatctggtctcttcctactctctcttaagtccctcattccaggcatactaagtgcttcagtctctcaaatggcaagatggttcttatctcccttccactgtgcatgctgagcccttggacaggacacatttccaccccaccactgctgtgctgtctccctcttctctcaatctcagatcaaatctcacctcctctgagaagtctgaattgaagacacttctctttcctccgataatacccaactatcaccatacttacccagccaatggtacaaaaaagcttaaagatctgtctgcaagcatgcttaactcttgaggaagttcacttgctttattcattcctgtcacattatttacaaaaaagtgtcagggaaatactgggctaaatagatatttaaatgagattctttctttgaattgacaccataatcccttctaatgaaattgttagtggtagaccttccaaaatttctcaagttatcaagcacgtaacattaagatgcttggagaaatagaaatggatcaaattgattattttaaccagggaaagaggccaaaatatttattacaacccagttgtttgtaaaagaaaaaaatacaaattcagtaatacttcagcaactcctaacagtctcttggcatttaaaatggctccatcttaacttggacatagagttttaattgacttccactatcaagaaaaacagaagctacaaagaagtgaacacttttagtgcagcagaagcgggatgcacatgccttgagttttgtattaattataacttcttcttcacaaaagcttctttgcagattacaaatacctaatcttaagttatcttattggcttttttaaatcacctggtgaagtgtatatcattattcctgtctcatagatgaagaaaccaaaccagagaaataagacatgcacaaagtaaaatgcccattaaatgtaaagttcatgcctgtctcctccatttttctattggtcacaatcctatagatacttctctgtcactgattaaattttcctaaaatacacagctaatttagtagaaggagcattcaaattatattcctaattactaaaaacaatagatttcagtggttaatagcagaaactctgcagagagctgaggctgaaagcccagtttggccactcactacctatatgacctcaacctaaagccctctgtgcctcaatttccttatctgcaaaacagagatccacagtaccttcctcagagagttgtcctgattattgaacaagttgataaacataaaagagacttagaatgaaacctatacaaagtaaatgtcaactattatgtaacattaaaaaattgatgattctatggaaataaggacctatgagattaagttgcatcacataaaaaaatgtatacttcagggtacaattttttttcagctaaacgatgccactgaatttaactgtacattccaaactaatcagaccatatttaattatgttaaaatacggatacaaaatgggataacttagatacaccattttaaatatgattgacgtctaccagttttataaacataaggactttttaaaatctttgttccttttcctagctaaatcagtaggctgtactcttttcaaatatttaggaatttgtaaggaaagtaaaaatgcaaattttccatttgtggaaataaatgttgatgaacataagtaataattgtcataattttagatttgatgaatattataaatataaaaatgttctgcagaactgtttttccctttttatccactatttgtaagtgtatgctaataagctatgtgtaaagattaatattccattgcattaaatataattttatggtattatactaatttagaaagatgtcttaagacaaatttaacattattataaaataatgtaaaacattgctatcataaaaagtaggaattactgttattagtgcttccatacaataaaacatttctattgtaaacttaaaactcaaatgattacattttcctaaagtattaagcaagaataatcagattttgaagtgtcatttaattttatcgtatctacaatattgagtaaataataaggattaagaaaaatgaaccaagatcctggatcttggcatggacaagtctgagctccttttagtggaatggaaagaaggtgatgggaaaaaggtgaaggctgctgagaagggagtcaagaggtcagaaggagtgaatggagcaaacaaatatctgtttcaaaagaatatatgagttgtcctaactgtacaaatatttctaccaagcaaccgtttaattcccatgaagtcatggccaaaacacccaggaggtagaacaaagacaagtgagagatattaatcaagacattccgccaccagttatggggaaacagcagcatttcaaccatgggaggaccagctatcatgaatagccatcctggaaatgcttacagaacatttaggctatttaactggccagtcagtaaacacattgctttaccatagtgatccaaataaatgattcccattgaaaatatttctccctgaccctctggttctaataatctgactttggttattggagactcagttaagctagacatgaaaagcagtcatataattgtgagaagaaaatttaagattagcatgcaggataatggcataacaccctttctcatgaaccaagaaaacactacacatttttgacttgctctttttcatctcagttgctgtaagaaaagccatttccttttacttaatacgttctttccacattgtcttgctgaaaaatcctccttattctttacagcatggctcaaaatgtcactctctgacaaaagccttctctaaattttgcaggcagagttaagcaaatccttccttgtgccttgttcacatttttgttaagacatttgttatatcactgtaattatttccaggttagtctctagtaggtgatgggccctggttgaatagatgaatgaatgagtaaatgaataaatgggatgtgtttcggaaggggaaataactgcttttgcctcatgtaactcccaaaatagcttctcataatctaggatttctaaatctttgggtttatttttttttaaattaaagaattggagactacaggtggtttcagtttaactaacctaaaattcactttcccgagtccatgtattcatctttttttttcttggtggtgccaatagcatgctttggatcagtgaccctttcctgtaagaaagaaaggtcattctgatttttattaagtcctagcaattgcctctttagctctctttgttgttctgcttactagagtcttgtgaatagcaaatgtcatgttcttctggaataaaagcttcacagagctcccccatcctgcttgaaatgttgaacaactcttaatttgatttactggaaagaaagaaatgctgatcaacacgcacttcctcctgcgctaaatctagttaaacatgaggaaaggagcaagtgtttgccactcaaaaagctcaaattatactgaaaaaaaatcaaatttagggatattttaactcatgtataaaccaaattaaacctttttctcctacttcataggcaagacagaaagaaatatggtggtcaaaagaatagacacaatgtctttcctctttcttaatgaggaatttttaaaataaggggtcttttatatgggatcatttaattatatacccatgaaagcataatgattttttaactgcactctctcttattcattagaatcataaggttggctttttgcattcaagctaacttaaatatctttttttttccttaagtcccattccaaaataaaattgtaatgtacagatagtgtgcactacacaatgaaaaaatgaagttcgagcacagataactgatttatttttgttgaattgccatttgttcatagattcccaatgtaagagtagagacaataagaagtcattggtattggacctgcttttctggcaatagattaagtaaaaagaattatctagaaatgatgcctgagaatactcatttattcattaaacaatcatttgctgtatttctactatgtgacagatacacagtagacacacacaacatgagtgctaaggacccaacagggaactgtcagacaaaaatggaaacagtttttgttgtggaaattataatctactggtgagaaacagaaaaatcaagataaaaaaataaattgtatgtgaatgtatgtgatgttagatggcaataacttgacatctacccaggagaaaagtaacatgaaaacagaataaaaagggctggattccttatcctattttaaacagtgttattcaaattatttatatcttaagaatgtgcatgtacagatacagttggattaaaaaatacgaggagaaaaagtcagttgtcattcatctgcattagtcacttgaaatctaggctttaaatttgagtcatggaaaaaatgaagagtgatattagtgatgattcccaagaatgattcccaagtgtcacttagagtagacaagagattcagtgacatctctcaagcctgacttcagcagcactaagccaaatttgattaggtcctgactgtgtgcaaccagagataggtatccttttaaacagtgaccttttttcttcagagcatgatgtcaggtcaacattacaacagaacgtatccattgaggaagaaaaaaacaaaatcaggacaattatctctcaaaagcaaagtaaaacagtacgtcaactaaaatatattcacagccagatacggtggctcatgcctgtaatcccagcaccttgggaggctgaggcaggtggatcacctaagttcaggagttcaagaccagcctggcaaacacagtaaaaccccgtctctattaaaaatacaaaaattagccaggcgtggtggctcgcgcctgtaatcccagctactcgggaggctgaggcatgagaatctctcgaacccgggaggcagaggctgccagtgagccaagatcacgccactgcactccagcctgggcaacagagtgaaactctgtctcaataaaaataaaataaaaaatatacttgcaaactttcattagtagagtgacacaactaatgggctttcttgctatcagcaatactaactagatggaattttcaaagttaaaggtatagcgcttctctaccttaaagcaaccttttaaatcacaatactcaactctatttttcaaaagaagatacaaggtgagtgggatgaagtaatgtgcttaagattacacatgcagtaaactgcagggaaaaatctatttctaacttcaattcatttatgtattgaatttattcaagtatttattgaatgtctactgcatactgaatcctggactgtactgtgaagtgaagatacaactgaaagcaaggatgtcaggtctctgcccacacagaattttccttctactaagatgatacagaaagtgacagagaaaatagataagataatttcagatattgacagaaagcaagaacataatagagaacaatgtcaggggacaacctaagaaagtactagaaacgcctctttgaggaaatggcatttgaagtgaactgtgaatgacagaaaagaccgtaggaagtaaatacttatgggcaaagaattctaggagggttcttcaaagaagaaagattgtaacctgtaacttctcaaagcaatatttagaagactaattttctaattatctactttattgccaggatttcagaagaaaacaagtctttgatttaagtgattctgattcaaaatgatacaaaaagtttttttaaaaagagagaagaaagtcaaatgccaaaaattttaagctcacctgtctcctagtaacctttatacccaaaataatatttctagatcctatttttagaaataggcatgaaagaagtaatatgcctataatcactcatcaacatttcctaaaaaggaaacacaaagaatagggggaaaaaaaataaaacaaaaagcttagaggttagcagatctggagtctttggtatccagacatgatttatgtcacaaacaaaagcagtaagcttggaccacaatacagaagtggaagctgggagaactcagagctttgtaacttccctaataaatcacaattaccaaaacatcaatgataaatagctagaatctcagcgtatttaatagctttcgccatttgttggcttgttgatcacttggttcttttcttcaaaaactggtgttgggtagctcaaccccaacacattaatgttgaattgtgaacccttggagacaccagttataaaatttaaaaggaatttactattataaacaagactggagcactggggaaaattctcttgcatgaatctatcccacattttaggagaggaaaaagactccaagatagctttagattaaaaaaagagatgtttaaaaactcaaaaaagaacttaaagaaagaatgaaaggaacattgctggttttcatttttcaatgagaatgtctccaaaagagcaattaagtaagttattggtgtgtcaatttaaaaaaaaaaactcaaaagaacaggtaaaacattagagttatcaataaatccaatagaaaatgttttcacatagacataaatttttctaaaattttaatattttcttcttgcggaatgactgcaataacatttacatggtttcttctagtatcattatgaagcagcattggtatccccatttctgagatggtaacaactgagacattaaggttattgaggacaaacataaaatgagaaaatgccggaatcagaattaaatataaaaatctttgtttttagtaatttctttatatctacttaaccaaagttatttcttttacactgctaaaatatattggttgaccataactttagcattggcttgacaaagtaacacctgaatataaatctatacaccaataggatttccagttcttcctaaagttgaacccaacacttagagtcaatgctgcttccgtaactcacgcaaagcaatccttcagtcatcatgaatgggattccattcatagcaagagtctgctcaccatcactctaaaatccatttccgtttttgtccccactgatttcaatgagaattacagtcaggagaaaggtttttaatgaaccatgaattggtattgtaagctgctgtgtttttatgtaaaaaatgtgtcagacaaaactcgtcctaaggagaacagctaagtacatgtaaatgtttctccttatcaccaccatctttgtctatgctttctagtttgttttgtttggtttggttaagttgataagttgatttgttgatggctttaaactcaaacattgcagacagcaaccattaaagaaaacacaagtaggaagagccctatcacaaagttattaccacgtgaaatttacttcacgttttacatacaaaacgtttgttcatcctgccaggttttttcctaaatttgaactacactgctaaatgtagcaagaaacagacagagttccatgcagccccaaaagtgggtggattacagtttatttcaattctccaagaattctctattctaaactcatctcacacatttgattttatgagttgaagttttaacttaaaaattaaacacagattattgataatgcgtacttgaaactagtaaaacaaaatgtttcctgctattatatataagatgactgctcacctgatcacctaccctttccaaaacacataatctaatttactggcacataaaatccccaatcaagatattctttttaaactatatgtctttgattttttttccataggtatacaccaacttacaggtgtaagtgaatgtcttccttccaacccttttttctttttgcctagttttccattgccaccacgattaccactaaccaagcaaccatgagacgccattatagatttctatggatctttctagaagttctgaggtatacatatacatactgcaaactgtgcccttttaatttacataattgctagcatatgactacaaataccccagggctctgtatttcttttgttctattctgtaggatcattctctgcacacacatgaagagcttactcatttttttttaataagggcttaaggcaactcatcctgagggctgcctcttgttttaacaagaaccaaatgaaaacacctaactgagttatttcatttataaagtcctgcttcctgcttctacactgggttcttacaattttccccagccatgtggtgaagtcccagccccacctttaccttctccctcatatttcagctgccattttgggtcttggctattgtctgtgcatgctttttcttagttagtctgttctcacactgttctaaagaaatacctgagactgggtaatttataaagaaaagaggtttaattggctcacagttccacaggctgtacaggaagcatggctggggaggcctcaggaaacttacaatcatgatggaaggcaaagagaaggaggcaggtcttcatatggccagagcaggagaaagagagagggagcggggaggtgccacacactttcaaacaaccaaatctcatgagcattcactatcacaagagcagcaccaagggggaaatccaacctcatgatccaatcacctcccaccaggccccacctccaatactgaagattacaatttcacatgagagttgggcagagacaggaccccagccatatcactgcctaagtacccagctctcaggccttctgatttctgcctgaattgacccctgttaactatgaatggtttttttttttgattgattgaattgtaataaccaatttcttccctatttaatttaatcacagttcattaatatgttatagtgcttttaagaagatcttttttttaagttatattttaagttctggggtacacgtgcagaaggtgcaggtttgttgcataggtatacacatgccatggtggtttgctgcactcatcaagccatcatctacattaggtatttctaatgctatccctcccctagtcccccaccccccaacaggccccgatgtgtgatgttcccctccctgtgtccatgtgttctcattgttcaactcccacttataagtgagaacatgtggtgtttggttttgaattacatgacccattagtaatcactggtccagactttttcctgtctttctaaactattcatttggaataccaactacctttcagcacttcttatctcagttgttgattccaagtaaaatgccagggtacacatacatatcttttttcccatgggcccagattatcagattatcatgttacttctttccgtttttttttcttttttttttttttttgagtactattgttgactttaagtggtgtcttttctctcacatacttaagtttggctttaaataattcccagagccaagtccctccgctaaactatgaaaatactgctaggagggtttattagttaaagttctccaaagaaatggaaccaatatgttattttatatatacttcccacattggttctgtttctctggtgtgtgtgcgtgtgtgtgtgtgtgtgtgtgtgtatacacacacacacacacacacacacacacacatacatatggagagagagagagattgtaaggatttggctcacacgaccatagagactgagaagtccccgaatttgctgtgtgcaagcaaaaggcccagaaaagccagtggcgtaactccagtttgagtgcaaaagcttgagagccagggcaccaaaggtgaagatccaagttcaagggtaggacacccatacctgcactcacagacagccaggaagggggtgcgtcttcccttcctcctctttttgttctatttaggcccttaatgaattggatactatcctctcaccctaaggagtgcgatctaccttactaaatttaccaattcaacttgtcaaggctaatctcatctggaacaccccacagacacacccagaaataacacttaacctgggtaccctgtggcctagtcaggttgacacacaaaattaaccatcacaggaatcaatttctgtgactagcccctttcaaaacttttgttacatacttcctgaaaaagctttcagcatctcttagacagtttacgacatcatctgaaacacagaaatgacgcttaaaaagcagccatttactacaggaccctaggttcacctgcctcatgaataattctacactcctgttacttattttctaggaaaagataaaaggtggtattcatccttccctttttcctcacactgtaatattacttgtcaattaacttaatgctctgcttacccttgaggtagcctcagggtactagcagatgtgttttgtttaaagggtacgctaaaactacaaaaaaaaaacagaagtcatcttagcctcttcattgcttctcttagttaatggcagcaccatgctcccagacacagaagactagaaactgataaacatcttcagtgtctccacatctttcacttcaacattaaatcagaattctcaatgcctttgaaatcaaagacactgttcagtcccacagacactgacctcgctcaaattccttctacctctaatgtttaacttccttaacccaacttccaggtaggcctctggaaagacaaacagctactttccccatgtcttcttcctcttctaagaggagggacacacatttaatgagtcagactccaagcatgtgcctggcctacacatgcagggttattgtggattaatcatcacatccacaggtgtggctcttttcttctttctttctttctccttttatggccaaggaatagcgaagtggcccaagcctttctgcacaaggaagagatcgagtcatctagttgtcttgctctttcatgtatatttaagccattagactcaaaagttattgtcgttgaggcaagttggatcacagcatccaagttacagtctaggcttaggaacagcaagaaggtttcttgggcttcttgtctacatgccatgttgcaagcccatcttaacagagttattggcattgtggagttgttgacaaaaagtccaaccaaaaaaaaatattattttgcttttctttgcatttgaccccaagcatgaacatttccctcagcaaccttacgagatgagtggttttgatcttgtgaagattagtataccagactaccagtcctaatggtcctcaaaatcataaaagacatgatcctattgttcatatccaatcacgccagattcttttgtgaaccatctgatgtcctgcttgcctccattgggtactgcatggcacttaagcctataggatgtcatttaagaccatccaatatccaggttgaaatctatctttacaatttttttatacactgaccctgaacccatgaatccaccaccatgaacttcttaaatggatccttcttaggcctccatgcgtatcttatgttgtttctccttccaggaagctttccctaaatcttgatttttcactcaccatattcaattcttccatatttattcactgagtatcttgtgtgtagcagccactgagccaggtttcatggaggtttaaggcatataagatattcaggccgggcgcggtggctcaagcctgtaatcccagcactttgggaggccaaggagaacaaatcatgatgtcaggagatcgagaccatcctggctaacacaatgaaaccccgtctctactaaaaatacaaaaaattagtcaggtgtggtggcaagtgcctgtagtcccagctacctgggaggctgaggcaggagaatggcgtgaacccgggaggcagaggttacagtgagccgagatcgcccactgcactccagtctgggtgacagagtgagactccaactcaaaaaaaaaaaaaagatattcaaagtcccacaaaatgtgtatatttcccaattttattactgaatgataggcctcttggggaaagatactagttttattcattcctgtattcttccattaccttgaaaagaggcatatatacagatgatttttatataattagttaaataccatattgtcacatgggaaagtcaggcttggagtctagagttgatagcaaatttgtaatattaagtaacatttttactctacttattttgtcccaaacacagtctgttccaaacaaattgcatgcatttccctctcaacatccctatatggcaggtaatattattatttccatctatacagatgaggaaactgaaacagatagaggttaaacaacttgcccaaggtgacacaatgggcacgtggaaagccagaccatccatgtttatagtggagggatggacagtagctttctgtttcacaggatggtttctggaaggctctagtctgactatttctcttgccatttcttagaagagtagagatccagggacataccagaccaaccagtcacaatgttagaaagaaaagtacccctgaaaaagatgatgagagaatcaaaattgctgactacagtacaaaaagcccttaaattgagattccaaagacttcaggttttgtcctggctttgccacttatgaagtgggtaattttggataagtcaccccatgatcctcatttttctcatctggaaatgggataataatgatggctttgtatgatcatggagaagatcaaataagaagctaaacaggaaaacatttgacattaacagatcattgcaggaattaaagaaaccactgttgcttcacagtcttatggcaggactcactctggctggtagggttaatagacagggattttgttgagaggtcctagtgaggaagctataaatgacagaagtttagtgcaaggaggcctcgagttgcttctgtagtctgtggggattcagcttttgctacattgagatagtgaaggagagggtgaacacagtctatttaacttccgaagttttgagtcaaaagtctttttctcttcattttaagtaccgatcgagaacttcttctggtaaataaagtgattttcacctaagtttaaaatccaagttgatattttgttctttttttaacttgaaagacttgggaatcacaggccagaactgacaacattcaatgttctaagtaagaatcttcataagggatgcagaagtctccctagcaacttcttccagttctttatattgaagctgaatctctctagctgcagcccttgttcctgtggcttgttttaggagggaacagctggtctgcaatctccatataatatccattcatagatgtattaaatcgtcatgcatattatctgtgttacgtattctgaaagtagcaggctcttagcattaccagcagtcatttttcagtcctgtgcaaaatatacccctgggagctcttagcagatgtttggtaaaaattattgaaagaaacatgaaaaaaggctttcccctgttttgaatccacactgagtctatcattcaaaaacagccataaggcatctcaaagtctctaaaaattagaaaaaaaacactcttttgtgagtatccttgtccaggaaaatgacacgccataattaaattccaaacaaatatgccattttctttacacaggagagcatattcatattgcagcagttatgtcttatgcatgttaaaatattatttataaaaactaaagattttgtatatttttgcctctaaagtaacaagcatgatcagattttatgtaacaacccaaatcaggaagcaaagaaagaaaaaaacagaaagaaaagaaaggacaaaaggaagaagggagaggtaaagagagagagaggaaggaaaggaaaaactatttttcttattactgtggtttaaatgtgtctcctccaaaattcaggagttgccaatgtgatatttttaagaagtgggacatttaagaagtgattagattttgagggatcctcacttatgaatgtgattaaagcccttataaaagagactttatgcagtttttggttaccttgcccttctgccttctgccatatgaggattcagcaataaggtggaacagcacaaagaaatactaatccctgcacccttgcactgcattcatcattgcatggattctgttcctaataatgaatactttcttttctaatttggttgacacagacaccatgagcttgctattgattttccggaagtggacattttctccttccacccactgctgttcatcttgtaagttcaccagacaactgaactcgccagaacccagatcttggacttctcagcctccagaactgtgagaaaataaatttctggccaggtgcagtggctcacacctgtaattccagcactttggaatgccaaggttggcagactacttgagttcaggagtttgagaccagcctggccaacatggtgaaaccccatctctactaaaaatacaaaaattactaaaaatacaaaaataaaaaaatactaaaaaatactaaaaatacaaaaattttgtaaaaataaaaaaaaaatggcatctcacacctgtaatcccagctgctcgggaggctgaggcaggagaattgcttgaactcaggaggtggaggttgcaatgagctgagatcgcgccactgcactccaggctaggtgacagagcaagactccgtctcaaaaagaagaaagtaaatttctgttctttataaatcacccagtcagtggtattttgctgtagcagcactaagacactttattcatagaaaacatatggcaacttttcagtattttatttgttttcttcatttcctgaatcatattcggtaatacttatgctaggagaaaacttaggaataatgagtcaaaatgaaagggatatattgaaccagatgaagaaaaacatttccttaaagaaatattatccctgcatccttgcactgcattcatcattgcatggattctgttcctaataacgaataatttcttttctaatttggttgacacagacaccatgagcttactattgattttccggaagtggatgttttctccttccacccagtgctgttcaaattccttattcataaacatccccctgggtgtaagtcaaaaattcatgtcacagcagttaagaaagactatgggccctataattctgtattttgaattctgtgctctaagccctctccttgggcttagagtttaacacgtttactgtttctgagaagagaagtaagtttctaaattatgcattgtcgtaaccattttagtaaataatcaacaagaaataagaaaagagatcaatttccatttgtaaccgacaagagaagagattgtactttaataatatactcacaatacatacatgccaaaaaaaaaaaaaaaaaacccaggactgaaactttgcatgtaggacaaaaatggtgggtatctaatggaaatgaacctcccatatgttcctcattgcatggtaccatgtgtatagagagtgttttcctcctcaccacagagttacaaattctatcaccaaagacaattctcctttatataagagtacttctattgttatttaataattttaagtaagacatagccactgtgaacaattttagaagtgcagaaattataaagaaaaaattaaaactctcaactctgctacacattgatcacacattagcgcattgtgctcctggattttatttcatttaattttatttttttgcctttaacaacaggaatttactgtctcacagttcaggaagttagaagtctgaaatcaaggtattgtcagggttggttcctcctagacacttacaaagattattcctttcttacaaaatttggatgattctgtaagtagtatttttcatttaatatagtaagcaccttccatgtcatgtaatgtatttcaaaaatttgaattgatgcatattattccatagtagagtcatgaatcatttgttcaaccctctctctattgctacacatttgggttatttctaattttccagtataatacataaatattctatgggcatcctagtacataaatctttgcctcatctctgatgttgtccttagtaatttcatattcagagatttatcctaagtcaagaggaaaacacatattttaaggctcttgtctcaaattatcagttaaccttttgaaagactgggtcaatttagtcccatcagctgagagaagaacaagcattttctgtgcccatggaaaccactgttatagttatccttggcaatttaggacacataacatggtacatcattgtgagtcctacattcatttccttcacatttccatgattgaacactatgatttctattggtcaaatatttgcttctagtgataaaatcaaactgttgtcacctcaaatctacttggcaccttccttactcatctcaggggcagatggaaaaagaaaaggttggcattcgtgaatcctggatttggtttgccttttttttttttttttttggtaatcctttcattcataataccatgttcattcatgaaatcttattaaccaggaattaagatatttacttacaggtgttgactacagtgaatcattgaagcatgtgagcattataaatagattcttgtggatactaaggaagacatttataaatttcataatataaaaggaaacgtaagtacataagtcagtaagccatgaggagaatactataaattcccctcactatggcccgtgtggtcaatgttgactttcaaaattctaatgtcaacgtttacgttgtaaattatccatttattattttgtgtgtcagttatagtgaataatttcattaataagaacaacaataaaaacaatttgaatattccacacacagaatagtgcattagattctagagtcaaaaaaaaaaaagacattgatgttgctttaatagaattttgaagggcaaggacatattcactacaacagagtgctaaatggaagaacactgtatttttgaaatattatactaactgatattttgcgggtatttctgagtatggaacctcccacccttatccacacagatatgttctaaaactcccagaggatgcctgataccacgtatagcaccaaactgtaaatatccttttttttcctatacatccacacccataataaagtttaatttataaaccaggcatagtactcctgcactatggggccattactatgtaaaataggggttcactgaacacaagcactgtggatgcctggacagtcgatccaataacccagctggctactaactcactcgcaggcttggagcatctatggcatggaggttccagacaaaggcaggagtcctgccctgggcaggacacagggggatgacaccagatcagaacagcgggcaatttgaaaattatcaatttttttttttttttttggaatttttcatttaatattttcaggccacgtttgaccatgagtaactaaaaccatggaaagccaaaccgcggataccgggtttttcctccacttttcaccctttgcccaatcccaccagcctgagtcattgcctcagggcagggctgcagccagacctcaagcacaaagactgaaggccaccagcctcttttctattttaaaagcctatactctgaagggaatagagaggtttctgattttattgaatctgagggtttgagaagtgaattcttctaccaaaacctcactctggacagggggagagaccaaaaaagaaatgatcagaagaaagaagtaggtgatgctcatcacaggggcccatcggtctcccaagaagagcataagacagtggaaaaacaagagctgaagcaggcagcaaaatcagagacagagagagagaatagggatggccacatggtaaacccaggcatcccaggtgagagattgttgtatacgttctggtgctctggcactgcacagaagtaacagaataattctcatgtgcccaagagggacctcctcaaaacctaggaggccatgcagatgggaacaagggcattttcacggtttcacaggggcaataattactaagaaccagagagtaggatggacatctgtttgtaggtgacattgtggacttgaaggctttatgcgttctttgctgaaagcactttggcatatcttaggtcagattccacagcaaacagactctgggatggagactgggacaggggccctgttggaaagaacattcacccaatagagaagtgagggaagctgaactggacagagagagaagctgaattgaactgtgatacaattacaatcgaggcctcagccaattgaggcaaggaggccaggcctaggaaaacttccatcattcattctttgggtctgagctgcctctggggagaagaaggggcataaccttgggcaaggtggtagccagtagccaatacccccagtagcttggagaatgagtgaatctatctcttttatgattgtgaaaaaatagaatgttattcactctggcctaccccgtctgcaacttagatccatttatttcttacagtaaatttatgccatatggggaagacttctctagggttctggttggttttgttccttggcaaagcatggaaaaagcttagtgagagaaactataaactccatccctgcagctggtctcaaggctgcaattaacactcctgcttcccctcctctactactcattctagattctcctcacccttggttggtgactttgatagtctagaaggcttacctggaagagtgatactaatgctcttacctgagagatctcagaatctagtcaccttgccattcccaggccacacttgatgcatttgtccatgtcacaccaaattgcacaagagagtatcaagagttgctcaaggagatcacttgcacggcaaacatatttctctctagccctatattataatagagaccctacttcctcttggtgatcaagatcaataacctctgccgtcttttccttatcttctgatttcttgaacaagttctatggcaaccgtagcttaagttcaatgagactctcaatgtggctcctggtgaaaacattttctctctgggaatcaggactttgagacacacacattctagagtcatcagaaacagatggacacaaattcccatggtgggcactagatatgatggttagtgaggccatctctcaaactatctcctggttcccaggcccgtgtattctacataatggggtaaagcacatgtattggttattgatttagtgtatacaccacattctggagaacggggatccattctatatttgtcacatatctgtgtgtgatatgaccaggagcttcctcagtcatgggcccactgctgtacctttttgctgttaagttcattacttagtctgaaacaaagttatgcagaatcctctgtcagtggatgaaacattctttaagccctcagagagcagtgctaggaaagtcaacttactcccaagatattttgtgaacactgacaagatgaattgctactccttacagggtagaagttcaatgtaatcaactttccaccaagtggcaggttgatctccttgaaagatttgctgattcagaagctcatcactggtctctgtaatgagatcagccttagtgagtgggagctcagggcacagggcccaggtatagcctccatccttacttcattgctataacattcatgagtccattgtgccagcactgggtggctgatgacagagttggctgaagttggctgggtagttactctatctgcttgggccctctttcattattgatgctgttaagatgaacacagagatccacaaactgatcaatccccaaggtccatccatgaacctacttgaccttgatgttctaatctttttccttccaggcccctggcaaatgagacatgtcattctgctcataaaaccattatttctaatttgacctgtttctccttatcactgggagaatctaccctcatcactggttttcagaaccttcccaagtgggatcatcgtaaagcacagttcactttcaactcgtacccacaaaccaagctgaccatctgtaaaccaagcatggtttagagaagtaccagctgtcataagcgatcccccagggaactagcagtatgaggtgaaggagaggcagcagttaaaccctgtaggcaaaaggggaatgaatcatggtaaccttacattcagcttacttgtaccctctgtctcttcgcatatataatttttttttcagatggagtctcactctgtcacccaggctggagtgcagtggcatgatctcgactcacagcaatctccatctcccaggttccagcgattctcttgccacagtgtcccaagtagctgggattataggcacgtgccttcacgcccagctaatttttgtatttttagtagagacagggtttcatcattttggccaggctggtctcaaactcctgacctcaggtaatccacccaccttggcttcttcttctcatatataatttaatagattcagctgtcccttactttcaatcaatgaaattgacttatccgtgaagaggcgaatataaagaaataagacaagaccctacggagctttaatagcactaccatatgatgatgccctgctgctggatccatcctgtcttacaacttggcggttctgaaataatataatcatgatatgttctggtcacaaagtcacatagtgcctccacttgagcctagtagcatgacaacactagaagcagcaaaaagggcacagtcttctgctgcaaatgctgcaacctagttccatgctccttgggtctttatcataattctcctattgggttttgcaataaactctacagtgtgtctttttccctgtggtgccacgtgatctgctgacccaagtgacagattgcttgcatggcaacctggacttactgtgggaccttttcctgctccaggccccactcaaagttgtcagtcttccaagtcacccagtaaatgaatgggaacagcatatccaaatgtggcatatgctagtatcaaaagatacctattaagtattgtgctctgtcttaatggtaagaaatgcaagctaactagccatgagaaaagacagtaaatgtatacttctttttttttttagagtctttctctgtcacccaagctggaatgcagtggtacgatctcggctcactactacctctgtctcccaggttcaagcaattctcatgtctcagcctcctgagtaactgggattacaggtgtgtgccagcatgcccagctaatttttgtatttttgtagagacgggtttcaccatgttggccaagcaggtctcaaactcctgacctcaagtgatctgcccgccttggcctctcaaagtgctgaaattacaggcatgagccactgtgacccaccaatgtatacaaatttttgtctcaaatgaatgcaaattgcttctgatcctactttcccataaggatgggggaaatatctattcaccatattaatagcttcctattatacatgaaggctgggttaatctactctagtagactaagtgctctgatcaagcaactgtaattgggtttgtttcttggtatcaggctgcctgagttgaaactcaaactttatcactaaatacttaaggtaagttatttaacctttctgggacaatttctatatgcatcaaatggagattattatagtatcttaattatacagtctttgtgattattaaaattacaaaatttacacaaagtagttagcactgtgcctggcacatagtgatcactaagtaatcaacttacatacattcgtttcactaccatggggttaaaaggtagtttgatttattaaaattcatcaaacatagagttttctgttatataaagcacttgaagtaaatctgaaatacatttaacttagggtacagtcatgcagaaatataagatagggtttattttgatagtaccaacactgccattgatcacaaatattaatgtaatttacaaatcaaatacataattatcaaagtagaacatttgctcagttactcactggtctaaattttatgccacttgcaataattatgctatcaagaatttaataatcatgcatatgggatagcttccccaatatttgtctttaactctagcacaaggactaactactaaccatgccacgatgtatgtacccaataggcttagcaagtttctccatctaagatcacatctatcaatatattttccccactatgctagaaattcgacagttacatgggaaaagaaatcatatgaagaaaatgaaacttcttcttgctcatcacagaaacgagaaactacctccatcatcacttccacaacctcttaaccacaaagcaaccctgcccagtctgtgcttcctccttctttttatatcactgcgacgatcttggcaggggaaaacaaagcagaaacagaacccagcatttcacattaatgtaacagtcttgctacctgcaagacagagtggggagggttgtgtgtgagcattacagtcagcctcccgccccctggatgatggcataatgctgatcataccctgatggtgagcatgcagcttgcagaggaaccagctcgctgcaacagaggcttagcgcctagctgcgctttgagctggcaggggcaatcttcatattctgtactgcaaaatcacaggaagggctgtttataaacctgtgaaaggaggaatttgatttcaaaggaaaaggctttagaggaattccagctgcctggcacatagtctgtttctcctgccttcatcctcatggggctcctgcagcaagtaacacagaaatgaccattgtagggagaaaacattacagagtgtgagaaagaaagagagagagagaaagagagagattcttagcaggcaaaataatacagccaatttaccagcaacttcatttggggctggtacgtgcgtttcctaataaattgccgaatatctagactttatgtgaagcttatcagatgaatatcctttaaccccatttgatttgcagtccttgagtactctgcaggtatttcagtgattaataaagcatgctggtaaggcaaaagaaaggtctgttctggattttctaagagctctaagtcaaacattttctgcaaattcagacagaactcaatcacagctccaattcacagtcattaaatacctcgttaatgttgtgtgatttaccaacaagacaaagatctgtcacactgcagtgtaactcttcagcatacagaaaaactagtgaaaccactagggaaattagttttaatagtagcacataactgtaaatcattcaatggctggtcacaagtttaatctgttttccagtttttctgttgttttgttttacagagctttgggtacatctgaattattgccaaaatgaccatggttttaaattacacacacacacacacacacacacacacacacacacacacacacttgaattgaaacaaacatcaacagatcttactcccagaaacgtgatagaccgagtgagagagagagagagattgagacagagagattgagagagagagagagagagagattgagagagagaaagtacaaagacacactcctggcactctgtgtttaaatagtttctcctcaaccctcttttctcaagtgctaggaatattattttggaatgcttctgcaggactccagagattattgctgccatatttcaaaatcacacctagaattacaatctctattccaagcggagtgtgagcctgagccctaggaaatgctttgttcttgacattagtaatagaaaccccattaataaacacctaacatggaagtagttgcagatttgaaagaactaaatacaatgctgcacccgttttctccctttaaatccctccctgtgagtcatgtccaagccaactgttcttacccacctcagtcacctctagacatgcttaatcccaacctacaatattgaacattcctgactcccgcatgccagtcaccctctaatcttttaaatctgtccccctactccccttttctacattcctgggacttatcaaacttttgtaattcaggattagtttgcatatttgccgtgggtcaccctgggatacacaaagctatcctagaactcagggtctttgtggtccctgaagctggaggtaggtgacatagaaacccagatactgggacactgtcaagtgtcctaaatgctgaatttaggctgccaaatttagcaaataaaaatataggacatccaattaaatttgaacttcagataaacaatatcttttgtataagtgggtcccatgcgaggtttgggccatagttataccaaaaggtatttgttgcttatctgatgttcaaatttaattggatgtcttgtattttatctggcaaccttagctgtatgtgaacatgggcaggaagatgtcaaagcttaattatcaattatatcccagaagggtacctcaatgtagatgtacggggtgataaaaatccatgatttgccccaatgtatagaaaaaaagagcccacagcagagacagcaaaaccaggcatcgctgcccttccactatccaatgcccatggccaacatcctttatcaatgaagacaccctttctggcttcaacacagccactcaggcttccattactaatcaatcagacttggcttgtgagatgaaaccttttagctctccctggcctagacaggactaacagtgtggaaatatgtaaaattacccaggcttggttcccaggcaaatctcaatgggttttttttttttgccttctccaaaaatcagaaaataaattaaaaaaagaaaaaagaactaaaaaactattgccttaaaaaagctgtggaatttcagagtcatcactagatagctcagttggggccttgataattaatgattctatagaagtgattcttagagtatggattatagtccatgtggggcctcctgataatgtgcattctttggttcttcctactatcatttttcaatgcattcaaaggttacacattggccaccttctaaatgaatgattgttacttaatgttatttaatgttgtatgcaatctcagagattgctaagaactctgattcagggtcctacattaccatgtaatgctggtgaggttgcacaattctaattgagcacaacttgtggaattcctgttgttttcaggaagcacacgtgattatcagtgtggtcttaacttggtcgtggtttccaaatgtcttctacttaggaattacttttggcttaacttcttcatttacattggactttgttgtggattgtttggttaacccaagtgtgtagtgatatatgtttccatcaatggcatttgaagaccgtaattttgcaatcactagcctttaaggcatgtatacattgtgattcgaataggagtcatctctaccactttgctaaggcaaaccacaaaaatctgcttatacagtgacacgttccctcttattattctattcttttccctctgtagagcaggaatgcataggataagtggtctgtgaagtcttctgccttctcagtctgcactatggtcacaaaaaataattcaagaaatacttttctagagccatgatattcaaccttgatcaggtaatattaaatgttaacacatttaatgcatttgttgatatcacatgaccaaacttttctcatatccagaaatatttcgtctcaaaaaacattgattttttgacacatgtaattttaaccaagagcatgtcacttatttttttaacttttaagctgagcatgattgactctttccaattctttttccatgaatatttgtctccttttcttttacttttgattatgcttactggcactcagttgctagcaatcgagcagtggcaaaagccagacctttaaaaaaatctgtaggaaaaaatatctttagacagacaaatggttttccatttaatttaattttcctgcaaactgggaaaatatttccagtattccattttactgtcatgtcactttggttctttaggtgcttaaaccacatattatgaactattagagaattatgaaattgatgtagtgagtcttggctggtattcttttcttaaagatagaatagagaatacatcacatatattttgcctcctgaaaagtttgtttcagttgtgtgtgtgtgtgtgtgtgtgtctcctaggacacaatgtaaaatgtgtttcttgccatgtaggagggtgttggttaaaagtttgaaaaacattgctgtagagaaaagttcctcaatcattaatatgtataaaattacaggggaaccttgttaaaatgcagtttcagacttctacttatctatcaatccatgggatagggtcttatattcttcatttcaataaaactcctaagtgattctgatgctgctattccaaaggatcacactttgagtagtgagggccaagaggaagagctatagccacaagcagaggatgactaaccctctggaggaatggcaaatgaaactctagaccctgaatatcctgctcaggataccacagccgcaagaggcatcttcagctacagcgtctgactaaggcagttctttccagcaggcttaccttcccttctctatggtaatctcagcacttcggggggccaaggcaggctgatcgcttgagtccaggagtttgggaccagactaggcaacatggtgaagcctagtctctacaaaaaatacaaaaaaaaaaaattagctgggcatggtggcacacatttgtagtcccagctacttgggaggctgaggtgggaagattgcttgagcctcgcctgggaggtcgaggctgcagggagccgtgattgcaccactgcactccctcctaggtgacagagccagaaaaaactttcctaactactcctttcctatgtgagtcagtctgggctgctatgacaaagtagcatagtctgagtggcttacaaacaacagaaatgtatttctcatagttctggaggctagaagtccaagatcaggatgctagcttggtggttccagtgagagccctctttgaagttgcaaatggtcagcttgtcattgtactctcacttggaggagagtaggcaagagagtctcttttataagggtgctaatcccatttatgagggctccaccctccattaaattaccttctaaaggccttatctctaaatattatcacattggggggtttggatttaacatataaatttggtgggggacacaaacattcaggccataatacttgccctacatatgaacaaacacacacacacacacacacacacacgcctggttcgattagagcaatggtttccaatcctggctacataacagcaacatcatcacgcatggctttttaaaaatactaattaaaaatattgatgcctgaaccccactcttcccttagagagttcattggaccaaaagggatctggagcatgtgtgtatgtgtgcgtctgcatgcatatctctgtgtgtgtgtgtgtgtgtgtgtgtgtgtgtgtgtgtgtgtgtttccccagggatggctctgttccttggtaaaacagaatttcaagttcccatattaattattaaccatctccatggagtttgcctcatgccctggaactttaaatatacctaacactctgggattttcagtgttagtcaattatatttctattttatttctttcatcttaggttgtatttgtccttcaaataattttccaactaaacaacaatgcccttgtcagtgaatgattgatttgcctctgaacaaaactgctatatgtctcctttaacggctgccctacaaatgtctggcccttggatatgatatttttagtgtttctaaagcaaacctcaagcatttggctatacctgagtcaagtacaaagatagtctggaagtggtataattattatagacattgttaagtaatagctgaagaacaattacaaatgcaatgtggtatgtcagacactctaagcatattttctccgttgctaatatagtccacccaagaaactgcatttctataccctgtttatctgttattattagaaaatcatgtgctttatatcacattactttccaggtaactgaggcttcccctcttatatgtatttcattaaatagatgtgcaatgcttttttaaaaaacgtgtatatttcaattttaatcattttagattaaatatgtctaagccatattacctacatctttgttttattaaacatggaattttaaacttaatttacccttttctagattgtgttagcattatgactattaatttttataataaaaatccagagactagttttgttctgtttttgctgttggctaccttttggctaatggcttacctattttcttcacatgtccctccccttattcacttcttttttcaagcattttaatcaagagcaaaatgaccaatcattagaatagatgagaaaggaatgcaacccagcaacaggctgtgaatcagaaagcctgggctctagtcctcaaccttcattgaaactctattgacatgatttgcctctcctgggtattcccataatatcgctatgctttatcacgtgctgtatgtaattgtctgtctctcttcaccagactgggtgcagctggagggaagggacttaccctcattgtcccataggtaagcacaggtcctggtaggtaatatgggatgaggtgttaggagggggcttaatgacagtcaacagcttcaattattccagaagtcactaagttcaaatgacaaccatggagctcccttacagtatgttgcaagaatttgaagcaatagcttttttttcgttgctctgttctattgggactgaaattgctaagaatctgctctggataagcttcttctctgaatgcatttttctagataagttattcttctatgcaagttgaaaactcttcattttgttataattcatccaaaaatacagggtgagatcttacatgtttccctcctttcctttccattcctgggcttaagatggggtattcggacccatgcagaggtgtgtgtgaatagaagtggcttcacaatgggtggaatccaactaactctaatgccgcccctaaaccctgccttgacgtacataccccatgatccttctcccaggcgtaaagctctcctctgctcctgcaccctctagatgtaaaaggaaagaaaaacacacaaaaaagttctgtttggttagagctctgccaataactacagggcactggggctgattattgtggcatcttatgagaatttctctcattttacatctaaaccttctgcagatgtcagactctactattgtggattcatgtgcaaatagatgagatgcatccagtaacatgatggacaagttactcaagtcaatttttgtattttcttccttggcagagattgtttctgaaattcgataggtttaattgtctttatttctcttttctaaaagtgcttagaggtagctaaatgttaacaggatattattaagagatccttaattcaattttaattgacttttctcaggacataccaccagaactctaccttccaataaaagatgtgaggttagtatattttatctttttctgtaaggatacttcccccccaccctttgaagtctcctgagttcaccaactctaagatattttgccttaggttgagcttaactgccaaatagaagcccactgttttttgtgaacataaacgctaatttagttaagtgatggaaatcctatcagttggtttctcttattattctataaatatatatgagagagagtttgattgtttttcaaattatcagtaatcatagaatagaatttgtcttaaatgtcaaatctgacttgggaaagattcctctaaatccctgttggccaccaccactaagttattggttttacaacaaaaagagacaggagaaataaaaatcgagtagaaagaaaaatgttgctttttaaaaaaccacaactcttccaattgtacatttaagacatatcagtgataacaaatattgaaaagaagtagatttatagtcatttgttttataaatgatctttccacatataaggagacagacaagcagcttcctgtgcagttgtcccttcactccagaagtttcattatctatatgtgaatgctaattaatgagcccagaattgttactaaagcttgatttacatatgtaccctggggagctatttacccacattctttctgatactcaattgcacacttgtccttgtgtcatatgggagacattcaagaggaatttgggatttttgccaaattctctaaattcttgaattcatacattttaagcaagatgaaacaggaaatccaaagaaggatattctctgagtgagagaagactcccctagttaaaggaaggtgataaaagtgtgttttatttcaggacgcttgactgggctgttagaaaggtggcatgctggattgttacataaatttccttcacaaagcaacttgagaggacgttgaatatcagtttccatcacatggttcagcagggatgttagtttgtccatggggtagaactaaggtgaccttctgtcaaggaactcaggtcagtgctattcaaaatgtggagactgctgctggtcttcaaactatttgttacttgtccataatgacataagcatgagaattgaaatgaaataattaaaacctttttagcaatttgacttgtctcaacatccaagtgtgggatcagcagactagtgtttgcacgtctttcctttctttataggtttctcgcaattcatttttattgtctcttacaaaagtatgtctttgacagattggaaatgaagaataaaactggccgggcatggcggcccacgcctgtaatcccagcactttgggaggctgaggcgtgtggatcacgaggtcaggagatcgagaacatcctggctaacacggtgaaaccccatctctactaagaatacaaaaacttatctaggcgtggtggcgggtgcctgtagtcccagctactcaggaggctgaggcaggagaatggcgtgaacccaggaggtggagcttgcagtgagccaagattgcaccactgcactccagcctgggcaacagagcaagactctgtctcaaaataaataaataaataaataaataaataaataaataaataaataaataaatagaataaaacctggtctttcaccacatactgttagagaagccctgataaaggtgttcctgaggctcttctagattgccaccatcaaaggtgtccctgatgatgggcatagcagtgaaaaagagctcttcacacacaaaagcagtggctgccctgggtgccccaattgcttgaagtcttgttcccagagtgaattactcaacagggagaaaagacactactactactgccagcaattaccaggaagaatgttggaattttttttacattatacttccatgaaaaaaataataataataatttttcactaggaaatggtactggactccaccctgacaccaaattacaaaggaactctagatatttaataattggaaatatcaaaactctaaactggtatctgactctcacactttcagctgggaggcaggaacatagtaaaagttgcttcattttgtatgtccatcatccagaaaagttataaataggattgtgaacatggtgggttagaatatctgctatttcaccaaaaagttaaatgaacttagaccacgtggacaattttcagataatcatcctaagatagagaatgagggactatcataaaagaattattgctcagggatacttcttcaaagtccttattcctttcttgagaatataagagaaaacccacaaaatagaatatgcatgaactagaaatatccaaacctactaataaaggcaagccatgtcagcatagtctgtgactggcaaagtctagattgtttattgaaaaccaagcagttttcaatattaacgtaccagtaaatactataagatattgtcagagaaaactaagaaagacttctatttggcctcataggacaattttccattcaaaatgacactaccaagtaactttaagtacaccttaaagtacatcttccattcacgaatgtatgtcttacatacatttaattttagtttcagaaataatgagagcttcccaaaggtgaatatcttgatgcttgaggtcctccatcatattcttaagctcctgaaaaagaagaggatgctcaatctcttcaaacctgctcagccttattggtccttgttgcctggagacatcaaagttaaccatggagctaaataccttgaattttgactttctattttagaaagtagaacatcagtgagtgagctgtattttaattattttatttagatgtatacttagggcttccataaatatgtttctggggcctataagaggaacattttgtattctgctacttcccaccaaggtagaacttggcgaaacactctgagtttcagcattcctgttgggtcctcagcagggatttgaatagcactctactgaatttgccacagacatacctttaacagcacccaaaatagaattgcagaatttaatctcagtttttgatgtttgactgagagcctaaactgaacactgatgtgtgttctagcatgagctgtgaagggtaggatagtggggttcctcctcaatgtgccatgaagctaagaaaataaaactctatttctcttgtttgtctttgtctctaaatgtgtccaatgctgaatggaaagagacacataatgaaatgagggcacagtgtccagaatactaaaaaggcatttgttagcttcataaactggacacattcataaagcctaaaagagcacataagtaagaagctattccctacaaagtgatagaaaaagtcagagtccctgctaaacaatttacaacaacttttaccagtcaggaaactagtgagaggaataagcaaaaggtatttagctttatatatgggtcgataatttaaacatcagtaaggccaaaacccattattctaaattcaacaggtcagtgatacttggttgttcagtgacactgattgaaaagaagatgtctctgattaaattacccaaccatctctccactaatactggagataacccccaacccaaagcaagccacctcccattaaggagctaacctgttgttcaaatgcaattatggttgaacctgaagtatttaaagtgtcttctcatcctagaaggaaaataataatagaaagaaagaatgtgatatttccattttgctgaggtgtcttgttcagcaatttaggaaaaaatattcttttctcctctttctcctccttctcctcctccctctctttcttctccattttcgtcttctgttgctacttcattttcactttgacaaattgtcagagctggcaatagcagccctacaacctttctagagggttggagggggaggatctgctgaaactttctacttttggaaaataaaagtgagtattcatgacagttgtgaacttacatccctccacacacatgtacacacacacacacacacacacacacatatatacacgcacgcaccctgagctttcggaatctctctactggacaaccagtgctggtggctgattcccaaggaagtctttgcagctcccgtcactccaatgactttataagtgatcatggtaacgggcagcaatagacccacagcatgattctccccctcctccctccctgatgccctgtgttcagtaacaaaatctccacccacctaaaacaggatgaaattagacaaatattgcaaactaatgtcatttccttctcaatatagaagacttacaaatgtcagagaatgcatttggttccagggaaggccaagaaagaaggagaaacaaaacaggcaacaaagacggaagttttaaatatgaatctctgtttcgaaaggctctctgtttctgaacttgaaaaaggccatttaacctcgccgcttgcattttaccacccagattggaggaactaattcaaaacagagctaatctgagaactccactgaggttagtatttctaaaatgcttcacactgtatgaaaaggagatctaggtgccaaatgctattactgtccactcctgctatgttgtaaattgacctctaacctttgatacaatggagtgtgaaaccagctttaagatctatgtaatgccaaacgggctgcaagagaaaatttaaaatagtaagcctggctgagttaagctctagcataccacaatttcacagttgaaccaaaagcagtacaaattcaaattgtagggtacagagagcctaaactttgaagtcaagcccctggaaagtggaaagtggaattggaaaagagagcttgtttacaatctgcaagttaacccttagatagggcacaatcaggcaacagaactccagctattactctatgcatgtctcccaagttattgagtccaactaaccataatcatatgaatgatgacaattatggcagcttttaataatctctgctatgtagccgtcagtgtgctgtgtttgacatgtgttatctcacatacacctcaaaactacacaatgagacagagtccattgcaactcttgtttcacacagaaggtaaatagaggctaactacattgtttgggggtcactcagagagtaatcagggaagccatggtctatactcatcccatcagaccccatgatgcacaaaccaaccattacaaagggcaaaaatgtctggttggcaaccaggagacaaccagtaagatattgtagatacagtactttcctcactcatctgactgagacaatcacctttcaacattccatgactgtttggagctggagctaatgtttttattggaatgtgcatgttgcgaatgattctctagccctccttgtgtcttctctgtaagattctcattgaaatccatcataccttcagccaggtccctttcatgtggtattagtcggttttcatgctgctgataaagacatacgtgagactggatgatttataaagaaaaagaggcttaatggactcacagttccatatggctgcagaggtcacataatcatggcggaaggtgaaaggcacttcttacatggcagcaggcaggacacaatgagagccaattgaaagggatttccccttttaaaaccatcagaattcatgagacttattcactaacatgagaacagtatgggggaaactgccccatgattcaattatctcccactgggtccctcccacaacatgtgggaattatgagagctacaattcaagatgagatttgtgtggggacacagccaaaccatatgacatgctgttaatggtttttctatggagttatattacactggagtcccccaggctataggcccactgtcctctctcatccttgttcttgtcttataggtaaagaagaaggaggatatttttttcccctgatgaggatgactggtttcagagtaactctgtccagtgaatatctagcaggcctagctgagcaggtgcagtcttcctccttctgctgtggaagacacagtccccatgattcccacagtggcacccaactgtcccaaatactgttgatggttgagaaaaagaccccaaggaaacccagtactctactttaggtttttttttttttttttagctttcggatactttcctcttcctctctaaatgtcgtaagtgttcacttatgacagtcttctgcaaatcctgtagatcaaatactttggtcctaatctgattctgcagagagccctcacgcagacctactctggaaaaagatgctcaggcttggagtgaggcttctgagcacttacccaagcaataccatttcacctctgctgagatcagctaacctttgctaattcagttatattatttcattctcacattgctgtgaagaaatatctgagactgggtaatttataaggaaaagaggtttaattggctcacagttctgcacgctgtacaggaagcatgatgctggcatcttctcagcttctggggaggcctcagaaaacttacaattatgatagaaagtaaagggagagcatacctgtcacatggccagagcaggagcaagagagagagataaaggaaggtgctacacacttataaaccaactacatctcatgagaacccactcactgtctatcatgaggactgtaccagggaagatggtgataaatcattcatgaaaaatccattcccatgatcctatcacctcccaccaggccccacctccaacactgaggattacaattcaacatcagatttgagtgaggatacagatccaaaccatatcaccaattcaagaacataacttccatccttagttagctgaatctgagataggggagggtgtagtaagcaaaataatggcctcccaagatgtctacggcctaatttccagggcttgtgaatatgttatgttatatggcaaggtagaattaaggttacagatggaattaagtttgctaatcagctgatgctgagatagagagatttttctggatgatctgggtagacccaatgcaatcacaagggtcttttaaaagtagaagaaagaggcagaaaaggagccaaagtcagagaaagcaatgccataatggaagcaaagattggaatgatacaatgtgagaagaattcaacccattgctgactttgaaaatggaagacaggcgtggagcaaagaatgctgcagcctctaggagctggagaaagccaggaaacaaattctctacaacctccagaaaggaacacattggcatatatagagccaatgtgttccttgccaacaccttggttttagtccagtgagacccattatggacttctagcctgaagaattataggataataaagttatgttgttttaagccactaaatatgtgctaatttattaagcttctatagaaaactaatacaaggagtttccaacaagttctgagccatcgaccacacatgcatatgcaggacaagggaggtctgctgtgcagagggagtttattatattgaagagaaggattgcaattgctgtcttcacacatttgtaaggtgactaggccagggctgtccctttgggtataaaaagtgagtggcaggctgggcatggtggctcacacctgtaatcctagcactttgggaggctgaggcgggcgaatcacctgagatcaggagttcaagactagcctgaccaacatggagaaaccccgtctctactaaaaatacaaaattagctgggagtggtggtgtgtacctgtaatcccagctacttgggaggctgaggcaggagaattgcttgaacctgggaggcagaggttgcagtgagccaagatagcgccattacactccagcctgggcagcaagagtgaaactccatctcaaaaaaaaaaaaaaaaggaggggagtttgtaggggagtgtctatgggacacaaaaatgaagagtttaggttgagaagtcagacaaaaactagttagcaagcactggccatgtataattatcaagaaaagatgatctatgctctctattctggggtgtgggttatttgaggaatgcaacttttctccctcttcattcttgttttctacctctcagacataagaagagggaaaatcgaccttcctcacctaaactcaggctcacatctctaaagatgtcaagacccagagagttctagatggaagaagacattgttactattccttaaattcactcattgtttagtcaaagggtcaagtaacccaaaccttccaaaacagagaaaattcataattcccaactcatacagaaacttgcttattaaatgctgcttttaatattaaagagtcttacttctcaagccatgtataaagaacacaggtgaccaaatacatcatgatttccttttccagttgttgctgctgaagggaaaaaggaagtgggaatgatcaatccaaatcagctatgatgaaaaccgattctctctgtatgttttctacctattagaaaacaatatatttgaaagacatttttcctaagtggacattaatcaatcctacccagtaaaaattcactttgcattatattactcaacttttttcctctaaagaaatacagaacaaagtgggtagaaatatatttcaggaagagctaggaaaattgtcgaagaatattcatagaaaaggaggaccatggtgccacgcaagctacttaaggcccttttgtatcccacgggcatctggggaagccacatatgtgtgttgcaatgtaattgcatcatttctccgaatctgaggggagggttttgctctatataaattgtggtcacagaagctaagttcacttctgctgtatttgtggccaggagaagaattgcacacaattatacatctttgatggtcgtgcatggaagcgaatcctaaaaataaaaccaactattctatcaagttctcccagcacacatctatcaaatttatgagacctcaagagtgtgaatttggaaactaaagaattgtgcttcccctaaaatgattcccaaaggtgtatgggtcaacagagaatggaatccttcacagtgggacagggagccagcagacagtatctgggtatgacatcgtcgatgaaagactgtttcaatcacctaatacatctgcaaaaactgttttggcacccagttattgagtccacaaaggtttaatttaacagtgcaaatacacaacttcctatgtgtatgtgtgtatgtttttaatgacctacatacaggctactattttatagtggcttccagcagagagagggaaaaacaagattcaactatagaagctgtctatatttaatatttctgttagttttctgtctgccagtctggcagattggcccaattggaaaaacaacatctatgattgctgaaacagttcctggctacatttggcacccttaatcactgaatgacacagaaatccctgtctgaaaatctaaggcaaaagaggccagcctttgtatatcaccaagacttatctgtttgtctttatttcgaagtccaaattctaatgtcattattcagttcaatagcatagcagtccacaagatttcacaaaaacaatgaaaactctatgcaaatccttgataaactgatgtcatcagtctcatgtcactataaaaaaatgaatctgtctcctgttttgttttgttttgtgctatgtttctaggtcaagaaaaaagaaaaaaaacttacattcacttcactcgaactctatttttaacagtaaaagagttaaagtaatttttatatattgataggtaacaagcaaataagaaaaaaaataactattggcaccatgtgctttagatcactatttggcttacaaaattcctaaatgtggtgaaaaaaagtttttaagtactgaacgtgaagttagaagtgccaagtttgaaagctggtcctgactcttagtagctggttgagatttgacaactcactcaaccctctgagtcactcaatctcacattattgcaagatcaaatagggttccatgcaaaaaagctgataaaagacaaagtgttattcaaatgtaacatattatactagaaaatgaaaagaggacacaatagcctataggtagtatttcaatcaaagtttaacattgaatacatatataattcttaaaggaggaaataaaaaagactgaaaatcttattcccagacttcatcagtgttcatctgcattttttggtcctacatttaattagcttctgaaaactcaacagaatgctaatggaagttatgtttctatgcaagaaaccctggaaacatgaacatctttttttctgaacatttcaacatcacaaactacaaattactgccataaactgctgcctgtagggccaggtaccttttaccctcagtcctgtggtggccaatgataggaagcacatgtcatcagcagtgatggactgatctggggacaggcacaggggaagactaataacacttcagtgaagctttgtcttggttataaaaacaaagcatgatctttgaagtcagactgttgtgattccaatcttggatctaccatttttcattttcttactgttgactggcataatcacactgcaggataatcatgtagctatgaggtttaacaggattatttaaggaaagtgccccagtccttagcacatagaaaatgcccagttaggcctggcgtggtggctcacacctataatcccagcactttgggaggccaaggcaggtggatcatgaagtcaggagtttgagaccagcctggccaagaggtgaaatcccatcgctactaaaaatacaaaaattagtagggcaagacagcgggtgcctgtaatcccagctactcgggaggctgaggccagagaattacttgaacccaggaggcagaagttgcagtgagccgggatcatgccactgcactctagcctgggtgacagagcaagactctgtctcaaaaaaaaaaaaaaaaaaaaaagaaagaaaagcagaaaagcccaatcaggatatagtcctttgtcagatgcatggtttgcaaatattttctcccactctatgggttgtctgtttattctgataattgtttctgttgctgtgcagaagctttttagtttaattaggtcccatctatttatttttgttcttgttgcatatgctttcaggtttttggtcatgaactctttgcctgagccaatgtccagaagagtttttctaatgttatctcctagaatttttatggtttcaggtcttaaatttaagtctttgattcatcttgatttttgtataaggtaagagacgaggatccagttttgttttctacatgtagcttgctagctttcccagcaccattcattgactagccaacaaacatatgtaaaaatcctcaacaccactaatcaaggaaatgcaaatcaaaaccacaatgacataccatcttactcctgcaagaatggccataattaaaaagtcaaaaaacaatagatattgatgtagatgtaggaaaaagggaacactttaacactgctggtaggaatgtaaattactaaaactactctggaaaacagtatggcgattccttaaagaactaaaaatagaactaccattcaatccagcaatcctactactgggtatctacaaagaggaaaagaagtcattatatgaaaaagacacttgcacatgcatgtttatagcagcacaattcacagttgcaaagatatggaaccagcctaaatgcccaacaaccaatgagtggataaagaaaatgtggtatatatacaccatggaatactactgagccataaaaatgaatgaaataatacagcaacttggctggagctggaggccattattctaagtaaagtaactcaggaatggcaaaccaaacatcgtatgttttcacttataaatgtgagctaagatatgaggacacaaaggcataagaatgataatgacacaatggactccagggactatggagggaaggttgggggaggggtgagagataaaagactacaatgtacactcgtcaggtgacaagtggactaaaatctcagaaatagccactaaataacttatccatgtaccaaaaaaccacatgtatcacgaaaactattaaaactaaaaataaaaaattattcccatgaaattttttttaaaaagaaaataatcaattgttgctattattcttataatcaactgtgagctgatgtctggaatattttaatgtccacccaaattttcaacacctgaaaaactgttaataggaaacaagtgaacatgtgaaaaataaaacattatgttcctgatagtatattggtatgtttgttttagaataaacgtatttttgcaataggaaagaatttcactccactccctcactagcacattagttcaagttgttagcaccacactctaaccaatggagctagccagccagttcacattggcgcaagttggaaaacaaattcattctaactaacttcattctcacctcacttatctgatcagtctttgaaccctgtctgtccaaccccggaatcctccctcagagcccccaaccctgctgtctgtgctgactctgctctgccctgcacctcatcacctctctcttctacagcttcttgctctcttcatttgtgtccacgcctccaggctcttcctcttcaatccactgtctacactgccacctgttactgagttaaaacagtgagccgacccatggatgccaaggagaataaacttccaatggtgtctctttaacgaaaaagttcaactttcctattgcaaagtgcagcttgcttcacaaccaggccccaggcaacctcgcagtctcatagccagatgttccctcctcactgccattttgcacctgagtacagtcacaccctgcgtaacgatgtttccatcaaccagggacagcatatactacgctggccccatgagattataataccatattctattttgccttccctgtgtttagaattgtttagatacacagatactattgtgttgtaattgtgttgtgttgtacaatattcaggacagtaacatgctaaacaggtctgtagcccatgagaaataggctgtaacacacagcctaggtgtgtagtaggctgtgccatccaggtttgtgggggtactctatgatgttcacaaaacaatgaaatcccctaaggatacatttttctaaggaccatatctctgtctttaaataacactgacttggatgcaagtcaccttctagaacagggttttctaatagatatttctgagattatagaaatgttctattctgaatagccccgaacagtagccactagtcaggaggggctattgagcacttgagatgtagctagtgagactgaggaactgaattataaatctttattaatttttaaatagccacatgtggctggtggctactatatcagacaacacaatactaaaggtttgctactcaaagcgtggtctggggaccagcagctttcacatcacctgctgcatttctgttagaaatgagaaatcatgaatctacaaacagaatctacattttaccaagattcccaggtgatttgcatacacatcacaatttgtgagatactgctctgaaacttttcttgatgagactgattagcttctggctcttcaggggaataaaatcccagcattcatgtgttcaatagagaaactagagattacaatattactccagtaatcttcctataaagacaccaagatagaggaatgactccagaattcagtcatctggagtcctcttaaatgtgatctgtattcaacctcactcaactgaaaccccctttcctttccattagaactggctttacatctaaactttgcaagtatattccttaaaagatttttactgttgctagggagaggcctctttactgcacctgatagctcccctaaacttcttactgatgttgaaattagtttgccaactcttttcataattagagataaaatttcaaaagcatatccccgtggaaaaaagtatataatgtttgcactaggctagtggaaacaacatcatttacccgagtactaaatgtgataaggaaggggtgagaaaggggacctctctgggaacctaaagtggaaagaaagacaaacagcagaggtcaaggaagagagaagaaagaaaacccaaggttccacacagcaggatacacaggctcctattctggacttagaaagccatcgtggttccgaatcacatcctacagagaatggtaatagccactctagcaaaccaaattcttggaatattagagatatgtgttggaaaggtcagagtgcctccaattgatccccatgttgaaccattctttggcacagtcatttgtaccccagcctgatttgtcactgacaggaacaccagagttccttctgtagtggatatttgtatgtgttcgcttgttttcagggccagcacgcacctccccgtttttccaatattaactctagaattttatctggggatttaccttccagtatgtctcacattaggtagagcgcttcttccactcaaaagtggaaaagatggtaaatgttaaccattagcctggtgactgtgattggttcagagaattgcacattagtcaattaaaacaaaacagaaacatggactttggctgggacttctaagaaagatacccttgttctatttagttggacttgaagccataaagcatggaattgtgccagccattttgatactacaaggagagaatattctattagagtgaatccaagtggaacctgagtacagtgattgaaaagaagaaaagggtcccaatgccccctttgagtatctggctcagacctcacctgaagccagccccatacattgttcattgtgtgagtcaatagatggcacctttgcctaaaaaagcttgggttcagttatgcatctcgtggaaccaaatgaatcctaacagataaatctactctcaaacaaatatcctaggaggaaaagaaaaagctggctgaataaattaacataaagaaatggtaaatacagtgctcttagctcttagcctaatgtggtataagagttgtcttgtgaagactaaactttcttactttcttccttttctactacatggatttctgtaaataaatgtatacggcagaaataaactaaaataagttctttagtaaacaaaatataaaaattaacttgtaatcataagctctctgttgttcccatttatttaaggcagtgataacattaccatgagtgaaaaatcataagatttccaaatgtacaattaaactccttataatctatattttacagattaagcacaatttaattttattataccaaaaaaatggaggctggagtacacactcatggctatcttgccctattagtaaaatctgacctctatagggaaggctgtgagaacagaagaaaaaatggaagagaagtcagtggtattttccaaaatgttggaagcagaattttatagtggtgactataattattctatgacatgtgttaagacatctgggtcatttcttcttagtaaaacaatgttagcaattaagctgagtctatttcacataagacattaagtcatgtaaaacacataagtaacaacaataaatcagtgtcagggtttctgacagtgcataatgtaataccaggcatagagtagcattctatcttgaaccactttaaccacttgcacccctaaaggaaatgccagtcacgtgtcccaaatcagaagtttccacaacaccagagactttcagcatgtcattgctctttggagactatgtgcaaaaacgcatcagtacatggactcattttaacatgaatccttttttagaggaagctaagtgctctgtatcaaatcaggaatgagagttgcagccaatgaagatggaaaaaaaaaaaagatagcttatcccttactgctggcaaagccaattaggcctatctttgtttcatgacagctatataaagaattggggagttgagagagtgggcatttgatatggatgtgcaaactaattctttctgttggctcacataaacaacatttagtagaatatccggtagatgttttttggcctcatttccccaaaccatgtaaggcaatgcaatctaatccatgcagtggttttctgtcttgtatccaaaaaaaatacaagagcttcttcagacagagaatttaagatgagttgaggactcaattctgattcattggattattccacttgaaactaaaattaagctcacattcacatgatgtgcttgatgactttgactttctcaatttctgtcatgaactagtgatacagtaattgtacaatatgcaaattcagcaccaacagaaattttgcattgtaatttaatttatttgagttcatttagtcctttataatttctttatccatcaatcttttctaatagattgtgaactcctggaaagcaaaagcttcatttgtgtctactttgtcagctctctactcatagtggaatctcaactgtttgtgaaataaatttagtattggtttctacaaagaagtatattaagcatttcagttaatatcttattaaagaagtcccacaaataaggttaaataggattcttctgggcagcattcattcttatctcacaaacatacatttttagacgttctcttaagcacaagacctatagcaataatatctagcgtgccctgactgctcactctgagtcaggccaaacactaggcactctgattccattattccttctctctttgcaactaccttatacagtatgactgtactatctaaatgtcacaaataaggtagctaatgcttaatgtttaaagaactttatgtacccaaggtcgtacaatctgacacctggatttcttgttgttaactatcgccctatgctccaaagccaatatgttttgcatgttgataactatgagaaccagtagaaaaatgccaagtctataggagcaataaggaagtaattacctttactataaactttaatttttcttgctttttgtttcttagtttcagaaatgagatcaaccacataaattcatttaaacccaagggcatatatggggatgactgtatgagatcttaaatccaaaaactgtttggctcataaaggttggcataagccagcaccactggaaagcacagtctgctgcatgctcagagaaaacaggtgtgcagaatggggtatgaatcatgcaactggcttcgattggtgggttcacaaagttatttgagcatgggacataggccattccctattatgtcagccacttctcctacatgtttcaagagatgaaaaaatgacacaggtcaaaaaaattacaagcattttctatgacaattgaagatgcttgtctggacagctgttaccctgaatcagcaaatagtttaaagtgactaatgttcattctgacacaaaatgttatttacttgatcttttcatataaatgttacaataacttttttcactttaaaggatttttgtaatgtaaaataggaaaagttatctaaattagcactagaaaaaaaaacttttatataaggttaaatccatttattttaccaatagcctatattgagttcaagagctagcaaatagggtgtgagatcaattaggggaataccaagagggctgcactgttaaaatattctagaaatctcaatctattttcttaaggcctctttaatagatccaaggagaaatatatggacatgtgaaactaactacttgtcagaacagggagaaagttaaggacagttttcaaaaaaccaatagtagaaggtactttatccaacctaaatccttacctaatggagaaaaaacaatcctcttctccaatcatttctagctttccaaagatttttttctgccaaagtcccccatcaaaagtaagagaataacaatcttagaaactgttagttctgagatttgagggagtgggtggtacagttggaaaaaaactgatttgtttttttctttggggtagggaagaaaggagtttgggtagatatttgacctatatctacctatttgacaaatctaaaattagaccctccattttcacccctttcttatcccaatctttcatcatttctgcagtctttaagacctgaatcccttgttggctgcatctttctctcagagtgctcaagtctatggttattctgctattctatattctatatttcacatccaaaaataatttttgaaatacattgtttggttaagtttgcccccaactacattttcttctaggatcatacttggtctttattctgttactgttattttgactccatctctggatgcaaaagaaataaacctgtgtgtgcagttcaccgttttcaataggaagactatttatacttaataattgagaattcacttaaccattcattctgtattcaaaaaccacttattgaatatattctaacagccagtgtcctaaaagtctaataagtatattatgtattaacttactattttttaaaatcatatgtcttctatgtaccaggcattgtaaagaacttcatgacttagtgtctcaggataccaaaggagatagctaagaggagatctaaattttctgttctcaaaaaggtaaagatgaagaagaaacatttgtctctctcaggggcctgagtgaaatggcttctggaatgctcaagaattctgagaagtgcaacctacatggagactaaataatctgaattgccagtttcaatagtgaggtgaagcttactaatcatgccctttctcaaatctcttcttcctcatggtaagagagtttcttcctttagttttggctggaatcatgagcaacctgctagaaactgcattttcagcttcctttgcaaagaaatatgagtagaaataacttctgcataacttccaagttgtttatatacaataaaattcattctctgagacctcctcccttttccttcatcatgagccgtaaataaagaaaaatcaatgtcccactttgatcatgcagagttagtcagtgacctaatgggtagaagaagaaaatgtcagtggaagccaagtctcttaatggccccagggagcagagcttcctcacccagctagaccaagcagatggtttcatgaggaatcaaagacgactttcttattcagaccactatatgttggggtctctttgtgaaaacatcctaaaagttgctctaaataatacaatagccttattttgccaaataatcgtaagtttctctatcagtttccatatatctattaaaattacgttttaaatagtgtaaaccatagtttccaaatattcaaattgtatttaaataaaatttcaggtgctacgttgctaaataaaaattcagtaagcgaattcacataatagcaattactctaatcttggacaaagcgaaggaacaatggttaaatcatacaatggctcctgaaggacctactcagatatcacacacagttacttctacgcacattccatttgtttaagtcagtgatgaagcctgactcaatggggttggaatatataacccccggcttcaccagaaagacactgtggctcttataacaatgggtaggaatatacaatcctcttacaaagaaaacaacaaataactgggcgcaataacacagtctctaccacaaccaaatgaaacaaactctaaataagtttcagctacaaggcaaataatttaaatgggcttcaatttcattcatatgtcttcatctcctttgtgccaatgggatctcataactagaagagaatgtattatatttagatatacttttaattacattttaatgataatgttctggccttgttaccttctataaatagaacctatggtcagatattaaagcattcatgccttagtttctgatattctcactcctttacctctgcaataaaaacttaacttgcgacagaaaggatctctaccattttagatcaaatttatctttagctatggtaaaggcaaccttgatcaattcataaattccatatattagaattcaaaacaataacttctatcataaaatgacaaataagtataaggacttataaagtattcccacaccatcataacaaacttcgttctttatccacttaatttttactaaagtgaaattaacataccctttagtcagaaattttttatccttgaaaggcaaaaaaaaaaaaaaaactacctttattctatttttagtaaagatttggtacatgactatataaactatatattaccgtctttcctttttcagcattaactacaacagcaaaatagtatcaagttgatcaggttaagttttataaaattacatatctgtttgaattgattatgcataaacaactccaaataactctacttaaaatgtagaaggataaaaagaagccctatattactaaatgtgaggcttgaatcttaaaatattactcaaatttattgctttaggaagcacctaaatagaggagttctatttttggttaggacatggcaagctgcaagagactattgcttttaccctaacagccaaaaccaagccatatcaattataaaattatagtattctgaacctactgctgatctgaggatgcaaagagaactaaattccagaaagtgattagtattttataagagaactatagctgttctcaaacctgataggcaggcaataaatcaatccatcatttatgtggataaggagaaatccattaacattttaagaaactatgacaagtgtatgtgagttagcaaggcatgttagaatcccaaggaaccttggccacagggcaagttcacagacacatgtcaagcttttgtttgtttttacaattctctgtcattaagtactcaggaactcaaaggctaggggcaagacagaagagctaagagaaatctccccctcctcccccatacctctgagtgaaaagatatctccctaggtgcagtttggaagtctggcagcagattggtaggtaaagcacgaagaggaatcttacgtattcagctctgcagaaaggaaatttctgatactgtgttcaaaatatttgaagtgagtagtaagttatattaaactaaagctgcagtcaagcccagataaacttggctacaatgagatttacacagaccccaaatctatcaatttatacatgaaggggtatgataatttctaggaaaagatataatttactttacacttcactgttatgatatgcaaaatgtttgctataaaataaaaacattataaagcaaaaaataaccaattaaaatatgacccatgatgaagaaaagacacagcaaaataggctgaaatatggcctagatgtcacaaatcacactttaaaataattataataaaaactataaaagatctaataagaaaggtataccacaagtatgaacagctggggaatttgagcagatgcatggaaatttatatttgagcatatgcatggaaactatgaaaaaagaattaaattgaaatgttagatgtgaaaacaatatattaaaaaatgaaggattcaattggctaacagcaaactggattcaccagaggaaaaaaatcagtgaaactgaaaccaggtcattagaaagtataccaattgaaacacaaagaaaaagataagaagaaagaggaggagaaaagagaaggagaagaaggagaaaagaaggcagaggggaggagagaacaaaggggaggggaggaaaaagaaagtgagaaagagagaagtataaaaatgaggaggagaatgagaacaaagacggaaagaaagaaactgaaggaggaggggaagaggaagaagagtgttcaagatttatggtacaatattaaatgatctcagattactgtagtaattacagtcccagaggagggaagagagagattaaacagaaaaatatttggaaacataatgtctgagatctttccaaaacttataaaaaataattcaacacccaataagctccatgaaccctaagcagaataaacacaaagcaaaccaaacctggacacattgtagttaaactcctgaaaactgaagattgcaaaaatgaatcttaaaagaaaccaggaaaatatatatatatatatactacatagagaaacaataatataatgaatgactgacttatcaccagaaacaatggaaagaaaatgacaatggaataacaccgataggatgccaaagaaaaatgatagtaaacctagaattctatatccagtaaaaatattaaattaaaatgaagcgaagatgttttcaaacagatagaaacagataattcatttccagcagatatttactacaaatgataaaataaactctttaatctaaaagaaaatgataccagaactcagaatgtacaagaaaagaagagcataaagaagaataaagctgggtaaaaataaactagtaacttttgccattattatatatatatgtatgtgtatatatgtatatgataataactatatatgtatgtgtatatatacacatacttatatgtgtatatatacatatatgtgtatatatacacatacttatatgtgtatatatacacatatatgtatatacatatacttatgtatgtatacatgtacatatgcatatatgtatatgcacatgtgtatatgtatacatgtgcatatgtgtatatgtacgtgtgtatatgtatgcatatacatatgtgtatatgtacatgtgtatatgtacatgtatacatatacatagatgtgtatacatacacatatgtgtatatatatataatttttaatttaaaatactattgacagggggagatctggcaagacggtcgaataggaacagctccagtctgcagctcccagtgagaccaatgcagaaagcgagtgatttctgcatttccaactgagttacccggctcatctcgttgggactggttagccagtgggtgcagcctgtggagggtgagcagaagcagggtgtggcattgcctcacctaagaaacataacgggtctgggaactccctcccctagccaagggaagctgtgagagactgtgccatgagggacagtgctatccggtccagatactatgcttttcccatggtatttgcaacccacagaccaggagattccctctggtgcctacaccaccagggccccgggtttcaagcacaaaactaggaggccatttggggcagacactgagctagctgcaggagttgtttttttttttttctttttttttgtaccccaatggcacctgggacaccagcaagacaaaactgttcactcctctggaaaggggtctaaagccagggagccaggtagtcttgctcagcagatcctgcccccatggagcccagcaagctaagatccactggcttgaaattctcgctgccagcacagcagtctgtagtcaacctgggacacttgagcttggtgcgaggaggggcatctgccattaaggcttgagtaggtgatttttcccctcacagtgtaaacaaagccactgggttgttcgaactgggtggaacccaccacagtgcagcaaagccactgtagccagactgcctctctagattcctcctctctgggcaaggcatctctaaaagaaaggcagaagccccagtcaggggcttacagataaaagtcccatctccctggcacagagcacctgggggaaggggcagctgtggatgcagcttcagcagacttaaacgttcctgcctgccagctctgaagagaccagcagatctccatgcacagcattccagctctgctaagggacagactgcctcctcaagtgggttactgacccccatgcctcctgacagggagatacctcatacaggagagctctggctggcatctggtgggtgcccctctgggacaaagcttccaaaggaaggagcaggcagcaatctttgctgttctgcagcctccactggtgatacccaagcaaacaggatctggagtggacctccagcaaactccagcagacctgcagaagaggagcatgactattagaaggaaaactaacaaacagaaagcaataacatcaacatcggcaaaaaggaagccacgcaaaaaccacatccaaaggtcatcagcatcaaagatcaaaggtagataaatcaatgaaaatgaggaaaaagccagtgcaaaaaggctgaaaactcccaaaaccagaatgcctcttctcctccaaaggatcacaactcctcaccagcaagggaacaaaactggatggagaatgagtttgatgaatttgcagaagtaggcttcagacggtggataataacaaactcctccgagctaaaggaacatgttctaacccaatgcaaacaagataagaaccttgataaaaagtaacaggaactgctaactaaaataatcagtttggagaagaacataaatgacctgatggaactgaaaaacatagcatgagaacttcatgaagcatatacaagtatcaatagctgaattgatcaagtggaagaaagggtatcagagtttgaagatcaatttaatgaaataatgtgtgaagacaagattaaagaaaaaagactgaaaaggaatgaacaaagctttgaagacatatgggactatgtgaaaagaccaaatctacattagattggtgtacctgaaagtgacagggagttgataatggaaccaagttggaaaacacccttcaggatattatccaggagaacttccccaacctagcaaggcaggccaacattcaaattcaggaaatacagagaacaccactaagatacacctcgagaagagcaatcccaagacacataatctcagattcaccaaggttgaaatgaagaaaaaaatgttcagggcagccagagagaaaggtcgggttacccacaaagggaagcccatcagactaacagcagatctctctgcagaaaccctacaagccagttgagagtgggggcaaatattctacattcttaaagaaaagaattttcaacccagaatttcatatccagccaaactaagcttcataaacaaaggagaaataaaatcctttacagacaaacaaatgctgagggattttgtcaccaccaggcctgccttacaaaagctcctgaatgaagcacaaattatggaaaggaaaaccagtaccagccacttcaaaaacataccaaaatataaagaccatggacactatgaagaaactgcatcaactaatgtgcaaaataaccagctaacatcataatgacaggatcaagttcacacataacaatattaaccttaaatataaatgggctaaatgtcccaataaaaagacacagacaggcaaattagatagagtcaagacccatcagtgtgctgtattcaagagacccatctcatttgcaaagacacacataggctcaaaataaagggatggtgaaatatttaccaagaaaatggaaaacaaaaaaaaagctggggttgcaatcctagtctcagataaaacagatttttaaatcaacaaagatcaaaagagacaaagaagggcattacgtaatggtaaagggatcaatgcaacaagaagagctaactatcttaagtaaatatgcacccaatacaggagcacccagattcataaagcaagttcttagagacctacaaagagacttagactcccacacaatcatagtgggataatttaacaccccactgtcaatattagacagatcaatgagacagaaaattaacaaggatattcaggacttgagctcagctctggaccagactttatagacatctacagaactcttcaccccaaatcaacaaaatatgcattcttctcgacaccccatggcacttattctgaaattgaccacataatgggaaggaaaaaactcctcagaaaatacacaagaatggaaatcataacaaacactctctcagactagagtgcagtcaaattagaactcaggattaagaaactcactcaaaaccgcacaactgcatggaaactgaacaacctgctcctgaatgactactgggtaaataacaaaataaggcagaaataaataaattatttgaaaccaatgagaacaaagacacaacataccagaatctctgggacacagctaaagcagtgtttagagggaaacttatagcactaaatgcccacaaaagaaagcaggaaagatataaaattaacaccctgacatcacaatgaaaagaacgagagaagcaagagcaaacaaattcagaagctggcagaagacaagaaataactaagatcagagcagaactgtaggagacagagacaagaaaaatcgttaaaaaaaaaatcaatgaatccaggagctggatttttgaaaaaattaacaaaatagataaaccactagccagattaataaagaagaaaagagagaagaatcaaatagacacaataaaaagtgatttaaaaaaagcccaggatcagatggattcacagctgaattctaccagaggtacaaagaggagctagtaccattccttctgtaattattccaaacaatagaaaaagatggactccttcctaactcattttatgatgccagcatcatcctgttaccaaaacctggcagagacacaacaaaaaaagaaaatttcaggccaatatccctgatgaacattggtgtgaaagtcctcaataaaatactggcaaaccgaatccagcagcacctcaaaaagttcatccaccatgatcaagtcagcctcatccctgggatgcaaggctggttcaacatatgcaaatcaataaatataatccattgaataaacaaccaatgacaaaaaccacatgatcatctcaatagatgccgaaaaggcctttgacaaaattcaacaccctcatgctaaaaactcttaataaactaggttttgatggaatgtatctcaaaataataagagctatttatgacaagcccacagccaatatcacactgaatgggcaaaaactggaagtattccctttgaaaactggcacaagacaaagatgccctctctcaccattcctattcaacatagtattggaaattctggccagagcaatcaggcaagagaaagaaataaagggtattcaaataggaagagaggaagtcaaattgtctctgtttgcaattgacatgattgtatatttggaaaaccccatcgtctcagcccaaaaactctttaagctgataagcaacttcagcaaagtctcaggatacaaaatcactgtgcaaaaatcacaagcattcctatacatcaataatagacagagagccaaatcactagtgaactcccattcacaattgctataaagagaataaaatacctaggaatacaacttacaagggatgtgaaggacctcttcaaggagaaccataaaccactgctcaaggaaatgagagaggacacaaacaaatggaaaaacattccatgctgatggataggaagaatcaatattgtaaaaatggctctactgcccaaagtaatttatagattccacgctatccccatcaatctaccatttactttcttcacataattagaaaaactactttaaatttcatatggaaccaaaaaagggccacatagccaagacaattctaagcaaaaagaacaaagctggaggcatcacactacctgacttcaaagtatactacaaagctatagtaaccagacggcatggtactggtaccaaaacagatatatagaccaatggaacagaacaaagacctcagaaataacaccacacatctacaaccatctgatctttgacaaacctgacagaaacaagcaacggagaaaggattccctagttaataaatggtgttgggaaaactggctagaaaacttatagctggaccccttctttacaccttactggctatatgcagaaaacttaaactggaccccttctttacaccttataaaaaaattaactcaagatggattaaagatttaaacatggccaggcatggtggttcatgcctgtaatcccagcactttgggaggccaaggtgggtggatcacctgaggtcaggagttcatgaccagcctggccaacatggtgaaaccctgtctctactaaaaatacaaaaattagccagacttggaggtacacacctgtagtcccagctacttgggaggctgaggcaggagaatagcttgaacccaagaggtggaggttgcagtgagccaagattgcaccactgcactgcagcctgggtgatagagtgagactctgtctcaaaaagaaaacaaacaacaaaaaaagacttaaatgtaagacctaaaaccataaaaaccctagaagaaaacttagtcaataccattcaggacataggtattggcaaagacttcatgactaaaacaccaaaagcaattgcaacaaaagccaaaattggcaaatgggatctaattaaactaaagagcttctgcacagcaaaagaaactatcatcagagtgaacaggcaacctgcagaatggaagaaaaattttgcaatctatccatctgacaaagggttaatatccagaatctacaagaaacttaaacaaatttacaagataaaaacaaaaaacccagcaaaaagtggatgaaggatatgaacgaacacctctcaaaagaagacatttatgtggccaacaaacatatgaaaaaaagtttatcattactgctcattagagaaatgcaaatcaaaactgcaatgagatatcatctcacatcagttacaatggcaatcattaaaaagtcaggaaacaacagatgctggcaaggatgtggagaaataggaatgcttttacactgttggtgggagtgtaaattagttcaatcattgtggaagacagtgtggcaattcctcaaggatctggaacaagaaataccatttgacccagcaatcccattactggctatatacccaaaggattataaatcattctactataaagacactatgcccatgtatgcttattgtagcactatttataatagcaaagacttggaaccaagccaaatgcccatcaatgatagactggataaagaaaatgtggcacatatacaccatggaatactatgcagacataaaaaattcatgtcctttgcagggacatggatgaagctagaaaccatcattctcagtacactaacacaggaacagaaaacaaaataccacatgttctcactcataagtgggagttgaacaatgagaacacatggacacagggaggggaacatcacacactggggcctgttggggggtgggggtaaggggtgggatagcattaggagaaataccaaatgtagatgacgggttgataggtgcagcaaaccaccatggcacatgtatacctatgtaacaaacctgcacattctgcacatgtatcccagaacttaaagtacaaaaaaaaaaaaaagataaaaacttaaaaaacggacctcctgtaatgccagcactttgagagggcaagccaggaggattgcctgagcccaggacttggagacagcctgagaaacatggcaaggtctcgtctctacaaaaattaaaaaagaaaaaaaaattagccaggcataaaaataaataaataaaatactattgattcttttagtcacagaaaatatctgtgtattagaggtatattatatatatataccgaagaaaaatataaaacaaaaatgataggagaaggaaatttaaataattctttgttaaagttgttatagtgtccattttatttgcaagtaaactgtgaaaacataaagatcctgtattaatctgttttcactccactgataaagacataatcaagactgggtaatttatacagaaaaaagggtttaatggacttacagtaccacatggctgaggaggcctttcaatcatggtggaaggtgaaaagcacgtctcacatggtggcaaacaagagaatagagcttgtgtagggaaacttctgtttttaaaaccatcagatctcatgagacttattcactatcatgagaacatcatgggaaagagctgcccaatgattcaattacctcccaccgggtccctccctcaacacatgggaattcaagaggagatttgagtaaggacacagccaaaccctatcagaaacatattgtaacaacttgaataactataagaaaacaactcaaaaagttacacataaaatatatgatctattttaaataatacaagaaaggagaacagagggataaagacaaatgagatgaataagtacaaataaaatttaaagaccaagatggtagattaaacacaaccatatcaataaatatattaaacggaacaggactaaacactctatctagttaaaagaaaaagacttggccaggtgcagtgactcacgtctgtaatcccagcactttgggaggccaaggcaggcagatcacgaggtcaggagatccagaccatccaggctaacatggtgaaaccccgactctactaaaaatacaaaaaattaaccgggcatggtggcgggcacctgtagtcccagctgctcgggaggctgaggcaggagaatggcgtgaacccgggaggtggagcttgcagtgagccaagatggcgccactgcactccagcctgggcaacagagcaagactccatttcaaaaaaaaaaaaaagaaaagaaaaagactatcagacaaaggtgatagaagcaagacccactgcatgctcttcagaaaacagactttaactataaaagtaaggcaagataaaattaaaagataaaaaaagttataatgaacaaacactaagcataagaaatctggtatgctatataaacataagagaaagtggatttaaagcaagcagtattatggaggttaaagtgttatttaataacaataaaatgatcaattaatcaagtagacatagtaatcctaaatggacaagcacccaacacagtgcttcaaaatacacaaggcaaaaactgatgagagtaaacaataactcttgcttcagaccaagaagaaataataaagactaggtttaccctcccatgtaagataacatttttaacaaaatatgtaaagcaatgatttaaaaaactgtaaaaatgcattcaagtttcacgatctctgaaagacaggaaacacatgagttgagttccaaaattaccccaagcttactgcatcgggttgcagcatagggaggagaaacacaagcgggtcctggtggaggccagtaggctttctgagttacagagaaagagctgagaattcagggagacgagcacaaactataagtcctctggacagaggactggaaaagaagagacttgcccagagaaagatcccgggggaagtgggagtcctcaaaggtctcccacaaatatgcagctgactactgataagcacatgtttataggggaactacccaagctggaaacagaatcacccaaaaggatgagagagaacaattattcacattcacagagggctggcaatagagccctttcgcaccacattggaaaacctcatgatttatggggcattggagagagagtgtgaaagctcttgcctcagtaatggggaatcattaggccttgactgagcactgctccagtttcccctaaagtaatcttaaaaacaagaccaaaaagtaccaaattctttctaagtaacttaactgcatcccagaagaaagctctagaatattcataggaatacaaaagtaaccagcacccacaaagtgaaatcacaatgtctgatatctgattaataattaccagacattcaaagaaggataaaagtatgacccatcataaggaaataaataagcattcacaaccaacaaagagctgacacagatattagaattagtagaaaaagacattaagacatttattataaacgtgtttcatgtattgaaaagtagaggcataaaagatataaaagaagactccaaatcaaactattagaaaagagactacaatgtatgagtttaaaatacactaaatgaaattaacagcaaataagcaattgtagacaaaaagattagtgaacttgaagtcagagcaatagaaagtaaccaaaataaagcacattaaaaaaagaagttaaaaaaaaatgaacagaacgttatagagctgtgggaaaacaaagttaaagttttatgtatatgcctcatacatatgaccttggattcagcaaagatgttttagacacaaaagcaaaagcaaaatgtgtaaaagcacaaattgacaaattggaattcaacaccaaacttctgcacttcagaaaacattcttgaagaaaataaaaaggcagattacatactaggaaaataaacttgcaaatcatatatctgaaaaaggacttgtatcaagagaactctcaaaattcagtaagaaaatgagcaacccaattataaaaacaggtagaagatttgaacaaatatttcacaaataagtatgtgaaaacatgttcaacatcattattctttaaggaaatccaaagttaaaaccataataagctaccaccgctcacttattggaatgactaaaatttaaaaactgaccataccaagtgttgacaaggatgtggaggaactgggacactcctacactgctggtcgggatgtaataatggtacattgactttggacaacaatttggcagttccttgaaaggttaaatattcaattaaaacatgattcagccattagattcctaggtatttacccaggagaaattaaggcctatgtgtatgcaaagatttgtacatgaatattcatagctgtttaatttataatagttcaaatttgaaaataaccaaaatgtcatcaacaggtgaatggataaacaagctgcaatatttttatacaatggaatattattcagtaataaaaagaaatgaattattaatacaagcaacagcatggaaaaatttcaaaataattatgcatagataacttttgtgccaacctaatacatacctatggtcccctttatttgacttccaagaacagataaaattactatctagtcaggaagtagttgccatttggacaagaaaggtgggaatggacaagaaaggagcacaactgacctttctgaactaatggaatcttggttttggtagtggttatttacatgaatacaaatgtcaaacttcctcgacctgaacactgaagatccatgcattgtattatatgtaagtaatgcctgagtatttttaaagatgaatcccgaaaaagtaaattactctttataccacccttcatgtaattttcttagtttttacacattgctattgaagattgagcatattttccatattcataaaaacaagctccagacataattaagatgtatcagatactacagagaaaaaatagaaacttttctttcccaaaaaactctcaaatgcaattccaggaaaagcagagaaaaaaacccaaagtgattttctagaccaaaaaccatctccaagcttagttaaaccccatgttttcttcatgctcagataatttacctaatttcagttcatctaagaatattatgcattaatatttatttgcatggtcatttgaaaatcaatgttcaaaacctgtattctcaggttttatcaatagtcccagccctgccaatttaaatcaccttcttaagatcgtttctgtgtgtttgttgttgttgttgttataaaacaagcctgaaagtaaaggcaagagttttaaattatgaaaatgaaagtccggttttacttaccaactcggggctatcatctaacacaacttagaatcttcagagaaccatgccctccagcagaggagagcacactcctagccagaagccacctcacttcaggctgctgaacccacacaagatacacctgacctcacttctctttcccaccatcagagctacactgccaatgagtaaaacctggacatttatcaattcatttcaacgaatgatagtgtgggctaaaagatatacaattaggagggacaaaaagaggaaaggaaggatttaaagaaaaaagaaagcaagcactggggacaggtgagcagacccaatacctatgcactgctgttattcaagtttctaaaaggtagaaaacccacctgccacacaggattcttcactggactttttagattaaagagcacatggcaaaaactgtggcacttgcttgtgtttcttcactggaaggattttgtgatattctttgacacttgaggaccctactttaatgaatttaaaagttagaagaactaatttccatttggacgcaagtgtgtgcacgtgtggtgattctctgcattttctttcctgcactggttccttcaagggagagtaaagccacacaattttaagcaggccaaagcattcttcttttatggctgaaataattaaaacatgtgtacagcctacatatctgtgggcttgggattgaagaagtttgtcccttatgtctcagtgaagcctacaggccattctctttcccagaaaccatgatgtggacagcactttctagggtatgcaggatataacctgtataatcttccacggagaccaggagctccttcttccttcattaaagcttccaaatttgaatctcaggttgtcagactatcccacctgtctcccctccctgttgcagccatctctcatttctcaatggctctaactcctgggccaacaattattccttctttggtgtttcctatgtccaaatagatgattcttccaatattctggtttcttagatccttgaacccatttatcctaatgaccaagttcttcaacctatctcagccatttcctcaccatgctcatacaacagaccagtggttctcaaagttccattttgctatcactgaagaaattactaaaaattaaaactctcatcctcacctcagccctgctgaaccaggaaatctgggatatggcccagcaatctctgttaaataagccttctatgtgattatggtacccaagtttgaccttgttattaccaaaaaatgcaacacctctataatctcaattacaagacttccacactttgacctcaatttgattatagtaccctaactctaacaacccttaccctacccataaatatgccttgaactcactttctccttaatattactcaactttatattattttcattttactcatttggcaaaaattcaacccttccttgttaagacaaaacttcatcccatttctggcctatatgcagtccttacagtgacctgcaatgccctacatggtctgacctgctttccattgtcaccaactgatatgaaaaaagctaactatgtatgactaaagaaggtctagtatcactttaaatgtatggacatgccctcatgggcccttcctgctgccaggcaatcatcctatgttattgagaaataacaactatcagttcagaacttctaccctcacttccacccacctacctgcacatgcactcttacattctgccttcccacctgttcctccggattgtgtgtacttctatctaggtcaacctcttctacttctatgccagatttcatgccctcttacctactcaggaatgttgtcctagcacctatccactctcttctgcttcctcattctgctcacactctgccagatccttctgactacataaagcatgctgttattcctcccatcctaaaaaaaatcttccccttccagttactgccctgtttctactatttatagcacacttcctccaaagagttattatctgtgtttgtcttttataatttgtcctctctcattttctcttaaacccactcattagactttcactcccactgctccatcaaaatgttcctgaaaaggtcatcactgacactcctgctggttatccaaggtgcgatcttcagtgttgcacttgcttggcctgtctaacatacttgacacaactctttcttccctgccagcacttcctgcccttagctctcccagtattcctcccacttcactgtgacccttccttctctgtctccattctcgtctccatagcaactgtacactggaattccccagttctcagtctttgtttccattttatttcattctttattcacttctttggtgatttcattagaggctttaagtaccctttatcctgatgacatcagtatttatagttgtggccccagctgcttcacaaactccccacaggtatagtcaaccacatactcaacatctccactaacaaacattgaaaactcagtaagaccaaaattgaattactcttcttcctcaacaaatgtgctctacagcttctcgcctctgttcggagtagccttacacttctagctgctaaggttaaaaactttcaaatcattcttgacctgttttttatctctcaaatctcccatctaaatccatcagcaatcctgttgactcaaatctgataccacaaagcccaaaccatatcgtctctctcctggattattgagacagcttcccaacattatcacttcccttttagtctattattaactggccagagtaatcctctaaaaacatacatcagattatggcattcctttgctcagaagtctcagtgccttcccaccttatctagtcaaaattccaaagtctttgaactgacctgcaattccctaaatgatctgacgtgcttcccattatgtcaccaactaattgcctacaattatcgccttcgatcatcctgccccagccgtgtttgtctccttgccgttcacagaacatgccaggcatttccttacctcagggcctttgcacttattggaaggaattaattgcttcctcatctcctttaagtttctgtcaaaatgtcctcttctctatgaggcttaccttcccatcccttttctagcagtgcttacccctcctgtgctttatttctcttcataatccctgtttccttctaacaggctatgtaatttacaaggttattagttccctaaaggcagaatggtctactttatttgttcgtttgttttattgttgaataccaattatgtagaatagagtgctgcaatagactggtcatcagtaagtggtttttgaatgaatggatgaataaatgagtcaggtctctaaaggtgaacaataagacagagactgtgtttgctgtagaccagaatgggttacaaaagctcgggctgtcatgcatcaagactcatgcctgcaaaaattatacaaaattatacaaaaccaataattgtgcttttgcatggggaaaatttttttaagtgtcctctcacctgagccagttttgcaaagaaaatagacaaaatagatcatttttaactgagaaaatacaaaatgttcttccttacatagtactacagagggtctcaacagggcaagctagtttaatgatttctcagagtttcaccatttatctctaagtcttgggatctgagatggctctcccctaccctcaatattagtatcactgtccttactctttataactgcaggttcctaaattttatcccccaaatttaacttttcttttccattttgtcatcacatgacacacacaaaaattaaactatttcctaaaaatgacacaggtattaaggtcatgaatccaaaaccatatatataagaaagcaaaactaggacaaaaagaagatttattagatactgtgcataaggtatcttcaaacatttcataatggaccagatagtaaatagtttaggttttgtgggccatatggtctctgcctcaactacttaactctgctacctaccatagagcaaaagcaaccatatataatatgtaaatgaatgagtatacttgcattccaatacagctttgtttataaaaacaggtgcatgccaaatcaagctgctgagccgttgtttgcctgctcccgccgtgtggcttccccatccatccaatcattatttcaagggttgacactgcttcttgaatgaataaagctatctacatattttgtattcagagcaatttgtgggcaattataatgacattgtttcagagtttatgagttctgagttgtgctcaaatcatttaacttgccttcccagagaaagtgctgaagaacgttagaggcagcaaatgggaaagctgcaagaattctatggaatattctcaaaaggaaaatgcaatgagtccacttatacaaacagacatccatatttatataaagtggatactttgaatttgtggaatgttcagaaatgtgtttatacaccttactctaattttctgtgaatataatcattgagacttggcagttaaaacacaaagatcaaatttgtagccattagaaaagctgtagaaagttactgtcccaggtagatagaaacagtaaagatggccttcgtcatcagaagtaaagatgagttaaaatagatttggggactatgtagtgcttttacacccactgacctttgcccctttaattttcaccagtatatgtggtatgacagaaagtggcatgacagaaaatatagcagagcctgacatgagaaacattttgtgagttcaatgcagtggtttcaggaagtaactttttatgttggtggtaagagaataaaagtgaagaaacagactggtaaacttaccatgttccaggcagtgccccaagtgccatatatatattcattcacttaaatgaatatatatatatatattcattcacttaaatgaatatatatatatatattcattcacttaaatgaatatatatatatatattcattcacttaaatgaatatatatatatattcattcacttaaatgaatatatatatatattcattcacttaaatgaatatatatatatattcattcacttaaatgaatatatatatatatattcattcacttaaatgaatatatatatatattcattcacttaaatgaatatatatatatatattcattcacttaaatgaatatatatatatattcattcacttaaatgaatatatatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatatattcattcacttaaatgaacatatatgtattcattcacttaaatgaacatatatgtattcattcacttaaatgaacatatatgtattcattcacttaaatgaacatatatgtattcattcacttaaatgaacatatatgtattcattcacttaaatgaatatatatatatattcattcacttaaatgaatatatatatatattcattcacttaaatgaatatatatatattcattcacttaaatgaatatatatatattcattcacttaaatgaatatatatatattcattcacttaaatgaacatatatatattcattcacttaaatgaatacatatatatattcattcacttaaatgaatacatatatatattcattcacttaaatgaatacatatatattcattcacttaaatgaatatatatattcattcacttaaatgaatatatatattcattcacttaaatgaatatatatattcattcacttaaatgaatatatatattcattcacttaaatgaatatatatatattcattcacttaaatgaatatatatattcattcacttaaatgaatatatatattcattcacttaaatgaatatatatatattcattcacttaaataaatatatatatattcattcacttaaatgaatatatatatatattcattcacttaaatgaatatatatatatattcatttaattcttaaacaactctatgaggcaaacatgaagtcccaagtgtccaatgtcccaactttccaagtgaaacaattggagaacagatatgttaaataatttcccaatatatcctgctagttagagacaagctgatatttaaacttacagaatatggttctgtagctcatgcttttattgacttaactataccgcctctcaacagttaacaggttaaaaggacattttcaattaggaaaatgttagcccactagaaagcaaaatttttaaaccaactggagaaagttaagaaagtaaataaagcaaaatttccagaaagacatattcaggtataattttaattgtaatcttggaagagaaaagagacattttgaactaaaacagaaggaaagacaggctgggatgaagatcaggaaaactacagttgcttccacccaagtagaagtggagaaattaacagctggccagtggacacggggcaggagcctggagagtatggaaacagcttgaagtatctcctgtggaaaactcgacagggtccccaaaaagctaaagctaaatcagatgatccgctcagggcccagtgggggccaggtgccacagactcagttatctattcattaaggcaatttctttagtgacctgttaatttaacctatgtcatctattataaattcaaaagttagaaattgtatccctttttaaaagatcctatatgtctgattatcactaattcagactgatcttctccccaatcagtccacatctttgatattttctctacttactatatttcatccgtaagacacagatttctttcagattttgacatctcagaaatctagatgtcttaaactcaatgatgaaattgggaggatttttctccagtgggaaatgaaagaatgatatatctgacaatctatggtgatttagattggatgaaccacatcatttactttgcctccaattaatgtgaacacttccaagccaaggaaaggcaagacatttaacctcaacactactcaatatttccctagcttcttatcctatctaacacatttctatatattctttccattcatgtcaatcctaaggtgacagatgtttattatcccttcctttcacagatgagaaatccaggattcagagaagtgaaatttcctgcacaaggccactggctgacagagccagcagcctaatgaggtcttctggcaccggcctctgctcatctgactacctactatgattactcttaggcttttgctctgaataaaagtctcactaccctacatttcaactaaggtctgaaaactacctgtacaactttggttgtaactgacaaccttttactcaacaatgtagagaaatagcatatataagaatcttactccaaatcaccttttaatcccaaacaataataagaggctgaagctgcctgtaaaactactttctatccttttgattttataagccacagacaacatcaaaattccagagtccatttgctgatatgtagaagccttcttgtgtgcaacaaaacaattaaaaaaaacaaaacaaaacaaaacaaaaaccacaaagatcatgcagaaaaagtgctctgcaaaattgaggcaatatttcaagctgatgcaatgaataaagacagccaatgtcagtcaacagccagtggaaaaataaccctcaacttcagattcatttgaagcctaccagaaagacagagtgaaatacaacacaaaactgtcacaaaagtctgttatttatagagaattgaattaaatatgacaattgaccaatagaattataatagttaactcttcctttcaggcatcacaagatggtgtttaccttacattacccagaaaatggactgcagatgatgatgaacttccctcagattaagaagcagccaacaaacaaaacaatcaaacttccaaattacagtctggctgaagaatcagaattattttgagagtttggcagctaaaacaaatgaactcaaagccatagggttagcaggatatatttggaatgagggtctaattgcagccaaagagagacaaaaggccaagggagatgctagagaaagagggtagtaacaaaattttttaatacactcagtcacatggacacttaaccaagttctattacagtctcatgctattagacactaaaaggtattgctaaggaatagtaaataaaacagtgtggcattaaggcagggatagatccaacataggcagaatatggtaatttagcccaaatcaatggagacaatatttattcatgaacaattggttttggaacaattggccagcagtttggaaaacaaggtaaaactggatcaccacttatttccttaaaacaaaataaattccaaaggaaacagaaatcaaaatccaaaaattaaaacaagaagaattataggagaatatataggaaaatacttttataatcttggaaaaaatgctttctaataacatcaaaaataaaaaaagcagttatttatataagaaatgaccattacatttaactccgtaaaactgtaaagtttctgcagagaaaaacatcttcacaaactgggttgaaggataaatgacaacatggaagagcaatttttcaaatacatatccaaaaaaacaaaataccaatttttttaaaagttcctgaaaataaaaaaatttaaaaataaaaaggcaaaagctaatttaaaaggcgcttctcaaaataaagactaaaacaaatgaatctgcatgaagaatcttagttgggtgataaaaatattctaaaattggtttaggatgatgattatataacttggtagatttactaaagaaaaggcaatcattgaattgtacacttgaaatgggtgaattatatgatatgttaaatatgcctccatcaagttgttaataaatgaccaataacaattaaaatagatgttcttcctcattagtattcaaagaatgctaacaatgctttttcaatgttctcctccctaagcctcaaggaaaccacatggtgctggttttcttcaggcctctctgatagctcctctgtgtcctctgttcattcctttacttctagagatggccatgccttaggcttctctgtgaacctccttcccagtttatcacattccctccctaggagttatcacctgctgaggttctgcagcaacacagcaacatattataaaacaacattccagaccttcttcctaagctccagaattgtgtatccaacttcctgcatggctgcacaccacttggctgaatcaccaatagtcttcagtcccatttctgcccctgctcacaattcttctcaagaagtccctcctctataaatggtatctctattttcccacttgctcatggcaagactcagatttatcctaggtatatttctatcccttgtgtaacccatggaatccatttcctattcctataaaatctgtgtcaaaaaatgcctttcggttccatttactactctgcaattttacagtaactttgcagttcaaaccatcatgatcatcttccattgaacaatttcaaaagtgttctaattggtttccactcctactctgttcctcactaaactattctcccaaaactgaaaacatgatttttttaatgcaaataagatttttgaggtagacaccaaggtgcaccactcagatcccccttcaataaagacttgttgtccatgggctgagagtgttgccagccccttcagggttgttgcagctgcaaagaactgccttgacccaggaggtcacactccatcctggggaggccctcatccagtgattggtcaatgtgaaggtataaaagcccaatcatctcaacccaactggggacccccctggagaaccattatagttccactgctcctcatggggtcaaccaaggctgtcactgggcccaaaccccagtgccccttatctctctgcccaatccttcttccttctcctgcttccacatgtgttaatccaagactagtccttctagtgaacatccttctcaccagactctggctcaaattgcatcctcgggaacgctatctacaagacttttgaaaccatgtgatgggttcatttggatcctactgatccagacacattcctcccttccactctcttgccctattctgctgcatgtttgttttcaaatataccaaattcctgcagttctcagaattattgtgtttggtggatccaaaataaggtttcaaccctatgatggcatccaaacttctgtagactatggtatagagaccactcatagataacacattttttcactttacatccttcttagaggaatggctcttaggtgtacattctctatagcacctggcacagagctttgctcacaaaagatactcaataaataaataaaatgtgtgtggattaggttacttggcagcaaatactctgttgcaggaccaaatcgctgtcaacaagggcatgctcaaaacagctcttctactagaaccaaagcaaaactccagagacacgagagacaattgacatataaaatttacaaatgtcttctatggttgagatcagaaattctttcaaggaaaactaaagcacaacctcagcagtgactcatactcaaggtatttaaggaagtagcaagaagtacattgggctgtcttttcaactccaatttatcacatctcagaatctcccctttacgaaagatttattcttgaacaattccatactaaatctttcctcttctcctgttgaatctttatgcaagtagagtcaaagacaaagaattcctttttccacctattcatagaatatcctttctaatcccaaggccccttacttaatgccatttttctatccattcaggatccctatgaacaaactcctatgattccagtttgtgtgtaagtacacatagttaattatgatggactatacattcctgaagctaactgtggccactttaagaagaacctccttccaaaaacaaacaaacaaacaaaaaaaacaaaaaaaaaaaaaagaagaagaacctccttcttaaaaggcccttggaaagtaagtatagtgatttaaataactagctgggtgtggtggttcacacctgtaatcccagcattttgggaggctgaagtgggagaattgctagagcctaggagttcaagaccagcctgggcaacatagggagaccccatctctacaataaatgaaaaattagccaggtgcggtggcacgtggctgtgttccccgctactcaggcagctgaagtggaaggatcactagagcccaggagtttgagaccaacctgggcaacatagggagacaccatctctacgaaaaataaattaaccaggtgtggtggcatgcacctgtgctcccagctacttggaaggctaaggtgggaggacggcttaagcctaggaatttgaggctgcagtgagctgtgattgcaccactgcactccagcctgggaaacagagcaagaccctgtctcaataaataaataaaataattaactaaaaatttcagaaaaaataaataatccatttgctcccaaaagatctccaagagaatactaccatgaccatacaggcaggataatttatccttgatcatgagtaatacatttgtctttgcatttttgtattggtagataaacagctcatattatgaaaaatcattatgaaacagctcttaaagacataaggaagaggaacatggataaaaaaacaggtagtagaagttggtgggagaaaagggataacagatcacccttaaacaagccagaaacttaattatcacctttagttaaatccaaacacccagtctcctgtttcaaggagaccaactcacagaatatttttcatgactaaccttatgtttgcaactgaagattaaaaactaaatattatttgacaagtttttatatgacgacataaagagtggctagtgcccgctgttgactcagacatttctgccaacctcttttgcctgccaaaatatagcttcaataagcacacataaattttatttttaataaataaccacaaaatagtttcataaacatactaaactgtggataattgtagctcacaatgagtatgtgttacagtttcggtaaatagaagttacacagtctgaagctggcacacgctaaccccatcgtatggattgatgtcaaaccagctcacgctggaacaccctggtgattttcttggtaagcggcctatgtgctaactacttgggctcctgccttcttccagcagtcctcctgttagtctacgcagacattaggtttcagagtcctgagaatttaaaaggatagctgaggtctctgcttggtgtcccaaagggtctttgcggtaagaaaagttccttatgccctgaccaacatgtagacacctataatactttaaaatgaataaataaagggcatttggggaaataaatactgatgtgatgagaaggaaccagtgagaataaactgttctttctaactaacttttcttggaatttacatgttccttttactcaaaagatccttttggaagagtgtattgccttttcctctgttggcagacatttctttctctttttttatttttttattccttgaaaaaagcagcttattgaaagcttaatgagtttttcttttctgtgttagaaatcaggtttatttttaagcttctttgaccacacatgtgctttgatgaacttccctcccattcgtggaaaagagctctaggttcctaacacttccagctccaattctccacattctccttcacttcacatcgacccctgggaaacttagagtgagaaaaagtcaaagggggaattttttttttttttttgtaatgtactgagcttccttttgaagacgaggaaagagagttttatcttcagtaaaaacaggcccttttgtggaaaggagacgtgatgactgatcaaacagcattcagcattccagggatgccaagatatcgctgggttaaatggtggagatgacccaaagaccctgcgctgtttgaaaataaataaaattactccggcaacatattccgcattcctgtttgtactcggcaatctacatgctttagattctgcctgtggttaccttcactcaggtcttagctcacagttgaatttattcagtcagaatttactgcaaacttccttatgggatgcatgaaactgggccctaggatggatggggcagtgtgcatggtaaggaggcaggatagagcaagagggtggccctgacaccaggaagtgctcagcctgaggccttggaatattgcagagccatggattaagggcctcatgggcacagggagagagtgactcactctgctggaggttgacctccatcaggaggaatgcctcgtggtgttttgtgacctatgaaacattggcagcctgcagtgctgccgcacaattctgttatgtttttcagcactgccaagggtagatttctcatcttaacctcagtcctcctccagtctgcatcctttataatcctacacaacccccagcaatggttctctaagcacaccctccctgactccagttaaccattttttctatcctcaccccaaattaaattcaactctctttgtgtatttcttgttaaacagctatgtgtagaaagctatgcaggacacagaggtgcaagatcttgtgcatcaaaaagcttatcacccagtaggagagttaaacacgtaaaaatttaagtggaaaaaaaatgtaatagaactgcaagtgctgtgagcacttagacaaggtagtgacacactttggttcagcgagattgtgaagttttcacaaaggttctggcacataaactgaaccaagatgcatggacacgtttcctagagctccaaggaacagcatgagcaaaagactaaagttatgtgggtaggcagccaagggtgtttgaatttgagtgtggccagggcataggatagtcagagaaacagaaaaagagctgaaagggttggttcgggccagatcaaatccaaatcaaggtaagtaaaagttactctgtgagtaatggggaagagttgaagttttcctaggaaaaaaataacttccattgccctgtggttaagaatgctaaccctggtcctggctaacacggtgaaaccccgtctctactaaaattacaaaaaattagccaggcgtggtggcgggtgcctgtagtcccagctacccgggaggctgaggcaggaggatggcgtgaacccgcgaggcggagcttgcagtgagccgagatcgtgcctctgcactccagcctgggcaacagagccagactccgtctcaaaaaaaaaaaaaaaaaaaaaaaaaaaaaaaaaaaaaaaaaaaaaaaaagaatgctaacgctggaagcagtgagaaggattgattagacaggatcaaggcaggagctggaatggacccatgtaaaggacccaataagagtgagcatagaagacttttagataagaagccctgtagaggctgaaataaacgttttcctaacatggacaagcaaggctccaccgtccttccacttttccttttttagcaatcaagcaagcaaccaaagacatcagatgttaataaaatgaaatggctatagacagcactgtacagaaccaatagaaccttccacagtaatggatactaggcacttgatgtggaatcactctgactaaagaactgaatttttcattttgtttaattttaattacttttagttggcatagccctatgtggctaatcctactttatgggaccgtgtagctctaaagaataaaattatattgactgaaccagagattcaaagcattttggaaaaatttacattattcttctaccggccatcagacttcagtggtgttgctggatttagaagatggtgtctacctatcaaaagccccatgtttacatataagaagatgcagtgcctgtatttagctcaggcatgaaaaaacttcaaaacattttcactttcaaaagggatccctttgagttgtccagaagggccatcttatctcccttctactcaggatagcctatcagtgggcagtaagatcatggaggtcaggaagagggtgactagttctctctgacttcagagaggaggacctgtcctcgactatctattttccaatgaaagtttcccaataagtcattgccccattataacctaagcacagcagaatggccatggtatgtcattaagtgtttttgtaagttgatttgtggtgttaactttctggatcatagaaatggttttcctcagtattttttcttctgtaggtttggagtcaagaattataatcagttgctaagactttgaattctccaggtagttatttcaagaacatccttttgcatgtttcttggaaactgattccttgttgtgtgaattcaaatacattatatgtggtggctactggccagctctcagggcacctgaactttttggcacttcactccttatattccattatggaatatggtaaaatctcttatgcactaagtaaaaccaggattagataactttttacttgcttatctctccaacaaaatatataagaggagcactggaagaaatttagcaattagagactattaaaataacatttaatttacacattgattatttctagtagaacaagtgttttgaagatggctacaataatatgaatctttgataacctttaaaacagaacagattgctctgaaaccagatgaaataaatagatcttcctaaagccaaaaggagaaataatgcttttcaaactgtgggccacaaccagctgggttatgaaatcaatttggtgggtcagaccaaattttaaaactagaacagaatagaaaatatcagtgtacctcacacatattaaaggtagaaaatgctgtattataaaactatcagttgcgtttgtgtcagtgtgttctaagttgtgatgtaaaataagtattttttacagagtgttactttaccaagagcttaaaagtcactgattaccaaatgagaggacctgaagtttcttgctgttgttctaggtaacaaattgtttgttttttcattgttctaggtaacaaatacttatcaaacatctgttctatgcctgatattgaattcagttataaggtgaatacatggctacttccttcaaataatgtatcatctaacaacatatagatacaaataattataacacaatgagcactataatagacatgaagaggtagattagaaacatggcagagggagcctctacttctgcatgtgacagaatgcagagaggagacatgacaaatacttcacagagagagtggcatttgatgtcatccttgaaaagtgacctggaggagcaagagaaaggcattccaagaaaacagaacattttctataaaggttgagatgtgacttgtactaggcctggagtctggagtggtactctaaatcttactgcacattttagtcacttaatatagccttcaaacttagagatatagtgaaaatggagatagtttattttcattatgtttgaattgttagtaatacggtggtgtttgattcagatcttaaaaccatcgcttttaagagcaaagcttttcaaatggaagagttcctctcaaatgggtcaaatgttatgcttcctagggaagaaaacaaaattcatttgcattataacagggtttagcaagaagtcatgtaaggctcaaactcctttcttttgctggtttgaacaaaacaaatatttattagaaaacaaaatcattgtacattgtaatagaatcaagaaaattaggtcatgctttgttataactgttattggacatagatcatttaacttaatttcacacttaaaaatttaaattacatggtaggggttggggggggtagaaattgaggcccagaacatcaggtatgtgtgtcatgaataatcataaaaggctttagagccaatttaggcaatattgataagtatgaaagtatagaattgaaagtactaattcaaaataaaacttttcattaatttttttcttggtattatttacactgactgtgactatatttgttatttatttcaaatcattctgctttctttccttttccatgattcctcgtagaagagcttttagaatagcgtttcaactcacaggctctaaatgatatagcaagatctaacagaactttatatattaagcaaagtaatagctaaaaagagatcagcaatatattattgcagactaggtaaataatcttagtaattcttctaaaggtaacatgtgaatgagcattctttctttgtgataggaaaactactttaattacttttcaaacaatctcaaaggctgaaaatgacccttgtattttagattttgaaaattccatgagaattgccgctgtaaagattttgacatggccttgagatgtaatcttattccccaaaagtgactgttattttattttaccttttgagaataatgactttgatttgaaatgagaaaataaataataatatttctaagctttgccgtaacacagtttcaaaacaaaaattaaaccgtcctgctcaggtacctattaaatttttcaggtcttagaagaaagaagcacagtaattataattgcagactctacgaaagacttaaaagtcaaacaaaccaaaaagaatcataactttttaaagaggttctcaagggttttccagaataaaaaaaagtgattatgagtgagtttgtgtttggatttgattttcatcctgcaggagtgaacattaaaccaaaaatacatatatcttggaggaaaagctgcagcttctttccccaactgtctgaatgctctaatgtcagatttttcaaattcttctctaccttggaggaatcagatatttccaggagcaccaggatggatgcttttcttttcagcaagacttcaattgtctacctgtttatataggagaagctctgtaatttaatctccaccacagaagacaatcattatgattaaatgaggcgctggtttaacaaggtacacctaataggcacttctgctcatcagatcttgcacaaacaacattctttcattgtgcaacatgtaaaataacttcttcgtcctgttgtagcctctgacactaggcacagcatgctacctctcgactgacttttcactggaaagcagaaaagacatcactctgtcctagagaccgtggcctctgttcatgtagcctgtatgaaagcaggaaagggagacattttttccactgtttgcactcactgcgggatttggggtataccacacaacagaggacatgtctctctaagcacaggatgaaaagaatgtgcctcagagaacacagcttttttgcaaactcaattggtttacccagtttatatattataaattttgtctccattatcctcttattcaaacagatgcatgtgcacacacacacacacacgcacacacacacaaattggaagaaagtcagccaaaaccaaaaagaccctgtagagaagcaaaagcaaatgaaaggaagacaaagctttaaaaagaggagaaacaaatgttaaaagggatcacaacccaggttaagaatcctagaaaagggaaagcaaaatatttgagcaccgtaaaaaggaaaatatttcaaaggagtgaaaaaacacccagcagaactgcagttcatgagtgaatttatgaactatcacttcctttcaagcccataggaggaacacatggatcagcttctatctctctctagtatcttggctgtttccatgtttttctcaccatatctcacatttttcttcatttggtagtttttttgttttttttttttttcaaacctccctccttctcaggaggtgaatagaaggtggcccctctataaatgactattatcccttcggggtgaggaatgtggaagaaccatgtcaggaattccaagcagcccaacagcattaagctgaggcagagttgtttgcagagggaaagcgagagagcctggacacacgaataatggagctgatgtcctcagaaatcattgcagcttatgtttcccatttaggttaaaaaaaaaaaaactgatagagtcacaaacaggcactatgaacttctagcatttcgcttagatacagaacttattactatgtgttccttccttccatttcagactttggggcaagagaagcagtcacctcccagaatttttcaaatcctgccttgtgcagcaaatatcacagctgcacccctcccgtattatgcattcatgaggtaactcacagaggaatgcattcttccccaagagctgctttgctggagtttctagagtagaaaagaattaagtgtagatatggcagagatccccaaattttatattagaaaagagaaaccagaaaccagacttaactgcttttatatgtgtgtgtgtgtgtgtgtgtgtgtgtgtgtgtgtgtgagagagagagagagagatggagataaataaaaacataaacaggtatagataggtagattagatagatagatatatctagaagaagatcaacaatgtatatgtcagaggcatgtgaaccagagcaactccatcttgaataggggctgggtaaaatgaggctgagacctattgggcttcattcccagatggttaaggcattctaagtcacaggatgagataggaggtcagcacagggtacaagtcataaagaccttgctgataaaacaggttgcagtaaagaagccagctaaaacccaccaaaaccaagatagccacaagagtgacctctggtcgtcctcactgctacaatcccattagagccatgacagtttacaaatgccatggcaacgtcaggacattaccctattggtctaaaaaggggaggcatgaataatccaccccttgtttagcatatcatcaaaaaataaccgtaaaagtgggcagccagcagcccccagggttgctctgtctatggagtaaccattcttttattcttttactctcttagtaaacttgtttttgctttgcactgtggacttgccctgaattctttcttatgtgagatccaagaactttctcttggggtccggatcaggacccctttcctgtaacacctatatgcgtatatatatatatatatatatatatatatatatatatacacacacacacacacacacacacatacatacatacgtgtgtgtgtgtgtatgtatatatatatataatatatataaaatatttcaaaggagtgaaaaaacacccagcagaactgcagttcatgagtgaatttatgaactatcatttcctttatcattttctataacatatatatgtgtaaacatatacacacacatatatatatgtgtgtgtgtatatatgtataaaatatatataaaatatttcataggagtgaaaaaacacccagcagatggagtgacatggggaaacattttgcttgtttccccatctaaacttcccaaacaattggcaagttcagagccaattgctacaccattgattgggttatggaaggctccaaaaatgtaaggggccaacacaagcaaaatgtttccccatgtcaccccatctgctgggtgttttttcactcctttgaaatatttcatatatatcatatatatatatataaaggtgagatggggaagcattttatatatatacacacacatatatatgtatgtacacacatatatacacacacacatatatatgtatgtgtgtatatatgtgtgtatatatatgtgtgtgtttatatataaaatgcttccccatctcacctttttaatgccctgtggctattgcgtgcatatgtcctttcacacaaaggcaatatttatgactcaccatcagaaagttacacaaaaagttacctaaagactaccatggattttcaatgaccaaatcatgacccaacttttggtcttgcccctaaggactatatctaggtagccgttcatcgagaagcagcaaatgtatctgcaggagtttagactttaacactaacttatttgcatgtggtcctcaatttttagagctcatgtgcactgatgtgaaatctcttcttatcccaccctcaaattctggcttaaatatcagaacagctgttcttcataagatgatggagatgctgatgctgataataatggagatgatgatgataatgatgtgatggtcgtggtgacagtaatggtaatagcagtaataaaaaccaacaactactcagaattaccatttggcaggcatgaagctaagcacgtttcatggattatctcattcaatcttccaaaacaactccatgagccaagagctatatccccatttaaaaggtggagaaattgaagcactgaggtgttaggtaaatattaaatatcatactcaaggccacacattggtaggtgacagaacccaaacttgaatgcaaaaaatccaccttcagaacttgtgctgttaatgtctactatctcctgcacgatgcccatgcatgttctgaacactgagagcttgggctcatccatcagatgttcaggccaggcacagtggggatgaggtgtgcatgtgtctaagtgtgaaaatgtattcagctgagtgtctctgggcaagtttagtgccaattgctacacaattgattggattatggaagtctccaaaaatgtaaggggccaacacaagcaaactgtttcacagtctggctattcctttcacacagacaaagtcagcaaggccagccctacagcaatgcagaaaacatctcctgagtggattcttcacggctttcccagccgatgcaccccaaacaccaacgatccaagacctgtcatttgtgttctgatactccacctgagacctgaaataaaatgcaaatacaatatataaacccatggtcacactagataactgggacctgaggaaagaggcagaaactttttgatactaaagagctctagaaggatcaaaagttcccagtacccccaacccaaccctcacaactgctgcattcacacacacacacacaaacacacacacacagaaacacacctaacaagtgccatcaaagtagcagacaaaagcagtcatacagcagtagacaaaattattagtaagtgcttcaaagggataatgaaagtgaaagagggaaaaatccttcattcattctatatggtaatcatttattcaacaaatatggtgtatcaatacttatggatataagttaaggaactgccagtctagtgcaagagatagacaaatgacagattatagaatattcaccatttttattagtaagccttttctgtggatgactctgtgttatttacatacgcaaaacttttttaacagatttgaatcaaataacatatcttatgtagggattaactactgtttgggggttctacgtatgtctcttccaatagaagagttagcagtcaactcttaaatgtggttaattttaaggatgaataaatcttgactacacagttagtttctttacctaatttttggctcaattcctgaattttaggcaaccacaacctgactttagacatatcttcaagtaactttaattaatgcatactagtgtggtataagagatgactaagtgctatgttataatacatacataggcctctcctttctcaaaaggactttataattggttatggtaatgagacaggtatacaaataactttgccacaataggcgtacaaattattgcgagagaaagataggtacaaaagatcatatttgattgaaggaattcagacacagtttttcttttaatttaatccaaaatcttcaggtaagagaagtttttaaaaaaaatgaaaagtcaaattcataacagttctcaaattttaaaaaacataatattcaatatcctttatgtctgaaaacctcagcattttcttgtgtatcagatgtttaagcagctaatggacttagccagagcctttttagaaggtgtgagtttgtccacacttagtaatgcccacacttgtaacactcatcaaaaagaggctagtttcaggtatggtttgactcagaggctcaaataaagacttgaataaaaatgtttccatctctgtactctgcctcctattgtgttaacttcattttcagtctccatgttgtgactcctgtcaactctgggctcattcttccatgctcagtctagcagagaagagaaagtgttttttcccaggagcccttccaccttccttggattcactctttcccatctctacaacgatcattgtggttaaggggctttgatgcactaaatgaccaagcttgaatcacagatttcattcctagtgtcaaatatgacaccctaccagaaccagatggacaaagagtagaagaagatggtccctcaaagagaaggaagtgcatctgatgctgagtgtttcaaacaaatagcctctgcacatatttcattctcctgagggagatcatatacacattaatcttatattccatttatgcataaagcagagtcaaaaagaaattaacaaaagcaaaaataattatattatttttgtggttgtatatttatatttatattattatgtggttgctgaaccaaagtctcgatctaaataattgattcttaaatctgaggttgactttcaatgaaggattccacagtcccttgaaatcttagtcttctctgatgtaaactctagaatcgctcctcctgagctcaatgatgcaatctgctcccttttgcggggcttaccttccattgatgggaaagggtctctgagaagaaaatacatgcgactctcttcaataaaacacatgttgagaaattgggagaaacggcatccctcaaccttgtcaacacattgaagctaaacaggagaatatatgcagaagcaggaaacaaccagactacacattgcgtgcttgtctaccagccctgctctgttctcaaggcaaattcttactgcagtgagtgtctgtccaactgcagaaaatgtacaatggctctgagagtactgttcagtgccagaaatgtaggaaaggaggaaggaccataaatgcatattaatgaatttattccagagcagatcatgcttttcactaacataatagcaaacgaagaccaacattctgcagtcacaactattaaacacactcaaacaccccatcaaaacatacttttccccatcatgtcttttcagatgatcattatatttccagtataaaattttttgcaaagccatcttaaggtgcttcacattctctttggaagtaagtggtgttatacatgaaccccaattgttgtcaggaaaatagcatgtccttaataaatgtctttttttttttttttttttttttgagacagagtcttgctctgttgctccggctggagtacagtggtgcgatctcagctcactgcaagctctgcctcctgggttcttgccattctcctgcctcagcctcctgggtagctgggactacaggtgcccgacaccatgcctagctaattttttgtatttttagtagagacagggtttcaccatgttagccaggaaggtctcgacctcctgacctcatgatccacccgcctcggcctcccagagtgctgggattacaggcgtgagccaccgtgcccggccataaatgtcttaaaagttgaattaataatgatggctaaaagggtaaatgcgccccacttgggtagaatgtcataattttaacaacggcctgcagaagccagtctagagacagcaccatgactcaaaggaatgactaatatcaggaatttcacacaccatggtagatgcaagaggggaaactctatttggggaattcctgattccactatttatcttgccaataagtagaatgagtttcatctgcattaaatctacttacactaaagtagcaacctctgaaataagtcttgtcatatccaccagcctcattcaaattagactgattttctaaatacagtgttttttggcaagattatttcactcataaaaaaattaaacatgagaactcatatatgattaagaagttttctacgaatcttaaaaacatgcctgatgaagttatacatttatgtgatgacagctccaacatactcaaatataaacgcccagctctacacattgcacaagtccagagggagtaccattcgtgttgaactttgtataagtggtacttcctagaaatggacaatgaatcattctctcaaaatgtagtgtgtttatgtatgtgtgcttgtggatgtacacacatcctatacctacatctatatctgtctgtatctatatctcaaactagatttggtctttcagaaaaaacctcttcctctactcaacagataacaaactgacttgggatttccatgaatctgtaatgtggaagctactttcaagccattcatacccccctattgccattctactttcgaggaactgtaaattatacatgaattatttagccatgtacgccttgtccataaatgtatttaggaaattcatttcgttccttcctataatattatatacttactatcgagacttttgaatgtgtatgtgtgtgtgcttgtgtgtgtgtgtgcgtgcacgtgtgatagagagagagtaaccaaaatatccatttatttcaaaaccacggcaaccataaacaaagttattttccataaatcaggagaacaggttgtattgcacatgtcaggaaccaaatacatgagcctgagcaaggcatttccgcttctgaatcttaattttaaaactgcatatttaattttaaataagttataatttattagttggtgaagatttacttagtaggctcaaaatatacagactatcctaagtggattcaatagtgacaataagctatacatgtctgtcaaggcttacaaaaagtcataagctgaaaataaaattgagaaatctgacagaaggtataatattttattttaggtgaagttaatgtgaattaattgtataaagcttcccaattccaaaaatgaaaatcaagctgtactgtaagaggaataacacttagttgatctattcaagctggatctcaaccaagtttccagagtagaagagatgtatgactggttactagttcccagtacaagtttccgttttcaaaatatttcctttaaaagaaaaaaagaaaagggcagaataccaattttgaactttaaaggaaaatatcattgccatgtatattcctggaaccctgcttaatgctgtctcactttttccctttaccttaacatttctctaaaaagagacattgtccaattaacatgatcctttttgtggacagggccaccatcatttagtatcccagagaaaggaagagcaagcgtctacaacaatatagcatttcacatacttaatccttaccactaaggtaacccatttatttttcccttatttcctcctatatagaatttcctgtaaaatgtatatttatactctgctgatttatatctgtgggaaatcaatgtctttcttaatgcttcagagatttgaaataacccattctcagtagcaacaagattatattcacggagataatttgcctgtgaaatactacccagcagtcttttgaacctcttactatcactttgctctgtggtgcattttgtctttcctgactaaacagtgtttgcaaacaaaatatttccactagtaaaccaggtcagaaagctgtcttgcgcttgctaagacagtgacacatagagatatatcacttatttctgtcaaattcaactccttcctacttctctaaaaacaatcgttttgcagatgagcgagtcaacagttgacaccaagttaaccaagagttttcttactgctcttaagatctcagagatcattaagtgggagacattgagcctggaacaatccacctgatatcacctttttcttaaatgtataacaacactgatatccaaagtgtttaaaagacatatcctaaataccacagatgattagtgccaatatcaaaacaactgccttaagtctttggctactgttgctggtttcgaaggaatccagtaacatgtaacatctaaataatttcagagtgggtatattcatcattttgctacaacataggataaaagtccacttgagagaatagtctggaaaagccatcaatagcttaccaagaaaaaggaaggacttttctcccaccctgtgaacccacagaatgggggtgcccattacacagggtgggcagaagttgctctatcaactgcattttattccagaagtctttcttggtggcacggtcttgggcaaaaggcaggacactctgaatggcttttctacgggaacagcagggaaagcttagaggtgttctaagaaaagggactcgcacaaaggccatcttgagacctttcattctgatgaatcaaatcccaccctggcccgtaatactggctcttctgctacctcctctgccttcccaagaaaggatccaggaagaaatccttcttctctcccccttacccattctcccatccacagtgaggaggaagatgacaagagcctctcttgggagagttgaggggaccgtgcatctttgctcgtggatctctcttggaaacaacgcgtcctatagggcaagtgctttcttccttctgtctctccatctgccttgagaagggctcccttcccccagctacccagctatacagcctatgactgggcaggtaggtggtcagaatgacactgtagcattgggtcctagttgcatccttcttatacccattaataaaatttataactctctcctgaccctaagagactatttctgaattgggtcagagtctggtgggggaaaatgtggagatgggatcaattagtctcctcagaggtttatgtgaggagagtagagaagagtgacaggtcccagggaaactcagcattaaattggaatgttaacaaaagaaattgaagccaagaccaaagttttggtcttatttgccttgggccaagactaagtggacatttcatcaaatttcaacagggaagaaacagagtgttattgggcctacttggattaagctgttagattcatggaggaggtaaaaattgctgcaggtatttggagagaagccacaagggattgttactggagatggggagggaagccatcttcaggcaatttagcatggtggacagagcccagattcagggagctacacctggcttctaatccaggctctgcctcctacttgcactgtgaccttagaaatgccctcccagctgtttttctgtaacaatagtttctgcatgcagttgttttcatgacaatgcatggggaagcccttagaacactgtgaagaaccatgaaaaggattatcttgtggggggaaaaaaaactagaaaattattaaaagggatagataattttgccagttatgttcaaggcccattaaccccaatctctcatgtactcacttcacaacactccaggtgtctgcatatcttggccctccagcctaccctattcttctactgataagatatgaaaagatgaaagagaagttgagataccaatttcctgcaaggtgggatagagacagccaggaattatagcactgtgaagggaaggtgctatgaaactcagatcttgggccctggcctccttgcccagccaagccaactgtttaaataatactatgtggcttcctctgcaaatagctgctgaagtaaattacttgatggagcatcagattagtctgtaggagactccctgttatttcttttctgatgtacatacagcaccaaggacaggaatgaacagtgggcatcattagtgagtgaggcagactgttaagaaagaagaaaactgcctgatttctgctgggaaattactaagactggtaaaatggttactgctattcaattagtagttaatctgaaaatcataaggtgcagtccaacatgtgaaaatgatgcttctccttggccataagtaaataactttggtttcctttctagtgcagaagaacttgcctttaggaaaagacatttccccggtctccctttgtcccaataggaatctagcaaatgagaatgcaaagctgaatgagctcaggaaccaagcctcattggcataaggcttccatctcctagaaaaccagttcattttcttttttacttcttacttataactgtaaaggcccatattaaaaaagaaaaaaagaaagatctcaacttaataaactaatcctctaccttaagaaactagaaaatgaaaagcaaactaaaactaaagcaatcagaaagaaaataatataaattagagtggcaataaatgaactagagaatatacaaagcagaaaaatcaaaaccactttgattcttaaaaatatcaataaaagtaatgaatctttatcttgactaaccaagaatacagagagaagactcagattactaaaatcagaaataaaagacgtacattactattgactttgtagaaatgaaaaggattggccgggcacagtgtctcacacctataatcctaccactttggaaggccgaggcaggcagatcacctgagttattgagtagtccaagtagtcacatagaaagcattctcagcagagctcctatcccagtgtccttgtgttgactgttgactgtccatagaccacctatgtcttacttgcccttctttccccctgcatcttcatttccagcagggctccctggtaggacagtaccaatagttcatactatctgtgccatccagcttgctttccctccctactgtttatttctactgcataccctaaggtactgggaatcgactatcagtcactataactgcagattacataggataaaagtaactcaggaatagaaaaccaaacattgtatgttctcaccgatatgtgagagctaagctatgaggatgcaaaagcagaagaatgaaagtcccccaatggactttggggacttgggggcaagagcgggaagggagagagggataaaagactacaaatatggtgcagtgtatactgctcaggtgatgggtgcaccaaaatctcacaaatcaccactaaagaacttattcatgtaaccaaatactacctgtaccccaataacttatggacaaataaaattttaaaaaaatttaaaaaaaatagataaatgaacacttcagtgtttttaggctggcgggtttgaaatgaaaaagaagactatgacttggataggagaagagaaagaagagaaccctcttagggcaggataccaaaacaggaagagtgtcaagagacccaagttcggggccacctgtaaatccctctttgcaaactagaaaatgacacccctgcctccaggtaaacaagccccatgacaagctgcacagtttggtgaaccttaccaggtttgcattttggcccgtttgtccttttagccagtaaccctgagagctgcacgacctgtcccacttgcccaactgggcgtgcagtcctaacgcagctctggctttggggtgatcttgagcacctacgtttctccaccttctggttcctccccccagaaagctacaattgcaatcatacttgccattctcacctggttttaaagatgacatgatatacatatgtaaaatcactttgggaaacacacagagtgacagaaatcattacagagcagcctaacccaagtctctgtagccagccaggagggaggagggggactgggaggctcagttcagcgtgactgagctttaggacacactgcgtttggtacaaagacaaacagcagtacattcagaggcacgtgctaggcagaaccatgaggaatgccatggctttcctcttgttatttttctagctgtgggagtttactgttgtatttgtgttttgtacaattacccagaggctatggtgacatttttgcatatttaatcaatctaataaccaaaacctaagactgtgtgcatatcacctctattaaatctcttcactcatatctattcattcatcctccccctccaatcctcccagcacttcatttcttttctcacacattgctataatttattcatctcaagatgcacttctgtctcatttaatcatttaaacagacctttggtgcctatttaattgattcttcctgggttttaatttgcatctttgactttgccatcctgatttctttgactacctctcgctctgcatgacatatgtttatgctttaacaggtttctaatattctggaagacttcagaggccaaggttgaaaaaaatatgccgtttaaaacagaaatctatttgattggccaggcaactgagcaaaaccaaaagcaaatgctctgtggcttcaggagacagacaaccagggtcatcctcgatgtcagctgcccacagccaacctggccagctcctgggccagcagaggaccaggctcctcgctctgaggatccctgccaggatggggaggcaggtccaccaataagaaaaggtgagggtttcctgtgaagggtttcactttgattttggctctatgtaacatagggacccactgtttgcttctcccgtgtttaggtttgcttctgatttgggagaaaaggagggtgattggtatggaaaaaacatggaactgagttaataaactggtatgctcaggaaagcaggagggagacaagttattcagcaacagtgtattctatgatgcccatggagaacaagatttgtgattttaattttgtgtagattaaatgtaagtggaattgcatgaagattcttataaattaatatcacccatagaagtcccaaatgataggaagaaggaaagggaggcaaggtgctatgattctgactccatgagcccattgttcagatgatccaataaaggttctcaactccccagaggggaacctaaccctgggtttgggtttcacaggtgatttaatttttattgcgattctgccactgacctgacaaaaaaaatccttctattttcattttctccttgatataatgggagttataaagcagaaattattccccagcagtattatgcaaagaagttaatattttaagcactcagaaattctaccatatgacagagaagtactgaatattatgggtgccacatgcatttattatgttcttcaaaggaaaaattactcaagttttaatcacaatcataaaataattaaacttgaaatgtggttgtataatttctgccaaaaaaaaagaaaacattccaagtctttcatttgttttaatgagcttcagaaccagctattggcacccactttctaatcagtctaatgcctttcataggcatccattctcttattgctgtatttaaacccttcttcatggaaagtggtaaatttacttcaaatgtataatgtgatttaaaaaaaatgaaataaaaataaaccaagaccttgttataagagagaggttgtcttaatattttctcttgtatcaattgtaagaccgaaattctgaatgtacatgtgtaacctcatgagtaatatcaataccccctttatggtgtttttttttttttttttcttagacagagtctcgctctgtcaccaggctggagtgcagtggcacgatctcagctcactgcaacctctgcctcccgggttccagcaattctcctgcctcagcctcctgagtagctgggattacaggctcccatcaccatggccagctcattttttgtatttttagtagagatagggttgcaccatgttggccaggctggtctcagatcctgacctcaggtggtccacctgcctcggcctcccaaagtgccaggattataggcatgagacaccgcgcccactctcctttatgttttttatgaaatctcgaccatttgtgggttttaaaatggtatatgtgaactggactcaatctgtcaataatatatccattttttttgcactttggtcttagacataaaattttccatctgtgatcctgggaattctgattggcaccaccaacgtgactaaacggccatttaagttgttctatgattatttctaaatccgccattgtggctaactttggtagcagagtgggcctgagctaaggagcttggatctggatattcaggagataaacatttgtggaaatttctttaaaaggaagcctggaatcatacaataggaaaagggaagggacccaggcacaaggctctctcattctatagaatgttctttgtaccaagatactggagaaagcaactgaggtggggtggacctcactccacttaccactcaccagagagtgagcaggtagatggctgcaagcacctagaatactttttctatcacatttagcttacgaaatccacatttggaagaaggtagccacattccagtcctgaaccctgaggctcacagggaagactttagtctaggggtgttgactcaaggttaggaatagttcaactgcacagcaggtgtagagctccaatgagtcctaataactgctggccccagagctcgagtgatgaaattagaaggaaaagagaaaatagagagtggtgagagtggtatgtcttggttggacagaactagaggcagtgacaaaataaacaggtatattttgaaaacaaggacagagcagttaaatgaggctcacatacagaagagatgtcaaaagatatttgagagaggaatatctgttcaagaaagtctgggtagtccagccacaacaagcaaatatcatggtgaatagctgtcctgggcttttttcaaattcctattactatgggcaagattaattccataattaagtagctaaacagacgctataagagtttggagggagcaggaactgctagtgtggagcatattctcagtttcgatggttcaagcatatgaggtcagggagccaattgactatgttgagaagaagcagatagtagcaagaaagggaagatgggaggagcaagaaaccaaactgcaaaggaaaaaccctttggacaggatctgtcttataaatagttgcagacaattctagaagggataggaacagggaataagatagccattatttatttatttattgagacggagtttcactgttgttgcccaggctgcagtgcaatggcacaatctcagttcactgcaacctccgcctcccagggtcaagcgattctcctgcctaagcctcctgagtaactggcattacaggcacctgcaaccatgcccagctagttttttgtacttttagcagagatggggtttcaccctgttggccaggctggtctcgaactcctgatctcaggtgatccccctgcctcggcctcacaaaatgctgagattacaggtgtgagccaccgcaccaggctgatagccattattactcagttagaaaacaaataaacattcaccagatattcgtatatcttgatgtttaacttttgctcttacatagacttgcacatgataatgaagtaggaagatttatgctataataaaatataaaagtaaatatcatacatgataataaaatatctgatttaccaatattcgcacttgaaatatcacatgcttctggacaacagtgtgctctgatacagcccctcgctttatgctatgagttgagttgtgttccccggaaagatgttgaagtcctaacccccagtccctgtgaatgtgaccttatttgaaaatagggtctctgccagtgatcaaagtaagatgagatcattagggcaggccctaatttaatatgacagcactccttataaaaaggggaaatttgaacacagagacacacatactcacagaaattaaacaacatgctcctgaatgaccagtgggtcaattaagaaatcaaaaaggaaatttaaaaagatttcttaaaacaaataaaaatagaaatacaacataccaaaacctaaatgatacagcaaaagcagtattaaagaggacgtttataccaataaacacctacatgaaaaaaaggagaaagatttcaaataaaaaacctaacaatgcacctcaaggagctagaaaagcaataataagccaagcccaaaattagtataaggaaagaaataataaaaattagagcagaactaaatgaaatcaagataaaaaatacagaagatcaacaaaatgaaaagttgttttcttgtaaagattttttaaaaatcaacaaattattagctagactaagaaaaatagaaaatccaaataaataaaatcaaatgatgaaaaagaagatactacaattgatactacagagatacaaaagatcattagagactatgatgaacaactatataccaacaaattggaaagcctagaggaaatgaataagttcttagacacatataaccaaccaagattgaaccacgaagaaatagaaaaacctgaacagaccaataagaggtaacaagataaaaagtctcccaacaaagaaaattccagaattagatgccaacactgctaaattctatcaaacttttaaagaactaacaccaattcttctcaaaatatccccaaaaaaatattaagaggagggaattcttcataatgcattctacaaggccagccttttctggatgccaaaaccagacaaggacacagaaaaaaaaaaaaacagcaaaaaaacaaaaaacaagtacaggccaatatccccgatgaacacagatgagaaagttctcgacaaaatactgacaaaccaaacccaacagcacatcaaaaaaattatacaccatgatcatgtggaatttatcccagtgatgcaaggatggttcaacataagcaaatcaataaatgtgatatatcacatcaaccgaatggaggacataaaccatatgatcacttcaatagacatgacaatcatttggtaaaattcaacacccattcatgataaaaactcagcaagttagaaacatccttaataccataaaggccatttaggaaaacaccacagctaatatactgatgttactgacataagagctggaacataacaaggatactcactttcaaccattcttattcaacatgatactggaagttctagccagagcaactaggcaagagatagaaataaagggcactcaaaatggaaaagaagtccaattgtacctctttgcaaatgaggtacaaatgaggtaaaaaaaaatttttaattttttactttaggtttggtggaacatgtgaaggtttgttacatagataagcacgtcacagggtttgttgtacatattattacatcacccaggtattaagctcagtacccagtagttatcttttctgctcctcttactcctcccaccctccccactcaagtagacccgagtatgtgttgttcccctttatgtgtccatgtgttctcactatttagctcccacttataagtgacaacatgcagtatttgtttttctgttcctgcgttagtttactgagaataatagcctccaactccatccaagtccccgcaaaggacataatctcattttttttgtgactgcataatattccatgatgtatatgtaccacattttcttaatccagtttgtcattaatggacatttaggtagattccatgtctttgctagtgtgaacaatgctgcaatgaacatttgtttgcatgtgtctttatggtagaatgctttattttcctctgagcatatacccattaatgggattgctgtgttgaatggtagttctgcttttagcgatttgaggaatcaccatactgtactttccacaatggttgaattaatttacacttgcaccaacagtatataagactccactagacttagtaaaatttcaggataaaaaaatcaaatgtaaacataaagagtgtttctatacaccaataacaaactagttgaaaaagaaatcaagagagaaatctcattcataatagctataaagataaaataaaattcttagaaataaatttaaccaaggtgaaagatctctacaagaaaaactatgagacactgatgaaataaattgaagaggacacaaacaaatgaaaagacatcccacattcatggattagaataatgaatattatttaaataatcatactatccaaagaaatctgcagattcaatgtaatccccatcaaaatatcaatgacattcttcacagaaatcagaaaaaaaaatcctaaaattcatatggaatcacaaaagaccatgtatagccaaactaatcctgagcaataagaacaaagctggtggcatcacactatttgacttcaaaatgtactacaaagctattataaccaaaacagcctggcactgatataaatacagatacatagaacaatggaacagaatagagagcccagaaataaataaatgtatttatagtcaactggtttttaacaaagacaccaagaacatacactaagtaaaggacagcctctttaataaatggtgcaggggaaactggatatctacatgctgaagaatagacccttatatctcaccacatataaaaaacaattcaaaatggattaaagacttaaatatagagccaaaactgtaaaagtactagaaaaaaattagaacggaaatgctttaggccattggtctggcaaaggattttatgggtaagacttcaaagacttcacaggcaacagaagtaaaagtagagagatggaattatatcactctaaaaacttctgcacaggaaaggaaacaattaacatagcaaagactgtagaatgggagaaaacatttgcaagttatttacctgataagagattgatatctaaaatacacaaggaactcaattcaacaacaacaaataataataataataatttgattttaaaatgagtaaataatctgaatacacgtttcaaaaaaagacatacaaatggccaacatgtatatgaaaaaaaaatgctcaaccctactaatcatcagggaaatcaaaattaaaaccacagtgagatatcatctcaaaccagctagaatggctattatcaaaaagacaaaaaataacagatgctggtgaggatgagaagaaaagggaactcttttttttttctctttttgttttttgagacggagtctcgctctgtcacccaggctggagtgcagtggcgcaatctccgctcactgcaagctccgcctcccgggttcactcattctcctgcctcagcctcccgagtagctgggactacaggcacccgccaccacgcccggctaatttttgtatttttagtagagacagggtttcaccgtgttagccaggatgctctcgatctcctgaccttgtgatctgcctgccttggcctcccaaattgctgggattacaggcgtgagccactgcgcccggccgaaaagggaactgttactcacttttgatgggaatgtagtacaaccttatgaaaaacagtttggaggttcctcaaaaaactaaaaacggaactacaaaactaaaaggaaaactactatataatacccagcaaccccagcactgggtatttatctcaaggaaaggaaatgagtatatcaaaaatatctgtaccaaacatgttaactgcagcactattcacaatagccacgatatagaattatcctaaatgttcttcaacaggtgaatggaaaaagaaaatgtagtatatatacacaatggaacactattcagccataaaaaagaatgaaattctgttattcacagcaatttggttgagcctggaggacattatgttaggtaaagtaagtctggcccagaaagatagattctgcatgttctcactaatatgtgggagcttaaaatgttgagctcatagacgagagtagaattgtggttataagagtctgggaaggagtggagggaggggagcatagggagggattggttaaatgatacaaaattacagctagataggaagaataagttcgagcattctatagctctatagggtgactatagttaacaatgatttatcatatactttcaaatagctaaaagagaaaaatgtttaatgttcccaacacaaagaaatgataaatacttaaagtgatgggtatgctcattatcctggtttgattattaagcattgtatatagttattgaaatatcactctctatcccataaatatatacaattattatatgtgaatttgaaaaaaagttttgaaaaaagccaggcacagtgtctcatgcctgtaatcccagcaatttgggagactgaggtgggtggattacttgaaatcaagagttcaagaccagcctgaccaacatggtgaaaccccatctctactgaaaaacaaataaataaataaaaattagattggtgtggcagcacgcacctgtagtcccagctacttgggaagctgaatcacgagaatccctgctaccctggaggcagaggttgcagtgagccaagattgccccactacaccccagcagcctgagcaacagagcgagattctatctcaaaaaataaaataaaaaaataaaaaacaaaaaagcaagaacagagagaaaagggaatatagagcaagtagtagaaataataagatggtagatataaatccaaatatattaattatattaattgtaaatgggttaaatattgaaaatagattttcagagataaaaacatgtatatattaacatattctgtttgcaagatacaattgaaagataaagactcagagatgttaaaattaaggggatatagatatactatataaatactatcaaacacagaaaaatattagctataacaggtgtagctatactaatatcatatgaaataaaagaataatgaggtaaatacaacagaatatataacaatcttaagtatgtatgcctctagcagtatagctcaaaatatgtaaagcaaaaaatgatttaaaaaaatcaacaaatgcacaagcaaagtaaaaatctttaacatacttctcttggtaagtcaaaagacacagaccaaagattggtcaaagctagtgaagatttgaataaattgaacatagacagacaattgtacctagaaattctagagtacattattttttaagtgcatacagaaaacttaccaaaattgaccatatgctaggccctaaagcaagattcactaagatcaaataatagaaatgattaagaatatgttctctaaacactgtagaattaagccagaaatgagaagcaagcatttaggtagaaaaattacaaatgttagatattaagtaatataattttcaatgatctatggatcaaaatatcacaataaaaaattaaaaagatgcatatattaccactaaatcaagttcattccagaaatgcaagattgatttaaaaatcaaaaatccaatttaaaaacatcagtgtaatttttcatatgaacaggttaaaggataaaagtaatttgatcatccacattgtgctttagccaaggcaatgaaatgaaatttagaatggtaaaggaaaaaatactgtccttatttttagataacataatattacttgtggaaaatccaaaagaatctacaaagtacttgaattaataagtttatctaccaaggacgacatatgcaaagtaactattcaaaagttatttgaagttctatatactagtaacaaaaattcagaattaaaaattttaaaatgataccattcacagaggtattaaaaacgtcaattacctagaaataagtctaatgaaaaatgttagacttttacactaagaattacaaaatactggaaggctgaggtgagaggagagctggaggccaggagttcaaggtcatcctgggaaacataccaagaccccttctctattaaaagaaaataattacaaaatattgctgagaaaaaaataaagggaacctaaacataatgcagagctataccacatcatagaatagaaagacgccataggttgaataactcaatattaaggtatcaattcttctcagactgatgcattgatttaaataaaatcccaaacaaattcccaacaatagcttgtatttaatggcaactgagtccaaaatcctgtggaaatgcaaatgaattagaggagccaaaatagtcttgatagaaagagaacaaaattagaggccttacgttatctaattttaagacttactatgaagctacagcaatcaagataacacaatcaatttgtctatctaaggataaacaaataaatgaaacatatagagtccagagacagaacctacataaatacagtcacctatttattacaaaggtaacactgcagtacagatgggaggtgctcttctcaataaatagtactagatcgatggatactcatgggggagcaaatgtatttgactcccatttaactgtaaacaaaaatcaatattggatagattgtacatcaaaatataaaaaatcaagctaataaaactttttaaaataagatagaatacctatgaatgtgaggtaggcaaagatatcttacacatgacacagaaaagaatcatataagactgataaattgtattaaagttaataataatttatttcttaatattgaattaacttccattaattaagagaatacacaggcaatccacactgaggggaaaggtttttgcaatgtaaaaatatagcaaatggcttgtatagccagtggcatcatggcaaaaccctctctctacaaaaactacaaacattagccaggtgtagtggtgcatgcctctagttccagctactcagaaggcttaggtgggaggacagcttgaacccgggaggtcaaggctgctgcaattgcaccactgcactccagcctaggcaacagagcgagaccctgtctcaaaaacaaacaaaaaaaatcttaaaaaattatataaccactctaacctttgatagcacttgaaaatattacatgtattttatatttattaccttatttttatttagcatttcatgatttcccttaaggagaaacaacatattatgcatttttgtatctctagcaccatgtacttaaaggaatactcataaacatctattgataatgaaacattcagaaatcgacaagcatagatagatataagagtcattaacccatccatgcatagaagaacataactacaggtattcgtgatatttcctaaaccatataccaatccttcctttcaaagagtaagagaaagcaaagagcatttattaaatgtttactatgttccgttcaccagcctaaaatttagaattgtatcaatgtatactctcaacaattatttgaattaagtactatcagtacagatgaggaaagtgaggtacaaatgattttaattaacttgcccaggatgacataactaccaacactcaaagccagaatggtgctgtaaattaactgcaaagtgaccaaagataatatacatctctccttctgggtcttcttcattgaatacagtttggagggtctgtcaagcaaagcctacagcccatcccaaccttctccaagtgacccaaactaggcaaatcagactgtcttcctgaaaggtgatccttgagcaaaaggtacaaacgctgaattcaaccggaagagggagtgttggggagggacctgtcttccttttgtacatgttagttcgcccagctccttcggcattcatctagattctgtaaacgacgacacgcattttcagtaaattgcttttctgcttaagaaggcatgatgggtgtctacggttgtaagacaagtaccctagctgaatcatcaagaaacatcatagaacggcaaaaaaaaaaaaaaaaaaaaaaaaaaaaaaaaaaaaaaaaaaaaaaaaaacccagacccagagcagaccagcaacttgctcaagctcctccgtggcagatgacgccccccatgactgctcatttctccactctctttttctaggtaagggatagcttttgttcctgggttgctaaaacataactggagagtcttcaagtttcccttcacagcacctcagttttctaggcttttcctcagctgcagctgactttgcccaagtactgtgatcaatggaccagcaggttccaaatgcaacctccatggacttttgcaattgagcactggcggctttacattgttctgtttcataagcccctttgcccatttgtttgctcctgtaaactcctcatgttgctcagcataaagcccacgctctgaggttgatctgaaagcacaaatatagaataatggcttcctgttttccaatttttaattccaatagttgttgggctaaggaaaagggaccccttgctgatggtaagtatcggagctaaagcattctcccatcctctctgccatccccttcacaaataaacccatttcataagggcacagagcaaagccattctacctggcttttgtaagtgctagctacttcattggttctgttcagcattccaaagctaccctaacatgtctgtgttcaaaactatgttaaacatcttcaactatctgttctgctcttcatccccattgttagctcttagatttaatattacaaataatattctaattagattaaagtctaattccaatcaggaagaaaacctacttatatttgcatttttaactttataccaaaatttatattactcactagagcccaagcagcattctcacattctgcttctcggaatccctcaaacactatcagacactcaaaaactagcatgtagcaacccaggggtttgaataacaaagttggaaaaggacggccaaaaacaataaattggcctccctggtctgagccagactcagtcatgtataactactgagctggaataaataagacctctgttttaaatggtaataagagtagatgaagcattcaaataataaagtcaaaaaaatcacagaagttcattctaaaattcctaaaataggatgtttctaaaataccaaagcattgatttaactaatggtattataacccatgtggaacaaaattaaatgctgatgtaaataaggaaaaggtcattttgattcagctggagagctcctgattttgatacagaatatctgcagaggcaagtgtttttcaaaaacttctccactaagtaccataaaagtaaagggattgggaacatgagcccactggttggatggtaaacacagtagaaagtagcacacttcaagcattaaatgtcttttaaactttgtatctgtcctaaaatattatgataattttgagttataccttaacatctatctctatataattatatttatagttatatataaaatatatgtaacatatatatctgtatgaatattaaaattatttaccttagggaatttttgaaattattttttattaaactctgagtgaagtcaacacttggggactatgtgtcatattgatcctgcaaataattggactctggcaagctatcagttccccataggagcacatatagcccatgttaataaacataattttagaagactttatgtatttcccaacctattggcaagctactaactaattacatgaatataacattaggaagcatcttgcagatatgcatattcttaaaggattaaagaattgatttggctcctattagagagactcaaagtaataagggcttaaataagatagatgtttcattttttttttcctatgtaaaagtcttggctagtatggtggcctgtgttggaagccaggctctatctgttttgttctgccatcctcaacatggtccactcctctatcttctgccattgtgactacatccaagagcaggcagttgttcttccctagaaatttcaagcaccattcccactcacattccaaatgcccaaaatttagtcacatggacatacctagctgtaagagaaaatgggaagtgtaatatttaacaaagtagcattatgctctccgtttttaagaaaaaaaatctataactaaataataaagggaaaatagatactgaagaacaaccagcaatttctgccactctcagctaaagttaccagcgtgatagaaatttgtgttcagtatttagtaaaagaataatagaaattatcttctagatattgtggctaaccaggcacatgtattgactaatatcctgtaaaggtatcaagcaattagaaatttaacttaataaaaagaagctcaaataaagtttaaggtaagagtttttgataactgaaattaatgaaggaaaatattatacacaaatatcctaaaccaggtggcattatcagcagacctttaaaaattaaaccatgaggccgggcacggtagctcacacttgtaatcccagcagtttgggagggcgaggtgggcggatcacaaggtcaagagatagagaccatcctggccaacatggcaaaacccggtctctactaaaaatacaaaaattagctgggcgtggtggcacgcacctgtagttccaactactcgggaggctgaggcaggagaatcacttgaacccaagaggtggaggttgaagtgagccgagatcattccgttgcactccagcctccagcctggggacaagtaagactctgtcttgtcaaaacaaacaaacaaacacacaaacaaacaaaaacctaaaccatgagcactggaggaaaacctctttacggaaaacattaagcattaagatatatttaacaacttatttagttccagggtcaaataaaacaatgaacctttactggaatactttgccaaggtaaaaatcgatattaaaaaataatatgggatagcaagatattgtaggataggtttcacaggaagccgacatatagatggaccttagcatgcagaaggttgattgggtgcccttggaattgcacccgttaaagggaagggatggaaggagaactggacagaaggaaaagctgggttgcaatgcggtctcaactagggtttcagccagtgccctggggagatttgaatgtgactggcctatcagaaatgttccaaggtaaagcgaggatgacactgcatcaatcagtcatggaacatgggctgtgcctagaaggagctatgacttggtagagaaagttttcttcagctgagacaaattaaaggagcctgacatttgacagctgtctgctagtagcatttactgcacgtggaggaataagtctttcaactgttgcaggttggtttccccagaaacagatattcaaacatagattaacataacggatgtttaggaagtgatcttgagcacctgctaaatggaaggaatgagagcagaatacaatattaataaagaattcagcaaaccctgtgggaagctctggagcttggacgttcagatttattccctgctggagagagaaggtcaggtttttacaccctatattgatcgctcactggatgtggccatccagaaagggctatgaccttgggtgaggcaaatttcttcagccaagacaatctccaaaatggaatgacagctagagtgttttctggcagcattcctagcagcaggggaaatatgttcttcaatgcagaaggagaatcttggtgcacattgcagtgtccaccatacgagatacactatgatttcattttatggccaaagaaaaacttaaatcatgctttacatggagaacaggttcaataatttatccatgtgaaacccaaggcatgggttaccttgcctttttttttttccaaagcatatttggtaatattcacataaattaaatgtgggactgatatacgagactttactatgtaaatatttctattcctcactccttttctctattcttgccagcaaattcctgcccttattgtcctgcaataataataacgattattataaggccataagcccttagtttcctcacctaacctcctttagaccctgcgcttgaatgctgtgaaataaatgtcatccttctctaaggtaaggaacgctgcacctgcatcctcaattcctgtcagtgcacagttcttatcctcattccgtcacccccagccatcttcaaaagctgctttccctctaaatttctatattttgcacatttcacttatttagccattttgaaaatgtctttgcttgacccttctgttttctctcattacacccatgcctctgtccttttccctgccaagtttcttaaaccagcatcatgcaatcattaattcatttctactactccagttctctccccagtgccttgcaatcttacttctgtccacactcttctacccaaatatgcctccccacaaaggctaaataactttccttccttccttctttccttctttccttccttacttccttcctcccttcctctctctctctctctctctccccacggagtctcactctgtcaccaggctggagtgcagtggcacaatcttggctcactcaacctttgcctcccaggttcaagcaattctcctgcctcagcctcctgagtagctgggactacaggtgcatgccaccatgcccagctaatttttgtatttttagtagagatgggtttcaccttgttggccaggatggtctccatctcttgacttcatgatccgcccacctcagcctcccgaagtgctgggattacagacgtgagccaccacgcccagccgctttctttttggcaaattcaaaatgttttcatagccctcagacttgacttaataatcatgggcagggaacacctgttgtttctgacactgtacttgactgacgttaggttttatccctatctcccaccactcatttccactttttcctcctcccccaagcaactgacagggcaaattttccaaagttctgtctttagtcctctatctagaacatcatatctttatcattacaatttctcttcattttcataattgcttcactgctgaccattcagatctgtgtctctgttttgtcttcttgggcaatttcagcctcgatctccagccgtcttagagacatttctatttggacaaccaaatagagaatggccactacattagtctagtctcacactgctataaagatattgcccaaggctggataatttataaagaaagaggtttaactgactcacagttccacatggctggggaggcctcaggaaacttgcaatcatggtggaaggggaagcaggcaccttcttcactaggcagcaggagacagtgagtgtgagtgtaaggaggggaattgccagatgcttataaaaccatcagatctcatgagaactcactcactatcacgagatcagattggggaacctgcccccatgatccaatcacctcccactgagtccctccttcaacacatggggattatggggactacaattcaagatgagatttgggtggggacacagctaaaccatatcagatgcctccatccacttccacaactgtaatcctagaattgtcacttctagatataccatatgtactctgtctttactccttctatattcccatttaccctacatgttgcttccaaatttaattaaattttaacattttctttctttttacaaaactcccctttcacaatctaaaaactagaatcccaattcagaagcttggacctcaaaatgcttcagaatttggcccacccttcatggccagcttcaccacagctcaagttttctgtcctatactcactctcaactgaaaatctttgctcatcctgttttcctgagtggaaatggcctttcccttcatttcttttatctaaacttactcttcttaagatccatattatgtttaaactatagggcacacaccatctcttctagcctcctgggatattcctttttctatacttctatagcaaatcccaactgctcactagaatagcttgtcacacattgctttacggggacatataattattccacatgaatacatcttgtcttgatatttacgttataagtttcttagaatactccataacaaattatgcacataagaagaattcagtacatactttctgaattaaaagtagttttcttcctatctacctatgtactagcattataagaataacattataggcatacagtggaaaagtttcaagagtgaaaacaaatccacacctatgtattattaaatagtgagggacaaagtgctaaagtattatatataaaattattcacaaatattaaaactattttctttttgttggaaggttttcattttttctaaatgaaaggaggcaaacttctattaaatagctagaacagtaaatgaaaaaaagaaatggtctcttgtttttttctcacttagaaatctttcttttcatgaattattcttaatgctaagtaaactgcatatatatatatatatgcatatatatgtatctgcatatatatatatgcatatatatgtatctgcatatatatatgcatatatacatatatattccccctgaacaaattcttagttttttctgtataatttttattaaacaagaccacacaaatgagtaggaaagaaaacattttgtcatccttatgctcggacacttacactaaaatatttttgccaggaaggaatagactaaacatacatcaagccaaatggagatgcttactttaagacttgaggtacttcttatgatttaagacattagaccataatttgagaatgtttggaaaaagcatgcaatggctttgtttctgaccatcactgcataaaagtctatatatccaaaagattttacaaacacatgtgggtggctaatagtattgttttaagctacattttagttttttaaactaactttacaaacatttttgagggtagcctcaatttttaattaaaataattgtgatctttcttcttgatcatctctgtcttagcacttctcatctcaggatgtaagtccaaaaaatgcatctctttgctgcataagttattgtcagtcatgactcatttatctggtcagaattaaagaaaatagtttctactaaatgctagtgtttcctctgaggtatgtcttttggggtgtggcatgggagtggatagacacagcggtaacctttactcattcatttgatacatatgacttgagcacttcatgggcaagactctgttagatgctgaagatacagcaatgaaagagacagatacagcctttattctcattgagtttgtattaaaagagacacttggacattaaacaactagttacacaataatttaatcatgatagtggtaagtactaaaaaggagaaaaatagcttggcaacccggaaactcttcagaattagccccctttttaaccattgttgtcctatcctttgttcctatcatttattcctaggagagattttatttaaactacttataattaacaaactccagacagtctctagtgaatgactcaacatgaccctgcaaacttttcaaagagatcagagtacaagattttgaaatataaccaacatgttttgaccaaacttaacctatgaaattagaccaggataagttaaatataaacaggtttctctaggagtaaacatacatgagacaaacacaaaaaaatgtatggtgagcagttcccagcatagcctcccccatcttctcattaaatacaaacgaacactgggcaaaagaggacacattgacaacacacagaaaaactaagattgatagtcaacctaaaaccagaatctaggaggaactggcattaattataagggggttagatctggattgtgaaacacatatcaaggcttaaacacatggcatagtgaatgaataaaggctccttgacagagaggctttccccctctcagagaacaggcaggttgcacgtggacccctgggaatttctctgaaaagatagaatctacttccaggcacaatcaatgctgggagtaagcaaagcaaattgctatgaatgaggcaggcatgaaccagacttttgcgtagtactgttttgttttatgtttaatattattatccaaaacagtagagtaaggaaaataacaccagagtagcgatacactaaaacactaaatgaaggccttctagaaatggagtaatgtgtagaacagcctgcacctcatctgaaaatccaagaaagatatgagacaacaaggtcaaggacaggagcaaagacaaataacttacccttctactgaaaactctaagtcttgactgttcctgcattgtaaaagtatgagacaaaagacaaagggggaacaaaaactattatagcagaatgaaactattagaacagcatctgtgaagcttgaaggaagaatatgctttgattatgagttagatgtaacgatgtccccattactgaaacatgagatgtgtttcctttcaaatcagaaataaagctagaaggcccactctcaccattataagctaatttctgaaaggactagctaatacaatcagccatgtaaatcaagcaaggcatatgaatatttgaaaggaagatatagattcatcattttcaactagaatcaacataaaacaaagaaaaattaatactatctaatattttggtaattaccatttttaatgtaatatataaaatacactcttctaaatgcaaacatcttaaatattttcaactaaacttaaacataagtgctaaagggtcacattaaaaaaataaaaacctcagaattttactcagggactcaaaatgcttttatataagaagacttatgtaatgaatgagtcttcctgcatgggaagtttcaatattctaaagatgtcaattcccttccaactataaatattaggtactccaaataaaaattaggcaatttttgttgtggagatgagggtagagagtgggatcttgacgaatgatccgaaattcattgaaagaataatcatgagttaacaaaacattttttagaaaaccaagagtaacagatatttttcaaatgacaaaatgtgttataaaagtacatgattcttatacttttcaagtaaacacaaatgacctttgttgtggactgtaaatgtaagtatgctcaaaactgaagcagcataaaacccaggcctacattcactccaggtcccagaatgatgacagtaggaagtgcacaggttatagtggaacagaacaaaggctggtttaagagactcaccttctcctgtagcacctaacatcactattttccaaaaggaatgactgatagggccagtctctccccatcctaggtgaactgtcccttatggacatacttcatacttaaccattcaaatggtcttttggcctccttcatgctcaccatatagttatcactgatgggaatttaattcaaagtccaacaagcaataactgcattaatagacttagtttcacttgatatatcaagtttatgaagaaagaaatactttcttcacataacaaataccaaaacatacaacaaaatgtggaaggttgtattctcctctctaggaaaccttatgccaaaataaattctaagtaatcacaatttaaatgtcataggtgaaaccattaattgtttaattaaaggtacatttgtaaacattctaaaaatatcatcaaaagcaaaaacactaaaaaaatgattgagaggtatgggtaaactaaaattagttccttggtagaaaagagaaggatgactaggcagagcacagaggatttttagggcagtaaaactattctgtgtgataccataatggtgaatatctgtcattatgcatttgtcaaaagttatgggatctataacaccaagagtaaaccctcatataaaccatgggctttgggtaatgacgtgccagcgcaggttcatctattgtgataaatggatcactgtggtattggatgaccacagtaggggaggctaggcatgggtgaggacagagtatatatggaacatttttgtattcctctcaatgttgccgtgcctccaaaactgctctgaaacacaaagtttattcacattttttaaaagaccacaggaaaaaaaaactttttaatttccatggagaaatacaaacataaacaaaattttttaaataaaaaattaggaggaaagtatttgtcacatacataacagaaaaatcgttaataatcttaaaatgtaaattgtggtcagtttttaaaaaaatctgtaaatacactatgttagtttcctaaggctaccataacaaattaccataaactaggcaacctgtaacaacagaaatttatcctctcacagtcctggagaccagaagtccaaatcaaggtatcagcagggccccactccctcagaaggctctagtggagagattccttacctctttccacttctggtgtggctccagcggtcctttggcttatggctgcaaagctgcaacctttgcttttgtttaatggccttcttctctttgtctatgtcttatactttcatgtctcttacaagaatatttgtcattggattctggacccacccaaataacataggatgatcttatcttcagatccttaatagagctacacaggccctttttccaaataagttcatatttacaggttctgggggctaggacatagacttaccttttttggggccaccactagacctactacatatagcaattttaaaaatgagcaaccgatatgaacaggcaattcccaaataaagaaataaaccttttaaaaagtcatcaatcttaacagaaatcaaataaatgcaaatacaagtgacattgagacatcctttttcactctcagatgttgaaaacaaatttaaataataaatgttagtgttggtcagggtaagggatacagacatatgcatggacagctggtagatgtataaattaacacaaaatttttagagaccaaatttttaacatatattaaaagcattgaaaatatttaaatgcattaattcagcaactgctattctgtgaatttagtctaagcaaataatcacataatttctcaaagatacacatacacatatgtatacatatctacacaaagatattgcacaattgcttatactgacaaaaaatcagaataacttcaacatccaaaattaagggatttgttgaataaactacagttacatcataagatgtaatactaaagtattacataaaaatgtagatatggctgggcacggtggctcacacccataatgccagcactttaggaggccaaggagggcagatcacttgaggtcaggagttacagaccagtctagccaacatggtgaaaccctatctctacaaaaaatacaaaaatcagctgggcatggtggtgggcacctgtgttctagctactcgggaagctgaggcagagaattgcttgaacccaggaggcagaggttgcagtgagccgagatcgcaccactgcactacagcctgggtgacagagagagactccatctcaaaaaagaaaaaaaaaggtagatacgtatttactggcagtgacagagattcacagtacattattaagtagaaatttaagctctgaaacagtgtacatgcattcttattaagtatcttcatatttaatttagatttttatttataaattggaagcccagttgttccagtagcatggttttatacaagcatcttattataaattccattgcacattacagagaaatgtctggaatcccattagctgtgatttcacacatttaaaacaaattttcatgtttacgcctaactgaaattgcatcttttcttgctgacaccaagatcccctgggtgggcctccaatgttgatgaaactgggtagccaaaagtggcaaaacagcaaaggactgggaaataagatgaaggcaagtttgagttccacatgttgcgcttatttcctggataaatacggatgtacttggagttcgtttccctactgtgtataaacatgtttttttccattgtagccaaagatgacaacacaaactgttttagttcattcttgcattgctataaagaactacctgagacagggtaatttataaagaaatgagatttaattggctcagtgttccataggctgtacaggaagcatggctggggaggccccaggaaacttacaatgatgatggaaggcaaaggggaagcaggcatgtcttatatgtctggagcaagtggaagagagtcgggggaggtgtcacacacttttaaacagccagatcttgtgagcactcttcataaaacagcactatggggatggtgctaaaccatgagaaaccacccccatgatccaatcacctcccactaggctccacctccagcattggggattacaattcaataagatatttgggtagggacacagagacaaaccatatcacagaccaacaggaaaactccttttcttttttccaaattgagggagagatttatgttattccatgccatcctctacttggtccactgttattgtataaagtagttctttatataagaaagtcttgtgttcagtcaagggtatagaaaattgaacaagttcatttttgttaaatgttctttctctcatctttcgtggtatcttgttgctaaagacatttagaaagtcccagtctcacagtaatgatagaaagttcaacctaaataaatcatttcagtttttcatattttgccaagtgctcctgtcctctattgcacctctaaaacagtttcggtgtggagaatacctgtttaatttcccatctttcttttgtccctgttgctgtttgtttttcagactgggtgcttcatgaagggaaattgtgtgtctagtttcctttcccaggtgcaataccactgctcatacagtctatttattgaatgaaagaagactcaccagccccagccagaggtcaggcctacatcacaaattaggaccgtgagcacagagcagatcattcccttgagattcaggcatatccctgtggcctcactaacagccagacttttgaaagctggacaaagggagggtttggaggggaggtagtctaaaaatgtatccctgtcctatttctggattagcctaagaagcaaagagaaccctggaagtgtccaggagtgaagggtgagcacagagaggatatggtgttagaatacagtctaggaactggcaggccaggaaaagagttgcctcttcttgaagcctactaagtaccagtttgtatgtgaatccctgtgttaggtcatttttgcattcttacacagaaatacctgagtctgagcaatttataaagaaaagaggtttaactggctcacagttctgcaggctatacaagcctggcaccagcatctgctcagcttttggtgaggcctcaggaagcttccaatcacggcagaagaatgtagggggagcaggagcaaaagggagaaagagttggggtgggaagtgccacagaatttttgtgttctttgtgtgttcagagatctcttgtgaactgttggagagttcacttatcaccaaggggatggccaaagccattggtgagggatccattcccataattccaaagcctctcaccaggccccacctccaacattggagattacatttcaacaggagatttgagtgaggacaaaaatccaagttatattaacccattttgcataataaaatctccctgtgtactagaagacccaatttacttacactctacataaatgtaaaaaattttaataagatactttttttctctataactgaaaaatataatctaacctataatctgatcatttatgacacccatctaatgggtaggaggggaaaataaaactgtgctttagtccactcaattgacttggtttgaagcaataacttaattccttgagacagatgcctactttctcaggtcctcttattctcccctgctcttctctaagttggcctccaactacatgaggcaggagcataacaaacagcaccctatgacagagaggaagagacagagtctcagaatccacatagtgccccctgtacatccttgggctttgcaactgaatggctgaacaaaacagccactaccctggtgcctgctactctgtctctggtctcatccctggggatcttgctgactggtcatggcctaggatgctctctgcttggggtgactttgttcacctctcagtcatgctgaagcatctcccacatcccctggccagcctgtggccctttaacctcatcactgagagcacttgataccacctttatagtcaagtctgtaccttctgccatctaccaagatgttaatgtttctaataagaatgtctctcacctgcctctcttaaatcagtgtaacttactttgtttctctctcctcctgctcatgttttgacattaaaaccaaagcatgttacacacagcaatcacatccctcctggaatttctaggtatgcttttctaaaaacagtgttccaggaataagccttttcaatttccttccaatctttcgagtttctaataatatcactgagtattttcctcaattcaagaagattacttctctgatatgtaataagaatttccattcttcttaatgcattcatgaattcacaagtttaacccttccacaagctcctttctcatctctcaaaatagttcaaaataagacaaaaatagctagatttggggcagctcaccttgtgctacctactcacgataaatactaactaaaaggttgaaagcttgcacacaagttctctgaggttcattggaaacttacctgcctttacagtttaaagtcctggcaaaaatagataaatagacagacagacagacagacatacagatagatagatagatagatagatagatagatagatagatagatagatagataaatagatagatagaaaaatattccccatcagcgactaacctgtacaacatattgtctgttttaaggaaagacagctacaaataaaaatctccttttccaagcccttgtacactattgatgggagtgtaaattggtgcagccattatgaaaaagagtataaagattcctcaaaaaattaaaaatagaattaccatatgatccagtgatcccatttctgagtatatatccaaaggaagtgaattcagaatcacaaagaggtatctgcactcccacctttattgcagcactagtcacaatagccaagatacagaaacaaccagtgtctatcaacaaatgaacggataaaaaaattatatatatgatatgtagatatacatatgatatgtagatatatatatgatatgtagatatatatatgatatgtagagagatatatatatatccacatacacttataatggaatattatttagccataaaaaggaaggaaatcctgttatttgcaacaacatggataaacctggaggacattatgctaaacgaaataagccagacaccagaaagagaaatactccatgatctcacttatatgtgaaatctaaaaaatcaaactcatagaagagatcagagtagggttgccaggaattgggggtaggaagggggaaagaaatggggagatgttgatcaaagggcacaaactttcaattatacgataaataagttctgggaatcaagaacaaagggactgtagcaaagtgaccacaattgaagctattaatactgtattgtctacttgaaatttgttaagagaatagatgttaagtgttctcaccacaaaaaaaaatggtaactgtaaggtgatagatatgttaattagcttgtgttgctcattttacaatgcacactttaaatatgtttatttgtcaattatacttcaatgaaactgaaaaaaatctcccttaccagatgaaaccaaagtatgccttctttggtcaatgtcagctgcagaggccctggaagccatgcttgctgaaacctaagctacatcatctgcatgcctacttggacactagctaccccagtcaaagcaaagagctaggcatatccaggtgtattattgggcaccaaatgccagtatgctcatgtcttctggaggttttctgtcctaggcatgacctatgaagatttctggaggaaagggcacaggagatcaaaatatcagcattaatgggggcatgactaggttagagaaagaggttcaaacacaaggccaaaagagtttcttcctccttccttcctgacataagcaacctgctggtcacaggcagatcagccatcagggagaaagtgtttgctctgattagagctccacttgaaggacagcagagtgggtggaacccatggactgtccagctcccgaagagctgatggtcattgatgcctgcattcttcctggggtttctgtgacaaaggaccacgaagtgcctggcctaaaataacaaaaaagtatctcacaattcaggacactagaagttcgaaatcaagatgtcagcagggctgagctctctccaaaacctctgtgggaggatccttccttgtctctttcagcttctggtagccctaggcattccttgactggtggctacacaactccatatctgcttccatcatcacatggctgtctccttctgtctctgttttcgcttctttcaagaacagtcacactggattacagcccacactaatgacctcatcttaacttgattacatctgcaaagaacttatttccaaataaggtcacattcacaagtaccagaggttaagatttcaacatatctttttggaggacacaatttcactcataacaatgactaggacctttagtacatttatctcatcacttagagaatctggataaagggatatcagaattttgccttccagtaaatcagataaagtgtgccatccatggagaggatacagtgagggagaagagaagagcagagaccttcaataaagataggttcttattctatgagcaatactcaaagaaagcaagatttaaaaagaagcacagttaattttaaccttaaaatgaatgaacaaggatttactgggacagttttgacatcacctctgtgttcatttaacactttatgtgtcaatctaactatgaatataagttatttaatatgccaaaataaatttgcatgtttccctcatatataaaattatgttcacctgaaggaaacagctgattgatggttaaatattaaacatgcaagaaaagagaaaatatgttcaataatcataatttaaaaatgcaggttgaaaaaaaatgcttttgcctatcaaattttgttgttgttgttgtttgagatggagtctccctctgtcgccaggcaggagtgcagcggcacgacctaggcttactgcaacctccacctcctgggttcaagctgttctcctgcctcagcctcccaagtagctgggactacagatgcctgccaccatgcccagctaatttttgtatttttagtagagacggggtttcaccatattggccaggatggtcttgatctcctgacctcatgatctggccgcctcggcctcccaaagtgctgggattacaggtataagccactgcacccggccaaattggatatttttatgcccatcaaactggtaaaaaaactttaagaactccatagtatgcattgttattaaggttggtgcaaaagtaattgcagtttttgccgttgaaagtgatacaaattagtgatacaagtgatacaagatcgagccactgcactccagctgggcgacagagcgagactctgtctcaaaaaaaaaaaaaatcaacttcagaaaaataaagaaagaagtattcacatctggcaaagtagcatcaaagtggacttccaactcttactttagcaaaagaagatctgacttagggcacattaggggctttttgcaggaatggagcctagtttcagtaaaaacttttagatatctgtgtttggacatagatctcacaacttaaatataaaatatttagccaatttggcccaaatggttataataaaatcatgaaatcctaattaattggtctttcaaaagaccaatgaattaactacagttgtacaaagacactactttattctctattagtcttttatttctttaaaatcaaagaacagaatcaccataaatgagaaagcagcatccatttttgacttgtgtattaggcaggccccacaaaaacatcataaaggagtaaggtataagatgttattccaaaagtcttctgttgtttcatgtcgtatatttagagcaataaacattgttttgtctattttgaggtttgatttctctcctagaaaatatgatatttcattaaaccagtatgtgttcatggtttcttttcatctctttttaaatctcctccagtcattaagttgcccagaagcctttccagataagaaagcaaaggatatttgaaaataacataaaaccagaccaaattcctatgcactaaaaaacctaggaacgcataaattatataaattgtgtgttcttgttacacacagttaaaattactgtcggtgccagctgtctttacatcagagaggatattttgatctctgctgagccctatctgtgtaattatttaacattgttctttagccctctcaacttccatttatcagtgccaacatccagggtgccttccagaaaagagtaaaacagttgattttgtttttctgatttatttattaagactttcatattaatgcccaaaatattatacaatatgcaaaactatttaaatctataagttatgttaacacaaattaaaaccaaaacaaaatgtatcaaaattgagtcagagtacaaataggacataggactatgatgtgtattatttagactgaagctgactttgcaggaagccaaaacatccagttgattcaattaaagaaaagagaaactcagttgatccagatgtctggcatcataaaatccaaacacaggaatgattgattgaatctttgacgtgattcaccagatgttttagcctcttggagacagactaaaaggaaaggattcggatgggtttcaaattccttcatttctccctgggtacccagtgtgaatcttctttgtttacaatttagttaccttctccaactactccctgaaccgtttagtaatgttatctcacattcttattcagactgaatcttgggatattccaatcaagtaacagattcagaaccaagtggcaatatataaacattctggtttcctttctttctaaatatatagatagcttcatgatttctttttttttttcctctggaaagaccacatgtaaaatctaataggatcagctgacatgataggtccaggagaaaaatagttggcccttgaacaccatgggttaaagcatctcaattccacttatacatgttgagatagcaagaccaacccccacctccttctcctccctggcctactcaatgtgaagactacaaggatgaagacctttatgatgataaacttccacttaatgaacagtaaatatattatctcttatgattttaacatttcttttctccagcttactttattgtaagaatatagtacataatacatataacacacaaaatatttattcataaacatttatgttattgggaaggcttctggtcaacagcaggccatttgtagttaagttctgggaatgtcaaaagtatgttacatgtggattttcaactgcacagggtggttggcacccgtaactctcatgttgttcaaatgtcaaatgtattcttgagaggcattattagcttgatttctctgcagtgtgaacattggctgttcagattgcctataatcagcttacttcatattaaatcactaatgagttgatggggagataaactctctctcaaaggaaataaattagaaactgacaattacagaaacaaagagaagtgaatgtaagagggtctcttcatagaaccacccatgggatgaggaggtttgcctgaattctgaattgtaaaagcccagctcttatttggagcatgctaaagggcagaagccacccagggtgtaggcagaaagattccatcctgtgtgtaacaatttgaaagaaagaaaattgatgattctattatatccccacctttggcctgaatttcccatccctgagagcaatgtgacgacaacgctcacgttatatagctgggtacagcgtcccgtgcattctttcaattgattagcttaataattctttaagaaatgtatttttaaccccatttcacttaaaaagataaaggtttgcctaaggacacacaacagtgagccatgatccaggacacagatattccaactgctagtcttactcagtaccacgactgactctgcaaattagttataaaagaaacattgagacttgttccaggaagacactaggtaaaatacacacccaagaagtttctttcccagaacattatgaacatagcacccaagagttttatttatcagattagtcagtcaacaccttgaactttaaaggaggtaaacacagaacaagcctacttgggatccaaaaactactataaaatctcatgtatttgaagataaactttgctgagccaaacttataattatgaactcaaatattctggaaaacaaattttaaaacatttctgccccaaagagcaatatactgagggaaaagcccatggtatttcttctctctctgaatttctagaattctgttatctagttaggttttaacgtgccatataatgtctattcctagaaggcatgctgcctgaagatatattttgatgttctaagttaaattgcaaagagtaacagcagtgtaggggatatgtaatctatgggctttatcctgcctgaaagggccccagattcaacactctaccactgatttcatctgctttctcagtcaacatctttttaaagcactgtatcctcagccaaccatcaaacttcttagctttttcacccataatcaacccatctcaaaaatcaccaccatcactgaagctttgagaagaaaaatctcctctttggtgaacacttttgtttacccagcatcattttgtttttgtttgttaacaagtgttgctcctccacttggccaggtatttatgatttgattctactcccctctcctggcataaggctaaacacatggctaaattcaaccaatcagagaatagcgttctcaagtcaagcaattggttttggcaaggactttgatccataccgagccaaagagtgtccgtccaagggcttttgctggcactatcagagaggagggtttctctcttctctggtgtcaataactataaggaaaacatgtctaggaaagagaatgtgaaacatacctgaggaaaagccaataaagtggaaaacagagctgaagatggaacgaaaaacatcatctgacctcccagcccacctatccctaaaagatatcacaactacctttgattcttcagttacatacatgagaccataaatgcattttcttttccttagggtactgtgagttgggcttcaaatttttataatcaagacttctgtccaacatactcttcaacctaacctttaagcattcccagtactcaaattcctgaactctttaaattatagtgaggccaaactcattttaaacaatggagctttggaatcacaggacttttaattgacatggcagccatgaaaatgtgactcgatctatcacaataaggaaagtacttgattgatgtctccagctgcaatgtccagaatctaccaccacttttgatccaaagccttgcttctcacaagctgctcccagccaatgactgaatgacacagggctacttagtaagccactcttactagaggtggaacagctccgaagagtggcattggttggagagctcactgtcaccctagtcctaggctttctggcttttattcctaaacagtcatactgatttctattacagatggttacaaactgtgttttccaccagaaaatggcaatgttgttccaaaggcaaaatagagcaaaacataatgactaatgaaggggccatttgttgttatctctaggggttcaatgccaaaatgcaagaaggaaaaagagagctactgcaggtattctgcaagaggtgaaaacaacttctgccttttcccctgtcttattgccttctttgttttctttttttttttttttcactcagtgtggtggcaggagcaggttcaagctacatgtgaagaggtaataaatgtcatgttaacagcatgcttccaaagagggctttatttcatgactacccacttatgcaaaacacatggacttcaccttgccctatagaaatgtttttcattccacatttatatccttaacggaacaaatgaaaccttgtaatgaaaattacacatatgtaaatgaactactatattgatatgctatattaattatgccatattaaattatctcaaataatatagatgcttccatattttagtgtacattaagcaagatctgcctataattcagtgtagatgttgaggactgaatttcttttttaaaaagatggtgttttcctgtccaagcattcattttcatggcttcaaaactacctaagcataggtagccaaaataaataccttatcctttacagggggaaatgaaatggaaatttaaatttaaattgagaaatccttgcctgttaaagttgtgtttgtttttgtgaaaataaataagacacctatcatttacatgcttcagtatgaaacacttttacctctctctgttgccaatatctagtgagctaaacccatagtcacaaatggccagcttgatgattctatttatggccaaaatgttgttatttgaaatgataaagaacatcccatcatggctagtatttcagctttctatggctaagtgtgttcactaaacatataataaaatcaacacatttattgtcatagataagacctctaattagtgaataaaattcaaattcacaggggttcttttgcgtgcggtaggggtagtggtggaaggcttctcacagaatactgtatcatctgcttgaaaactaaaaaataccaacatcgtcaaaaaccttctgagattccaatcattgatttaaataaataaataaatactcattaaaatgcaagctttcaaaatgacatcgaatttggcatatgtacaaaagcatctgggagaattaaaatcaaagtttgagttacatgggctctggttgactttatgctgctaaaagcactggtctttgagcacgccccaaaaatgcagctacatgatgcaatcgtattagcaatgtagtaaaacgcactgtatgaaataatagatttttacaaggacaaaggccatatgtaacaaaccatttttttttcctaaattgtctgtgagctccattgccctatggatgaagctgctccataattagtcgtggtagtccggagatttccctgccttgcaatgccacacaagcccctgttttcgtttatgggagccaatgattcatagggtgcaccgagaaatcttttatcaattagttgtgaaggatcatactcccatcttgatttgtatcagcctgggtggaaaccacttttgccgaggactgtatagttcaccaagatgtgctttcccccaccccccacaaccccactcaattctagcttcgtttcccaagacagagtgctgctgtacgtggaattcaagaaaacaaagtggttctaacttgcagtcgattctactggggaaaataaatcttgcaatctgttgctgtgttaagattaaagaacatcaggactagggaaaaatatactctgtgtctagctggaatccattgctgtcacacatgacaaaatacaactcaaagtaaatatgctttatttggcatatatatatatatatatatatatatatatatatatatatggaattttggctttactacacggagccttttaacttttagccaattgtcatacagaatacagagatataagtatagtaaacatagcatgatgtacaatttcacaaaaccagaaatatttccaaacatgccagggcatgacagtgatgtagtatttcaggactgctttttgtgtaaccctgtttaccaagcttaattttcaaaatgacaaaccgcttccaaaactagcaattcttccatttcccgctaattggtgtctacaataacacactctcctccatttatggagctgatgctgcagatttgccattttccaggcccaagtaggtagatcatgaatgagcctgtcattagcagggatacatttgtgcttgtagaaacaagaggctatttgccccttgtcctcaatcttgtgaccatcagcacatatcagtaagatggtgggctaggaatgggggtgcaagctatggccatggctctggacttgtggatcctcctacaaccttgaccttgtgaaagccactgaagacaatatccataagtcactggatactgcagaactagagcaaacagctattttctgggtcactgccctatcccatcaacaattcaaaacatgacattacaatatatgtcacatcttctactaagtttacttttgaaaaatgattatatacacagaggaaaagctgcttgacaccttctcagacttagaagaaccttgattaacctgctcagacaccttatactatgttcaagaatattgaggcagctatgacaatatagtaggaaaagggaaacaaatcactctgcaataatcaattcataggtaattgctaaacatatactatcaagatatatacaaatacgtatccacttcctcagatatgggtctctaggaaataaatataaagataactacttagtttttttatttttttactttaagttctaggatacatatgcagaacatacaggtttgttacataggtatacatgtgccatggtggtttgctacacctatcaacctgtcacctaggttataacccctgcatgcattaggtatttgtcctgatgctttcgcttcccctgacccacctcgacaggccctggtgtgtgttgttcccctcctgtgtccatgtgttctcattgttcaactcccacttataagtgagaacatgtggtgtttggttttctgttcctgtgttagtgtgccgagaatgatgatttccagattcatccatgtccctgcaaaggacatgagctcattcttttttatggctgcatagtattccatggtgtatatgtaccacattttctttaaagataactacttttgaagtcttgttgaaatataaacaaactagtacaaagggtttctaaaaattaatattattgcagggcaataaatctactgctaacgaaacatacatcaataatcagtaccccttcaatgagaagttctcaaatactccattatatttaggattttgtaggcactgatgtttagaaatgcttttagttgtaaaaagcatattataggaaggacaaacactcccagcaatacattagcagctatttatacttttatgtagaaccttcaaaccataaagatcattgtttagctatcattttatgattcttctatgaacatgaacatattagttttgttcttttgtgggatgtgaactactagttctaaaaaagaaaaaatataataggctatcagaaaaggacaacttgatcattgagaaagatgtaaacattgtaaaatataagattttattccaataaaaatatatttgcaaggaaaatacttggaaccctaggacagagctaaatgatgcttccccagaaaacatcaaatactgaagcatttttgaaaatgtttggaaaaacctacttctaatgaatattacaacatttaccacagggtaaatctacattttgtggagcctttacaaaaaaagaattcaaaattgtaaaaacacaattaagtataaaagtgaatgtttatttataataagaaaataaatcacggggatcacagttttttaaatgtaaaaatgtaaaaaaaaaatcacaaaatctgaggaaaaacattaaatttttattaatcaaacacctgctatgcctatattagacttttttcctacatcgtgattgcatactcttctatggcttttcacatgcaaatgatatatttttcatggagagaagaaaaaaaaggcagtctttcttctagcatggctcaatttgtttttggggttttggggggagttttttggtgttgttgagatgtagtctcgctctgttgcccaggatggagtgcagtggcactgtctcggctcactgcaatctctacctcgagggttcaaatgattctcctgcctcagcctcccaagtagctggcattacaggcacgagccaccatgccaggctaatttatatatatatatatatatatatatatatatatatatatatatatatatatatatatattttttttttttttttttttttttttttttttaagtagagatggggttttgccatgttggccagactggtcttgaactcctgacctcaagtgatgaacccgcctgagcctcctaaagtgctggaattataggcgtgagccaccatgtccagcttatttgttattattgacaggttgtaaagactccttccagattcatggtgtgctttttgtaatatcagataggtttctgaactgtcacatttgggaaaacctctgtctctcaatcttcacaccaaaacatgtctgttcatcttgataaactccataaaattatcaagagaaaaatcacatttagttcacactaatatcattttaagtactctggaacactttttgactgatcaaactaatcacaaatgaatatgatatttctaaagaaatttatagtgaaattcatgttcctttctatccttcatatttttcttaaatgacctattgaatatattgactcatgtctatttttaagttaataatatgatctacttttgtaataaaatcaagaagttaatgacttttgaagccgaaaattttttaaccttgtaggataaaaattataatatattttaataagaacacatgatgaaactgaataaaatggaatgctgtatgacaagtttgaaccagctcaaacctaatgttcaagacagttgaaaactaaagaggaagttaataaatttctgacgttaaaattgacccagttaacatcttatgtattttaagaatatctctcatttgattttattctgatggaaagccaatctgaaagcaaaatataatccattaaatatgattagaatcataaaagttattacagtacttacactgttttgtcaatgactagaacacctcctattatcttgtaatgttttgcaaaatatatcattatttggttgtaataagaagttttaaatctggagagttatttttgctgctaattcaagtcaaatcaaactgctatgcattctcatccaaaactcagagatctttaacctctagtcagtaaaagtcacggctgataaatatttatagaactcctcaccaaagcttctgtttgttacaattttctccaagaatgacatgacctaggaatttcctggactcatgtttctgttgtgatctatagagttcagaggcctttgccacatttaaatataaaaccctagggagaacctctcaaaatcaaattaagttttgatgtttgacattcatttcacattgaagccactttttttgtttttttcttttacttttcatctgataagctaaaaggtcacatatgagataatgtattatagaagatgaatattaaagtgatcagggccgacaattttaatgacatcaaaaaagttgttcatctttaaatttctattttattactctgttttcccctaggttccttccaccctacccttcctcccctacatacatccaggcactccctcacctttttgcatttagttttgaaggaaaactctccttccacttgtttaaagctaatttgagaccaatgaataaaccccgtgccctcctgccattgtctggtatcttgatccataatttagcccttctttacttaatttttgactccccctttctttagtcactatcttcaaatctctctcactttcaagcacctgccttttatctcatgtccctccctattgacttccctctctctctctcattcccatcagaatcaaggatctaggacatgtcaccttcagatttcatctcttataacttcttcatcttcaacacattctgaggaggtttctgccgctgccaatacactcaagcagctcacagagacatcacaaaagcctcctatgctgcaagacccaaaggacatctctggtgctgtattttatgtcagcttcccatgacatctcttgaccacttcattcttcctgaaattccaccctgattccaagcacctctctctcctgattctctccctacaattctctcatcactccttcagtctaacagtgggataccctacatttctctcctcttctcccttgtcatcttctctgtcagccacctcattcatctttatgatagcaactctaatctatacgcgctgatggactgtaaactgaatctccaccctagacctctcctgtatatctaagttatacttcccctttcgtaagagacatcacacctgcaattattgtttgaagacttcctttatgactattagtaacttcacaaggacagagactatctctgtcgtgttcgttgctgagtccccagtatcaacctgggatatgcgtctgaaagggactcaatacaaacttgctgagttgaatgagttgatgttccatagacacgttacactcaatgtgtcaaacatagactcctaatcttgagaaaatagccaccctctaaaactggtcttccttctacatttcctgtcttgattgaatttcactaatatccctccactttcttaagcccaaaacttgaggacagttttctgactcctctttcccttacctcccatggtgaggcactcatcaagttcagctaattcaagtatctctcttgaatgagaatctgctctttcctttattgccctaggattctaactgcatccaggtaactagatgtttccatctgatctttttttccttgcacttccccatgacgacctcagggctctttataaaatgcaaatcaggtcacatcacttcacagctgaaagcttttcagtggttccccaacaggtttaaatgtcttagtcctttttaacatgattatatgtgtgtgtgcatgttcacgtgaatgtgaatgtgtgtgtatgtatatgtgcatgtctatgtgcatgtgtcaatctttcctgacttcaccctatttgttcagtctttcttcctattgctcttcccttactgcttctaattttgctccagcaataccagataatttacagttccccaaacgacgcatattgctggaatgtctctgacaggtttgtcttgattcacagaattcagttcagaggccctacttctcaaaggccacccctggttcctcccactctccatggctaattgctccctcctccattctgttccacttctcagtacttacttccactgttgccttgatgaccctggactctgctgagtatatcatccatcaatcccaagtctttttttaaaaaatagtctttatttcctagagctgtttttgtttcatatcaaaattgagcagaaagtatagagatttctcatatccccccctaacccaacacgtgcacagccaacccactatcagcatcctactccagagtggtacatttgtttaaactgatgaactaacctttatgcaaggtattagtctgttctcacgctgctaataaagacatacctgagacaggtaattttataaagaaaaagaggtttaatggactcacagttccacatggcttgggaggcctcacagtcatagcagaagttgaaggagaagcaaaggcatatcttacatgctggcaggcaagaaagcatgtgcaggggaactgcccttttaaactgccctttataaaagcatcagatctcatgagacttattcactatcatgagaacagcaccaaaaagacccacctccatgattcaattacctcccagtgggtctctcccatgacaactgaggattatgggagctacaattcaagatgagatttgagtggggacacagccaaatcatatcacacatcatcactcaaagtccatagattacattggggtttacttttggtgtgtattgtacagcttttgacaaatctataatgacttgtatccaccattacagttcatgcagagtagtttcactgccctaaacattctctttgctttgcctcctcccccgcaacccctgacaatattgatctttttcctatctccacaattttgcctttttcataatatcatataattgaaaccatacagcaagtagcctttccagaatgtcttctttcacttagtaatatgtatttaagtttccttcatatagtcagtggcattttatctttgctttcctcttatctaagatagttctggtcatagaacaggtatcaaataattttagttggattaaatctataatttgttgtgattgtatagtgatttgcatgttttcttccttgaaaatatattgttctataattgtctgacttctatctcttattttaaaagaaaaaagagtaccaagcaaaaaaggactttaaatctacttaatagtctcttttaggtttttaagcacaattttaaaagatgagggatagtattttccaaatgtaatcctgagatttgcaaatatacatttgtgctttcctttgaattagaagcaacatgtgttcattgacaattgaacttcttgtttccttaaaactgtaccttctgttgcacttagttccttctatcttgaccatctttccccagtcatgcctttcagaatgaaagatagccttaaggttgacttgataaactaagcttttatctatagcagctattttgccatccttcatagaattctctgaatttatttcaagagtaacaagtcaaataatcattccactttctatcaaaattaagagtattttgacctaaaataaacaagaatgcttggctaatcctactattgaaactgattatttgtatcaccatatttcattgtcatgtgaatccacctcaactacttgaaagcatacacactaatccattatttctccactgttggtgaacatcagctcctaaggttaatatcccctggccacagctcagtagacatccagtaggaaccagcaaaatgcatctttaacaagtatcccaggtgattctgttgcagatcatgtgaggatctgatttctgaaatgccgtacttcatatcagaatacttggaagctagcggctactagcaacaagaaacttctcagtgaaagtaatgagattgatcatctgttaaatttaatgctctattctaaatgaaaattgcaggagcaaacctaattgatttccatgcattaacagggggaaaataatcaaaatgtctctaatacctcaatctgtaggacagtttgtacttaaaaagacaatttttttttttcactagtgtggctacactctgggtgagaaaattttcaagagtctgaaactcaagaaaattgtatcttctagaggtaggttggaaattttgagaatgtgttcaaaatctggaaagctcggatgttatttttcccacaagattagaaatatgcttactttgtcagagaatcagcaattgcatttaagtctacacagggaccagaaaggtttgtatggctgagaccgattaactgaaatccaaataacaaaactctttttgttacctcctctgctgaccccactccctttctcagcacgagctcagacacatataagtgacttcattcttagtatctcatactgttttactaattagttgtgccagtgagataatcttgatatgcttgctctctactcttaaactgatagacaataacaaaattatgttctcaattaaaggaaagtaactggtaattgatcagctcacagtgggatttgctaaagcatattgtgactttgagctgaaagcacatcataatcaaggttcttagtaaaggaccaggaacaagctaatggtcccagggctttctgaaagtgtgattatgtttgcttttcttcttgaatataataatgctagtagaatctttttagtagtccattttcacactgctataaagacatacccaagactgggtaatttataaaggaaagaggtttaattgactcatagttccacatgtctggggggcctcaggaaacttataatcatggcgtaaggcaaaggggaagcaaagaccttcttcacatggtggcaggaaagaaagagaaagcaaaaggggaggagcacattataaaaccatcagatctggtgagaactcattatcatgagaacatccaatcaccttccaccaggctcctccctcaacacctggggattacaattcgagatgagttttcagtggggacacaatgccaaaccatatcaatcttttaaaatgcttaatcaataagaagccgagaaatagaaaaatctcatgatacaggaatgaggcacagactaacttagaccaatgattagagcaggacaaatatgcaagaaagtaagtgcattgaacattaatctaccaagcagagaaatttgatttcaatggaagtttaaggtttaaaatcatcctctgactaataggaaagtcaggaatatttttagcagatgaacttcagacacttgtgtagtggttggaaacactgctatctttaatcaggtgccaaccaattatactgcagggtcaaagtcaaccccttcccccaggaaggacctttctcttatcactattccccctctctaaacatctcctaaatttaagactccaaaagaaaggaaaaaaaaaacacacacacacagaggtgagaatacaatgcattatttatttttcaaatgtacagttattaagtattttagggggagagataagagaagaaaaataggtagttttgaagtatttataagcatattttatattttagcaatctctagttcattgccagtaacctctcccctctcttccaccactgtgacttaagttgaatatgtaggtttatccacagaaggacagcatcttttatcagcttggtgtctacaaaaacaccttgtcatttctgatcttcacatagttgggcagtaaatagttaatgagcacccaacatttgtaagaaactgtgtcagcactattcagattgcaaatattttcaggaatagcctttatccttatggaatttagatgttctagtaggaagggaaggcaaaatgtgcaaagccccatgtattagtctgttctcatgcgactaataaagacgtacccaagactgggtaatttataaaggaaagaagtttaattgactcagttccacatggctggggaggcctcacaatcatagcagaaggtgaatgaggagcaaagtcacatcttacatggtggcaagcaagagtacttgtgcaggggagctcccatttataaaactatcagatctcatgagacttgttcactaccatgagaacagtatgggagaaactgcccccatgattcacttgtctccacttggccctgcccttgacaaatggggattactacaattcaaggtgagatttgtgtggggacacagccaaaccatattaccccactatggtgaaaagaatgtactaggttggttatatggagatacacctcacatttgtttagaagataagacaaggtttccctgatgaggtgacactaaagttaggcacagaagaacaaaactaaaagattcagattgacaaaaatgagaaggaggcaatctggattgaggaactgcttgaagaaaagcagagtaataggaaaatggaataaatagagcagatacttgggagtgtagaggatgcaaagagagaaagagaaataaaactggtattgtagagagcagttaaacagattgagtatcttcaaaaccaggctaaattgtttgaccatggaaggatgtggaaatacagcgggatataacaatttctgagcatctgcagtgtgccaagtaatgagagagaggcttgtgaaacctacatccctaaacatcaacacggagtgagaactgtcctcaaaaatgttagcatagtgcagcttgtcagggaagtttgagaactgaaaagccaaaatttcagggaaacaaccaacaaccaaagatcatttcagaaataaaggaagttttaattcaagcattggtgaggaggggaaaatggaggaatgctttcttctgccattttgatacaatagttttctttacatcagcattttcaccatgagaacattctgaatgtgggtattatcagaatatacaacaactggaggattttgaaagggaaaagtgttctccagggcataactccttaagccatcttaattccttgatcagttttctatacggaagaaactgttcctaattttttcatttttattcttattgcactgaaattatcttaagataaattctttttccatagagaaagttacaaaccaataactgacttatcaatcaaatttttttaatgtgtttgagagctttttgtttgtttgttgtattttggtttctgagacagggtcttgccctgtcgcccaggctggagtacagtggcacaatcatggcttgctgcagccttgacctccctgggctcaggtgatccttcaacctccgcctcccaagtaagtcggattacaggtatacaacacaatgcccagctaatcattgtatttgtttgctttgtagagatgggttctccctgtgttgcccaggctgatctcaagttcccggcctcaagcgatccgcccatctccacctcccagagtactaggattgcaggtgtgagccaccctaccggcctgttttatttttaataacaaatttttactcatttaggttctattaatgtgaatgtattaataagttcttcagagaaatagaacgaacaggagattaaatgatgacagatatatagagagagatactgaaatgcattataaagaattggctcactttatcatggaggttgagaaatgccacaatctgccatcttggaaaccccaggaaatctggtgatataaattccagtccaagtccaaaggcctgagaaccaggagtgcacatggttggtataagttctagttcaaaggcaagagaagacccaggtctcacctcaagcagacacagagacagaaagagaattcagctgtcctccacctttttgttctatacaagccctcaatcagttggatgatgtgcacccacacaggccatctgctttacatagttcaaatgctaatctctcctggaaatacattcacagactgatatggtttggctgtgtctctacccaagtctcaacttgaattgtatctcccagaatttccatgtgttgtgggagggacccagggggaggtaattgaatcatggaggccagtctttcccatgctattctcatgatagtgaataagcctcatgagatctgatggatttatccgcagttcccgcctttgcttcttgcttattttctcttgctgccaccacgtaagcagtgcctttcacctcctaccatgattctgaggcctccccagccatgttgaactattagtccaattaaacctctctttgttcccagtttcaggtatgtttttattagcagtgtgaaaatgaatcatacatagacagatccagaaataatgtttaaccagatatctggccatctcatgagccagtcaatttgccacagtaaattagccattatagtgctcccttcagcagcactatactaaaattggaacaatacagaggagattagcatggcaatttgatttataaaatcttttaaaataaataattaaccattacagtgatttttcttttgtgggcagtaattccaccaagtccaatttacccaggttatatttttaagaatctaaaaattgtgtcaagatttgttttttccaacaatttgttaaaaatatcaaagtttaccacttgccctttagctatagctagttttattttccattaattacactactggtaatgttcatgatttctaataatagactgatggtttgtatgtttctcaggaaattcgttagaaatttgtgagaaaaaaatcttcagatatctcaatagtgataaattggcaaaattacttaaggactcagaaatcttatttcaaaggtgtccctaggtaccttttccctcacacataatgttcttggtcccactgttcttgatcccttacagattagacaagaacaatgggatctaaatgaagccaccttcactaattaaactatgacagtgagagaagtctagcctggctaactccatcttgcttctagcctgacaagtgaactgcctttgctcattcctgtgtgtagaccaaactaactatgggaggatttttgtttatagtttaactgtaaaacaaaaatgatactagttcctttccaaaactaaccccttccttgcttgaggaccaaagccacccttgtaaaacctaatgaattggccataagtttagaatgatgactcaggaatcatgtagctagaggtcacaagattagtaacctcccagattgctcctataggtcacatcgctattatgaaacctaggactggtgtttgaagtatttttcagaccttgcattctgatggaccagctggtaccaccaagacaagtaacccatacctagaaattgactcagccagtcctgtgaccctcaaactgactcagcacaagacagcttcaaccccctgtgatttcatccctgacccaaccaataggcattctccattacctagacccctacccaccaaagccatccttgaaaaaccctagtttccaaattctctggcaggcagatttgcataacatgtcccatctttctgcttgattggccttgtgattattaaactctttctttgttgcaacatctgctgttctctgtgctttagcttttctgggaagtggacaagaagactccattgggtaattacattcagtttcataaattgtgggtttaaaatggaaggatcaggccaggcgtggtggctcatgcctgtaatcccagctctttgggaagccaaggctagtgggtcattgaggtcaggagtttgagaccagcctacctaacatggtgaaaccccatctttactaaaaatacaaaaattagccaggcatggtggttggtgcctgtaatcccagctatttcagaggccgaggcaggagaattgcttgagccagggaggcagaggttgcagtgagtggagatcgcaccactgccctccagcctaggcaacagagtgagactccgtctcaaaataaaataaaacggaaggatcgaaacactctactccaatgtgaaaaccactaaactagcagggctgagaggatttccagctggctagatgtagttgggaagaagaaaataagcaaaagatgaatttatggttttgaaactgggtgacatgtactattaacagcattaatgaaatcaagaattactcgtcatgaaatctggcatggattcaatgataaaatcttgggcatttttcctgacgtgtcatgttctcagaagaacacctcagaggtatagaactggaaatcaggtgagcagtcaaggttggaaataaaatgtggattacaggtccagaattaacacacagttaattgctagtgaatgaaacaaaaaacagaacatagcaagaaagcaggaatgagcatagaactttagagtcataggggaggaaagctagtgaggacaacgaaggaagcttggtcaacaaaaaggccagagaactggggagtgtgttatgcagaacccaaatgttttagtccgttcttatgctactaataaagacataccaaagactgggtaatttataaagaagaagaggtttaatggactcccagttctacatggctggggaggcctcacaatcatggcagaaaacaaagagtaaggggcatcttacatggtggtgggcaagagagaatttgtgcagggggacccctctttataaaaccatcagatctcatgagacttattcactatcacaagaacaacatgggaaagaaccccacccccatgatccaattacctctcaccaggtccctcccacaacatgtgggaattataggagctatgattcaaggtgagatttgggtggggacacagcaaaaccacatccccaaaggaggaagatatttctgaaggagaggaatggccaagagtaagaagcacaaaattcatcctctactcattcagcagcagtcaatcacagctatgacttgggaattttgataagtactggggggaaaaaaatggttcctgccctcaatgaactcagagaacagacaaatacaggaagataagtatcattaaacaggaacacagagaaggaaggattagcaagtaatttatttacaagtctgtgaactctaaaatggcatgcacataaaatattattaagaataaaagatgagaaaaggcttctggacttgaatttgaggagacagatcatcactgactttcaaataaaatttcagtcaaatggtgtctttctccatgcctattttgcttttagtaccacagaaaatctgcattgcaccatatcaaaagaacaaaagaataactgattctctgagaactcatctaaattaataacccttgcataaagattaagaatcatggtaccagtgatgagactaactaaatgtttaatcccaaaatgattggttttgacatggcttctgaatttcaaagttctgcccctggtgacattgttctagccctttaatattctttctcaaggaaatgccacagaacactaatgattactaattgaaagaaacagtaagcactctattgaaccatttctcaaaggaaaatatctaatgagttacattaataaaaatagactttgaatgtttatgataaataactcttttgcattttgtaaagtgaagtttgctatgttgtcatgttctaggttttttgttgttgttgttttttggcgagttcaatttttgaggcttgactgaagaaagatatgcaggattcagtatggcagagttgttctgggccaattagaatggatagaggaagaggcaggagagtgagccaagcaatgggtagaatgctagcaaaatttaaggttctataagaacaagtatcatagcctaggaagagtatagagcaggttagtagcacaggagattatgctagctaggttaatggttctttgaaagcaggaaagactcaagcaatgatggtcatagtaccagggaaagttccaagtaatttattattttttttcctgttgattagagactttcattttgggtacctgggtactttctcatccagtattattgtcctaaatgaaaatttcttggccaaatatgaagtgcttacattttaaatctcaggcttcctgaggtaaccattccacctcttttatacagaactcttatccttccaaaattaggcccttccacctcttttatacagaactcttatccttccaaaattaggccaactctaattttgtacagccttgagtttagtctgaaggtcttcaaagtctttgtagagacttcaagctctccatgagcagaaatcttattcacagtgattaaagcactcttaaggccagaatggggtcccctacaataatggtatctattctcaaaacttggtcattttttccattagtcattgatcaattaatcatcttcttaaacagtatatatactgtattttccatttaccttctggctcttttactattactttgtatcttggtcttatcaatataatcatggacaattccttaaatatactttttttttttttttttgatacagagtttcactctatcacccaggctggaatgcagtggcgtgatctcagctcactgcaacctttatctccaggttcaagcagtcaagcgattctcatgcctcagcctacagagtagctgggattacaggcatgcaccaccacacccagctaattttagtagttttaataaagatggggtttcaccatgttggccaggctggtctcaaactcctgaccttaagtgatctacacacctggcctcccaaagtgctgggattacaggcatgagccaccacactcagcccttaaacacacttttaccttcccttgtgtatgtggtccagagctgtgcacatgttgatatcccactgaaacctgttgatttcatttgaaatttctgacatacataagagaagtctccatgttctctgattctgcacttagtttaattcttaagagatgactagatctcagcaaacctggtggtttctttttacttgtacttctagtaaatgttaatgatacaaatacacagcttttaattacagtgaagatattacgggatttactctttcaatcagccaagaatcaccagctgattctgattcagtaaaaggtgaaagtttctaccaatcagaacaatgaaacacactatgtaagcagtaatcttcctatgcattcactgctttattcaacaagcacctactaagtgagtgacatagtaaattaaatccccccactcttctactttcttcatgaggatggtagttcaagcgcaaaatcttaggggaggaaaggaaaacatactagtttcctattgctactgtaacaaattaccacaaatttagtggcttaaaacaacacaaatttatcatcttacagctctggagatcagatttctgaaatgagtctcactggactaaaatgaaggtgttggcaggaccaagttccttctgggaggctctaggggagaatccatttcattggattcattccaaagaattttattgcctgcattccttatctcctggcccccttccatcttcaaagccagcaatggcagattgaatccttctcatatcaaatcattctgacttctgcttcgatcatcacgtccccttctctgactttgactcttcttctgcctctgtcttctactttttaaagactttgggcccacccagacaatctaggataacatctccatttcaaagcctattcacaaccttgatttaatctgcaaccttaattctctcttgctatgtaattcagagtgaacatatccaaagctttcagagattaggacataggtatctttgaggggtcatgatgctacctagcaaaagaaaaacaaggaaaacttagacttattgcattccagttgtatcaggcactatgccaggtgtttttaaattcgtttcatatccaggacaacctggtaaagaagtattcttatttccacttttgcacatgaaactgcagtgcatagaaagtaagtcgcttgccatgtgccacagcactatcaagtagtagaacttgtattgaaacctgggtccatttgactccaagatccatggttttctctctaccatgtttcttctccagcaccagagtcatttaaggaactggccatccagcatagccattgccaacaatctacattctatattgagcaggagggcctatccacgacttacaactgaattctgagttactgacttgtttattattaggtagaaatacaggttctaccttcaaaaaattgcattctggattactatattatgtaacattacaagaaaatcaatagtatgaaagagtacataacaagtgtttactccaaatgctaagggcttgaggatttcagaggaaaaagaatctacttgaaacagaagttttgctcatggatgatttggtcttgatctggaaccatggggagaatttgggtggctacaggtgggagggtgtagatgacataaggcaaagcaagcccagtgacatgctcaggggatctgaacaaagcaatcccttatcaacaagtagtgaatgaacacctacaaatgtgccagtcactgaccagaaaagaaagagagaaaactaaaatgacaagcagagacataaaagactaaacatctaggcaacagagtaaacaggaaagtaacatgttgaaaaccatttggagatagtgtgtagaatctggaagaggagagatgaggtaagaagcttttgcaagaagccaggaatgacatagtgtgaaggcctaaaccagagtaaaataacagagaggcaagacactttgggcaggtggagaagacagggggagggagacattacagatagaggtcacagcgacatgtccaacacttgagcctacgaaagtatagagaatattctactaatataaaaagtcagacaattgagctgacctgcagtgatttgtgataatggatttgatgggaagcatctgaatggcatcaaatggaaagcttccagctgcaaacagacacgcagtgttaaaactaggtcttgcagcgtttgaagaaaagccggaaattgagacattcatgcaaaatatcaagatctgaattttaatcttggccataacgaaaattttccaacacaatgtaagtcaaagcagacctaggcatgagacagacctggcctgagagcagaccctgtgaggatacagtgagaaggcagggatctgcaagccaaaaacaggggccccagaggaaaccaaactggcccacatcttggtcttggacttccagcttccagaatgtgaaaagtacatttccattgtgttagctacctggtctgtggtagtttctggtagcagccatagcaaactcatgcagggatgtatcaaccaactctaattttaacaaaccgaggagcactgcccctccacagggcgataagagagcgggcattagagagaagaagtgaaaagcagagtcaattcattcaacaaatttgatcatcaaaatagcatgctaactagtatctttgctcactgactcactcatttctgaggctcataaaaacaaacctgaaatgttacctgtctgcttaagcagtctctcagggaagtagcgtaccttcccaccttgataaatactgttttgttggcaatgggtttcggctcactagttctcttccttctgtcgctggggtctctggagcccggtgctcctaactcttctggcatttgggcctaagcagtcctgagactctcctgaatccccagcaatgccgcctccccttatcttcagtgaaggcttctctgccagcctctggttcatccctgaggctggctcttgtttaagccagtccaggttccccctcccaaacaaggctggagagctcaggaagctaaaggaggagcactgtaaggaagagtgtttgagcatgcgtgtggtgtcacgagggaaccccaggtgcatatgaggacttgtcttttgaacacagctgaattcgagaactccaaaagggaatgggctgcatgagatcaagggcacaggtaaaagtgttgatcttaatgagcttctcagtgaaaaaaagataaaggggagtgcacagaaaaagcaaaatgggagactccgctctgccaggtgagacctcaatcttctgagtaaagtctaaggggactgattgtgagtaagctgacagcaaagactccaggaagtaagtggttggggggcgggcagcaaggacaggtggagagagtgctgcagggatgtgtccaggtgtagatagggctaggaattaagcatagccagagggaggcaggagaagttagggtcaaaggtcaggttgtccaaaaggctatgacaactggcagccaaaagctgtgcattagcttctgtgatgaaaggccagaaatggctcttacctggccctggtcccctctccctacacccaatgtgtcacattttatcccagcattaaataataaggcattcattatgtaaggaaagaatcacaagtgcctttatcaagcacctgcaattaaacacacagccaacgtatattgcaaaagagcatctttattacaaggatacagatacttatcttttaaatttagtagttattctaaacatacttccctaactgcctgcattccaaattccaaactgtattgctttgatccacttaaaagagaaagcattctactctgaattagaacaaggaaacaggactgcaaaacagcctagagactcctgagcatacctctaggagaaattttaaagcttttattttacctgaaaatactgacaacaaaagccaataacctgctgtattactgagtagttacaattatatagaaaaaacaatttttacataatgatttggtaaatgtcatcatctttgttatattttactttcgccctatattgtacaagggcactaagtattaataaacccaatcacagactttcttattgttaaatcattcaattagaaggtgccactttccttttgaaagaaatcttttttaaagacttttttaagtgatgcatttatcaaaaatacgaaaattgcaaaaaacctaattgcatactgcttttgagaaactacctctactatagaaaataaggtaatgtatccaaaagattataacaagattattatgacagcttacacttgtccctgctctctactttccttccttaagtcggatcatctgccttcgtaaaagaaccagaaaataacatccatgtctgagtatcagtgagaagatttatccattccttgggcataatccactctctcctaattgagtcagcatctggcaaactggctggagggatctggtgcaaggacacatcctcagacaaggtttcttgattctcaaatgctctgacctgcagacaagtcagggtcacggctccactcccgacagtgagacacttggcttcaggcacatggtctcatctccaaagtaaatgcattcaattttttattccttcattttatttaccccatcaaataaataacaattccctatttcctaaaggctctttcttctactcaagttagagcaacattttccaaaatgtgtggaggtctttgcatgctttctaagaaatggaacattccagagaagaatgcatacttgtttgtttgtgttcctgtctgtctgtctgttttgatggtaatttgcttaatcagtacaacatgttagaacttctgttagaccgagttctgatctaaacatagttatttagaaaaactgcttccttgaacatgggcagcaaagcaagaacaggtttgtcaaagtacagggtgtgtaaaggattcctgctctccagtggacctctggatccagcttcatcagcatctctctcccaccaagcatcccctcaccttttgttgtgagtaagggtatgaatgagtttggtgtgttgctgcaggtacagttgcctgcctggaacctcaaaagcaaagccatctgaattgtaaacatttttcagaagaggagggctgcccttttttttttaatttgaatactaaagacgtgctaaggcttctcactgtgttttgattctttatgacaagtaccataaaaaagcaaaacatattttttttacggccaggtgatatgcagaagaggtgtggtttctgaatataagccaggtggaactaaaaggtttttctttctccattatgacacatttgaagcccaaacccaagtaaaaggtaagactcctgcaaatcttccttgtgacatctcggaagtatccccatttacatggagctactaattttgtaaatactttcatgcagttaaaaactcatttaattttccttccgtttacttcttaacagattgctaccactggtcagaaaccaacttcctagaacctcctgatatttgaagattctaattttttttttcttttctgacttgtatcactgtccttagaaactgcaaagagaaaactttatgcggagatcaagacatactcccacggttctgttaggtatgacattagtctaccaaaaccaagcagaaatacacaggagacagatgttaagagaatgggctttggaaataatcagacctagacatttgtcctttctctataaacgtgtgcaactatttaacctctctaaaccacaattgtcctatttgtaaaatggtgattaaaaacagtgcctgattcttagcaataacaattcttccaattgttattgaaagaatttgctaggacaatccatgtaaataaagcacttagctcagcgcctggcacacgttaagctttccttataattttagctcatcattattagaaaccagagcccccagacagttaccatggggggttgcttctgtaattaccttatatctagaaagttgatcttagtgaaactgacataaaagtgatactaataccaatggcactttcagtctaatactgaattaaaatccttaagtagaagagatttagggaatgcacattaacaaaaagaaatccaaatttagaaaaatgtaaagcaactggagagactgatttcaaagtaagtagtacactgcttatcgctgaacaaaaaaaaatgatattcagaagaaatgagataatgggcaaacaacttggcttcaaaaaatttcaaaatatgctttataagatacttacaaaccatggttacatgtctggttttctccaaaagtgaaatgttcaattattgacatggaatccatggtcctggagttggccattaaaaccatagaggttttgtgagaacaagctttggcactatagcacagacataaaagaatgttttcaaagcgtggtgccacattccatatcattagataaagcacagaagagcaaagggaaggcttcagggtaaaactttaagaattaaaactcaaaaccagtacaacaaacattaccctatcacttaaaaacttgtagccatctggtaaatattaattctgtctaattctcacacttgagtcaagcaggctggctatttgatttggtagtcatgtgcaatgtggtcatatgaggttacagagaattgcttgcctaccatgaacaccacaaaagtagtttgaacatatctatttcttcactaccatagttaggacaggttaatagaggaaataggagtgacaaaaatgagacagatctgaataactattatgccccagattacttaactcctctcttccttcttagttgttcaggacaattttttttttctttgagacagagttttgctcttgtcacccaggctggaatgcagtggctcaatctcggctcactgcaatgtctgcctcctgggttcacgccattcttctgcctcagcctcctgagtagctgggactacaggcgcccaccaccacacccggctaatttttgtatttttagtagagatgaggtttcaccatgttggccgcgctggtctcgaactcctaacctcaggtgatccacccaccttggcctcccaaagtgctgggattacaggcatgagaaatgaaaaccaaacacagccctgagaaacaccagtgtagctaggatgagggtaaaagcaatgtctatttccatgaactcttaaagggaaatgatgtcatgaccctcctagatgctaagaaaaaatcaaatccaaataatatcaagtaatagaatttgaattactggtgttgagtgtacacccattattgctatagtaaatgcggaattataatacataaattacagttacataatagctctaattttcatttttacatcagaattttttctttaagcttatactttgttcaactggtaatgcaagctcactaagtaaaatcttataaactagagaaacagaaaaaatatcaccaccatccgaagaaaacacaaatctactgatgtgtatcccctgtctcatatggtgtgtatatataccatgtctcaccacattacacatggtgtatattgacatctctttgctagcaagaaggttctgggtactgttctaagtaccttatatggttgacttatttcatcttcacaaaaattttatgccagaaagtctacaatatttccattttacaagtaataacactgaggcccctagagattaaatgatttgcccaagaagacgcggggagtggtatgtggagtaattgatggaacaaggagtaatatccaggtagtgtgactccagaacccacatccagtggcaaatttcatctaaaacacgctttttcagataaacttgtggctagttcaaaagatgcctccacaacaatgagcaatcatttccaataaaaatatttacttttaggctccatccagatgacattgtggaaaaagggagcaaattcttcaaattcttgtagttttcttactgtggccagtttaatcacatttgctggggtgacagtttgcctcgagacttagtaagtaaactatgttttgcccatctcctaaagcaccgggcattctggcagtcatgttttacctgggcttaattcttcttgaatttcatatattaaaatatgtcactacaggtaattttgttttcagaaaaattagatggttggcgtatttttagtatatttgtaaagatcttacttttatattagtagatttttttaactgggctaaatataaaatggtcatgtaaaaatgttttctttcaaaattctgtagacgttgctccattgtgtccagagaaaaagttaggctaaggccaacttagctttgttctttttgtttttcaccattttttctacatgaatgcttatagtctcttttcctccatccctgtaattcaaatgtaacaaagttctcttttcatttaatttactttgaacatggtgagctcttttgatctgcttgttcattctttttcaactcaggaaacttttatttaatgatatattggaataattgcttctgttcttgttctacttgttatttattttctctagaacacctataattctcaggttggctctccattctctatcctccatacatatcattttcttgcattattttcaacccttgatttttttcttcctctgcatcctagtagaatttctcaagtttgtctttttgattgcttataatacctatttgattgcttgtaacttcactctgctctgtactgctttaattctatttatgcacctttatttttcaacaatatatttctaatgttaccaaactacaatttcatctagtatgaattcttgcttctattttatggtaaccctgcctgtctttttccttttttctttttcttttttaatatcccatatatgatgctagttttctacttttttttttctcattcctacaataattctttttcagaggtcttctcttcattgatgtcttctggattgtggagtcctaattaggtaaaaggagtcatgctggaaggaccaagggaaagcaaaaagtaaaagcagataagctctaagtctgtctttcttcatggtccgggacacatagccctcctgcgcaaataactcaaaatcttcctgtgcccacctatcaccagacacctgcaaactagctcactgtaaccttggcgttatcagtactgcacaaagctctcttcagcatacgcataaacactcttctagaaaatccccagcgattctttgtttccttgcagacagccccttctctgccttcctgcctcttgcatccttccaccgtattttcatactttctgtagtaaatctgcctttctttacctacaactgtcttggtaaattctttaaccacccacgtgaaactgggcccagagagtcacactcacctgtaacatggatgatattctactccctttgttctattatatgtgtgtgtgtgtttacatatatatatatatatatatatatatatatatatatatatatatattttcttttaataagagatctgccaaacccagcatccaaaagacaggatgtacatgttaactttggctctctcatttgtccagttgggtcttcatcaaatttcttttttggaactatgtgtggatgtgcacagagatcataggcttattcctcttctctaaccgacaaaactgtcctcaatgagatggcgtcttcccagccccacgctttagctctctgattctgaacaagtggattatgtaagaagacacaatacagccaggatttctcctacttctgctctcatggactaccatcctgttctatcccacacctcatttcctttttatcaagtttctgtctaggagttttaggttgaagtggaaggagaaataaagggatcgaggagttcctatgacacaagggctgttgagttttttaattgatgaaaaccttaagttctatattggtggcagacagtgggaaatgctgaaaaggctatcatgcccgcatgcaggactactgaccatagtgttcagactcattcaaccagccttcggtacttagtgcaatgttctagcttctggcaataggtaaatggtcagtttcaggtttccatcagagtatagaattttcaccttttctgtgttaagtgtttattttaggggctgctaaccaaatgctatttttaaaccagaagttctgaagtggatactgaagaaggagatttcctttgtcctcattacattattattggtgacaggtggacatggcaatacattggccagagccaccagatactcacattccttctctgcgagtgtcatggagaatgataaaaaccgagacaactgaaatgctctagcaacacgttgtggagctgacaaggaatgagaggtaacatcgctcacaaatctagaccagcatcgcctgtcttagaagtgtcctgggaacagtttctcatcactggtccaggataattcaactgctttttaggagaaaatttaagagagaaccagggttgttgtttttttaatctttgacaggagttaagaatagaagttcaacccagtataatagaataaaaaattaatttaggaagcaagaccaaatacttagaaatgtgattaagtgataagtatcaactgacttgaactgttcaattttgtaattgttatggtaatctactatttcctttagaaaagattctaggattcttccattctgtgtatatataaaagtaatcaggtcagtttgagaagcatagttgctatagtttacagtttatcttttagtaatttcatacaacatctaaatactgtactaacaataatatgactctggctgtttcattaagatatttttaagtagaaaaatggcctaccagcctcaaatatttggggaagggagctattgtctgtgaaaattgaaacaaggcaaatacacacatgcgcacacacgcactcatatgcacacaaccttctcagagaaacttccatctccacattcaagtaagagtttgatcccctggaccctgccacctaagctgatttgaacctggcttcatttcctcatttaactttgatttctagtatcagcaaagctaagcataagctgtaattaaaagaataatgcaggaacagaggagacaaaatagaaattgaaaattaattaagattaagtaaaattagtttcacttaataggcacacactagcctgtgatggtaagcttattagttctactgatgtgaattcataagagcttaaaaggtctatattaagattctgtctttgaaaacgcttctcattatcaacccaactacttgatgaaacatcctagaggaaagtcatgttcttattgacttaagagtcttttaacaccatgatcatctcccaatgtgtataaatggagtggtcccagggaaaggtgaactatgcacaaaaatgtcacagtaaatattgcctcatctccccatccccaaggacatatctgcccatgagaatttctaagtggttaaagtataaggtctttgtgaaagttttcaactttaatgactcaggttttagatatgataggaacaggctgtaatctttctcataatgaacgatcaattttcttctcaatgatgaaatagatgcctattctgtcagacattcaagtagagtttacactttcatctaaaataagcatttttgttcttcacaagagctgagatttttaaaaaatccatgtgtgctaccgtgtaatgtaaccatcctacagtctaataaattggcgtttaagtgctcagtattttttttaatgtgtgaaagttctataaagaccacattcatcaatacacataaaagccaggatattttctggaaaaaaagaacaaacaaaaattttaaaaaacaaaaaagcatcaccatttatttgtaaatctgtttctcaaaagagagaagcaggtctgttagcatatgttttaactgtaagttgctttttgcagtgatttgaacaatgaatcactttttttcatgtctaatcggtagcaggtatctaaaaagcaatgtgatgaagagatactgtgttgtgagtgtccattttatcttgaaacacattagaaattaacattagacatgagtttctcaacagcatgagctagataattctctgtaatgggggactgtcctgtacatccctcaccactacccagtagataacagtagtatcctgctggctcaccaccaattgtgatgaccaaaagtgtgtctagacatttccaaatgtcccttgtgggaagcagggagacaggggattactcctggttgagaaccaccatcccagggcccttgccaaattgtgcttgctctggaaataagcagagctctttcttcttggttgaagagaattaacgtatttgggtgtcccttgctcaaatgtgtggttggtgctcactgcatttgtgtacttgcactttatcaatttcagccagtgtgtgactcttcgtgattggaagtacagcctttgctggtgttgcagtgaagggcacttactgcagccaataacctctgttcaactgcagacacaagtctctcagggaaaaaaaataggtttaacatcaagggaaccaacattattcctcctaatagacattcttcccttggcttctctctttgttttccttccctgtcaacaattcttaatgggaaatccatattttttctgttggctatttctagaagaaagcttcaggtctactacttccaacttcactcctcttcccagtacttttatccctttccagttcaagccatgaatttcactatagtgccctctcacgctgcacaccagtctcccttcttaagacaaatgggttcctgcaagtcacacatgacaaactgtatgccctgttccaacctgcctccctaaagcagctctgtaatagaaggcacaataaaagcaagtcatttaaagagtatcaataggtgaccatggagtaagaaaactcgattattatacattgggtgggttgcactttaaaaatacctagaggggagattggagcttctgtccctagtaggaaagatgtgcagactctcagggatttacctacagcaaaaagagctatttgcaaagcacgaagcgggtgacagtggtttttgtaagaggacacacaaagagcagaaacagactcactcaccttcaagccactaaaaacagaaagtggcctaatctggcaggaaatcttttagttaagtgatatttgttaagagcactcaggagaatgcccactgggctacgtatggggaggatctggtcacctgaggaccatttctgttctaagacagcctgataaaaggaaacctaggttggggaaagacaggtcctaggctgttctggagcctgaagctattatgtcctaggcctctgtccctgatccacttcctcccagtttagagtgttctaggaaggtcatcatggctccaaggtcaatctgcaattgcatttagttgggttggtgataagaatctagcttgccttgggtcacttgaaaccaaccccaaaccttctataatctgtgctcagtaccaagttgagggtttggtggtgagcagtctctttcagggatttggaacaacagcagacacaaaggactagaagcaaatgtttcccacaaagccctcatagatcaatcaatctttagagcagaagctctcaatatcttaaagttaagcaattatggaggtaggtctgagagaacaagttgctgggcaaccccttgcctttctacacccacttctctagtaccaaacatttccattctagcaggtgggaactggttgcctggaaatgcttatctaggaaagtcattaatacaacatagattctgactcagcacccaggtgtgtgccagttaagagcaactgcttatacacaactatagcagccctgactctcaggctccaactcagatatataagaaataaacgcttttcattgttacagcaaacctattttttttcatttggacagcccattgcattggttgagaacaaggaagcaggaaacaaaatcttatgcaattgagggtcctcctcagagatggctcttaggctcctgggggcaggcacagaccaagacctagaagtgcaagaatatcacctgtccatgcaccaattgaagtatctgcagcatctcaactcttcagtggttgagttacagagacacttgctgtgaggtcgcttccccttggctgtaagacttccctgggtccatatctgagcctctcaagaacacacaagaaatctaagagtaggagtgaaaaaaactactcaagactatttctgacccatgtctaaacatttctactcaaagcatcccctgtcatgggcaaggccttatatactaggaaaattgtcatgtctatgagttatacccaggaaggaagaaataggtctcctcaactctcagatgatctaactcatctgaggttttaatcatgtcttccccaccccttgtctgaactagctatgggccccttctcaaaagtctccctgaatctaaactttcttccttaaatttgactctctcctcctaccatgctgatagaatctttatctaaaaaagataaggtaaatagaggaagacaagttgttctctctcacttcattggtgttgtatgtgcatatcttcatgtttaaagcttaaaaacgctaactgagaaccagccatggcagtgtgcatctatagtccccagctactggggaggctgaagtggggaaggattgcttgagcctgggaatatggggctggagtgagctatgatcacaccactgcactccagcctgggcaacagagcaggacctcatctttataattaaaaaaaaaaaaaaaaagaagtctgagctcaggagttcgggaccagcctgggcaacacgatgaaaccctgtctcttctaaaatacaaaaaagttaactgcgcatggcagtgtgcgcctgtaattccagctacttgggaggctgaggcaggagaatcgcttgaacctgggaagtggaggttgcagtgagctgagatcaagccaccgtacttcagcctgagtgacagagtgagactctatctcaaaaaaaaaaaaaaaagaaaaaggaaaaaaaatttgccattgatttgtttctttcattcttctgtaacaattctcatgaggcatctcttgacatttattggttattatcccaaactatcatccaactgcataataaaatgatgagagtgcctgcctttgacaacgggtggttcatttttttgttttttcaaatttattttagattcaggggatacatgtgcaggtttgttacctgggaatattgtatgatgctgaggtttggggtacaaatgatcctgtcacccaagtaccgaacatagtaccccaatagttattcatagtttttttcatctcttgctccactcctaccttccctctagtggtccctggtgtctatcattgccatctttatgtccatgagtacctaatgtttagctcccacctgtgagaccatgtggtattagattttctgttcctgcgttaaacaatgggtagttccagcaaagtgtgtatatcatgcaatcctgctttgcacttacatttcagactttcccatttaaggcttataggtcttcctgaaatacagatgaatgcaatgcatgtcatgtttttcagcctcttcatgagcccacaatctgatggccttttgttcataagagtgcctgataactaagttgacttttaattctctgcatctttcagtagtgactgggttactgtcctatcagaaaagattagaggcttctccagtctccttaattatacggcaataaaacattaaggtttgagatacattattttcaataaataagaggacagcttgttgacaatactcaaccaagtgtgcaaatggtagaaataaatataatggactcctttttcaatacacaatttctctggaattattaatgaacattgtattggtctgctacggctgtcataaaataccacagactgggtggcttacacaacagaagttcatttctcatagtgctgaaggctgggagttcaagggttggtttctccttggcttgcagatggcaacttcttgctctgttctcacatggccttttctctgtgtgagtagaggctttcttctcttctccatcttcctcttcttccctttcttcttctttggacactagtcccattgaattgaggccctatcctttgatcccattgaaacttaattgcctctttaaaggtccaatttccaaaaacagtcacattggaggttagggcttcaacagaggtatttgtgttatggatacaagtcagtccatgcacagtcctattatataaacctgtgactcttcatgataagtagaacctaaaatgtaaataacatgacgttcttgctcttactacactgcataagaacacaatgtttaaactttgtttttctagccaaatgctaacgctgggttgctcccctttcaccaacatggatgctgactcagcgcccaggtgtgtgcattgctcatgctgatccacaatgcagccttgaaggaatgagacagagagctatcagctagggatgtgggcgcacctgactataatccaaaaggtgagtgatcccatgtgtccaaatctctgccatgcacctcctcccacccaccagtgacagttctgccctctgacaaggagcagtccctgtattcagacattaaaagctcgcatttgccccaaagcttatgaggcatgaaacctattttaccacttttctcaaggatgtttgacattttgatgattaggagtgtcgtctcttggattttgctcattacaaagatcaaataacataagcaattatgacaattagaggtgaaagatttctactggaaaaaaaaccctcttagaaaataacatagttgaatccaaaatgataagattccttatctggcagatttgaacccagaatggatccagaaaatcattagatcttgaaggaatttaaataaaaactaaactgagaaagttattagcttctgttatttaactaccttttttttctaaagcatcctggtacaccgaaataatagaaaattaaagtaaaataaatgcatcggtgaagaaactgactcttattttaatgctgatgctactacctaagaggcaatatttatctaggaaagtcattaatacaacaccgacaattccctgtagaattaccttttgtgaaatttgtaaacttttgtgttttttcttatggttttattggaaccaaagacactatacacatgcgctcatgcgtgcgcacacacacgtgcgcgcacacacacacacacacacagtatggggaagatactgaaggcacagattggtgaatctatctttatataaagagcatgttaatttacaacttaagtacgcagtcaattgcttggcttcctagcaaatttaatatctaccatgagtttcaaccctaaggctagccaacttcacccttcacaattaggtacttggaatttatttcctctgtggataaagaacaaagaaaaatacagccaaagggtgtttttgttgttgttattcagttgtatgtatttttaatgatctctgtggtaatataattatggttttcagccttctggttgaatcaattgaaaggaattactttttggttatacaagatgatgaaatgctgaggaaaatggcctaagttatagaaagagaaaaataccacaaaaaaaagagacttggcatgaatatgggtatcagcctgtgtaatttttttaatgtggagagaaaatgatggacatttagacattagtctacaagtatttcttgtgcccaagcacaagagaagaattctctcatgtgcccaccaaaaattgatataattcaagcattgtatgctctacgtagaattttaatttaaatgtttcaagttgccatacatatacaggaaaagacaacttataaaccctggacttataaacagtagtctctcataaacagcctcatctgaatcccgtctccctcctcagagcacacataaaggggtgttgccgctgctcccatgagaaaagaatctgaagaaatatggagattttaaggaattatgaggtttagaacataaagagaaagtgagaaaatgggaaaaatcaggaacagaataatgtgctcccctggccctagactcccagatgggacgagctcccctctattggttcctgatatttattttaaaaataagtaaataaataacaaagagggaggataacaaagttctgtgttagaaaggaaaaagcctggtgtctcttcctcttcttatagggacaacagtcctattgaactagagccccacctttgtgacctaatttaactttacctctttaaaggtaattacactttctctaaatatagttgcattgggggttagggcttcaacatataaatttggagagggtacaatttaggccataacagacgggttagaaggaacctgaaaaattaatttgaactacagtgactcgggttaataatagtgtattgtatatttcaaaattgctaaaagagattttaaacattctcaccacaaaaaaataagtatataagttgatagatgtgttaattaacttgattttaatcatcccacaatgtaaacatatatcaaaacgtcacatttttccccatgaatgtatataattattatttgtcaattaaaactaaaattttatcagaaaagagctttttgaggaaatcacacaagcagagaaacaacttctctctataaagtttcttggtgtgaaatcacctgatgtgtgatccaaactgggactaataacaaaggacagaagagaggcagcataggatgaatcaggaatatgtggagcatgggaaggaatcaagggttcagatgactgcaagcatgacatgtagcaatagtgtggtatggctgctaaaaaacaaacaaacaaaaaacttccaatcttaggccgtaactccatgcttttggcttcatatcacccttcagcctgcatcccataatggtgagcaagaaatcaacctgtatgaatgaaagtcactgagatgcaggagttgttttttaatgtggaggttgaaagttgactggcaacaggagcatgaaaagagtatgaaattggaaaggttaaaggaatctcaatctctcccctaggttttgttacctacgtgggtactcactatatatctattaaatcagaatggcatgagctcctctatttggggtccttcgatacatacaaagctccattaccctggctgtcacatagtcgagggtccagatatttcacagaaaccagacaggcagtaagaactttttttgctccacggtaaacttaagaggagacattattggattctctcatgtaagaaagtaaacaaagatgcttatgattaactaaaacccacctcccgcataaaagctggtagtagacatttgctactttagcagatacaaaacatttttgaaccatctttctatgttctggtaatttcctatacaattcattcagaaaatttgcaatccctgagttctttatggctcaaaacctaagttcttccttgtgatgcaggttctccaaatgaaatgcatttgcacagcattggattcagaagtgagtgatgacatggggtgggataatggcatgttggtctttgagggcaacaacagaggaggagcttcaagcccaaggtttatggaagtcagtggccataatgtttccactaaggaagtctcagcagtgtgctgttcaggactctgattctctgatataatccctcatattacagttttcctcactgcagggagaacataagtttatatgatgattgtcaccaatagcttcccttagcttccacatggtcacttaaaaagttaaaatcctattttagccaatttcccttcttagcactcaggtctcctttttcaagctctctatatatttccctctgcttctgatatggtttctatctgtgtctccatcacatctcaaaaatctcatgttgcaatgtactccccagtgttggaggtggagcctggtggaaggtgatcaggtcatgggggtggatttctcatgaatggtttagcaccatcactctggtactgttctcacgatagtgagtgagttttcacaagatctggctgtttaaaagtgtgtggaacccccctctctccctctcttgctcctgctctggccatatgacgtgcttgcttcctctttaccttctgccatgattgtaagtttcttaaggcctccccagaagccaaacaggtgccagtatcatgcttcctgtacagcctgcagaaccgtgagccaattaagcctcttttctttataaattacccaattgcaggtatttctttacagcaatacaagaatggcctaaaaccgctccaccagtactttccactttaatgaggccagtatcttgattgtaacacatatatacacacatacacatacacacaaacgcacattcattgtgcatccccttccttttctagtattattttcaccctcggccacacttgtccatagcaggaaagctcccttgctcctctcaaaactcctgattctgtctttaaaaagttcaacttgaatactatgtccacagaacctctaatcactccaacctcaaatcatctattttctgacccttctataatgctgttatccacttaattacttcctagtgatttgatgggttagttttgactgcttccaactaaagctctctgaaagtgtgtatttgcttttgcattggttgctggcaagaattctccccagccatgtgacaaggtcttcacaaccagcttgccattctgtcaatttgcaataattttccatggataaaaattcaaggagtgaaaggaatttaataaactgaaaaaactgtggcatattttagattatgcatatgagtggattaagtttttcttttctctcctttgatatcatttttcttttatctctattgctattctgtacttttaataatattttctaaagtgaagaatttttaaatagtataggtttctaaagaaacaaaatatgctaaattataacaacttagtaaaatatgtgatggaatattgtgcacttggcaaaaatgattgtgttaagtgtatactaatctagaaaataggtgataatgttgaatacaaaaatcacaactctaataatgctaacaatattcaccctgttaattagccaccctactaaacattattttcacatgttagcttatttaaaaatttcaattaccatataatgtaggtatttttatcttcctttcatgtaagaaagaaaagagactcagcaagtctaagtgttcacacagctgctaggtaggagaacaggtacttgagttgagattcacctgattttaaagagattatagtcttaactactatattgtacatgtatatcaaaaataacaaagcccgaaaaagacaaatagacattaacaaaggctttatttggataatggaattatgggaattctttcagggatctgttttgttttttcaatattctatttttcataccatccatatatgtaatttcttaacatcatatttctgcttttttagtaaaaacagacaattcataaatgcctaccatgtacccatgacctatcactgcagagatgtctgagaaagaattccaaggtaggcacctgagaatgatgcttcttaaaatctaaacaggagcttggagtcttgagtcagctcactgtcctcaaccaaatcctgtccaaccctgcaggaaaagtccttttaattcctttgtggaaggtgaggaaacgtggctttgtccaaacatccttgacagaaacacatgtgtctgcctctgttgagaaaagtttccaaggatcgtagcgctctcctttgagcaaagttgcccaacttctgtctcacgggggcctgcctggacgctggtggccatggattcttgtggtgcacacaccttgctcaggtgtagccagcctccaagtgatacatgatggttacttcttgaagtagacaaattaataaaccattagcttttaattttgttttgttttgttgtgtttcaagacaagagcttgctctgtcatccagactggagtgctgtggtgtgatcatagctcaccacagcctcaaactcctgggctcaagagatcctcctgcctcagcctcctgagcagctgggtctccaggcatgtgccaccatgccagctaattttttaaaaaatgttttatagagatggagtttcatcatgttgcccaggctggtctcgaacccctggcctcaagcaatcctcctgcctcagccccccaaagtgccgggattacaggtgtgaaacaccacacccaacaccactgaccgtaacagtagtgaaaatccattgaatataaacagcaatatttgtgcacatcagaatgaactactgaaaaacattctgttgttaacatggccacttctctgttgtattcatttccttttttcttctccctttttaatcagaagcaccaccagctaaatttcctgtattttcacactgtgttcctggcttatcatattactttggaggagggtaaataattgatttgatccattacctctaattcctatccttctattatatatggtctgataagattacacataaacagggacaaattccattttatacctggattcccaagtaacctaaccgtggcactctttgaaagaattcaaatgactgatatagaggtacactaaaaaatgggtacaatcgatggacttactataatgagttcctcagtgccatgcaagtgaacatttgagtatttagaatgtttcccaccaaatagcatctactttcaacagctgagaaacctgccccttctttgtaagctctcaaaaatcagatatttttattatggaaatagctattaataggtttaattggtggctattgtgccaaatgaacagtatccagaaagaaataaaaagtattcctgatggcagcagtaagaacatgagtgttaacctgacttacaaacccaggtcagagccaagtcaacccatatgcttagtgagctattatccaaaatgcactatggtgagcggaggttggagctgcaagtgcagactgcacatcagcttcttgaagttcaatgtctcctctctttgtggctaccagcttgttgcagttgggcatgagaggatggtttcagtggaaaacttccataattatattagtcaaagttcttagtgatcaagaatttcaattctgacatgggtgtagaagttttgtataaatgtaagcaaaggttaccctctgaaatgcaaagaaaaaggaaactgagtgtccaaaaataggagaataattaatagatggtgatgtaaccactttaatcggttaatggaataatatattcattcaaagtcatgttttttaatgtctaatgacactgaaaatattaaggcattatattaagtgaaagaagcaggattcaaaacaatatatacttaggatccaaactttagaaaaagaaaatgtgtgtgtgtgtgtgtgtgtgtgtgtgcatgtgtataaaactggaaggagagacaccaaaatcttagcaaatacatcttctgggaggacattttttttcttttatatatcttttccaaattttctacaatgagtgtgtattactttttatagtaataaaagaatgtcctaagaacccttaggaaaataatcagtgtagaatagatcttatttcttacctggcttatccactgctatttcccagagatttctcaggtaatccctaccccactttatttttcactgtgccagaagatttttctttccaaaatacaaatgtgattttatcactgtctttttaaaaattttcagtgatattccatttcctaaaagaaaagaacccagactcctctgcctcctttatacattcccaccctcctatcagcccatcttcctagtgtcccctccccccacggccctgcccccacccccatctctggctgggacacatatcagccactgtgaacctgcacattgtgttctttccttacgggatctcctctgccaaatatcctgttccagtttgctacctgtcaaactcctacctgcctttcaatagttacattatgtaaccaatctgtacttccatctctaggctaggtataatagtcatatctaccttgtgcaattgttaaggggacttaatgtgttaagacatacttgaaacagtccctggttgatatggtttggctgtgtccccacccaaatctcatcttgaattgtagttcccataattcccatgtgttgtgggagggacccagtaggagacacttgaatcatgggggcagcttcctccatactgttctcgtggtggtgaataagtctcacgagatctgatggttttataaggggaaacccctttcgcttggttctcattgtcccttgcctgccatcatgtaagatgtgccttttgccttctgccataattttgaggccttcccagccacgtggaactctgtgagtccattaaacctctttttctttataaattacccagtctctgttatgtctttattaacaacatgaaaatggactaatacacgggcatatagcaattactcataaatgttagcttactggaagttgaaatgtcctatggtcacccctgcagcctcctccacttccctccacctgtgtgccagctgcctgagatgcacaacttggctatagccttcctcgcatcataaacattagagtactttattgttatgtctgtcttctctgcaagactctgaacacatccaggttagggaccagattctatccatctgtgttgcccctgctcctggcccacaactggtcctcaggcattcttaccagactgaagggcttgaaataaaacaggcacaaatactggatacagattcaacaaaactaaatataattagacattttaaaatcatgagtgggattagagggcattaaattagattaaataattgtgttcatttcattaggagtgataatggtgtaatgattctgtttttttaaggttcttatctgttctctgaagcttttatgggtaatatgtccctgctatctatgatttgctttaaaatatttcagcaaacaaaaatccaaaagaaaaccagtggttggtggtagaagggatgacattggcaaaatgttgttcattgctgaatgtggacgtgagtgcctgttctcaccatacccataccgttctctctgcttctgtgaatgtttgaaaatttccatagtaaaagttacccaaacatgctagcaacaaatgaaccattccataataacactgaatgaaatctcaaaacactggtgaatattttcccaaaagagtatctatgtagaaattcattcagtgtcctgaatggtaatgcctaggttttcttctagggtttttatggttttaggtctaatgtttaactctttaatccatcttgaattgatttttgtataaggtgtaaggaagggatccagtttcagctttctacatatggctagccagttttcccagcaccatttattaaatagggaatcctttccccatttcttgtttttctcaggtttgtcaaagatcagacagttgtaggtatgcggtgttatttctgagggctctgttctgttccattgatctatatctctgttttggtaccagtaccatgctgttttggttactgtagccttgtagtaaagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatgtccaaaacaccaaaagcaatggcaacaaaagacaaaattgacaaatgggatctaattaaactaaagagcttctgcacagcaaaagaaactaccaccagagtgaacaggcaacctacaaaatgggagaaaattttcacaacctactcatctgacaaagggctaatatccagaatctacaatgaactcaaccaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacattgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaagaaagggaatatcacactctggggactgtggtggggtggggggaggggggagggatagcattgggagatatacctaatgctagatgacgagttagtgggtgcagcgcaccagcatggcacatgtatacatatgtaactaacctgcagaatgtgcacatgtaccctaaaacctaaagtataataaaaaaagaaaagaaaaaaaaaaaaaaagaataaacaggacactaaaatacaaaaaaaaaaaaaaaaaaagaaattcattcagtgagcagctgattacctggcctgtgtgagaaggtcctgctcccatgctcaggtgagttacagaagcccaaactgacttggatttggcaacacactgtccttggaaacctgcatcagttgcaaaatggagaccagagaacccacctttcaggagaactaaaaacaataaataattaatggcaataagcaccctgctaatataaatgtaaatgatgatctgcctgcctgctcgatttacatacaaatgtccttttaaaaaaaaaactatcgatagtggaaaatcaatagtgttggtgatgggaaagtgatttccaaagctgttttttttaatgtttttgaaataataatcagtaaagcacagttataatggttaaccagaccccttgaggctggagcccaggggaaggaattagaatctccaggtagatgctgactgactctgtgacctcaggccacacatctgtgtccctgtttccctagaaaaggagtgaggaatgtccagaggctgggatatcccaaggtcatctagacctgagcagatgggggcacatccagagccaaggggcttccagcgaaaggatcccataatctccatatataccatctcaccccaagttcctgtgctcccccagttctctctggcttccggaaaagcctattttatttgtcccagggtaatagccaatagccaagagccatctaccaaaagggccttctgtgtggactcatcagtttgtatcactttacatcaacaaaaaaggtcaggtcaggttacattctggctggtagctgttaaatactgaaactagaattatgaagcattaactgcatagtgtgttcagtgataagccgtgcctttattgcatgatgagtacaaaaaagctattatagtttcatttgtattaagtattgcaaagtgctaggcaccccataacacgaatgaaacagctctcttctaaagcactcttcactagaaagacactttagaactctaatactgagaatcttccatgactaaaggactgaaagtaacttcatgtttgataagaaatagtaagttctaaatgaagagaaaaatatatatgtacaaatgtataaactgactcaaactctcaaattcgttattggtaaaattaagacaattttccatagaatcagttattgagtataaaatgtcaatctagataataaaataaatttctgtttgtgaccccatcacgtgaaactgatgatttgagctttaccaaatgtggaaagcatgtttacaactaattgaaaattagtaagccactgcaaggaagtaagagtcagttgcctcccacagctgctggaaaaaaggtacaactcatcttccaatttgaaaggtatatttgggctgctgtgtcttaaaacagaagctatatggcactcacaaaaatccaccgtgagggacccaaccaaggggttacttccgagagatgttagggagattcttcagagcagctgaaatgctctgcaaggagaaaagctcaggcaacagtaattttgaagctcccagtgatgacagtgtgcagccaacattgagaacaactgagcagtataactgagctttatagcagtcactacaggcccctaatggagcagacgcccgctcggaacaccagatgatttcactgaggcctcaatggcatcacacccattaacttcccttactctaccaccctgggtactttggctccagatcacgtggcccctgcttatccataatgcttccccataccctaaattttcaccttccacaatatcaatataatcaaaatagctatgacctttatatgtttctttccattttccacctttctctgctcctaattttgagctggattagaaaggatggttaaatctcttttacctttaactgaatcccctgttgtttttcttcaaacccttccagaacagctagttatataacttgaaacactcagccactgtctatatagaaggaaatatatattgttctgataaaaatcactccatacttaatggcgtataacccagcccattcattcagcctcccataaactctgcggaagtttcttctatagtgtcataaccaggtgtctccttatgcagcctctagttatgtgctataaacgggaaacttaccaatgagccacaagtgtctattgcattcagggatatgataaaaactatgagcaaagttgtttcagaataaagttgaaacctggatatcaactggcatttcaggttctcttgacttttgtggctgggccaattatatctttacctatggaaggagaaatatgagagggaggctcttgccttcatttctgagcagcaaaaacatacaaaagaatgaaccggccaggcgcggtggctcacgcttgtaatcccagcactttgggaggccgaggcgggcggatcacgaggtcaggagatcgagaccatcctggctaacacggtgaaaccccgtctctactaaaaatacaaaaaaattagccgggcgtgatggcgggcgcctgtagtcccagctattcgggaggctgaggcaggagaatggcatgaacccgggaggcggagcttgcagtgagccgagattgcgccactgcactcccgcctgggccacagagcgagactccgtctcaaaaaaaaaaaaaaaaaaagaatgaaccgtgacttttcaaaccaagttgtaaacacagtcaaccagccagccatagcccaggacaccacactacattaatgctttaaagtactgttcactattttaatactgtttgaatgatttttctgatatgtaactcagacaacaccaaattcatcaccgacctagatactcacacctcatatgagttaggtattttcattatccctctgtaatgaggcaattgaagtccattaagtgacttgtccaaggtctttttatgtgtacctggactatataacccaagcctttatcagaccccaggttttccacacacagaaatatttgggttttattattccacagtccatttaacttgccagatatagctgttacaatataggaacttgggttgggtcctccctcaccactttaaatttattaaccttgctgggttctcttggtacacttgcaggacaccacggagaggaagtgactggggcagtggttaagcatagtccttggagccactttgcccaggttgaatcacgactttctaatccccagccacaaaaccttggcatgttgcttagcctctgtattcccccaatagcattgtctgtgaaatgaaaatgataaaacttcctttcagggtttcggtgagaattgaccattgcacataaaattcttagaacagtgtctgacacatagtaagggctagatacatgttagcttgtctgaagcatccctgagatcccttccagcaagaaatttctatacttttctgaaattaaagcaccaaattaatctcttagacaattacataaaatttgggggtctgtggcatttcctttaagatagggacgtggaaaaagcagataggcataggtaaagcaggtggccacttacataatgtgatccagttggatgaccatattctgtgttgaagaaatcaagcccctttgacaggggaagggggaagtggcactatgaataatttcagtggaatgattgtgatctgggattgtgcaagaccactccaggacatgttgtctgcaccctctgtgggttatgagaggacttccacctgccctgtaaatatctcacttactattgagctgaggttgtcctctttcctcatactgagtttgaatttcccagcacttgagatacccaatatcatagtcatcccttaaattagaaataaaacccatacttaaaaaaaccctcatatacctctactttattattcctactcctattctaaatgagattccactaaattttttgaaagatgcatgaatctttacctaaaccttataccatgtacaaaaattaagtccaaatagatcataggctaagatgtataatagaaattataaagcttttagaaaaaaataaaagaaaatattccagatttagaactagaaaaggagttcttagatttgacaacaaaaacatgaccaataaaagagaaaaaagggtaaatttttgccttgcaaaagagcatgtttgagacacattatggaatggaagaaatatttgcaaattacatatctaacagacaaattatgttgtaacaactctcaaaactcaacatgaaaaaaacaacaatccaattttaaaagtgggcaaaaaaaacagttcactgaagaggatacacagatgacaaataagctcatgaaaatatgttcaacatcattagtcatcagggaaatgcacgttaaaaccacaaagatatataaatgtagtggtataggcaaagtaggtggccatgtatataatgtgctctagcgtgatgaccatatactgtattgaggaaactggcaactttaagagtggaagaagcactattaataattttgatgaaacaacaagcttcatctgagactattgcagacaagcccattagaataaataaaataaacaatagcaatttgaacaaatatcaaatgctgatgagaatgtggagaaacagttaccagaaaggggtcccaatccagaccccaagagagggttcttggatttcatacaagaaagaatttgaggcaaatccataaagtaaagtcaaagcaagtttattaagaaagtaaaggaataaagaacgtctactccataggcagagcagcggcgtgggctgatcaactaataatactaatagttatttcttaattatatgctaaaaaaggggtggattattcaggagttttcagggaaaggggtgggcaattcctgaacctgagggttcctcccctttttagaccatagagggtaacttcctgacattgccatagcatctgtaaatggtcatggcgctggtgggagtgtctttcagcatgctaatgcattacggtgcgcgtataatgagcagtaaggaccaccagaggtcacttccatcaccatcttggttttggtgggttctggccagcttcttcatgcatgcttttttctcagcaaggtctttgtgacctgtatcttgtgccaacctcctatctcatcctatgacttagaatgcctaacctcctgggaatgcagcccagtagggcttatccttattttacccagcccctattcaagatggagtcacgctggttcagatacctctgacataactggatcactcatgcattgctactgggaatgtaaaacactacagccactctggaaaatagtttgccagtttcctttagaactaaaaatagatttatcatacagcccaacaattgcactcttaggcatttatcctagagaattaaaaactgatttttacaaagagaattgttaaacctggtgccaccaacacaatggaatattaactggtcattaaaattgataattatgatgtttgtttagaaatagattttaagtgatcctgaaataatattaactttaaaatgcagaaatcagaactacacactagaataaagacttgcaaagaataagcacaaagaaagcagctattgtcagggtggtgcaattgattagcgtatttgtttctattctttttttcagaagcttctttgctgttatgtttatatcctccattttaaaaatatgaaaccaaaactggaaaatcattaacacaaaacaacaatttacaaagagactctgcctgggaaggaggggcttggagggccccctgctgctctagtcttccccatggagagcattcaccagaatgatctttatcagattagctggggtggtgccaagagtccgaaggttaggaccaaagagagaggtatcaagggaggcagaagaaagccagaagcaacacaacaactgcctccactgcatgattaattgaggagataaagaaagagatttttaagcaaaaggtctgaaaagatgagtaggaagagaaacaggtttcaaccaggaaggacaaagttaatcagagtgttatcagtcagaaccttaaggcagatgctgggtaggaaagaaatctggagcccaggtagtagacaggacgaatgcagctccaggaagaacacaaggaaagggtagagagggacaccttagtgggacaggatgagtacatcgacaagtaatttccattttcagcattccaggataatcatagcaaatcttatgttcaaatttctaacaacataaataattagaagagataataatatcctttgttaacacaatttcattattcttttagttattttgatttccatgtgcagcccgtaaacctgcaggggatctttttaaaaccaagctattaattactccttccaaatgagggaaggaatgaaagcacaaattcagaaacaaagagcaccattccgatgagatgatctgtccaaacacaccacaggccactattttgactatgcccacattaacaccccacatttacttgctgaatggtggagtagcttgatctttaggtgacctaataaagaactgggtctctgttgctcattgcaaagttaatctctctgaatttcagtttcttcaaatggaaatcatgaggactacgtgaggctgaaacacacacacatgctaacatatgcagtatcccgtgcatattcggcactcagtaaatgttaatctctcagtcctttgctttccttagtctcttccttccttgtttccatccctaattatagcagaacctggccacttccctctgcactcaccataaacactaacagctttgtattgcatgcatttgtaaccctatctgtggtgtttttttgttttgttttgttttttgtttttttcgttttttgcactctgcagacacaggctaggtcagaggggccagggttgacactctgagaacaacccttagtcaatacaagcaagaattggaggataaacactttcagttacctgactgctcaaagggctcatgtccaaggcatattttatatcgtctccaagatgtccccagcagaaatgagccccaaatgcccatatcaacttaatcattaacatcctgtattgttttttcccttctctgcctcaagtccccattcttctcttggttcttcctggcatcacctcccaaatacactactcctcaccaaatcctgaccggagtcagcttttggtgagactcaactcaagacactgagcaacccaaccaagtggtccctcctgctcctgaatggataagatatgcccaagatttcacttgagattggactgagtagagctcattccctggccccggtatttcaatagccctttgaaatgcagcttcagctctcactactcttcataaactcttttctcagacgtttccaacactctcgtaattgcaaattcacagtcctttgatccttgtcatccctgcagaactcaacactgatgtcaacctttacttgaaactcttctcccttgtttgttctgaaattcattccctagtttttctctgccttttgtcttctctggatttcctttaaatgcctgttctttacatgtaggctttcacaagactctctaactagaatttgcttctgactttgtattctcctccttgacattctcatccactttgatatctcaaaatatcttctttctgcttttggcacctaaacccacatctttaactctatcttctgtccttttgatcaaacttcttctcagctatggaatgatttaatgctggttgagttactagtgccagtgaatgaacactgctcagaccaatatcaagtgaaatcttgcatgtatcttatccactcaagagcaagatagagctattgattgggttactcagtgttttgggttgagtttcaccaagagccaactggagcaagaatttgaggagaagtgtgttatttggcaaagtcctggtaagcatatctacataaaaattctcccatcacctcaaacccaagtgttccaaactgaagtctttatccgcctccccccgacaagcctgtcccttgtcctgtgattcttgcctcagttaaattgcctctacctcccagtgatgcttcatgttgaagtcctctctttcattcacgtccttttcccaaggagtttctctcatatatgttgcctcctttcaggtgtctttagttcagagtttcatgatctctcatcaagaataacgcagttgcttactaacagcattgacttagcaactcaccattcaccatccattgcatgtatataatcacatagcaaaattcccatgtgctgggtattatcattagccccattttagaagtggagatattgaacctcaaagaggttaagaagcttcttcaacatcaccccagccagtactcagtgtactgactagaaaatcagctagaaaaatcttgaagaatttccactatgctagatgactcattggagtggattgtaaagtccttcctgcattttatgcatcagaggagaatacactttctactgctacagtaaacatagtctttgagagggtagaatattagctggagcgtggactctgggcatggactctggattcactctggcctgggtttagatctcagtcttgccatttacaagctccatgggcaaattagtaacttttctaagccttcatttttcccattaataaaatggaactagtcaaatctacttcagataactgtagtgagaattaaatgaaatactggaagaaaagcatctagtatatgcctggcatgttacaggtgctctgtaaatagtaatgatcataataataattctataaagtttttttaaaccaaggaagaaaacagaagggagtataagggatgacgtaacgatgtaaaaaagtagtttctttttgaacaaaattttagaacaaataaaacaggcaaaatctcaaatctgaacactcacttagcaatgccaaactaaggagtcattttcataaaggtagaatgtactaaagcaatactttatttggccacaccatctatttacaaatcttcaccactgtctctgaaaatgaagaaatatagccctcatttggtttggattctacctgtcttcgcaattttcgcaaaggttctccatccttccccttacaaaaagctatttcaggtcaatccaaaaaagtagtgacagatcaggacagtgacagatcactaatgccttgaggctggtctcagcgcttacaggcatgagtgggaaaggcattagacttcatggttctgtcatagaggagccacgctcacatgacaatctttggtggagtctatggtcatatctttgtgtcaaccaaatccacattccagagcccatcagtgatcaatccactgtctgggtagtgtgttggtataagaataggcattcaaactggaaaaatgttgacacagtaattttctctatgtggtttaaagaaaaagtgagcagagatattataaagatgtgagattccagtgagacagaaaagtatggctagaacctcagtgagaagaggtgctgatctcaggagacaatgactgaggccagcgttctgctcagccagggtgggaacagtgagtaggttttactgaaaatgactgacttgaacattttctcatggtggaaaagggattctgggttatacaaaggtttggagtgtaaatccattacacatctgcaatgctccccacctcaaaaaaaaaaaaaaatatctaaagttaagtaagaagtttgatctaaaatgggctggctatgttttggcaagtccaggaaaatgagaatgcttccattggaactatttcattctccattgcaaaacctaggcctctttctttagaagtccagtgaactatccctacaagttcaaacagtgtctgccccggggtgaaaggtagggaggaccatgacatagtaaaatctagagacagggagaagcctagaaatgtggtggcactaacaaagcactttcatcttcaaagctctttataagtgttaattaattcatccttcccacacccatataaggcagcaagaagagatcaaagagctctgcacagaatttggcaggatcagcacagggaagcatgtagcccacacattgaaaataagggagtaagtaagcacttagtaagagctcttctcccaagccccacctcctcaccaccacctccaacccaaaaaaaagtcacattgaggagatattctggaagagagagataatgtagtattaggaaagacacatttagtgaccccatgtccccttctaaaaatataattagagaagaagataaataagctttaatccaaataatcctcgttgttcctgagttcattaaaaccaaatctgttagaaaaaaaaaaatccactacaccagaaatcactagatgatcaaggagaaaacagttctgcagaagaacagaatccagaccatgggggccaaacatacataggttaataaatctggttatttcatcattctgcttttatttgtttatttgcttacaaatgtgtgaaaatagatctgattatttccagtagatttagaaactgatctagaaaacataattcttttgtttcagtggaacttaacagaacattcaaatcttttttaagaactcttttaaaatattctaaaatttcgaagtaagataccaagtattttttttcaactgttagtttaagttcaggggtacatgtgccagatgtgcagtttcgttacatgggtagacatgtgccacgttggtttgctgcgcagatcatcccatctcctagatgttaagcccagcatccaatagctattcttcctgatgctctccctcccacaacactcacctccaacagacctcagtgtgtgttcttccccccatgtgtccatgtgttctcgtcattcagctcccacttataagtgagaacatgaggtgtttggttttctgttcctgcattagtttgctgaggatagtggcttccaactctatacatgtccctacaaaggacgtgacctcatttctttttatggctacatagtaatttccatggtttatatgtaccacattttctttatccagtctatcactgatgggcatttaggttgattccatgctttgctattgtgaacagtgcttcagtgaacttacacaagcatgtatctttataacagaatgatttatattcctttgggtatatatccagtaatgggattgctgggtcaaatggtatttctgcctctaggtctttgaggaatcaccacactatcttccacaatggttaaactaacttacacccctaccaacagtgcaaaagcattcttttttctccgcaaccctgctaacatctgttgtttttttactttttagtaacagccattctgacaagtatgagatggtatctcattgtagttttgatttgtatttctctaattatcagtgatgttgagcttttttcatatgtttgttggtgtgaatgtcttcttttgagcagtgtctgtccatgccctttgcccactttttaatggggttgtgtgtggttttgttttgctttgttttttataaatttatttaagttccttgtagactctggatattagacctttgtcagatggatagattgcagaaattttctcccattatgtaagttgtctgttcagtctgatgatagtttcttttgctgtgcagaagctctttagtttaattagatccaatttgtcaatttttgcttttgttgcaattacttttggcattttcctcatcaaatctttgcccatgcctatgtcctgaatggtattgcctagattttcttctaattttgggttttagatttaagtctttaatccatctagagttaatttttgtatatggtataaggaaggggttcagtttcaattttctgtatatggctagccagttcacacagcaacatttattaaatagaggatcctttccccattgcttgtttttgtcaacgttataaaaaatcagttgactgtaggtgtgtggtcttatttctgactgctctattctgttccattggtctatgtgtctgttcttgtaccagtaccatgctgttttgattactatagccttgtagtatagtttgaagtcagttagcatgatgcctccagctttattctttttgcttaggattgtcttggctattttggctcttttttggttccatatgaattttaaaataactttttctaattctgtgaagaatgttaatgttagtttaatggaaatagcattgaatctataaagtactttgggcagtatggccattttcacggtatcaattcttcctatccatgagtgtggaatgtttttccatttgtttgggtcctctctgatttctttgagcagtgatttgtagttctccttgaaaaggtccttcacttcccttgttagctgtattcctagatattttattctatccgtagcattgtgaatgggagttcattcatgatttggctctctgtttgcctgttattggtgtattggaatgctagcaatttttgcacattgattttgtatcctgagactttgctaaagttgcttaccagcttaagaagcttttgggctgagacaatgggattctagatataggatcatgtcacctgcaaacaaagataatttgacttcctttctttctatttgaacacaatttatttctttctcttgcctgattgctctggccagaacttccaatactatgctgaataggagtggtgacgggggcattcttgtcttgtggcagttttcaaggggaatgttttcagcttttgcccattcggtatgatcttggctgtgggtttgtcatatatggctctttattgttttgaggtatgagcctttaatacctagtttattgacagtttttaacatgaagggatgttagattttatcaaaggacttttctgcataaatggagataatcgtgtggcttttgtctttagttctgtttgtgtgatgaatcacatttattgacttgtgtacgttgaaccaaccttgcatcctgggaatgaagccaacttgatcgtggtggataagatttttgatgtgctgttggatttggtttgctattattttattgaggatttttgcatcaatgttcatcaaagatattggcctgaagttgtctttttttgttgtatctctgccaggttttggtatcaggatgatgctggcctcatagaatgagttaaggaggagtctctccttttaaattgtttggaatagttttagcagaaatagtacccactcttctctgtatctctagtggaattctgctatgaatccatctagttctgggctttttttttttttttttttttggttggtaggctatttattactgcctcaatttcagaacttattattggtctattcagggattcagtttcttcctggttcagtcttgtgagggtgtatgtgcccaggaatttatccgtttcttctagatgttctagtttacatccatagaggtgtttttggtgttctctcatggttgcctgtatttctgtggagtcagtggtgatatcccccttatcattttttattgtatttatttaattcttctctcttttcttctttattagtctatctagcagtctatctattttattaacttttccaaaaaacaagttcatggattcattgattttttgaagggtttctagtgtatctccttcagttcagctgtgatcttggttattttttgccttctgctagctttggagtttgtttgctcttggttctctagctcttttagttaagttgttaggttgttaacttgaaatctttctagttctttgatgtgagcattttagtgctataaatttccctcttaacactgctttagctgcatcccagagattctggtatgttgtctctttgttctcattagtttcaaagaacttgatttctgaattaatttcattatttacccaagagtcattcaggagaaggttgttcaatttccatgtagttatgtggttttgaatgaattttttattcttgagttcttatttgattccactgtggtctgagagactgtttgttatgatttctgttcttttgcatttcctgaggagtgtttcacttccaattatgtgatcaattttagagtaagtgccatgtggcaatgagaataatgaatattctgttgttattgggtgaagagttctgtagatatctctgaggtccacttgatccagagctgagttcaggtcctcaatatctttgttaattttctgtcttgatgatctaatattgacagtggggtgttaaagtctcccactattattgtgtgggagtctacatctctttgtaggtctctaaaaacttgctttatgaatcgggatgctcatgtattgggtgcatctacatttaggatagttagctcttcttgttgaattgaaccctttacaattatgtaatgttcttctttgtctttttttatctttgttggtttaaagtctgttttgtcagaaattaggattgcaatccctgcttttttctgcttccatttgtttggtaaattctcctccatccctttatattgagcctatatctgtctttgcacatgagatgggtcccctgaagacagcgtactgatgggtcttgactctgtccagcctgccattctgtgtcttttaattggggcacttagcccatttacatttaaggttagtattgttatgtgtgaatttgatcctgtcatcatgatgctagctggttactttgcagacttgtttatgtggttgcttcatattgtcactgctctgtagttccatgtgtttttatagtggctggtaatggtttttcctttccatatttagtgcttcctttaggagctctttcaaggcaggactggtggtgaagaattttctcagtatttgcttgtctgaaaaagatcttatttctccttcacttatgaagcttagtttggccagatatgaaattcttggtcagaaattcttttctttaagaatgtcgaatattaacccctaatctcttctggattttaggatttccactgagaggttcactgttagtttgatgggcttccctttgtaggaaatctggccttttgggcttcccttaacatttgctctttcaaacttggagaatcttatgattatgtgtcctggggttgatcttctcatggagtatcttactgaggttctctgcatttcctgaatctgaatgttggcctgtcttgctaggttggtgaagttctcctggatgatattatgaagtatgttttccaacttggctccattcttcccatctctttcaggtaccccaatcagtcataggttcaatctctttacataatcccatatttctcaggggctttgttcattcctattcatttttttttctctgttcttgtctgtgtgtcttatttcagcaagacagtcttcaaactctgagattatttcctctgcttgatcttttctgctattgatacttgtgattgcattgtgaagttctcctgttgtgtttttcacctccatgatgtcagttatgttcttttctaaacttgctattctggctatcagctcctgtattgttttatcatgatccttagcttctttgcattgggttacaacatgctcctttagctcagcaaagtttgttattacccactttctaaagcctacttatgtcaattcagccatctcagcctcagccaagttctgtgcccttgctggagaggtgttgtggtcatcaggagaaaagaccctctggcttttagagttttcagcatttttgaattgattctttctcatctttataggcttatctaccttccatctttgaggttgctgacctttgaagggggttttgtggggtcatttttgtttgtttgtttttcttttaatagtcagacccctctactgtaggactgctgcagtttgttgggggtccacaccagaccctagttgccttggttttccctatacctggaagtaacaccagtgaaggctgtgaagcagcaaagatggcagcctattccttattctggaagctcagtcccagggagggtcactgacctgttgccagcccaaatgtgtctctaggaggtggctggagacctctgctgggagatatcacccagttaggaggaacaggatcagggatcggcccaaggaagcaggctggctgtcctttggtagaacaggtacactgcattgagtgaaacccttcctcatctggaccctttgtattctccaaatctggcaggctggaatggctgagtttaccaaacaacagataaggctctttattattttgaggtatgtgtctttaatacctagtttattgagagtttttgacatgaagggatgttagattttatcaaaccacagaaatggtggctgcctctccccccaggagcttcatcccagggagagatgagagctttgtctttagaataagccccgacagggaggtcttgcccagtgaggaggaatggattgtggtcctgcttaaagaagcagtctggccacgatctggcaaggcagctgtgttgtgttatggaggacccttacttgtccacctgtagtcttcaaagctagctgactgaaacgactgagtctactgaaccacaaggatggtggcccccccttcctccgggaattcagttctgactcaggcaaactccagcctgctgctgctggccagctggaatttcaagccagtgggtctcaacccatgaggcttggaaattggggctgtagaatgatgccacttggctccctggactcagcccccttcctagggacatacatggatggatctacctcattgccatggatcccagggccagagtatgcaaacctcctgggtctctgtgcattcctgagcagccactctgctgagactacacacagctccatatatcagacccaagacccagtgttgtgggctcatgaaaggatctcccaattcatggattccaaatatctatgaaagaagcatggcttcccaggcagagtcgcactatcactcgccgattcccttggttgggggtgggggttcccttggctccatgctgctctttcgtgggtgtcgccccaccctgcttctcttcaccctccatgggtcaagctgtttgcctagtcagtcccaatataagaaccgaaatatctaagttgaagatgctaaattcacttgctcctttcattcatttccatgagcattgcagaccacagctgcttacaattggtcatcttagctttcccagaaaccacgtattttaaaagttgcacaaaacaatcattcttactattgccctctttcagaaattaactttaacatatttttttataaataagttagaagagctcagtcaattctcaataagataactttccattatggtttggaagagtgtgaaaaaaataaattaataaatattggccaagaatagccatctattcccttttgacaatatctctaatcaaattcaaaggttggacttttgcaggagtgctaatgagcagatataagggaaagggaatggaaaactgaaatacatttttgaagaaccttctttgcaaaaggcactggaataggcagcttattgacatcacaggaaatccatacagctttccaggtctgctcatatttttggaggtttggggacacagaatctcttctctgacctcccacaattcactcaaagaaccagatgagtcttaaaataccagccttataattgacccttcctgttccgaaccttgaccttgggactctcccgccccatccacaccactctccactccccactctgatgctgagcctccacttcccctgtttctggaagcagcagactttcccgtgggaacctccatactctgcatcactgtccaaattggttctgtagaataagtgccctcctgtaaccctctgtatctagggatgggcacatttcccaatgtaacctgttgctctatctcattcccttggtcatgtgaatggttgagaattaggcatgggactcaagtaggtccaccaagagtccatcctggggattaagaataaaacctgcttttccactcatgtctgctgtgctttccctgagaatggagatgcaagacagaagcaaacatgacatgcttcttaattggaaagcaactgccagaggtctcactaaaacaacctgtgtgactcacattttatgttagacacatgttccatatttcaacaatgaatttactgagaaactgagtaatgtgtgaagtaaatagcattacaaaattatcataaatattaaactttcagtaaaaggagacagtaaatatgctcgtgggttggtgacctatatctacacttaccaccaatgtgttggtactgggtattgattattcttcccaactgggaatcacagtcattttctctttggtttgaatgaaatgaaaattgctgaaagtagctttccccacattacttgtggctacatactgcataccaagtcaacaaaaaaagtgatgaagaggattattttttccccaacagaaggctgcattaagtacctcaattttgtgggcttagaacctatgataaatggaaggacagtaggcaattggggtttggcagtttgtttccaagtacttattatattttgtgtttaataaaactttcatggtattttaccccagctcctctttctttggtcatttaaacatatagatgacaaataaaatgtaatttagtgttttcttgaatgttttaatcaaaaagagatatttataagagacattaataattactgaataatcacagcatattctgttttgaactgggagtgaatttttgcaaaagataagccaaaatggaaggtcaaagatatggtcaaaatcacagctaagtttctgttttaaaatagggctggtccttgggaaagggaaaatgagaaacttctatagtactggaaaagttgcataccctggtctgagtagtgccttacacagctttatttatgtaaatattcatcaagatttaggtgcattcattgtacttccaacatttcagctaaaaagtttaaaatgaggccattctagctatctctagacagaaatttcaacacaaaggcttcaaaaaaaagtaaaaattcataaaacattgaaaaaaagtttttattatactttaagttatagggtacatgtgcgcaatgtgcaggtttgttacatatgtgtacatgtgccatgttggtgtgctgcactcattaactcgtcatttagcattaggtatatctcctaatgctatccttcccccctccccccaccccacaacaatccccggagtgtgatgttccccttcctgtgtccatgtgttctcattgttcaattcccaactatgagtgagaacaagcggtgtttggttttttgtccttgcgatagtttgctgagaattatggttcccagcttcatccatgaccctacaaagacatgaactcatccttttttatggctgcatagtattccatggtgtatatgtgccacattttctaaatccagtctatcactgatggacatttgggttggttccaagtctttgctattgcgaatagtgctgcaataaacatacgtgtgcatgtgtctttatagcaccatgatttataatcctttgggtttaaaataaattttttatctagaatctaggaatagagagaattgggaaacatgatccattgcctacaagcactttaccctttgaatgcaatcacagcctgcaaggaagctgatgggaagaaagtttagacacacacacacacacacacacacacacacacacaaacagccctacaacccactcctctccgccccagtttatccttaccttagtgattagatttgtaccactagaaacctgagtgtggtcaacccttgattttgctgaccactcccttcaaagaaagaagaactttctatgagactgaaagtcatgaccagctccagtccctaacctatttccagcctgaagaaggaccacaaacacaaacccacaatcttcatctaaatgcttgtgtgttggtaagttgtgtgttgacaaatgctaatgtgttgatgtgttgatgaccaccatcatctacaattctcacactttcaatcttgaagacatgccatttttggttgaagatacagtggtttaggctgaaagacaggaggaaaggagagaaaaaaaataggaattttgaagtgtcccctttattcttgattatccctatgtgttccatatagtcttgggggcagtgggatgatgggaacagctccaacttggatcctgcaagtggtttattctggtgcaactactcattagtgacaagatgtcagaacagttgttttaatttctctgagcttaaaagttccttcatcaagagaaggaggagttgtgtagcattatgtgtgaaagcactttacaaactacaaagcgatgtaaaaatataagttctcaacacagctgtcaagaccctttgcaaacactgttggatcatgtcatatctgtgttcaaaccctgatgttttcccatctccctcagagtaaaggccaaagtctcacttcaactccaaatcttctccccgcaaatctcctcccctcactctcacccttcaagcaaccccttggctcacacaggtatgtttctaccttgaggcctttgtatttgctgatctttctgtctagaatgttctcttcccaggggtcacatggctcattcctcactcccttcagcttttcattcaaaatgttggttctcggtgagaattttcttgtctacccatacaagagtctcacctcactttctctcaagacttcatactcttctcctctactttatttttccttcttagaatttaccattatttatctcattcattatcttcccctaggtttcttgagagatgtacacatactgatgccaaaacactgctagaacattctaaaacagtgcctggcatatgttatgcattaaatatgtatttgttgagtgaatgggcttattatcatccatatcctcccctccttctcttaaccatctccttcatttattgtcattttccttaagaatcttaaatcttggccaggtgcagtggctcatgcctgtaatctcaacactttgggaggccaagacaggccgataacttgaggtcaggagttcaagagcagcctggccaatatagtgaaaccccatatctactaaaaaaataattaaaaattagccaggtgtggtggcgcatgcctgtaatcccagctactcaggaggctgaggcaggagaattgcttgaacccaggaggcgaggttgcagtgagccgagatcatgccactgcactccagcctgggtaacagagtgagactccatctcaaaaaaaaaaaaaaaatcttaaatcttactcatgattcaaagttcatgtgctcacctcctttgtaaggccttcttcattttcctcccttcttcctcttcttcctccataatataattaattcatctcttttcattttccctgtagtgcatggtttataataattgtctagcatttatatgttatcacattgtactacagtttgtgtgatcctttgcacacacacatccatatattgtgatcagggttgactgtccaaaattatcacttcaactattacagtctctaatatatagaaatctctcaatagatgattattaaatatatacatatacgtcttatacattttaaatgttatttccattaacaatgaaaaatgtggttttcagccaaatgtctactcacatttctgttttagagaagatgatagcagcctatgcactcgctgtcctctcaaaaactctagcttggaaaagcaaggttaaaaattaccactgttttccatgatgactctgttatgctctctaagcactctccattttgcttttattgttatccattcctttttagcagccccgttgcaatcagatacagaaaatttggggttttaataacttgcatagcatgtggaaatatgaaaagccacagaaatatgtactttgaaaaaacaaaaagtttaagatctttattcaacaagaaaataaagatactcttcaaaatagacatctttatttgaactcttcagagaattcaaggctctcaaatattgccctcattttcaatgacattaattctcaaattgtagcctcctctctacccatatacataataactactatgaacaagggaaaccaatgactctttttatagcatcttcacacaaaatcttcaaaccatttgttcagatgactgatctcagcaaagtgggtgaagggcattaacagacatttggaaatccctgtaaatccatcatcctgaaagacagcacagtgttcatggtgactccagagggagtgaaatgaaatatgccatcgactctccagaggttaatcgatcatatttctggtgctacttggtttgacataaccaaatttgcactgaaaatcaactcatctatctttgttctggtcaacttaaaaaatttaatcctatttgacctttgctgaggtgcagtcaaagaaaaacagattcttttctgagctaggcaacctcctcttatctatattacagtcacctgagcgggtccatctttgctctaattcaagagcactgagcagcccgtgacaaatctcatcactggctttttggaccccagcagcagggagactgggagatttttgttttacttcgagatggtaaaggaaatttattttaagaaaaattaaagcgagagaaagcaacagaggaagagtaacatgatgctttcatttaccatatgactgaggcagaaataaatccagagaaatcattaggttcccacaatcaactaattttctcatggaaacgatcaccactgcccaactcactgtggcctccagaaagcagacttggcccctctgcttcaaattgtttttattaacttaatttagaacttaatggaaggatgctactttttatatatagaggcttcccagaaacacaagagtatctgaagttgtatttcaatgactttataaagggatttttctctctcctctgtctctttctttctctctctggaacactctcttgttctcaacctctctctctcaccaaatattgctttgcataccctttgttcaatgtctgaaaccgctaacattcatcattgatgccgagagtcccttgttacaagagaacttcttcccaggaaagaaaaacagccctcgactgtgaagataatgggtgcatttgatatgtttaaagtggggctaaatttctgcaggaactattcaaggagaaggcaagtcaaactgacaacaaagaacacgtgtatccattcatgatggtgactggaatgtgaaccaagcagagagaatgagtatctggaaccaaaaagattcgcctatgaaaaaggccatttgaatgtgatactgtaatgtccatctcacacacagtctttggggacctcaggctcttcacacatgtgatgtatgagtggacagtgacaaaaaaaaaagttgttctgtttaatatttgattctcacacttggttcttcgtgtgtgtgcatgtgcatgtgtgtgtagaggctaaatcaagctcttggtccttgtagcagagataggagaatgtaggtaggcggtcttaggagtttctttctttgctaattttacttttcagggttttttaaatataaaaataagaaaatatatttatttgcatcactcctaataggtattgtcctcagttttcactgagacacaattcaaaatgtcagccaatgcttaaaaaaaaaaaaagaaaaagaaagaaaaagctttgagaagagaagcacttcagtcaaaccccctctcctctaatatgtggaagctcagctagacggtggcatccctcacctcatcctgcatcatagggtaatcactgtgatcatctgcagaagaaagcaacataaatgcacgtgatttaaaacccaagtaaacatccactttagatgtttatgttatatgtgttctacaatccataggagagcatttttacctgataactaaatgttagcaaattctgcactagaactctaggagtctctgaaacatccttatcttgaacctctcaataatataatcacatgagacatagatatataaaataatagcataatatatgttatatgaataacacaatataaacttctattaaatttttatactaagtaagagtcatctaaaacagaaacaaacactgatcaagcactaatacaaataatgttaatatttgcttacattctttgtgcacttaccatgcacgtgctaagactattttaagtactttatatatttaactcattcaccttaatgaccaccctgagaattagctactgtaattttctccattatctagatgaggaaataaaggcacagagagttgacataaatttttcaaggtactataccaagagaactataaacttcacaactataacagcaagcatttattgactgtgtactatggggcaaccattgtgctaagcagttaacatgcattatctttcttaaacttcaaaaaaaagtctaatgagataggtactacttttaaccctaatttatagaaatataaagagcaagtagagtaaatgacccccaaatactaagttgtatcacaaatctcaaactcaaagaggcctaccatgaagacaaaattttgtcctgaccctttctatggaatattccattatttgaaaggaagaaagacagaaatgcccatctgctgtgacccttcctccatggcagggattggctattctcctttacatacactatcttgcttaatgctcccaatgacctgttatgcaagaattaataccccatttcacatatgatgaaatagtttgagtaatgttgttcaagatcccacggctgccgtggggtggaaacagcattcaaacccaacttcttccaataccaaagtcctaatgtgaccacttcattgttttctctccaggcttttgatgtaaaagaatgctgaggatcctgcagcacttcctgtgagcatagtttccctctgtgtgcctcagggtggggggataggaatggaagaggatggaggaggtggaagagggttttccacactttatcctcatctctcccttgccgttttagtggcgattgcgtgaactacagctaaacatgtgatgacaatacctaaagtaaatgatgcattgtgatgaactctagcaaaccaaaataaatgaagtttcatatatgttaaatatgtgacaactaggacaatgtttctgtggcagaccttctcacatggctccccagagtccctgcttcctggtattcacagcctcatgtggttgcctctccttgaatatgggctgaacctagggacttgcttctaatgaatgtgaatatgaaatatggcaaaagtgatgagatgtcacttctgagattagataagaaaggagtgttctttgtgccttgctagcattctctctcccttgccatctgttcgctggctttgataaagcaagatgtcatgttaaacagccccatgtgacaaggagctgagggggcctccaatcaacagccagtgaggaatgaaggctctcaggccagcagcccacagcgtcctgaattctgccagtaaccatgtgagtgagcttaaaagcagagtttcccagtcgagccgttagatgagaacacagtcctggccaatgccttgattgtgagatgccgggagacagagaacccagataggatattcccagatttcaacccacagaaactatgagataataaatgtgttttattttaagctgttaagttgtaagaaaattagttatgaagtgatagaacttacttatgaagtaacagaggatatataacctccttcttccataaaaagctcttccagaaaagtatttgctgtcactttaagtttagcaggatgcatttacatctacagagaatgaagaacactgatttcagaaatctcaaagagcagagaaagccaccttgttttgctcacctcattattgctggagaagtctgtaagtggtggttatagtgaacggaaccctgaacttggagtcaaaatacctgattctgccatgagctcaatgtcagttaatctctctgggacttgcattgctatttgataaaatggggtgaaggtgcttgctggaaattacatctgaaattttttccagcatgatgtacacagagagtatcctcagcagcactgggatctactaaacctgttactgttcactgatatacaactccattagctgtttcacaagaaacatctcagttaggaactgtcgctgcctaattagtataaaagattggcctttcccccttaaaatggattacaacccaaaatagggatcaaatgagccatagcattgagttaccaccttgctagggccctacctcaggccaacctgattctaacaatgacccagtgggaggctggaagtcagaatggatctcctccccaccccagcctccatgcctacagaccatgccttcatcggagagttcatttaaccctctgagacacaatagtatgtacaaaagatgtcctcagttataagttatatgctatgctacaaatcacatttccagaccacatcaaggctgatggaaaaagaactatctcactagaaaaccacgtatggctaagaagtaaaatatctaaaaagccatatgttttttaacagtcttacatcagcagacacaaacaagagtcttgtggtgaatcacaggcactttaatgattttgagaagtctaactctgcagttctgagtgacagaaaacactatctgagacagtagccttaaatgacaatattctttttaaggtggaaaataatttggcaaagatttagggagatctataaactatttgtaatctatctgggaaagatctaataaaaagctaaaattagttccttatgattttcacaggctcacaactggagagtcatccaataattcaccaggagggagtggtaatttgcttttgcttctatgcatgaacatatatgccttttcaatgaagagacagctcggcatgtgactttgaggctcactatctgttaaccatgtcatttgtgttattttggcaggagatgtttcgactgtcttattaatctaaatagttctacagtggaaataaagacaacacacacacacacacacacacacacacacaaagcacacatacacacaaacaatgtctgcattgtttcttaagtgaaccatatcctttcatctttcaactctttagcaattgtacaatgaatctaatcaatatagacaggcaacacaaataagtcagacataactgattttttatgaattaataagtatgtaatgagactttactgcttgttagcatgagttctgcagataattgacttcattctccatttcccttttgtgtctagaagcagctcaaaacagcagccaaaggaaaaaggtatggcaagtatggtttggttggcaaccatttattttggagaccattaaagaaataatttgggctgtggtattttccacactactgttccgcagctctggcatgcatgtcccctctagtatataagtctctgatatttaaaaccttggaatcagttgttcctggttctggaatctttgagcgttcatttgtcagtcttttcttccttgaggcatgaatgtttcttacatgtaatcactctttcagacacaagcaagtggttgcagtattaggacaaattcatgggatcaaaactgcctggaaatatgctgaagagtctgatcttgttccagaaattaatgcttttttgaaattcaataccacatattttaccagtatatatttaatgtacggcagtggaaaggatttgaaatagcaaattttaatgctaatccataaggcgctatttccagacacttgcttacgggatcttttttaaactatcttaaattcccatgaccataaacactaccaacaacagtagtaacatccctgagagcacctttgaatctgcaaaacacttctgtatgggtataaaagccctgtgagacagacaggacaagactgattttttccaatctgcagataagggaagagagcccagaaagggtaaaataactggtttacaggtagcaagaagcagaaatggaattagaatccaggcccctagagtaagccaattcagcatgctttaggacataagaagaccagatttaatcaaaaatataaaagtaaaatagcaacaataatcatgttgacatatttatcataacctggcaagactaaaatagaacatgggtaacatttggaagtagcaattgggaggaggtaaggttcatttggaaatatgagtagagattttctatctaaaaaaagaactgagactcatctatggacctgttggtcctctcaatttccattagttgcaagggcgccagctacctgaggttaccaataagcatctctcagcaagacagatgaggccaatgtcttcattaaagaatgtctttagcttttgtgatcccagtccctgaagtctgtgcagctctttaagactgaccaaaccttgcttactgcactattgtattctgtttctcccacaaccctacaaataggccagagcaggtatcatcccccaccgtttacttgagaggattctcacaaaaacacctcatcgctcatctgtgcgtgcaagagttagtacatcctgggtggtgggattcgaatttgagattgacaatgtcctgtttgaaactgatctctctgtaccaagctccattttattaatcactatttcagagtcagagtccagtcaacagacagcagaaagagtatagtataaaatgttttaggtaggtaaacaatgaaaacattggcttcatccgtctcagtgagagaggcttattggtaatctcaggcagctagtacctttgcagcaaatggagattgacaggaccaacaggtccatagatgagttttagttcatttttcagacagaaaatctctacttatatttccatatcatctccttgatacacctcatctacctagataactgaaaagccagagagagaacactgaagtatcagagaggtagcagctgcaggaaacagctaccatcccaagggctgggagaaataaagattagaatttaaatttctagaatcttggagaggagccctgcagaagaaacagagacccctgagaaaaaggcatggctcatcaggtgcttttatccctgaggggtagatgaggagagctctgcaattgttgcaaatgctgcaggcaggactctcatgctgctccaggaaggcactctcacttaggaactgaagaagcataaccagggtcattttcacaggaactagaagcatccaggaaggagcagtctctctttatctcctctagcctcaagcccccatctagtgtccccttatcagcagagcataaccaggagccatctagctgaacagaaatatggtttgcacagtcctagcccagcaacattcagttgagtgtaaaggggtaggtctggagctaagagataatatcaagaagcgggcaccatccacacctttgggtactcagcatccatgcatatccttctattattttaacttctgtacagtgataaaagcaactttgtgtttcagcctaacaagatgcaactattcttactaaaaatgaagacattctcatactcttccttaaatgagaagacacaagtccagagagtctttgtatccatctgggcactatgtcaattactcctcgaattcagccaaggtcctttctgaattgacttttaaccaaatactaatttgtaaagttatcctccaacaaaacttgtataaaacagtgaaagaaagaagagagaagaagataacagataatacaaacaaaacaagcaaagaaacaacatgcgtatttcctgtgaccctaagtggacatgaggccgtaatggaatttgtaacttccttctttcattattctttccaagtttcctttgcccctaactggggcctcggccagctgggagtatttccatggtgggtatctgaaccttctcgaagggtctaaatactctgtgatccagccttttatagttactctagttcttcattaacttttcatactggctacgaaagtactaagaggaacccccagagaacctcctaggttccagacatattatttgtccccactgtgggtaacaatccaactttctcagcatcaatcacactggctactagagtaaccccttctagatttgctggttcaatggtgtgagtagcccagactggacagatggcagtctctcatcttccagtttcaatggaacacctgttgtgggccatagaggaagcatttatccaaaatcaagtggaaagcaaaaaaatgatgattcagttattagtgagataaaccactaaatacatacccaagacccatgtcttctcgccatgggagagacagttccgatgagtttctgatcccaagcacatagagattcttccactcaggatgttgtttcctaactgacaaggtaagtctaattttagagcatgataatataattgcacccatttcaatggcaccatggaacaaaatgcttatatgaaggacatcgcttcctatatttcgttaagctgagcccagaaaaaaatcctctcctaagtttacactgtcaaagtaaagatagttccactagagacaaaagaacacagaagatcactttgtactttaaaagaagcagtaatgaaagcaaatctaaaaaggctacatattgtatgattccagttctatgacattctggataaggcaaaactgtggagatagtaaaaagatcgctggctgccagaaactggagatagagaagaacaaataggcagagcacagaggaaatttagggcagtgaaatatgccgcatgacactacaacggtggatacatgtcatttaatatttgtttaaaaccttagaatgtaaaacaccaacactaatgtaaactacggactttgggtgacaatgaggtgttaatgtaggttcatccattgtaacaaatgtaccaacgtgattcagggtgttaatagcaggtgaggctgtgagtgtgtagtggcaagggatgtatgagaaatctctctacttcccacagagttttattgtaaatgtaaaaaaaaaaactgctctaaaaaatagtctattttttaaaaaagacattaatctgattaaacaaaaatcaataattatgcaaaaaggagacaactttggatatggtactcattttaaagaaagggtagaaaagtgaagtcatacggtaaaagagaaccaagaatatcaacaaatttgaaagaaatagatgcaaactggtaatatggcaatagccctgaagatctttggatggctgcttcaccctgccattttccccttcagttcacaccccggaacacactactcacctccatcactctccttagtgacctgtagcccctgcagctgagatagcccttttgatcaacgccatctttgactgcattttcaggtagcgctaatgaagagagagcattccccaaagctaagaaaggctggcatcatttgcctgtgtgatttagatgttttgaggttaatttttgtatttagacattcattctgtactatttctttgatcctcagtccaaatggtaggtccctatcaatctgcagagacagcaagtcctgggaacaagacattcagagaaaatcacaaggtattatcagggagggaaaagtgagtgagatggagagggcatgtcgaaggctctgctctctctgggcttcagggaagatgctccacttccatccaatactggtggccagagtctccccatcacccacaccccttcttcttacagcaagccagtggccatgaggtcacttttccccgataagatgatacaaagccaggtagccagtggcttacagagaggtaacttggacagtggtgaaaggaccatgcctacatttgagaaaaacaccaaagggcaaacataaaaaggacggtcccagccctacattaaatcactactgcgaactttctagctcactcactttcttatctcacactctttcaccagattgttgccacaacattttgtaatgcctgggaaacagtagattctgactaaatttttgttgaaaggtagataaatgggtggatgagtcattgtaatatgtctccctgcgtgcaaactcttttctttctaattcatccttcgcaatatcaagtaaattatcttatgtatctatcatgtcatatttcacccagcaacacactccaccccacaaacaaacaaaaaaaagaccttcaaaagctccccttattcccagaatattaaattaaattccttagcacagaattaaaatctgatccatacaccactttccactaaatccctccatactccttcactctccttaagttcctgccatgccagtcactaactagtttaccttgggaagttacttacctttatgggcctccattttccaatgcatcataggtagggttgaaagtactggccacacatttcctcctgcccttccctattcccacccacctctgaccactagtccactttcacaactttcatcatctagaaataatcattttcttttgaggggctctcatatagtattttgtatatgttttatctatgatttattctgccttagtttattgttatcagttgttgtttcttctctcttctactagacagcgagatgtttgagggtggggattagttttattataactattgtatcccccacaacacttggctgtgtggcttaaacatggcaaacttcctttaatgactcgtccaatggattcactctaaaagataagcagtctcttaattcaggacgtgattagaggggaagtgagaaggcaacatgttttctccccttccctgtctgcaaattctttcacactaaattacttaaaaacaaacaaacaaacaaacaaacaaacaaaaaaaaaaaacgccatcgcagaatcattcctgtagcttaaaaccttgtcttctcagaagtaaaatggatatccttcttggaaacaatagcccacttctggggatcatacttctaagtaagaacacgtgcatctgatcttttctgagaagcagattttcacagaaaagtggagagcctagtgctactgagacatgaagcagattgaaagacacaaaaatgagagcctgggaacaccaagataaactccaaccatttcataatcttgctcaaaccaatcctgaccggtggtccccaagtgcctcctaggtggtccatagacgggtttcttgaggaattcatgtttataatatgactgtgtctttgtttttgtttctggaatgaattaatcatttagttagaatagtaaatgaggatcagacgctgcctttcaacaaacgcagttccttttgtctcattagtccttgagaaaatgttggcactgtagaacgtaaataggtgaaatgtgtcaattacaaggtcttctctcctgataaaatgatacaaaagaaagacaagtatggtattcctgttattattcctactgattttacacagtttctctctaagccatcaaattaaaaccgttgtcaatattaggttatcagttcacttgagaatgtcatattattcctggcctccaagtcatcctctggaatattcattccatcgaagagactctccctcatctgtccagaaacattttcatctctcaaagttcaagtagaatatcatctctccatggaagccttttctgattcctccatataagagtagacagccacctatgatctctcacttatctattttatagccagtgaattgaactcctacatttatttgtctatctttgttttagttatgtattactgtgtaacaaaccatctcaaaacttactagcttaaaacaatagcatttttaaaaagttttcatgtatttatgggccaaccaggttcagcagggccattcttctgctaagtgttgtagtagttgaggtcactcatgcagctgcattcagatgctgagagcaaaacatcagtgatgacatctcatcgtctaaggcctctctccacatgctggttaatcactcagtggttgggcttgggcttcttacagcacagcagctgcacaagagaaaaaaagtgggagttgccaggcttcttaagggctaagcctagaacttggatagcaccaccaccttcacttttattgaacaaagcaggtcacaaagccatccaagactgggacaaggtagtaggaatgtacctcttgaaggaggagcagccaagtattaataaacatctttaatctaccacccttccccaccagacagtgtgctctttccaggatagaatacttctgacatttctgagagaatactggaagaaatcaaagatctttgaacatagtcatctttgagaagttaggaagacagtttaaagatgtgtcaaaaggaatttaaaattaaaagcaagaaaagaggtcccataacccacattctgaagtttcacaaaattctggcttcaacagcgttcaagaaaaacaatagaaggagagggagtagccacccatgtcatctgctgtctctccagatgcctaagaaaacaaagcttcttgtaccagaactactatgaaaacatgcacttcttaaagctccttggagctcaaaagtcctccatgttccactacaatccaaaggtccaaccaacatgagattaacctaacatcagaactcaggccacttgatacatttaaataaattttcagcaatagtttcatctaatatgcgattacaaatgaactaataggacctaaccactagaatttcaggtgttagatctgaatatgaaattgtgtactttatttgttaaaggcagggttcatgcaatggaagggaaatagaagatttaataactagttgcatcatttatcagaagaactcgtatcgtcaggttcatgacatcataaggaattgattcctgattgtaattttggggaaaaattgtgctggagttaaatttgacaacataaaaagcaaaaatgttgaaatttttgcatatcctttaacctatatgttctcctaagaatttgtcctggaggaaatagtcataagtagtcacaaagatataattataagatgtttaccatagcattatttgtaacagtgaaaatactagtgacaagctatattcaagcaatatgagattataaattacagcacatctgtaagatgggattgtaggtagccagcaaaattatactatagaaacatatctaatatgaaaaggtaatttatgatataatatataaaaagcaaaacatgaaacagttactgagcgtcagcatatatgtatgagaatctggaaacctatatgccagataattataagtgattagaagtgattatctctgggtagtaaaattttattatttttagttatttacattctacataaggaacatagagctgtaataaatgtaaaattgtgcacttaaagtttttttttacttgtacattaccaatttgtggactgtttagaaggtgttagaatagagcagtttaattcaatcaagtcaggtgactagatcatggaaactgttatttactaagctatttcctgaaatcaacaagttttttgtttaatgaaaagccattgaaacctgcaatatgtcagacacaccatactacacaacaaattgtgttttctcattgatatgatgtgacttcagaacacactgaatctgaaatgtctctgggatttaggactaagaactgtagttatagactgtgaattccatgaaagtagagatttcattggttccattaagtaaatgtgctttgaatggatgaatgataagatcacatgaatcattaatctcctacaagatagtcctgaagatagcttcctagatgacctgaggtcacataattacatcctgtgctgtggctgccgcaaacagcccacatcccaggaacttctgaggacaggttttaataggtagttttatatacatatagaaagagagctggaaaacgtctcagtatatactgaggccatgaggaagctgaaaccagggagagttaggagagaaagaccaaggacagaattttgaggaataaagatagggatgagcttcactgtcttccctgcccgcatgtccatctgatcttcagatgtgggatttcacagcttctcacagcagactgaacttcaccctaggttcaaaagagcacaaaatcaaggctcaaaagatccctgcctggccagacaaacatgttgccttgtgcctgagatctagccatcacatatttatccaattgtctcatatttgacttttattcttagtatcttactccgaattactccaggattttttagacaaagtgttcttgctttgtttgagccagagctctcagttctggagtcctgaatcctatccatctgagaccctctgcttctctgtacctctgctatttgcctattgccaactcccaattactccacccacctatccaaattccctcttattgctcattgccagactttgtcagactgtttgtgttggcagtttcttcacagtggatattcttgagctgtctaccttccgttgaccaagcctagggtctgacaggtagaggaatcatttccacagtgacccccgctttatgctttcctcttttgagacgtgagtcatttaactcctgttatatgtatgcaattggaaaaattctaggttggttatttactggctcagtgttgagtcactcttgatactttaattttggattaactggattcatgacttttttttttttcttcactgaagttcttttccttagaagggaaaagaaacacaggtcttcctgggcccaggtctccaacgcttgctgggtgtttggccagtcctcctctgaaactcagtctgtccttgtctctgggatcttctttttttttttttttttcctttttttgagacagacagattgtcactctgttgcccaactggagtgcagtagcatgaactcggctcactgccacctctgctcccggattaaagcgattctcatgcctcagcctcccgagtagctgggattacaggcatgcaccaccgcgtccagctaatttttgtatttttagtagagatggggttttgccatgttggccaggctggtctcaaactcctagcctcaagcaatacacccacctcggcctcccaaagtgctaggattacaggcgtgcaccaccacattcagactggatcttcttgatctacatggatctaaagtctaaaatcttggatttatttttagacatttgctgaaggtatttgtgatgctttccaattgtgtttgctgtgactgccttcaggatgaaagcactcagtttcgattgaatccattggatgtatattctaaatgtctgtccttataatatctttttgccttttttctctttgtaaatttgtcacagttgctaaggcctggactttcaaatgatttctcttgctcctatctatgaccagaccaaaaaaaagttttcactaataaaatagcagtatgttcccagtggatattcaggagcaagactgatgataaattcttgacttttgtcctggtacttttaaactcttcttctttcaagtctgctttttacttctagacaattctctagatatactgctgttcctcctccttttccttcacattaaaattttgaaacaaaaaataactcactggtccacatgcccctcatgcccactggtatacccagcagtgcagctgtcttgaccctctcgtgtcaacacatcaatcaatcagtcatccttaagagaacatttgtaaagtaactatgttttgagctttttggttcagttttattgggatttttaaataaactgcattcattggatatccaacagtagcccaaacatataggaacataatctgaaatatcacagtttcaaatttcataatttgagatatcacaagaactcaaaataatctgccttactaataatctgcattaaggctgatggtattcaataagaaaagtagaaagttcttacccaatgggtttagagctgccaacttgggtacaatagaaatgatatacagttttcaaagccacaagtcaaagattttacttgctgttttagggaatagctaatatactatttcatttcacctgtcttgagttttctaaatgaattagaccctaagacaaaggatggtgggcagctggtagacatcgcaccacacacacacacacacacacacacacacacacaatttttaaattaagttatagaaattttgtgctcagattagtagagcaattattccatagtactttatgcttctctgatttctctgattatcaattagaattcaatcggagctctttgtttggagaaaaatatatatttgccccataagtaaaaatcccatggttagtgccgaaatgaacatggcaggattgggggctgtaggccaaatcttattaccttttcttctatctctgggcttagcctttcaaccattttgataaagccaaagtaaaggtaaaatggcaacagaagatttagccccacctcctctgaggcttaagacccagtggaaaagctcaaacaaaagtcccaaaattgaatcgtattcatcctgataggtatgactttggttaccgtgcccgtaacaaatccatcctcctagccagtgggatggaatgtgctgactactgtgggccatgtatgcacatgctttcaaggctgaagtctggtggctatttttttttaaaaaaaaaacaagaattaataattgttggcaaggatgtggagaagaaggaactcttgtacacttttggtgggaaggcaactggtgcagccattatggaaaacagtatggagtttcctcaaaaaactaaaaatagaactaccatacaatgggtagatacttgaaggaaaagaaatcagtagcttaaagagatattttatacccatttgcactctcattaagaccttattcataataaccacaacatggaaactaagtgcctattgatgaatgaatgaatgaatgaatgaataaattgtggttcatatatacaatgaaatattcttcagccataaaaaagaaggaaattctgccatttgcagcaacatagatgaacttagaggacattatgttaagtgcaataagctagaaatagacaaatattctatcatctcatttgtatgcagaatctaaaaaagtcaaactcatagaaacagagagtaggacagaggatgagaggtgagagaaatggggagatgttgatccaaggttacacactttcagctataagatgaataagttctggagagctaatataatatacagcatgggtgattatggatatgctacttattttgactgtggcaatcattatacacaatgtgtacatttatcaaaccatcatattgcactacttggatatatacaatctttacttgtcaattaaatattttaaaatttaaaaatagatatatggatagaaaagactgaagttcagggtggcatctgcttccctggaaataaatggtcagaagaaggttgaggattttctagaggaaaattccggtaggtgccagatggaacataaacagcatctcactgataggcaaggccttgccctcaaagagttcatgttctagaaggtaaagagacaatgagcaaaatacttaaataagataaatgtcagacagtgttcagtattctaaagaaaataaatcatatgatgacagacttacaagtataataaattagacaagatgattagaaaaagcctatcccaggaggtaaattctccatataagattatatcgaggcaagtgaggctttgttttatgtaattcttcggtaaatacaaattatttcttttcaggttatttaacacaagtgtttcttaagcattgttcagtttattggagatgatttatacagattttcaacagatgctggcaaatctaaatatttgttcagttcttaaggttgtttgctgagggaagtattttgtatttttacataattgcatttgtttgtatgtgacctgggtttgttgcaactaattgtctgatgatctcaaatttgtctgcaatcagtacaatgagaacccttttgttgtcttttccactttaattctttttttcatctgataattaccattgtctaaagagttacaaaagggaccacactaagaaaagatacacatggggatttttttcaaaaactaatttggacaactaatttattcaattaaataagtgctcccgcctgagctggaggcagcatctttgcagaccacatctatgagcagaggggcacaaccacattttgtgggagatgcatttcagcatcaggaggcagttaagttttcacaggtcatccaaggactaaatggacaatagctcacaagtctttacacctcaattccagagaaaagctctgtgcaattactactgtcttacagctgtggggactgaggcacacactggcaagaaaattactttaggaactatcttccagcaggatcaggaaagaactggcctctgccgaacactgcattcgagtgagcttgtgtcccagatatcaggatatcagtctgtctaggtcccagctgtattcccagtaactggcagagttcctgggacaaagtaggtacctgcattcactttctattgtcacagtaacaaattaccacaaatttggcagcttaaaacatttactatctcacaaattctgtaaatccaaggtccaggtataatatattgtggctcagggagagccctcagcttagagtcttataggctgaagtcaaggtgtcagcaggactgtgttccttttgggaaactttggggaaggacccattttcaagttcactcaggttgttgatcaaattcagttccttgtgactgtaagaccgaggtccctgtttgttttctggatgtaaactgaggactaatgcaaaagaggccatctggctcatggcctccttcatcttgaaagccagcatcgatgcactgaggccccctctcatgccttgactctcccttgcctcttcttctgctgtatttctctctgactcttctcccttccctttaagggtccatgtgattatattgaatattccagaataatatccctattttaaagtaatctgcaaagtccctttgccacatgaagctaaaatatgacaggttctaggggttagggcgtgaatatctttggagggggcattattctgtatgctgcacttaatttttttttctttttaaaattttattgtattttactttaagttctgggatacatgtgcagaacgtgcaggtttgttacataggtatacatgtgcaatggtggtttgcggcacctgtcaacccgccatctaggttttaagctgtgcatgcattaggtatttgtcctaatgctctacttccccttagtccccaccccacaacagtccccggtgtggtgttcctctccctgtgtccatgtgttctcattgttcaactcacacttatgaatgagaacatgcgatgtttggttttctgttcttttgttagtttcctgagaatgaaggtttccagcttcatccatgttcctgcaaaggacatgaactcattcttttatggctgtatagtattccatggtatatatgtgccacaataaattaacacctaacagcagatgttaataatattgtctaggccgtgcagcaatatacctgaagattgaatttgatgcatcgggtacttgtgtagacaaacataagaggaaagaagaaaacattattgcacacacattctgtaccaggcctagacttaagtgttttctcatgaaagctttctttgaacacaggctttgtgagcaagcatgtcatccctaatttgtaatgaggatattgagactcaaattaattatgtgacctgtagcagagccttctaaattgaagtttatgtggttttctctcacgcacagtctcttcatgcttagatctgtgcatgttatacccaaatgtattaggcacatagactttggagcaagaatgcccaggctcagattcaggtctaggacttaccaactgtataaccttgggctaaatgcttcctatctctgtgcttctgttttctcatttgtaaaaacaaaaatgaagataataattgtaccaggtttatagacttatcgtgaggattaaatgcattaatataagcaaagctctcagaacatttctctgggactgttagttattactgtcttacatgtttgagccattggatttcaaccacatttgttacctttcaattggtagtttttactaacttctcatgaatagattttatcatctctggatatatttgtgtttgcactgccacatttattgttagtttttctccataagccctactaaatgatagaggaagtgatagtggtaagacaatacttttgaaatgatgaccatacgtaaataatagattaggaaggataagtgtcacacgagtccgccagataccagaaggtttctccagcatggcataagaagacacaaacccgagagaggtcaggggatcccagacaaggtggctggatgtaaggaaatcacagaggtcagagtggtgtcactctccagacaccaaccagcttccatccccagcacactcacacaagcacaggctgtctgggctccatttgagaaacagagagcatggccccactcaggagcagtggggtggtgtccatggatgtcttcctttcaacatctgcagacactgcccatggatcatgaagcaggagtatgctcatccattacaaagttgtataccccattaccctctttctcctctctccctctctctttctacccctcttcctactccctcctttttggcactaagattatgagagcaccactcttcatagcaaggaagaccgctgtcaaggtcatgaggcccaggttgagcatccagcactacctgagctgaccactgctcccaatcatttcacaccagacacttctttcttgtctttggaagtcagagaagaagcaatcattactaatccaatctgagtgccaagtaatcaccaacaacatgaagcagaaacatgagtcccaatggaaatacattactgatcactataacctaatgaacaccagaatggaacccacatggagacatttattcttgcactcacaatgagtgagatttcgctatattgaaggagtactaagaacggcgtttaaagaaagaagttatgcgaggaaagtgaaatattttcatgctgtcggtagtgtgtgaacattcatttgatcattccattctgtgatcttttcataacaactgttggatcatatagccgtccagcaaacaagtctcttccatgaattctatttccctcttgggccatatgccaagaataacagattgaactttaactccaagtctgaaaagtttccttttactgactagagttcaaccccagtctattatcctaaactaactgataaagcaatcctttgatgctgtcctttgaacaagttgtgtaagctaaaactcagtgagaaagaaaaaagcagcatataaaggaagcttttgagttagcagctatgctaattcttaattgcagacatagtacaaacatttcacaccttaaggttgcaataacaagacccacaaaacttcaaacatagaggcagatatttctgagttcattccttcatctcacacaaaaacctaagcggccatatgttaccttatttttcctgagagctatgatttatgtacattccattttcccctgaatctggaagcaattacccctgaatatgaatgtgacggcaatagaggagggagggtaggaagtgctgtgttcacacagaacagtgtttacatccctggcactctgaatatacttctaatatagggtgtggctgtttatgttgcaactatttatttaaacctgcttatttgtttattgcttccatgaaccatatgctaaattaccagccaggaaaatgtgtgtgagcccttggcaaaagtgaggcagcaacaacaacaacaacaacaacaacagcaacaacaacaacaacaaaagaggaagaggaagacatagaaatattttgatagatatttattttaagaaaattattgaaataatcactacaggaaaaactcagtactttcctggacttctggacttccttctatttagtttagtgttatttgggtttgaattgtattaggatgggaaagggccacagtaaccttttcattgcctggagcttttcaaggaattgacctggccctcccactcacttcctagaaaagagggagcctccagtgttaatcttgggtaaaaacattcaagaatgggtcctgagccagagtaccgcctggcacatagtaggagttcaactgtgaaaggataggaattgttatccctagtacttagcacgtgctttactctttagtaagcatcaatattcaataatcgatattcattgacctatgacagtgtggtggcaaagcttaagtttttctcctagaaagccaagtgaacaactaaaaaacaaaagtatttgcagataaatctatcaggttacacacacatacacacacatgctcatacgctctgtgacacgccttataaccagatttttctgaagccacgtagctgcagcctgctgtttttctttataccagtaagttattttattttctcctccatgtgttttgtttgattacatttgttgtatctaatgacttgaccagattgaagaatgatagctgtgggcttgcatggttaaaggtgcctgcaagccaggcacggtggcatgcgcctgtaatcccagctattctggaggctgggacaggaggatcctttgagcccaggattttgagatcagcctgggcaacacagcaagactccatctcaagaaactttttaacaggtgccaggaagttgaactagctatgttccctgaggtggcccatgaattggggtaagtgttaggaaagaattcaggggcagcaatggttaagtggagggaacatcctgaccaaacagtgacaagcagcagctagaaatattgcatacagctatcacaagggaggtcagagagggatcatggtctttcctgatgggccatggagcttgaaaacagggacctggcagcaggcactatttagtcactctgaaaaatggccaaggtgtctgagattaaagagtacagctcatgacaggtctggactcaaagatgcataaagtggacaaaatacaggcaagacaaattctgctgtcaagaacctgctgggctcctctcttggggggctaacagcgcagctaggttgacaaggcaggaatttaggcacaagagaattgatagccatctactaaaactagagtttggggtggggactctgtgccatgaacagggcagaaacccaagtcagaaccaaactgatgctggtagatgccttccattcaatctccttcacctcccgattacagcctgcaatgagacggaccagaggtggagatgtaggcacctcggcacgtcttcattgatttgctccttcatttagaaaacatcctatggctgccacctcttgccaggcaccaagaactagtggagatgacgatgacatagcacagcagagagacagaaaagggagcacatttcaattcctaggtgtgttgcaaggaagcccagcagggaagggaggccttcaaaagatggacctaagagacgtggagaaaaggaaaataggaaaattaaaacattttgagttacactatgttttctccataacttaggtttttctttacacatgatattcagtgatttgatctttaattagagtgaacttaccactttcagtaaattgtcctttcactatgctgtgtttatttatattaaactctcaagaccatcatgaagggtgaaactaacacagccaaaacaatgcatgtggttttgatccccaaacctgtttctctccacctccccatttctgtaatggtaccagtcattcactatttggacaaactgaaaacctaggagtcatccttgttttctctcttggtcccatcacttcttctcccaacaaccaaaccatcggcacactcttccattcaaaggctacttccaaaatatatcctaaaatcattcacttctctccatctgtgtgccacctcctagcccaggacacccatctcttacctgtaccatctcatcagcttcctaacatatctccctgctctcacagttgccactccctaaatccactctctgctagagtagtcacttcattacctgcctaaaggcagtcagtggtgtcctgccccatttcaaggcctggcttggacctacctattcctgtgttctggtgcctaatgcctgtcacaccatgcctctccctgcttatccactatatcctagcattacactgcctgcttcttgttccttaatcaccaatccattcccatctcagggtatctgtaccttctaattactctgcctagaatgttcatgtccagtctttgcatgactggcttcttcacatgggtcaacttgaatttcccctcctttaagaggtttggttctatgccaggcaaggtggctcatgtgtgtaatcccagcactttgggaggctgaggcaggcggatcacctgaggtagggagttcaagaccagcctgaccaacatggcgaaaccctgtctctactaaacatacaaaaattagccgggcgtggtagtacatgcctgtaatcccagctactcaggaggctgaggcaggagaatcggttgaacacggaaggtggaggttgcagtgagccgagatcacactattgcacttcagcctgggcaacaagggccaaactccgtctcaaaaaaaaaaaaagaaaaaaaaagaggttttgttcttttaatgttaaataagtgtgatcataaaaacaacccttttgttactgaattttaaaatcttcctcaattgttgtagttatcattctgaagatggtgtccattttctccagttaaaaataaacataaagaacagtgggctcactgaaatctttcaccttagcaaactgctcaattcagtggccaaaatgaaggcattttgacctcaggtatctttagcaggttaattttgcaaatctccctctgctggagttactgtggtaggtgtactgggagctctgctaagttccaatagaacctatctagtagatgtagccatttattttttaaacaacagacatctgaagcaccatgtcggggcaaaatcgagtcctggagtttgactttgccaatcactgcatgttgaactatggattgcaattttctgattagcatgtgatagctaattttaatttcaatgcttagagaaaaatcacagacctggacatactattcctacagtcagagccacagaacaaacagagatagaggttcaattcagtggtactgttaaaggtctttagtaaagagtatttcactcctcttggtgataattcctgcatcctcagagaaaatgaacctctggctaacaaacctaaacttgggtgtccaaggtaagagtaaacactctttattgggccagaaatcactttaagtgcttcacgttcataatgtgtaactgtcacattatgaaaaggtctgcctcatttttttatatgaggaaactgaggctgaaggaacacccagtgagttgggggatgagcctgtattcaaattatggttcatccagctctaagcccccgactagtcctgctgccaacattggcccccaatctcttcaactaattaagctaggactgaggctcacctaacaccactagagaataaaatgagtcttgtaatacaaagaaagtgaaacagaaaagagcataaaaagagaaagggcagagatggtaataaaggagaaaattggcacaaacccttattattcttcgaagtggagagagtttattggatttctagcaaaatccactttatcttctcaattcaatcagattgataaaccctctgaagatttataccatgctgtcattgtttttctgacccatctggtgactgtgatcatgttcaaacattaaatgagaggaaaataaatgtgcattctttctggaatgacagacacatatgttctcagcctgacaggtcagattcagctgaagaagacacacaccaaaaaatggatttctttaaatgggaaagggctgaaatcagttcccaagcagctgctttattttgagcaaagctgcatgtaatactagatgggattaaacctctctttttctgatgaggagccggccaaatgtttcctagtttctaagtatgtaccctggttagatcccaaagaggagctaaaaggaccttccaagatatcgtctgttgaagatgtcattaaagattctccctcaccagacctttagtaattggagaaaaatgtctgtaggtgaattgtctgagaataaatcattttgatctgcagagcactttagtctttaagcactctgaggcttcagtgaaattcttttcatttttttttcagtcaggtgctgatatttattgtggcttttaatggtatgccaaaaaagatcccaccatgtgtgtgcatgtgtgtgtgcgtgtgtgtgcgtgtgtgcatgtgtgcgtgtgtgtgtgcgcgtgcgtgtgtgtgtgcacgtgtgcgtgtgtgtgtgtatgcgtgtgtgtgtgtgtttgcatgtgtgtctgtctgactgacgatactgattagctggcggtaaagactctcttttccataagagaatcacaagaatattttgtttttaaagagcattgatttcttaggcacaaaaattattttttaggaggtagactaataatttcatgtaaaattcctgtgaatcatttaagggacatacagccttttgtgtccacttcacaaatatgaagagaggcatgacatgactttactggatggtaaattccaggcctcagagactaagccagaccaccagccagcaagttcttacaaactacgtttccttccttaggtatgttttacaactttttaaaaagttgtaaaagtaaaaactccatgtttaaaagtaaaaactctatgttttttctaaatcccctttttagcatatcctactagaaaggactgtgttagtccattttgcattgctatacaggaatacctgaagctgagtgatttataaagaaacgaggtttatacagaaagtaatcccagcactttgggatgccaaggcgggaggatcacttgaggtgaggagttcgagaccagcctggtcaacctagcaaaaccccatctctattaaaaatacaaaaattagtggagccttggggtacaagcttataattccagctactcaggaggctgaggcaggagaatcacttgaacccaggaggtagaggttgcagtgagctgagatcttgccactgcaccctagattgggtgacagagcaagactctgtcaaaaaaaaaaaaaagaagtgaggtttattttagctcatggttctgcaggctgtacagcaagcatggtgccagcatctgcttctgatgaggcctcaggaggcttacagtcaaaggagaagacaaaggggaaccagtgtgtcacatggtgagacagggagtgagagagaggggaagaagtgccagacttttttacacaaacagctttcacatgacctaagagtgagaactcactccatcaccaaggggatggtgctgagccattcatgagggatccacctccatgacccaaacacctcccaccacaccccacttccaacaccaggaattacagttagacaccagatttggaggtatattagtccattttcgcgctgctgataaagacatacctgagactgggtaatttataaagaaaaagaggtgtaagggactcagagttccacatggctggggaggcctcacaatcgtggtggaaggtgaaagccatttcttacatggcagcagggaggagagaatgagagccaagataaaggcaaaattccgcataaaaccgtcagaccttgtgagacttattcactaccacgagaacagtatgggggtaccccctacgattcaattatctcccaccaggtctctcccacaatatgtgggaattatgggagttacaattcaaaatgagatttcagtggggacatagccaaaccatatcagaaggggacagatatccaaaccatatcaatgaccgagtgtttaattttgtatttgtcttcaattccacagggtaaaattcacttttctctcatgatctcctattttgatttctgaagttttctgaaacttctgtgaataaaacatacttgcagttgagcttctgtcagtgagggggcaggtgggtgctacagtttgcaccagaggcaggtgctgctttaggaggagtcaggaggcagggatgtcccttggtctttccttgtcaccatcctttctgctttttcttgtattctcacagcatgaactactgacctttggaatgtgaagaccttgcttcaagtgagaccttgtctctacaagaaataaacaaaattatccaggcgtggttgtgcatgcctgtagtcccagttacacgataagctgaggcagaaggatcacttgagctgggagagattgagcagaggttgcattgagccaaaattgtaccactgcactccagcctgggagacagagcaagatcctgtcttaaaaaaaaaaaaaaaaaaaggaaaagaaagtaaatgatcctactcaagaaagttccatcttaggttgaaaatcaaaatcaaagcatggcaggagatgggtatattctaagacgtttcttagctactgtgataatattctttagagcactaaaatattagaaaatatctctggtcagagaccaatttggtggcttagaaacagacatcctacccttctcccagcatatctctttgttttatgagtgctgtagaaacacacgaccttgccttttgaaaatgtggcttattaacatgtcatctcatctggttatgtttttatatgggtcactttcaccaaggcttgcttcagaaacttggattgatgggaattttgtttgtctggttggttggttgattgtttaagatacatcttttctgcattacaagtgctacagataatagaaataattcattattggatagtaccatgcttttattgtttacactaacataattttgcttgcttatcaactggacttcattggcagttatttaattagctattattctaacacaaataagcaattttttaatcatcgcaccagatattttactgcgaagaagacaaattaaacaaaggagaaacgaaatacagatttttagcaaaaaggactgggttggtatcacatgaagggaaacagaactagaatactgatatggtttggctgtgtccccacccaaatctcatcttttattgtagctcccataatccccatgtgttgtgggagagacctggtaggaggtaatagaaccatgggggtaggtttatcccatgctgttctcctgatagtgaataagtctcaagagatctgatagttttacaaaggacaattcccctgcacatgttctcttgcctgctgtcatgtaagacataactttgctcctccttcaccttctgccatcactgtgagacctccccagccatgtggaactgtgagtccattaaacctctttttatttataaatcactcagtctttggtatctctttattagcagcatgagaacagactaatacaaatacataacttgattttgtctagcactaatcagctttcagtggtggaggagggaggattggcctaggtaaagggatttgcaaagccaaacctggagaagaaagactctttcctgaagctattaggatcatcaaaagaggtcaaaaccaaaaattatgctaggcatgaagttcaagaaaccagggagttctgtgatggaggatgctggccaggaagtgcaggttaagtgaagccttttagctggaagtgactttatgttctacagccagtgtttatgtcttagccgatgcatgcaggatgagagtgaccactgtaggtcaaggcagatggcatcaactgcaagttctaggtgaacgttttccagctacaggtctttacccgttagtgtggtcataaaataaattcctgaatagcaaaaggtgtttgttattttcatgaagtaatagaatgtgatagaatacatagattaaaatagaataaacagcattgcacatggtaaaggaagtatcatttggggaaactctgtgtttgtgtgtgtgtgagtgtgtgtgtgtgtaccatggtataatttggttttcttaaacgttttttgtgggtacatagtagatgtatatatttatggggtacgtgagatgttttgataccatcatacaatgtgaaataagcacatcatggggaatggggtacccatcccattaagcatttatcccttgaattacaaacaatcctattacactctttaagttattttaaaatgtacaattaagttattattgaccatagtcacactattgtgctatcgatgcaatgtaatttgtatttcttaatatatatcaaggtcaaaaaaagcctagaagcacaactagtgttccagatagaccctgcctgctctaatcctcatcatggcaggctttgaacagacaactttcagttatagttgggtctttatccagagttcacttggctcagtatttggtcagcaccactaccaccatcccatcccacccactccatccttggggccatctttggttgccttaagcctagtcaaagtcatcttcttggaatccacatagtctccagctccagcctttcctgtgagcccaatacatacacaaggctgtttaacgagacttctatcctaatcggcactgaaattcccagccagtcctgaaaccttgctcttaaaacccagagtacttgacaaaattcctaacaaccttcctaaatattgtttgatgtgtcttcccaaggatataaaccctgccattttactctgcagatgagccggagtcccatgttcatccatatgcttccctcttggaattgtgcctgtgccataattaggaacttcaccactgctagaaactctggctactatgtccccaaggcatcctcaacccagctctcaactgaactatggattataattactcatctgagcttagcattgggatttgtctagaggagtggttctccaagtgtagtcccagatgagcaacatcaacatctcttgggaacttaccagaaatacaaattattgggcccaccacagacctattgaattagacactctggaggtctggcccaggcatctgagttttaacaactcctttaaagtttgcacactaaaatctttggactattgttctaggcaaagacacatgtactagaacatctattgatacatgataaccaagatagaacatcttttttttattccctcacacagattgctatgtgatagtgtcatgctcaaatgaaatgtgttcatttattaactttattatgttagaataggaatcttctcactgctgtctttgttcttacagttttactcgattgaaatatgaggacagttaagtagcgacctgactaaataaaaacggagcacatagtagcagaactgttttgaagtttgcaagtttccataatgctaaaaaaagttcatttgttaagtttcactggctaaatttctttcttccagctggaaccattagtaaaagacgtgtgaacttcatgaggcatctttttttctcaggaaaacacaaaccagtgtttgcttttttgttttgttttgttttatactgtcttagtccattttctgttgttataatagaatactatagactgagtaatttataataaaaagaaatgtatgtcttacagttctggagggtgagaagtacaacgttgaggggccacatctaggtaggtccttcttgctgtcataacatgacagaaggcatgacagggcgagaggagcaagccaccatgctggcttttataacagagccactttcagagataaccaacccactcttttgatcacccattaatccattaattcattcatccaatcaccttttataggtctcacctggtcccacctctttaaaccatcacaatgccaattaaattccaacatgagttttggaggagaaactcaggtgatagtaaagatggttctagacactgggttccttagcacatgtgtgcattttttagtttccccgtcagccattgccttaaagcccagattactgctgcattttatagtactgtaactcaaaggtaaacacttgagacagcacctgttaatattttttggtctatgatgcatttatgatcttttttttttttttttttttttttttttttgagacagagtcttgctctttcgcccaggccagagtgcaatggcccgatctcagctcactgcaagctccgcctcccgggttcacgccattatcctgcccgagtagctgggactacaggcgcctaccaccacgcctggctaattttttgtatttttagtagagacggggtttcactatgttagccaggatggtctcgatctgacctcgtgatctgcccgcctgggcctcccaaagtgctgggattacaggcgtgagccaccgcgcccggccgaactttcttataaagaaacagctccttccaggaattagcctacttctttactaatccttagccttccaaacccaagcacggatgtgtctgtgtacgctgacagttacacacatacacacatacccaccaactctggtgtttttgcttccatagactggacacactgattaggcagagaggagaaactacaaatcaaccattacagataaacatggagtcagtattcctgtgatatggttcggctctgcatcggcacccaaatgtcatctcgaattgtaatccccacgtgtggaggtagggaggtgattggatcatgggggtggtttcccccgtgctgttctcatgatagtgagggagttttcacgagatctgatggttttataaatggcagtttcccctgggcctttcactttcttctctctcctagccaccatgttaagaaggtccttgctttcccttcaccttctgtgccagattgtaagtttcctgaggcctccccagccttgtggaactgtgagtcagttaagcctctttcctttataaattaccgagtcttgagtattaggtatttctttagagcagtgcaaaaacagactaatacatcctgagttccatttgtagctctgtcaatgactaactgtagtgtgcaggtatttttctggtctgtgcagcatcccatcctttgaggagtcacccatccaccattttgggagggacctctccttagaccacatggtacaggtgaattgatctcaccttcctgctgaagaagcagccacgacccaggctaggtcactcagggaactgagcccacaccctgggcatggcggttaggtcaggaaagggtcccttccccaaactgagccaaatcataatgttcccagcactcttgccatgagaggtggtttctctttctctatgattataaacactgaaagccacatgcatctggaactcttgggggccattgtgctacttcctagggagaggaagagaggtaagccgggcagaggaaagcatctccaagaggcctgaagccacggatgcccaaggtccagtgtatgtctttggctccctagttacccctgtcaatctactcccctttttcacaaaatctattttgagttgggtttctgtcacttgtaaccaacagcctcacagagttggctggatagtcctgtaaaattgattttctaattgacgcaatacatgggcaaatcattctcagtggcctttttccagatctatgactaaaaaatatcctattccctaacttgtgcaggttattttctaatagagcaactaatttatttctggaccagttttatgttgcttaaacaaaattgaatttatccccccttaattttctgcaaaggtgaattaagtccaaatttatggatgctgtgaagagaaattcccactctagcctgctgcaaaacagttcagtgactggtgcacaggcactggattctgcaagtccagctgtgtgaggttcgtcttcttgccattgaccttgttttgtaactggtacatcagccccttatttggttctggtgagagcaaaggcaaaatgcactgatcatatttgctgacgtattatgagcagtcaaagcgtaagaactgaagcattggcagccctgataaacccgaatgaacacaggaaaaggttacattgctctataaacagtttttatatataaatgtcacatgaaaggctctgggattaaagatttatgccgtggggctgcctggaaaacatcactcgagcactgttgttcctttggcagtagatgttgtggcacttactgcttcttttatctgggcctctttttcttagaactctacactgtcaaaacagttctttgttcttagtttatatgtgtaaaattttattaaaaagaactgaggccattttatttcttttatataaaaaaaaaaaacaaagaccagaggcaaataggagacaatgttaacaaagtatacttctgggtattgggaaaccaggtgtttttttgtacataaaaatatacttagggctctaatggttgcaccgaattatcacttataaataacaagactccagaaggattcatgaattcattttctgtcctaatagtagcacttaaaaaaagttctcatcaaataatattacactgagcccagagatgaaaaataaaccacatggagatgagaatacttgaaagctgcccagaacatcagttgctaaacctggaatctacctccaaacctgtttgagtggcaagcagcaaaaactcacccaccaattattaaaagcaatttcttcacctttaagatgagaatttaggttgtggggggactaaaaccaccacaagaagaatgctgcagaaggccaataaagaaattttatgtgcagaggaatttgccatatatgtgtaaatggtacagttattttgcagatgatatgcatttttatcgctttagttttagttgtcattttcattattatttgccagtgcttaatggcaagaaatgggtttttttgtagcataaaagcaatagctgtgttcaattatgcatatttatttaatcaatgttattaacacagtgcttactctaggaatgtaatattataattatacaccaaaggaatttttcagacaaactttcctttcatgtcatttcatatgtcaattataggacaatgttatttattcatggaatctggcattatagtcactcaaaatatattgttctaagcacagcctgcttcagtgagatactgagactccattgttccaaatctctcacagtgattattagatctgctcaaagaaaagatccccggccttacattcaaatatgggcaaataaacacgcatttaaatgtgtaaggtaagtactatatttttatgattccccaaagtaaagtgccactttcatcaaatagacaaattgacaatcataagtcttagttcagcaaaaacttattataacatcatgatttatatttattggttttccatttttacagtcaacctatagacacagaagaatacaagagacttaattacatttacagaacatgatgtaaatgttaaacatttacatcattaacataaatggaaagacagaactgacagaagtcagcagtcagaagagagacggttacctgatgtataggaggctaatttcctccacctatgtagttaggagtcaaagaaataccacctcaaattgaagaattaagaaataaaattggccaggcatggtggctcacgcctgtaatcccagcactttgggaggccgaggtaggcagatcatgaggtcaggagttcgagaccagcctgaccaacatggtgaaatcccatctctaataaaaatacaaaaattagccaggcgtggtggcacatgcctataatcccagctactcaggaggctgaggcaggagaatcacatgaacctgggaggcggaggttgcagtgagccgaaattgcaccactgtactccagcctgggtgacagagttagactctgtctcagaaaaaaaaaaaaaagaaagaaaatcaagaaatagagatataagcataagcaaagtgcataaaataacacgagttatcatgaacgaaaaataacagaacctataaagaagaggttaaatcaaaaaaaggtgaatatacataggacaaatccttatctttaagagcagaaatcaatgctgatatatttgatgaaacgaagagaagtataaatatattgctttttgtgacagtaaaactattaaaaaatgaaaccagaaatggtaaatccccagtcctccccttatttgacctatcggcagaactttttccctgacacctggcctctctgggctttcagcacacactcttctcctctccatctttcctcctgctgcacttgctccttcacagtcctcctggctgcttcctcctctctaactggttaatgtcagggtgtccctagaccagttctcagccctctcttcttctctttctgcactcattcccttggtagtgacagtctcttggcataagatcatctgcatatttctctgagatgttgaaaaatgcaaccagttgtaataattttagttgaaaaatatttatgagacacttatgatatcaaaagcacagtatgaggttctcaaagggtgttattcactagaactttctgttatgtagaaacattgcatatctgcactgtccaatatgatagccactagccacatgtgactactaagggcctaaaatgtggctagtgtgtacataagaaactgaatttttaattttttaaaattttaatggccacacgtggctagtggctaccatactgtacagtacatttctagagacttgtctatgaacaaggaaaagatcccactaaagaaaagacagtttgagaaaatagaggttaaaaaaattctttatctctactaaaaacgggccaagttcactcaactatatcatgtaaagattttggaaaagtagttctaatttttactggcgaaagataaagatagccaaatcaacttttgtcattcttaccattattttgcttatgatattagaatattaatcccatttttaactctgtaaattttggtggttagggaatacaaagttaagaactaaactaaaatcaaggcacaatagactcattttagccaacttaaattttccatcttccttgggtttcaacattttctcttcagtttcaaagctctcagtagaactgctgttatttcattggtctctaattctgggcttcttactctgattttgtttcctgatatttatcacatgcattgtgaatatctccctgcatcattgatacttgccttttatcatggcaagacttctgggcttatagtccactaacagctgcagtcatctcaactcattcctggcttggaagcgaaatatctgacatttcattctgatttacatatcatcatattagaattcctatttttttattgcgcattttctcagggcagattttcatgtggtgaatatccaggttttagttacttagtcattctgagtttttttttaatttccttgtttaaaaattttaaaactatctttagatgaataaatgtctgctattcttgcatactgttaactactcctgtctatttcatattccaaaagccacgcccaccattatttttaacacatgcctctatctctggacttcactcttggcagtggagtctgaggctgctgtgggaccacagacatccataagctttctaagatacctttcgtctgactgaaagggtattctagttgccattttattccttccacaggtttttaaaagttgttaacagcccaacttttgctttggtctttaagccttggagcaaagtttagagtgagagcccatgtcttgctggggtaccggaacttgacctctgtggtcagactgtatcttcatttaagaatctcctactgaatggagagatggtctgagaaactcatgtttttctaaaccagcaagttctgggatttctacagtcccttgaaattctatttgcaggccagctggtcattttctgagctcacgatatcatacagctaatattatatattagctggctaaaagaagccagccaatactccaacattctcatagaaaccatcttgcccaagtccacaagttcattggttacatagctaccttccagtttaccacagttacagaacatgggtcatcccttttgcaggctgctatgatggtttcttcagtattttaccaacctataccaccacctagtcccatataatttaggttttacttatagccagcataccacttgttaatccaaatttctatattcatttgcaattggtacagaaatcttgcataatgaacagctttaaaaaacctcagtggtttgcaacggatacagtttggatgtcttcttcaaatctcatgttgaattataatccccaatgttggaggtgggacctagcgggaggtgtttcagtcatgggggcaaatccctcgtggcttggtgctgttctcgcaatagtgagtgagttctctcaagatctggttgttgtaaaatgcggcagctaccccccagctctctctttctcttgctcctgctctggccatgtgatgtgcaagctcctgctttgctttccaccatgactgcaagcttcctgaggtctccccagaagcagatgccaacactatgcttcctgtacagcctgcagaaccatgagccaattaaacgtcttatcttaaaaattacccagtctcaaatatttctctatagccaagtaaatatggcctaacacagcaacaataaacatttatttagttcacattatctgtagatttgctggggcagggtctgcttatccaggctggggcagctctgctgggtggctcagcacaatgtatctcattcccctcctcctggaacctgcaaactaacctggtcatgttcctttcatggaaacagcagatgtacaagaacccaggacttaccatacaagagcattttcagcctttgttgagtcacaactgctaacatcccactagccaaagcaaatcacattctaagcccaaaggagtggtgaaatactttctatccaccatgaagccaaagaaagccatatggtcaagtccaacattaaaggagcagggaagtttactccttccatgaaagtgagaagggaggaaatatatctgacaagaggtaaatctcacacacacgcgtgcttgcacacatgcacacacacttcttgtttctactttactttcataattcctacataagttaggcatattttagtataagcaactaaaataaatctggctaagctaatcacaaagaaattcatcaaaagagtatggggaaattcatagaattaaaaaaaaatctgaccatacagacctcagaaaggattagaaccagaaaactcaaaagatctgagcagcagaaactagtaggcagtctcggggggattctgtcatagaatggggacaattttccatcaagccactcagctgaggattcaaattctcaagagagagagtctaattgagcaattctgcccagccctgggccagtgaggggtcgggacactgtcctaccaaatctgcaaataacagggaaaatttgaccccaaaggaaaatcagtgttttgttatcaggagttgagaggattgtgtgctaagaagacaaaaacagtgggtgtgcccaccagctaccttatgaaccaatctattaggatttaaggacattaaacttgtcaaaagtagtgtattgtgcagacccaattacatatgtttatccaattaaaatttgtatgaagaaataaacctatgttaccatgccaggcacagtgactcatgcctgtaatcccagcactttgggagggcaaggtgggaggattacttgaggccaggaattcaagatcaacccggccaacatagcgagaccccatctctatttaaatttaataaaaaaggaaacaagcccatgttagtctaacacacattgttcatcagaggtcttggaatcagaagacttagactaaagttccaagtctaccttttgccacttgtatgaccatgggcaagtcactgacccacaatcttctcatcataaaacaagaaaaacctgctttatcgatttcagtgcattgttgtgaggctcgaatgtattcacagatacatatacaaaagtgctttaaaacctgtaaagttactcgcaggtgacagcgactcttatgtgtctcacaacactgataccagtttacaatttcttacaagactcatcaccacaacctccacaacctgtgcctatttattgtttcatctagaaatgcaggcatatcagaaaaaattttcctatttaagttaattagttataattataggaaaaagacactctgaatgtagtgtccccaaagaatgaagaagggaagagggaatggttatttgcatgccactattggaatacagtttagtgaggcccaatgccggggtctattactgtattctactatcataagaagtacttatgatacttccaggacagtattccattagcacaagtactgggttgggaaagtattcaataatcatacaaggtgaagtggcagaggcagacaaacagagagagacagacaaagagataaagaaatccttttctgcactaaaaattcgagttcatgtgatcacaccactgtactccagcctgggcaacacagcaagaccctgtttacaaaaaaaaaataataaagaacagaaaagtcaagttcagagttgctgagtgaatagcagagactgtgtatatgctaaacagcatcttatttagttccatacttaatgcctctcacccttttgtatgttttccattggaaaagacttgcaaaaggaacaggaaatagcagaatatccaaacaaccttcatgtagtctgctgagggaggataaaatatacaaaagtggctcagcgaggcagcccttgaatgactcgccccagctggggcaacacagcctcacttttgacagcagcttgaagttgataacttggtgaagactgtacacaaggagcgggcatcagcacacccacggccccacacagaagccctggtatcttgaattcctcctcgaagatctagccacgcccacatgcgcacagagggacactcagccctcactgcttaaataaagatggagcctcaccgggctgctcttcctaaacgggtggcttgctcattcatgactgctactttctacagtcaggccccaggttatgtctcaccttgtaactgatctctagttgttcttccattcatgtagcagaataatatttttgcagcattatcttatttggttttatctcatggtaattttcccccacagaagcaaagagtaggctcagaatcccttgcccccgaggaaattggcgtggcagaatctcctgggcatgtgtggctccaggaacttccgcccctcggagatcatgcttgtgcctctgacgtggacatcaccgcagagggctgcttctgggaagatggaacaaatcaatgggggaaggagttccctgagggtagaaaaggtttcctgaggtgaggtaagaataagggagagagttatgcgggcaaagtcctgagtgggtctcaggaagaacgccccccacacagacacacatggtcacagagacccagacacatatggtcacacagacagatagacacacttatacacatagacacacagagacatgtatggtcatagcaacacacatggacacatatacacaggcacagagatatatataaacacaaatatacagctagacacagagacacacagacacatagacacacatgcacactcaaacatatttatacaaatggcacacacagacatatacggaaagccacacatagagacacacatgaacatatatacatgagcacacatacagatagacatggacacacatacacacatggacacatatataggcacaaaaacacatggacacacaaacacagatacatacacagacacacatggacacacatatgcaaatagccacagacatggatacccatggacacccaggacacacacacaaggacatacacatgaaaacactctcctgttctaattgttggacaggcccttgcgggctgtgtccaggtgacagggccatgggaagcctcactgaaatccccatgttccagcccggcatcaaggttacagtccctcagttattagacttaaagaggcccaaaaggaaaagaataagatgatcacaatccatgggcaatcaaggaccaggcagcccatgcaagtcccagaggataccacaatgaatagaggaatagatgagctcattgtcccttgatcccaacaccttgctattgtaccagaagagagagagggaagctttagattattcgaagtagtttccatcataccagcagaataaaactggaaacaaattaaattgagttgtagaaaaaataaaatcaaattttgtgcataccaaggctggtggactgagatccataccagctatctgtgtacatttttgtctcctgattaaattgtgagttcccagaatatgcctgacaggtatcgtttcctctagtattcttgcagcagagcttgtcagatgtgactgttcacttgaatcacttagatctagttaaaacagagattcttattcagtaaagctaaggtagggtccaagattcttcatttttaacaagtccccagatgttgctgatcctgagtagcaaagccacagagattcatagtgatctgcccatgtactagatgctggggtgaggggaggaacaaacacataaatagaaaatggatcctgaaaaaactgaagaattgtggaagtgtcctgactctattcatcattcatgtttctacctttaggctcagctggaataggagagatggaaggtacaacacatgtagaatacgatgctaaatgaattgacattaaaacgatcaattatcttctagttaataccatttcttcagtgaatcaatatttattatatataagtatgcatgctagggatgtcaagaaaatgtttactcttgtggtatttttcttttggacagagtctcgctctgtcacccaggctgaagtgcagtggtgccatctcagctcactgcaacctccgcctcctggaatcaagcaattctcctgcctccacctccctagtagctgggattacaggcgtgcactaccatacccagctaatttttgtatttttagtagagacagggttttgccatgttggccaggctgatatcaaacctgtgacctcaagtgatccatccacctcagcctcccaaagtgctggaattacaggcatgagccaccatgtccagccacgttaattaactctttgtgcacatatccagagttatacccagatagacacacctggatacatatccagatggacatatatagatgcacagacacacatggacacacatgttgggcacatgttatctcactgggtccataaaagaactacttatataagtcagaatactgagggccatggtgatagtgactaatctaaagccagagatcagcaaaagacaaggaatggatttgaacctgattttcttttatgttctgttctcttcccaatatcctaatgaaccaaacttgctataaagcattgttataagtgattgttaggcctttgattcaggccacagtattttattgctcgatgggaactggcaaaaagagattcttacattattggtcaaaaagatcatttttatttatgaaaaagatgttcacagggtgattgctcatcagaaggcatctgatttccatctggaaaacaggcaacaatctcatatgtgattcagtttaaatatccttctttatttcaaattctttctggatttatttgcctttcatgaaaggcagacttactgtcccaatggttattactatatcactgaagacattataagtgcttagagaggcaacttctaacaaaatgaggaaaatcaatttataaaaaatatatagaattaataattctggtggttcgttcatgcatcttctgtttgcaaagaaatttctctcgaactctacaattaaattgtaaatgaattctagagtaaaactgattatgtcatctttcagacaaaattcttaagactgacatgctgccctagggttggagaaacatcagagagcttagggcagaaacacaggcgaaataagtccatagtactgcacctgaggccatcattaaattgtgagttgcatgattaagagatcatgtaatgtctctcctgctatgcctggaatttctcttcaacataatatacttaatttagccaacacagtgccacatttagacagaggtaaagaaatatacacattaaatgaatgctgcagcatgcatacaaaattcaattagtcttggccgggtgcagcggctcatgcctgtaatcccagcactttgggaggccaaggcgagtggatcacctgagttcagaagttcgagaccagcctgggcaacatgttgaaaccccgtctctactaaaaatgcaaaaattaactgggcatggtgacgtgcccctgtaatcccagctactcgggaggctgaggcaggagaattgcttgaacccgggaggcagaggctacactgagccaagatcacaccactgcactccagcctgaatgacagaggggttaaaaaaaaaaaaagaaacacaccacaaaattcaattagtcttgcaattgcttcaatgtagtagcaacgcagctagtttggggtgactgtcacaaggcagaaacaaccttgatacccatctgccagaaccaggaaaacttgacttgtcctggatagccctggttcccactgtggagccaacacaaccattaataggtcttctcttcactttcaaatgtgtcccaatttggacaacaaattatatagtcactttatttctgagtgactttcatttctgcacaaacatcactgtttgctaatctgctgattatgctgggaatcctgccatgcaaagagaagagtgatgagtatagatccgagtgtctccagattaaagaaagcatggaataaatcaatagcaacaataacaccaccttaaatctccgtcacgaatatctgaggagacatgaagttttaaaaaacttttctaattaatttcttacagagggacaaatgcagtcattatcaccacatgacaggtgaaatcaagcaaagttagttaaaaagtatctgaccacctcctacttgatgatgagcttaattataggtgattgggcatgaaagcacctaaaaataaaacatattgttctatcctcaaggtgcttggaacctactgtgggaaagcccaggccagtgaagaaaacgtaagaagtactaaatgacaggtacagactattatgcccaagtgttgaaagatccctctccaggttacataagaaatatgtgtcagggttaagaatagacggagtagaaagaaaataaacatttatcaagcacgtactataagctgtatatatctatgcactagctttatgtcttatctcacttaattctcattacaagccctagaaacagactcttaagggaaggaactggcctgaggtcacccagagtccactccagacaacagaatccaaagcctgtgttccctcctctgtgctgtttaaactgccttcatttttcatatcccagggcagacagaggccaataacaggaatccatcaattgtctatactcaggagaaatcaattcaaaattgtacaaaatgtaataccaaaaaaaaaaaattaaaatcagatttttttgaactgtaaaaaaaaaaaagaaagaagactgctacactgcatttccctcattcaatttcaaaagcaaattcccacacagttgtgtatgattagggaaagaaagggaaaaaaaaggaggggggattgtgtaaaaagacgtagtgattcaagaagtgtttgttgagcgcgtcatgttgaattccctaggaagactaccctgtggaatacattaccatttgctcttctcctaatgctaatcagaacaaaatcccctattctgtgctgccatcattgtgtagtagggtcaggagttgctgagctgctgctgaaggcttcaaagcctttgtcctgttattgattcaactccccacacttcaatttatcagatactttgcagttgcaaagaaggtgctggatggagaaagggagttgggaggagagttgagacacgattcctgcccacttgtactatcccccaggaaagcggaaccagtgtgtatacaagagaagtcacaatgcagtgaaccgagagtgaggtaaatcatgtgccctgaagacacgagtgcccagtcacaacaaactcccctctccctttctctcccacagatgagcatgaatgttcttattgaaacagggcacgtaacaccatctatgacttcttcactggtttgttataagaatgtaattttttaatgaaataaaatcactgaaagtgcacttcgaaaactctagtatacaaatgaaaggtattatttttaaagaaaactgggcccactgtttaatgcaaatccacactgtcctgctaaatgatgaatcaaacaggctaacgtgcatctgctgagaactgcgggtgcacttggagtctcgggttcctcccatctctgcagcctccctgcctggtctctgtccattctcctcttgcagcccagccaaggccctttttcacactgaactgccttctccaatgatctcatgcacactcatgcttcaattctctgttgacccgaagttatgcctccagcccagacgtctctgaactccagactcatacatttcctgcctagtggaggtttccacttagaagtctctaaagcctgtccaaaaggaactctctatcttccttctcctccaaacaatatgtccatttcccatgttcccattctcagtgagtgccgattgttgtttactagttacccaagtcagaacatggccatcgactcagcacctcctgcctcttcaccctctatccagaattatcttctttcacttagcttgtttaggatataacataaaagggaaggaggttggaagataacatttcctatgcacacttactcatcatgttccctcatgattaaatgttcatttctgattttggtatgctaagaatatcttttgtttctatagagaacaaacaacattcagctctatacagacaagcattttcctcactggggtccctgaaatgttatttctaaatgattttaataggagatgtttctttaaaaaataaaaaggtggaagttgttccaacgttaaattgtatattgattgtatttccaggcctgccccttcacctctggttcccaggatttgggcttctaggcaaatgctatctttcttttcttttctttttttcttttatttatttatttatttattttttgagacagggtctcactctgtcacccagattagagtgcagtagcacgatcacaactcactgcagccttgacctcctgggctccagcgatcctcccacctcagcctcctgagtagctggaactgcaggagtgagccaccacgcctggctaatttttgttgtttttgcagagacagagttttgccatgcttcccaggctggtcttaaattcctgggctcaagcaatctacctgccttggcctcccaaagtgctggggtttacaggcatgagccaccatgcccggccaccaaatgggattatcactctggccccaagaaatgaacaagatgattccatctgcttagaacacactgacagtataatttgtgtacaaatatgatgtttgaatttaagacggtgacttgttttttgctgctgtcgggcttgctggctttttgatgtaccggagcgaatcatgagctagatgagtctatgcaccctagcttgtatgagcttggctattttcattggcagccctgactctaccagtttgtcctgccaaaggacgaggcctcaggtcctttcccaaaaacagcctgatgtagcaggacccacaaccaacctattgctgctgctccaatgggacctgccaccatactggctatccccaccctacacccggtgaagtattatacattaaatgcagatgtggctggctccacccaccagcaccatgcatgtcaccctgcccagggtctgaaagcagtgacccttcccctctccagagtggactttccctttaccaccagtaggcgtaggggtgctaaaggcagccacaaagtttgctgtacttttcctctcattttgtgagtttgtattctctgagagaggcccaatcagttgaaggaaaagtaccaatcctttgttccctctttggcattggcgcttaaccagtctaaagcacaagagaaccctacatacttgagcctcattgcagagccacagcatgcagcaacacagccatgtatctgaggagtcctgctgccaagaacctgcttgctttcctttaatctagtttctcaaactattttgaacatggaacacttttgaacaacctgatttttagggatccatgttgctaaagactggcaaaagtcctgggggctttggaaggagctcatgcagcaggatgctctgggtgagcccagactgatttaagctttcaggtgggtcagaacaggtggcctaggaagggttacttgtgtaccttggcatgaaataatctgcatgtgagctccagatcctgtgctggtaacgtaggtggagttggtgcaggagaacctgaaaggaggaagggaaaagggagcagagaggccagaaggaacagtgtggaatctgcctcctcctgccacccctacccttcctacgcaccttccgtggcctccagcttgaacacctggacagagaaagctcagagtagctctgaaaaccatgacacggtaggtgcataagactgtgaacacagtgggggccacttgaggcccagagcaatactgagttgaaaagagaaacattctgttgcccaggctggagtgcagtggcacgatctcagttcattgcaagctccgcctcccgggttcacgccattctcctgcctcagcctccagaggagctgggactataagtgcccaccacgcctggctaatttttgtatttttagtagagacagggttttactctgttaaccctgttatggttaacacagtgtatggtctcaatcttctgaccttgtgatccacctgcctcggcctcccaaatcatgctgggattacaggcatgagccaccatgctgggccgaaacatttttttttaaatttcaacttttattttagatacagggggtacatgtgcaggtttgttacatgggaatattatgtgatgctgaggtttgggtatggatcccaccacccaagtagtgagcatagtacccagtagggagttacccacccacaccccccttttttcctcctccctccagtagtccacgtgtctattcttcctatatttatgtccatgtgtgctaaatatttagctcccacttacaagtgagaacatagggtatttggttttctgttcctgtgttaattcacttaagattatggcctccagctgtatccatgttgctataaaggacatgatttctttcctttttatggttgtttagtattccgtcatgtatatgtgccacattttctttatacaatctaccgctgatgggcacgtgggttgattccatgtctttactattgtgaatagtggagcgatgaacatataagtgtatgtgtcttttaggtagaatgatttagtttcctttgagtatatgcccaataatgagattgctgggtcaaatggtagctctgttttaagttctttgagaaatcttcagactgttttccacagtggctgaactaacttacattcccaccagcagcgtataagtgttcccttctttttgcagtctcattggcatctgttgtttttggactttcaagtgatagccatgctgactcgtgtgaggtggtatttcactgtggttttgctttgtatttctctgattgagaggtgacagcgtgctggcagccctcgcagcccttgctcgctctcggtgcctcctcagcctcggcacccattctggccacgcttgaggagcccttcagcctgctgctgcactgtgggggcccttctctgggctggccgaggccagagccggctctctccgcttgcagggagttgtggagggagtggcacgggcgggaactggggctgcgcatggcacttgccggccagctagagttctgggtgggcatgggcttggcgggccccacactccgagtggctggccagccctgccggccccgggcagtgaagggcttagcacccaggccagcagctgcggagggtgtgccgggtcccccagcagtgccagcccactggcactgcactcgatttctcaccaggccttagctgcctcccaaaggggcagggctcaggacctgcagcctgccatgcctgagcctcccctccccaccccaccatgggctcctgcacggcctgagcctccccaatgagtgccgccccctgctccacggtgctgatcccatcaaccgcccaagggctgaggagtgcaagcaaacggcgccagactggcaggcaactccacctgctgcccaggtgtgagatccactgggtgaagccagctgggctcctgagtctagtagggacttggagaacctttatgtctagctaagggttgtaaatacaccaatcagcacactctatctagctcaaggtttgtaaacacaccaatcagcaccttgtgtctagctcagggtttgtggatgcaccaatcggcactctgtatctagctaatctggtggggacttggaaaatctttatgtctagccgagggattgtaaatacattaatcggcactctgtatctagctcaaggtttgtaaatgcaccaatcagcactctgtgtctagctcagggtttgtaactacaccaatcagcactctgtatctggctaatctagtggggagggggagaacttttgtgtctagctcagggattgtaaacacacctatcagcaccctgtcaaaacggaccaatcagctctctgtaaaacagaccaattggctctctgtaaaatggaccaatcagcaggatgtgggtggggccagataagagaataaaagcaggctgcccctgccagcagtggcaacctgcttgggtccccttctacactgtgaaggctttgttttttcactctttgcaataaatcttgttgctgctcactctttgggtccacactgcctttaggagctgtaacactcatcatgaaggtttacagcttcacttctgaagccagcaagaccatgaacccaccagaaggaaaaaactccgaacacacccaaacagcagaaggaacacatccaaacatcagaaggaacaaactccggacacgcccgccgcctttaagaactgtaatacctcgagggtccacggcctcattcttgaaatcagtgagaccaagaacccaccaattccggacacgtgatgattaccgatgctgagcaatttttcatgttttttgaccacttgtatgtcctttttgagaagtgtctgttcatgtcttttgcccatttttaatgaggttgttttttacctgttgatttgctcaagttccctatagattctgcatatttcgcctttgtcagatgcatagtttgtgaatatcttcctccatttggtaggttgtctgtttactctgctgatactctgttttgccacttcatctcccatccccattttctggccacaaactgcagcataactttggccccttgagctaaaaaataacagcctttccagggcagcagcagctgaagaaccagtaaaggaccaggccaaggtgtccagaggggaagacagattcagacttgtcactgagcacaggaaagacatcaaatgcaagagcatggaagggtaaaaccaccaccattagcccttactgtgcctgtgattacatccagaggctggggagcccccagcactctgactctattccctttgctgttaactttctggtttcctccttccctttttctccaggctgcactttcccctccctcacagtatctctggaacaatcagattcaagaaggaggtaactgacaggcagggccttttctattttattcaggcaactcagtgggtggtggtgtcaaggccccccatggggttactgtacatgaaacaagtccataaaacaaacggtcaaactcgggtcggggctgttgctagtaaagggagttcccgttgtcttaaatcaccctggattgtttactgcaaaaggcagtggttaatctgaaacacagacagaaataactgcagccttgtgcctctgcatgtcttggctgagcccaacttttgcattctaagcactggaagtaccaagtggccaggatggctggaagccaaaaagtaatgtttccttttgctgttgttgagaaaggcattcaggaaaacaattgagcacaataagggccttcctgttccggcaagcaggcagccgtgtgaaccacccagtaaacgtggagtgagtcatcctggtgcactgtaagcttccttcgcctttgtcaataagttcgctcagaggcagctgtggggagcatgcagaacacagccccagcaggctgcaatactgcggattgctcccctagattagcatttccgaaatctatttctcccatctctccaggcaccacagatttccccccaacaaagtcagcgtttacacagggaaatgtcacaaacacatttgtttgggaaaggcatgggccatgcatctccctccagctgggaagtcggttctgcaagggaagtctcactgaggcttgctcttaaaacattcaaaatgcctaaatttcatgggattttcattatgtggtgtacacaaactatgttgactaacatgcacttgattaattgtagctgcccataaggggcaaatcacaatgattgagttcaaatgaaaccagctatgtacaaaattgattagaatgagacaggaaagagataacaccttaaaatgtgttttgacctttaatatttcaggcagtgagactgaaatactacgttgtactgagatgtcctgggtcactgagaaggacctggagagatgtaggatggtcaatgattccttgatagtggtaaagatggagcatgctctctctcttttcctttccctttctctcagtctctctccctttctttttgcctctctcccctacttctagggtattccattttgccatgaatgggtctaaactctaaaagatctttcagagcatgatccagtagagatggcagacttgacatcattcttcataaccattcttcataacctgttccaggaccccacctacaatggtgcttaaaccagagttagaatgactgacattaagttttaagcatccattttgcctgctcaaaaagagttgccactagccattcatgttttattacagcgagacaatctatttaggtaagagacagtatgctggtatagtattttgggacaactgtgagttttgagtcaaatgacactgtttgggcctgaactgttctgttttctagatttaccacctggagaagtcatctgacttcactgtgcctcagtttcctcatcttagaatggggataataataatgcctgcctcacagaattgctatgaggattaaatgagatgacctagctaattttacttagtcttacccagtgcccaataaatgtaattagtagtactactaccactactaccatcactactactacaaacactaataaactaaatagccattgaactcattattttaattgaaggtctaataaaccaggcttggctgagctaaaagcatattgtcaccccttaaaaacgtatagcctctctcttctgccaaactgaaactaggcttcttagaggaagatgtttttgataaaggatgaaggtgatttgtcagttgaagagtagtatcattttgcaatcatagtagaaaatatttcaaaaacatgcaaggttataggagagtaaagctaccagatttctccaaaaaattgttgatcgttgcaattgatacatagttactaaaaattcacatttaaaacacatttaagtttcaactaaacaaatcaggtgaagcaaacgaaaacattaatttgtattacactaaaatatctgccagatttgtgcactaactggattaggcttataattagaggaaattccaggctatgtattccttcactcagtatgaagctatctaaaaaacaaatacacttgaaaatccatttttacaagtcaggtggcagccgcttgcacatctcaatcagtcaataagaaaacattttaaactgagctactctgaagaagctcagacattctttaagttaagacacatctcatttcccagccacaatctgcatccctaagacagatgcagttttgatcccagcagttccatgaaagaaacacttccacaaagtcaagaaaacccaaagttcagcaagattttggcagtgtggccagaaatttaaaaataattctggttaatatacccaaagtttttaccagtggtcttggtgagcatggtccattttcagctcagtcagatctttgggaaactgaaccacagaaataacattgatcctgagtaactcagacacatcccgtggttttgtgcttcaaaggtagccacaaattcttaagatatgattcatagtcatcaaaatctatgaatctcctgtgaaattgttctttcacttccactaaacagctctgtaattcttcaaatctgtgacgccattgaggtcaaggaagttcaacagtaaattatgaatgcagtaggaaatgagagtagttattaactgctcgaccagttggccagttagaacctgcgtttccttgaacaaggaaaagagagaagtcagggttcatggaagagctactgaaacagatattcaaagcccacggacttatgtcatccaggattctatgccaaaatttgaaaatcctatcaaacaacctaagtctatacatatgccagtcaggagaatttaggagctaggctacatcagaaaaaattctagggggaagaaacctattgattctgccagaagaaatactctattaattctttactccaaagctgggaaccataaaaatgctcagggaacctatataaggaatgccactccaggcattccttatcagttagcttttactatataagaaaccactacaaaacatagttgcttaaaatggtagccatttatttagctcacagttcttcaggttggttatagaactgtgatctctgatcctctggacagttcttctggttttagctggatttgtaaataggtctgtggttggctgctaagccagttgaggtaggctggtctagaagagtatcagctacaatggctagtctttattccacaaaatctttcatcctccataggttagccagggcttgttcataaattatctgagcagtgttccaaaagggagcaagaaaggtaggtgcaaggcctcttggaatctatgttcaaaactagcacactgccatttccaccgcattccattgccaaagcaagttacagagtcagcctagattcaagaagtggggaaatcacttccacctattgataagaggagtttcagagtcaaatccaggcataaaaaattgtggccacttttgcaatccaccaaaaccctctctcccacatgctccttaatgccccactagctaaaccaacaagacagatcatagtcagcactgactgagtgcagcatttctgtttaagacaaatcagagcaacagcaagaatgcctgatgttccttcatggcagccttcccactattgggtactctcaagatgggagataatcctatttgcctgagtagtagatagctactacttcccagagtagtagacagctgtcccaagtaactgactgtagtaaagctcagctttatgtctctgggcaaataactgggagtggaggcatgaaggaaagcgtagttggaataccctgagctgagagagccagaggaaaaacacaggtatcctgataaatgagtactcgtgctcctctgggaaactgggattttcttttatgcttggtgtaaactaaaactactgtgatagttcattttacgtgccaacttgactgggccatgacatacctagatatctggtctaacattatcctcagcatatcagtgagggtgtcttgggatgactttaacatctaaagcagtgtgccctccctaacatgtatggggctcatccaatccatcgaagacttgaatagaacaaaagattaactcccccaaataccagggaactcctcttgccagattgcctttgaactgggacattggttacttcctgccttttgactcaaagtgaagcatcagctctttctgggtctgaagcctgccagccttcagactggaatcacaccattgtctcttctggatctccagctgcttgccaacttacagatcttgggatttggcattctccataatcatgagccaattccttacaataaatacacacacacacacacacacacacacaacatcctactgattctgtttctctgaagaactctaatacaactacttatttggatattgtgccaggcaaaagggcaaaggaatatttgatgcctggtaaaggtaaatggctggtttgtactcaggtttgccatcccttgtttctttccctgttagcaaataatcccagtcgtcctgggaagaatataaaacttgaactaataactctctagtgttgctgttggtcttgttatactattgtcactacagttgcccctttttgtttgttttggctgtttgtgctttgttttgcttttgcctaaaatggttaaacacctcgagttcaactgtgagatgtgcacctgtgctatctatcaacaaacactctcaatgtggaacttctctgggaatcttccagaaatccagtccacaagatccagtgtgcaaagaagctctgtcattggaacctgatagcagaaatgctaggagtaaactcatggtgaccaatcagtttgtccagtttgctcaagtacctcttgcaatgactagaaagtttgcacaggtaccagagaaatacattactagagaaagacatttcagtggtgggctttggtttgttattgtgttggctttgcgacttttcaacctggatcaattgaactacaatccccagaattctctttctagtctgtttctggctagcatggcctacaaagaatatcctttcctggaaggaggatggaaagggggcagcagccatattatagcatgtacctaccttctcctagtgattcagcaaactcttatccaggtgccagtgtgaagggatcttgcaggtgtaattaagttccctactcagttgactttaagttaattaatagggaagtcctgttgatcaagatggaagtcctttaatcagtagaaaggcctagaccttccctgagttgaaagattccacattccagctcatgcttctggggttctggcatgctcattacttcccttctgaccatcttccctatggaccccaggcctgcttaaccagtccccacaattgcataaaccaatttgttgtgataaatctcacaccagttctgcttctctggttgaaccctgactgatataattgtcatctgaaaataacaagaatatattcaagtttgccatttggatcttccacaaaaccatgggcccctacaaagtatagtggggaaaccacagactctggggccacatggcctgcaccttctcccagcatctttcttcaccagccaagtgactttgggctactaagtctcataacctctctgagcactgtctttttacttgtaaaatagtatcaatactaagtccaagcctaccaacttcccagggttgttttgaaaaatcaaaggagatatcgtatgtggaagcactttgtaacctgccatacaaatgaggggtgtttagttttaagatcacctagcctagcatttttagttaggggaggcagagaaataataaacatttactcatgtccactgtgtataggaaatatgaatatatactccaatgcagtcttctagactttctcatgaggcagacagtgtttgccccacgtgagagatgagaaaactgaagttctaagaagttggctaacttccctagatcacagaatatgatttgcagtccagtgtgaaaatggttcttacaacaccaaagtccaggctgtgtggccatgccaacctccttcacaaaagaaggacatttctttgcatgtgacaccatgatagtcatgctaactcctaaaaaactttcaagacatactttcagtatctctttggaatttactagtttaattgaggagcaaataatctattttgattagtgaagaagttatttcatctaatatgctctgagtcacaacacttaagaaaccaatagaagacaaaacattttttgctttttatatccagcaaattttcttttcctaatttacaataaaactattccaagaataatgaaagcgaaactgtattatttactgattttgattgccccagtctttaagtactcagaaaagacactttactgtttgtgcgcacagggaaattattgtggttagaggttaaagctatgcaaaaacaaacaaaaaaattaatgtgcattttcctcaaaaatttaaagcagccagaataatttatgggttaggcgttttctgagagttaatgatcaactgtctgaaaagtccttgagacagttagttggtaaatggccaggaagtcccttccactgagagctgaggatttcgagacatttgttatgcaaaaatagaacctgaaataagcaaatatatatcatagagactgggattttttcagatcactctattacatataaaattaattctactcaaaataactgtaaaaatacaggtagaaaacataaaatatttattaaatacccaccaattattatgcttggcattttaaatcacttttctcctaattctcacaaaattttcatatttattaaccccattttgatgaagaggaaactgtcagttcatggactcacatagctattaatagtaagagcaaagctgggattcatacccagttccagtcaaagtacttgcagtttctactttttgcatacctgtagccttttatttaaatgattctctattgtaattataaaataagaaagagttctattttaataaatactgtgttaaccttacaacttggctcaaaaacaaaatggaacacaatgtgcaaaaataaaatcattaatgctatttaaagctttgtgaaactaattcatctatcacagaatttaaatttttattacttttcatgtgggggccaaagaattttagttacttcttatttcatgggcttctcatagtgcaatcgctgatggtagggaccttgtttttaccctaaactctatattaaactcggattaaactaaagttgtcaacacacagtaagtgctcaataattattggtgaatgaatgcaatcttacgtatgcctggtgctttgaaacttacaaatcactttcactcattattgattgtgactacgacaagaaggctgtgtatgagttagtgacaatcattgttagcatcactttagagataagaaaattgaaatgtagaataagttgagtaacctgctcaaagcctcttggatttgactgtaaatcaaggtctcttgagtacaaagaacaaagtttttgtcctactacaaacactcccccattaaggaatatcaatttttgttaatgtttgacaaaactatgcctcttatttaaataaaacactgaaatgaacagacccgcatgataccaaactgcatgttagagtttgaggtcaccagtttatttgaattgcttgaatgtgcttttatcatactgaccatcttacaaggtagatcagctgttgccaaccatgatattgggtcagcagagtattgatgcatctgagatcaacacatgagaaaggagaggatttggagctggaaattgcagaattatccatgcagcaacttggtatgagcggccattaccaacaggaaggatagccattaacggcatccatgggggagaaggtgaggaactagtgaactagaatgattatcaaaatgccaaaacaaagaaaagataaataatggaggtgatgaatatcccgattatcctgatttgatcattacacattatacacatatatcaaacaacaaaaacaaatggagtgatgaatatcacatgtatcaaaatcacatatatcccaaaatatgtactactatagattattttttataaaggcccaaacagtgagaattgcatttacttggttaactatgtgttgacatggccttttttgagattttatatttagatcattttgataaaattgcatcatttttaagaaaaacttttatgtgcttatgtaacatcaagtttgcaaaactacagtcatagtaaaagcaatacaagccaaaaactaaatgtatgagtgtgtgtatgtgcagctcttataatatggagtacattgaaattaaaatatttaaagggattcatttccactggagctatccccatgtgtgaaaataaacacattttcttctcaattacccatggtattattggctctccacaaacacttgaagagcttgactaagccaagttatgtactactcaatgctttttagcagtctctcttaaactttttttacttccatctaatccctggtcatagcctctgggaaattcaacactatggagaaagggccatttgctttgtggtcttacataaaagaagttatcacccaaaagtcatgggatatgttgctgactcaacctacagaaggatttcaggttggatcagcaacatatcccaggagttgaggccgccaaacctcctcttaaggccaagtcacagcaagtttactgagacaactggagagatacctgtaatgactgctggaactcactccaaaaccaacatctataaaaagaaacttctcttgaatctccggtccaaatcatcaaacctatgtgttttcctaacaggaaacagagaagaaaccacttttcctcttcactctggcctctattgagaaagaatccaacttctgaatattcaggaaaagaaagtgctttttggtgtgacaacgtaagcaactctctaagtccctaaggagcaggaaatgtgtagagaatagccacctgtgtgtatattacctctttccagccactcttttttgttagccagcagccaggttgcaagtacatagtctgtacttatctgtgcaccatttgaggaccaccagataattaagtcacactcacattgagatatttctcctctgtctccatcctcagttcccctacatcagcctgggtgtaaaaatatcaccacaaaatagcagtggccctatctccttgactgtcacctcctctcatatatctctagccccactgaaaatcctatctactcattagtaagagtgttcccaggggtgacctcaggtgcaccagaaaccatccaattccctctgtcctgtccttactgcagctatttcctaccgtctttccatgaggcctctctgaactgtgaggctttggacagggcctcattgccagccctgctctgggccccacaacaagaaaattgcgctcccggccaaagtgtgtgttctctgtgggggtcctgaggctatacggtggcttcagccacttccactgccagctccacctaccaggcaccgcccgacacaatggtcacaggaatccctggattcagtgccaaagtgagaagaatagtgactgtagtagtctagtagtcaggattctccagagaaacagagaaaataggaaagagagagagatgagaaatgtgtgagtgtgtgtgcatgtatagtgtgtgtgtgtatatatattcagagaaacagaaccaatagagtgtgtgtgtctgtgtttgtgtgtgtctgtgtgtgtattatatatgtgtgtgtatgtatatatatatatatatatatatattcagagaaacagaatcaatagcgagagagaaatagaaagagagtgtatgtctgtgtttgtgtgtgtctgtgtgtgtattttatacatatatatatattcagagaaacagaaccaatagcgagagagagacagaaagggaaagtgtgtgtgtgtgtgtgtgtgtgtgtgtgtgtataaagaaagtggggtctggtgtgcaattttagggaatttgggtaagtccccaatctgcagagtaggccggcaggctggagacccagggaagagatgacactgcagagttcggaggcagtctattggcagaattctgtcttctgtggggaggtcagtctttgttttttttaaggccttctactgggtaaatgagacccatccatattatggagggcaatttgctttactcagcacttactcatttaaacgttaatctcatttaaaaaatattttcgaggaaacatccaaatgtttaaccaaatttctgggtactgtgtcccagacaagcagatacataaaattacccatcgccttttttgtttgacattttagtaactctcctttggggtcccacctcccttttggtgggcttacagcccaaaccagtcattctcaactccaaaggacatttgtggcagtcacagctgggggaaaactacttgcatctagtgggtagaggccaggaatgctgcaaaatgtcgtctaatacacagcctggttcccaacaacagaattttccagtcccaaatgccaatagtagcattgcagctgagaaaccctgctccaaatgaccagttcacttcctgtctctaaccctgttcattattgcttcatcctctctggcctcctttcaggtcacagagcatgccaattccttccctccttggggcctctgcaatcatcattctcactgcttgaaacactctgctccttgcagggttggctctttgtcatctctcaagtttcaccaagaaatcccacccccacatgcccctaatccctgtcagtttcattaacctgattatgtcttcatcaccagctgacatttgcttgctttaccttgtacatctggatcttgttcccctcaaatataagcaggatgagtacctatcactaggctccaaggacaagtgccagccctggaacatagtaggtgctcaacaaataattagggaaggaaaggaattaagggaggaaagaatgccttagactttttttttttttttttgagacagcgtctctctctgtcaccaggctggagtgcagtggcacgatctcggatcactgcaacctccgcctccccggttcaggcgattctcctgcctcagcctcccgagtagctgggactacaggtgcatgccaccacgcccggctaatttttgtatttttagtagagacggggtttcaccatgttggccagatggtctcgatatcttgacctcgtgatccacctgcctcagcctcccaaagtgctgggattacaggcgtgagccaccacgctcggccagacatttttaatgaatgtcactctccccatgtgtttcgtttccaaacacacacacacacacacacacacacacacacacacaccccaccagctcaaatacgtgtttataggatccgtttccaaaaagtcaccaagagagtagttcctgtacactaaccctgcccccagaatgctgagttgttttctattgaacttagaacacgaacccagcctttttctcaacgacatccttctcccaagacacaatgtggcccctcatgccaacgtgtgtgaactctactccccaccccttaatcttcctaacatgcagagatcccttagatttaaagtgcaacccctgctatgaatcaataactttagaaggacttaccacagaaagagattagcatgagaaagctaagcagatatcatcgcaacagttcactttaaaaataccaccactccttctatctgtgactacagatgcctcctcacagaagtggggcagagatcatctagccagaaccaactagcaggtcatctgcgcctcccccgtccacgccaattccattccccgctctctcctcatgtgctaagttctcccacgttcttacggtgtcagcgaagaatttatacatgcctctaaagtgactcactgcatgagtattactgtttatttttagcaccttgttgttttgcctataaatccctctaaatgtcatttctcactgcctggcccctttcaggacaatatggcatgctcctcgaaatgtcctctcactgggtccctctgttctcagttctgcccacaaggccactgcacatggctgcccacgatggaactgacctgcctctgccatctctaaatctggaataaatccccttcctgagtaaatatccatccatcaagtgtgcaggataactatttcctccagaacacccactgttcaggaagacagatggagatctctgagatggggccaccacggaaaccatccacaagggaaacagctctgaccctggactcccttgctgcctccattcaaagcaccctgtctgagaattaagttgtgatgagagatcatctgccttgcaggtgcagaggcagcagaagagccacctgtgtttttcctctgcctggcacgtgggtgattgcaatactctggatgtgcaccttccacagccgtcgcttggattcactggcctagtagaagacagtgccgagaatgggtggcaaagacccatgtttcccatgacacttgtgaaaatgaggggcagaaagatcctctgaagtaccactcagtctacccagaaaagagtagaatctgtccagtttaatttttgatcattttatgactaaataatctcaaagtttaaaaaggcatgaaagaccatctaaaccaattcttttatggtaccaaggaggcaaggcccatattgggtgagtaccaggcccagggctgcacacataggttatggcacagctgagtctggactccaatgctgtcttagctgattttctgttgctataaccaaatgactgagactgggtaatttataaagagaaaacacttgtttcttatagttctggaggctgagaaatccaaggttgaggggctgcatctggcgagggctttcttgctggaggggactctgcagggaacccaggtggtgcagggcattacatagcaaggacttcatgacagacaaccaaactggcttttttaacagacccactgttgtgataactaacccactccctcaattgcctattaatccattaatccaataatgactccatcacccctcagatgtcccacctctcaacactgccgcattgtggatcacataaacttttgcaggacacattcaaatcatagcagatgccttgccttctagggttgatcctgtaacaactgccatgtcatcttttctttttcctcctgtcccttctttcttcatcttataaaccatctattcccattccacatgtttctgctgggggttaaaagtccctaccttcccccaacttcctggaaactctgattagtccagagagtagtcaagtgacccaaattgaagtaatgagatatttttttgaaaatggatactgatatatggatcatgagaagtgtattagccagggcaagctaactgctgtaacaaacaacaccaaaattgtagtggcttaacactgtagaggtcggtttttgttggcttgtttactcacttaatggcccaatgtgggtatatgctggtggccttccaccaagtctccctgtatcccctaaaccatggagtcctcattgaatcccctgcagcttcctggcagctgggggaaagagacctgaggtgaagactcctgggagggagtgacacgcatctcttctgcccacctctcattaatcagaaaccattgtatgcgcccacctaattgcaaggaaggccaggaaaaatagtctaattgtgtgcccaggagcaaaaggaaagagtaggacaaatgacccagagggagttgccaggatccatatttcctgccatgtggaaaaagagccgctggtagatgaaaacaaaacatagcaaagcaaagattaaaaataaataaataaataaataaataaataaaagatgtgagaaacgttatctgatcccctggataggccatatctgatgttggaccaattcctgcacctatctctcaaagaaagcattcttatgtttatcaaaacatattcagcaggataataattcaactgggacggcagattagaaattttaaaacttaaatagttgtctggattggcctacacttgtgtacaacttatgcatcctcttgggcccacctcttcctccagccacttctttcagagtccagttctgccaggctttgaccaggctctcccaggtgccagctggcaatgcctcactttggcccaatgcctagagcctctctcttcctgccttgggtttctctgaccctgccgcccagttcttccatgggaactgcccagccatcatggaggggccacccagaggtacagggagccaatacacatgggaatcacccttgaccaaggtggttcaggagccaatgggtaaatgctccccttttgcctcctacggggacaattccaagagacagttgatggggccctagtcagaggctcaaatgatagttcccaagattccagtccctctttctgaactttttgccctgctttcccaggttttatttttatttggcagaaagccccacagtgttgagcaccaggtgcccttcatggtggccgactcagtgacacattcttgtgttgacctcttttccttccctttctcactctgctttgcttcttgccctgccctctgcatttacacttgctaataaattttacactcacaatgtttggaagtctctgcttttgagggacccaggcagctctatcgcaagagagaaattttaatatgatgatatgtgctgtgattctcctagaagaagtagtatgcaaaacttcccaaaagtgtctgactgggccactcctttttgttcttcccagaacctacagaactaaaataaactgcccctctattgattttgcttcttgattgtagggtgtctgattctctaactttttagcatctccaaccagttcacagcattgagggagcagacattgacccattgataaccccaatctaccacacaacaaccggcacaaagttagacacacagtaaatactcaataaacacttgcaattaggtcaataggaggctcactggttgaatagcactcaaatttgagctattttcaatgatcctttaaatcaaaatgttttccatttttattttacttcattagaacaaagtaaaatatgatcctttcagtctctgtaacagcacactgattttttctcttcttcctttgctctcctttcttctccccttttcttctttctctctcatttccttttttcccctcattttctttcttccttgctttgcatctcttccaccattctttattttctgttttttgttgttgtttaaaattcagaggaaaagactccagggacagtgagtcagtaaatgaaaattgtatcgactcccatggtagagaaagttgtaaaccactgagaattccaaaatagaagtatttcttgtgggaaaatcatcaccatgtcttccactcccatcgattatgatgttaatttgtctgtatcattcttcagtgtttataattatcttaggcaaagtatgttttaaagagtgtctttcctatctcccaactcccacctcccacaaactgcattttattggtggtgcttgcacaacccaacgactgaaacctcagtgagaaagtaataaagtgcttagaagtaataattgatggtcagcccatcttacatttgggggtgtagttaaaggcagagtccttgtaagctctcctaatcccatttattaatggttagcaaattgtgattatcaatcaaaatcaaaatgtgtgtgctgtctccttgacctttgggtggtagaatttctttttactcattcaacccctatttgtttatgtgtacctatcaggagttttgatatgtgtaacgtgataaatttattattattagagccattgtctattaagagatgattatttgattccatacctaatcttttatatacatctttgtgtttaactttagtttcacaaagatttcctaaggtagggattgctatccacgctttatagggaggttaagtaactggcctaccattacacagccaatcaggtggcacaggtgggatttagacccacattcgtctgaattcaaaaccagcactccatgagtaaacatccatttgactgacatgagacaaatcagagatctgaaaggttaaatgacacaatacatgtgcctagcacggtccatagcacataataaagtctaaaaaatgtttgctgctaggattattatgatgatcattactactgtcattattactgctactattattattttcattatcaaggttccaacacttgggatctaatttccaggacttagaaatacctcagttgttaaaatgataggtacaactttaaattccctaaaccaatcacaaaaggtgaaatgacaagaatccaacaagttaataaacacattaccaaaatgcagaataaatgaatgaatttaaataacaactgtttctaaagggctcacaattgttcacagaacttcacctctttaattgattttttaatgagctatccaaatgagaagtatatttatttccattgaagagaaaatgtggaagatggagaattgtgtgagcaagttatagtaagggcaagcaggtaacaactttctgggacataagagactagtgtttcttatcgtacaaatgaaagatcatattccaacttcatgatggacatatcccaagttgatgtttataccaaatggtagagaaattggtgacaaaggaagtcaacctctgcaagctattaaacactgagtcactttacctagaaggacggtaaatttccttttccaaaagtgcagtttctggttgggtatagtggctcaggtatgtaatcctggcactttgggaggccgaggcaaaaagattgcttgagcccaggagatcgagaccagcctgggtaagatggagaaacctctgtctgtacaaaaaagttataaaaattacctgggcatggtggtgcccacctgtagtcccagctactcaggaaggtgaggcaggagcatccctggagaccaggagttcaaggctgtgatcgcaccactgcacttcagccaaggtaaccgagtgagatcctgtctctaaaaaaaataaaaataaaaataaagcgcaatttctaactcacaatctatgttctaaaaacaagtcagttacttggagtcttgtgctcagaatgctatttcccacctccacatgatgtagtcaggtccagggccaacccacagatatttttttataggcaaaatacagcaaaagagccttgtaatcaccatgacccatatactatggacaatgggaaagtgctcctgggattccaatccaggatagcaagaatgtgtctgccaagctgcaaccctagaagcaggtgaaagttacccttcacctcttacctgctagccaggaagtagaagcagagaccctactggatctctgaggcctgggatagtggctttggtggagaaaaggccagagagatggtgaagggctcaatcagggactccaagtgacagcggctaggaaaggctgcaaactcttggaaggcactggaactgcttcccattctgtgtgtttacctatcccaagtccgcagggctaacttcttcaagggcttctgatggtatttcctcttccccttatatacggaggagacagcctcaagtttccttgctcttctttgagattctcaaaggacttttctaaggtgttttattacatctaatgtttctcaaaatgtgagctgcagacactcttaggtggggctctagagtacggtatgaggacaggcagttaaattccagctccaggtaatggaccacgccttgctcctcggcttcctgtcagccattcccccttgtttagttaaaacattcccaacttctttgtaggaattaccccctccccactgttgagactctaaataaaggtgtcctgtcctactctgaccaaagggtagggctgagatccataccaggcctaatctttcctgggacattgattcttggccagcgttacagaattagagaggaaaagaagtagtaccttggaaagctatcagaaattaattcatcccagaactagagattttgaagtgaacaaatctgaaaaaagccaactgcctttgtgaagttgacatttagtgggaatggtgagggaggcaaacaataaaaagtaatacaaataaaatatgtaataatgtcttaaaagctgtaggaaaaagatggagcaaagaagggggacagggagagaaaatgggttagattgtgatcgcaaacagttctcaatgagaaggtgctgagagagcaagccatgaggctctcagggggaagatggctacagccagagggaaaaaatgcaaaagcctcagcagagtggacccagcaaggtcaacgtaaagcagaggccaagacaagtgaatgcaggaagagggtcggaggaaagcacttagggtgattatgggacacagtatgccgggcctcgtaggccattggaagcacactggcttgtcctctgagcctgtctcaatcaactattgctttgaaacaaccatcacaggctctctgtggcatacaactaccagtattgcttttgcttacatacctacaggtcagcttagagccagccaaatccaggctgagctcaactgggctgctctatgtgacaagttaggtccatgcctgctccatatgtctgtcatcttctttggacaactgagctcaccagggcatgttctcacagagatagcagtgtgcagaaggcaactggaaacacatgacaagtcttaagaactaaactctctaacaggatgctgtcatttcggacaacctctccacactcctgtcactagaaagacatgacaactcttaagaattaagctctctaatgggacactgtcatttcggaccacctctccccactcctgtccacttgctcaaagcaaggacatggccaagtcaagtcaaggagtggggcagcagacttcacctctagtgggaagcactgcaaagtcatatggcaaagggatggatggagaatggagaatgataactcttcttagaaccagggagccattgaaggttctaagcagataagtgacctagtctgactttcgtttaacattgatctggctagtgtgttgaaaatagatggtaggacagccagtgtggaatccaggaggccagttagaagtgatcacgttactccatgagaaacactgtggtagcatggagcagagaagtagcagaagagttactgacgtgggaaattctggaaatatttttaaactatagtcaagggatttgctgatggattgaacatgaaacgtgactcaacacttttgagttaggcaactgaaaggatagatttgtcatttttcagataaaaggactgtagaaagagtgagttagaggaaaggggaggtagagagtctagtttgggacatgttaagtttgcaacatgcatttgacatccaagcagagatatcaaataggcagttggctatcaggctgaagttcgggagagagtcctggactggaaatataaattctggagtcatcaacatgcagatggtatgttaatttttactgctgcataacgaaacaacaaaaaccgagcttcttaaaataatacccattgtctcacagttctatgggtcagaagcctggacacagcatggctgggttctctgctcaggctctcacaggctgaaatcaaggtgccagctggggttacagtgggactttggtcctcttccaagctcactgattaacggccaagttcagttccttgcgactatggggctgaggtacccattttcttgctggctgttggtcaggggtccctctcagctcccaggagctacccacagtttcaagccttgtggtctctctacaacatgacaattttcttccttaaggccaccaagagaatctctttctcataaagactttcactccagcaagggtccagttcctcttttcagaattcagctgatcagaccaggcaaacccaggataatcactcttttgatgaactcagtcaactgattagtaatcaaatcacagaggtgatgccccatcgcattcagactcccacccacagtcagggagaggggattacacaagggatagggaatattgaggcccatcttagaattctgactactgtagatagttatataaaaccttggggttagatgcaatcacccagttgaatatagaaagaaaataaaattagttccttctacccagaacccctaagctgcccaaatcctggctgcttacaacatccagaacagatttctgttacctacaaccaacaaacaccaatggagtcatccttggatgagtcttactcacaccaaggtttcagaaccactggctcagaccatcagagcaaaattgatgcaaataaacgataatgagtcttttgtaccccaaattcagaaatgagatttattttagttacaattcagaggaaatcccatctaaatgattctctcaatatttgcttaatggaaagagaggagcctctgagcagagaatgtaggaacatggcagaatagtgttctcacgtttactttagctaatttcttttacttcaaaatcagtgacaactagcatcttggttcatcttgctgttttttgcctggatatggcagatagaaaagccagagggaaaatgcaacagagagagtgtgtgacaaatatagaaagaccatgtaaccaaccagtggcctccatctcatccctaccttctcaaaactttgcttttaaaaaggcagtagaggacagtaacaaaagcacgggctttagtgacagacaaatctgggtttaaagcctaatgcttccattcaccagctgtgcaactttgagctcattacctaactttttctgcatctcttttctctcatctgtcaaatgcaataatattaccttcctccctgggttgttgaaaggattaaacgagataatggatgtaaatgcatttatatcatgtgctaagtaactatttcagtgactactgctgtggctattgtgcctgtttttctctttgaaacaggaactggaaagatgacctccctttgtctcttagcgttgccaaacacgcgcagatcagaaaccttaagagagaaaagctgtaaatagcatgaggcagcagcatggcttgttcatatcctttgccctaattgtgacttgctaatattatctggccctcatctaagcttcactttggattggacagaatattaacaagcaggtggggtggggcaggaaggggaagctgcaccattgagctatgccacatgaatgcacaccaaggcaatgaggtaggaatgacaaagtccaaaaaaagtaaaagcaggagaacattaaaaatctttccttacatgaatgcaaattctgaatgattgcacaatttatgactttgttccagttaacaagttctccaggatcaatccggaaaaacaactttaaatgtgcatgccatggtgtctgttcatttgaacattttttactacatacacagtatgacaactgaatgttatatggttagattttgaagatgttttcacatgcttacctacaccataactctctcttctggtgtatttgaaatccttatattgccttctgcctatgaacaattgcaatttgtgtcaaacccagccattaatttttctcaataaatttcacagttctactagtgaaactaatgagatgcacccaccattacatggtttattttaatgttccttgattgcaaggattctctgcatcctaaaagatgagtcaaatgttctctctcccagttccacttattcatcaatgctttaaacaaatcagctgccacctgattctaaaagacagggttgacatgtgtatgatactcacccgatcatttttcttggttatagacccctgaacacaaatatcccccatgtcaggggatttgaagacatcacaagtaacagagaagggccagagttctagaggaaatatgattgaaagttctcttgacctaatagtccctggttgacatgttctaatcctcctccaagtgtcaccttagctaaactataatatttataggacagaatataaaacaattgcatcttcactaaagcagagagggattttgacaatcaaaaatgcaattgagccgggtgtggtggctcatgcctgtaatcccagcactttaggaggccgaggtgggaggattgcttgagcccaggagtttgagaccagcctgggcaacatagtgagaccctgtctctattttttaaaagtttaaaaattagctagacatggtggcaccaacctgtggtctcagctactcaagaggttgaggtgggaggatcccttgaacccagaaggtcaaggctataatgagatttggttgcaccattgcactccagccttggtgatagagggagaccctgtctcgaaaaagatgcaagtctacaacggaacagaggattaaaatgatatttaacctgtgaattcaaaacttctacttcccattttaatttgtaagggcttaggaggaggaggaaaagtaaacaatttatagaaaataatcaaggctattttataacttatcaatatccttgcatgagagtcaataaataaacaaaggtgttttggggccaaatcaactgggtttgtgagtcagtagcttattgatttcatctgccattttgtcaggtgttaacccaatgtcatcatcacacaaatgactgatgaatgcattcagttatactcaagagccttggtggaataactaattttactcactaaacaatgcctaaattaactcaaatatggaagaaaaactttagaggtcagaaaactattgcatatgtatattttctgactcctgatatttgcatatatatttatttcttccatctctccctcttctcctatttcttcttcccttttcattttttttctcccttttttcttatttatggtgagacatcagtagtctcacaggtgttactaaaaaccaaagagttgattcactcggagctcatattatttaggattactgatacctgttctatactctcagagcatttcctgggaattacttaagattcactaggttcaccatcgtgtggaattcattcacttgaatttcctttgagtcaaatgcagaaattgactccagttgtcgacccagggtgttcatacctcaaaaccaacaggaagcctagtaatgatgaagagagagtagataaggaaggggattagatgccaagaaataaagccctttttgtggtaagataaatctagcaaccacaaactgataaggaaggccctgaggcggccttcccaaggagatgccaataaggaaagctgatcgtgaattcagaggaagcagctgcctgccagggaagggtggaggccaagtggaatggcagagagatggtggcagcagcaaagccctgagtcagaactccagcatcgagccttgcatgtgatattacaagctacatggctccatgccaatcatttcatctccctgagtcttagttaacctcctctgtacaatgtagatcataagtttactctagagaactgtcctaagactcaaatgaaatcaggtagtagggtagtagcagtcccttgcaaagtggaaagtgatttataaatgtcaatgttagcccttattatttgctggactcgtggcccaacctcatgatctttgtctggaaatacaggacaagtttctgcatcagtctggtgcaatttggagggtttcaaggaaattttcaaaaaaagagtctttaaccttgattaatgggaaaaaataatcccatctccagactacttggattgagtgctgactctcagacatgtttcaaagtatgaagagttcattttttggtattcctagctgtctttccttatatcctattccatccagtcctcctctgggaaatacttttcttttccctccttcattgctctatttattctccagtactcaaaaccctatcccagaaaaaaaacactaataaactcattgtattcgttacatttgattttttaattcaattgttttaaataatgcagaaagtatgactcacttatctggaagtcttgacaagggctggacaatccagaggctggacaatgtcactaaacactcaggtccgttctgtctctgctctgctaaacacaatgtcagctccattccaaggttgttttccatgtggttatagggttattatgtatatcagttaggagcctatgcttcattgttcatgtccaaggagcaacaagggactggggagagaggggagaggaacaagaaggtgcttttccccagacattgaatcaaagctgtctcttctgtctgactagatcaacatatgtcacttacccctgagccatcatacatagaatatcacactctgtctgagttttcgaaccagttactgataaagggaagaaggttaccatgtttggccaagactaatcagggtccctttctccctggagctgggtcagtctccaatccccatagctgctacacgcagtggggacagtagagtgaagattgtggactcaaccccaatacccagcacatatcaaaggaaaacattattgatgagatttcttgtgtcacttctcccagatttctctgcattccatcaaagatagaaagaagatgaaggaatgaatcattgaagtgttatatttcagtgatctgatttcaaaaagcttcctttaacaaccctaataccatatcctagagatgattgttgggatttgggaggcaagaaaacttctcaaagtcagtgtgagaaaaaacattctcacttataagtgggagctaaatgatgagaacacatgaacacatagaggggaacaacatacactgggacttaacggaggatggaaggtgtggggagggagaggatcaggaaaaataactaatgggcactagggcttcatgcctgggtgatgaaataatctgtacaagaaatccctatgaaacaagtttacctgtatgacaaacctgcacaagtacccctgaacttaaaagttaaaataaaattacgtaataaatccaataacctaatttaaaaaaaatcagcctggtgcagtggctcatgcctgtaatcccagcactttgggaggctgaggcgggcggatcacaagttcaggagatcgagacaatcctggctaacacggtgaaaccccatctctactaaaaatacaaaaacaaacaaacaaacaacaacaacaaaattgtagagcataggccagtccaggaggcattttaccttaagaattgttttcaggtgtgcacaacccaaaggagagaggatagcttgggttggggtaggaggacatagaaatgagaccaaatctaataaattgcaaaatgaagacaagatgaaggtattaatgttgaccaaatatagaggttgggggtcagtcagtgaggtcagaaagtttgaaattaaatctgaaaaagctgggtgtggggtcttttggggaaagcctggtagtagtaacatgttcttagaggagttactgagacttggccaactccaaggtaatatttatgaccaccaagtaaaaaaggaagatgttctccttttctttgactccagtgtgcttttatggcttcccaggttaccttgtaagtaggcataactcaacaaactaaatgaattatctctaccaagaggatatcctatgtaaatatacagtgttcaattgaagcagaaatcataaagaaatgtaacacaaaattgtattttgaggccaggcgcagtggctcacacctgtaatcccagcactttgggaggccaaggcgggcggatggcgaggtcaggagatcgagaccatcctggctaacacggtgaaaccccgtctccattaaaaatacaaaaaattagccaggcacggtggcgggcgcctgtagtcccagctactcgggaggctgaggcaggagaatggcatgaaactgggaggcagagcttgtagtgagccaagattgtgccaatgcactccagcctgggcgacagagtgagattccgtctaaaaataaaaaatattgtttttggaggtctctaataacatttttcaatatattttgttgaattagcaggactatcttccaaactgtatcttccaccttagtagaatagatcctgttttggtaggatttgtaagtagtgattacacttagtccttctattcaagagaagtttgctttggaggttgcctaacatacaagctactctctgtattaaccatgactctttggatttcaaatgatggaaattcaactcaaactagttcttgcaaaaaaggcagttgcttatttctgtaaggtccagaatgaacactagcttcaagcacaactggtattgggacatacatactatcctcaggactcggattctctggtcctcatctctcttgacctagcttggctccattcttcaaactgagtctctccaagatgacctccagtggctgccaaccacatactctgggtgtagcaattccagcagaaaaacagttaactgaaagttaataatttttgaaaatacagtggttgactcaaattagccaatgtgcccttctatgaaccaattactatagccatgcataggggctattctgggtcatctgccccactgctgtggctggggaggacaggcactgtgacctccagccccaccaagttcctgctgaacacacagggttagcaccaaagggagaacaaagggctgctatcacaaagacccttaaaaatcacgtagggtagagagaggccacagttaccactgtcccttctgttctctgggtcttaatctttactccatgacttcctgaaaggtcatttaaatatgttcagtaccccaccttgaatataaaatcatggtaattcccactcatccacatcagattaacattgtgaaatcatgtaatagatgaagaattcagcaaatttaacacaataaaatgtttaataataaacatgatagaagagaccaagaatactgccgtgatgaaagtgtttactcacctccagtggagtttggcctaattagatggtaatcacatttatctggtacacagtgttcatacataagaaacaggcacggtgaatgtttgatctgagtaccaataatcctggcaaggttctgcttttacgcacataagtcttcaaaggaggaaactttttacctaaatatttttgtatgtgctttgctcctttgtaattagctttgaaggattaaaaaaagaattttcccaaatcatatgagcatagatgtgttgcagcgtgcctaaatgtctttcaaataattctccattaagattgtgccttcagcgctctaacaaagtgagcagagctggggaggcatagcagtatttgtttgactgacagattctaatgctctctgttaccctgctgtgggtttcctttgtagtatatcacagggcaattaaatacattgttccttagatacatagctagattgtttatttaaaagtcattttgctaattagaaattacaacatcaatatgtaactatccaaagttactctttgtaactatcctacccatccaaacgctgacttcatataagcatgtctgaaaaacttcccccatcaaaaatatctttggacatgaaggtctacggaatacttcatatataatgtattcacctagtaataaatagcagttacattactctcactaataaaagaactgcttacttacatgcaacagaggaccacacatagaaatatcaacttcacagccaggcacagtgcctcacgctgtgtgaatcacttgaagtcaggggtttgagaccagcctggccaacatgatgaaaccccgtctttactaaaaatacaatactaaaaatacaaaattagctggatgtggtggtgcatgcctgcaatctcagctacttgggaggctaaggcaggagaatcgcttgaacccaggagacagaggttgcagcgagctgagagggcaccactgctatccagcctgggtggcagagcaaggctccgtctcaaacaataaataaataaaaataatttttaaaaaatcaacttcacaaaatggttgcaaaagtcagcaaaacaataacaaaaatctcccttcccttcaagggctgtaaaattcaaaatggttcacattagtaaaaagcccaggcttttgctttttgggaaataaatattacaatataattcccctgaataactttgtccccatgcccaaaagaaggcaaggcacaaattgcaacctatttgtggagctgcaatgagctgccttttcttgtaattgtctgtgccccccagggacacctgaccttgcttatctgagcatgagctcgctgctgagttcagtctggacctctccatatctacacacgctggctggtaaattaagcaggcctctccatgcaggtggcctggcttgcatatgtactgccttcgtggcccagtgacaaatgcttggtgttatcatgggtgttacacaccaaagtccatggagacattggagaagtcaatgggtctgaagtcataaaggaaaataggcacatgccacctgggctcttttatttcagtgtgtttctatgacacttctcttttatattactgtatatcgaggtaagggtagaataatcatcacaatttatttggaggctgggattttatagtggaacaaatgtttggttattattccatatgtgtttatatttgtgtacattatcttccaaaagaaaaaattaccaaacaacctaatataaagatcatgcttcgcagggtgcagtggctcacacctgtaattgtagcactttgggaggccgaagtgggcagattgcctgagctcaggagttcgagaccagcctgggcaacatggtgaaaccccatctctactaaaatataacagaaattagccagatgtggtggtgtgtgcctgtagtctcagctactcaggaggctgaggcaggagaattgcttgaacccaggaggcagaagttgcagtgaaccgaaatagcgccactgcactccagcctgggggacagagcaagactccatctcaaaaaaataaataataataataataaaaaaagatcgtgcttcataaacagaaagatctagatttaagtgtagcttagggaaggtctctctttgagggtagggactgtgtcctgcctactattctgtctccactgcctaggacatgcctagcacatacacatttgtcctatgaatgatcaaacaataattgtcagaagtatttgattcatcacagagtcttaatttgtgtttatctccctcaaacctcttccttctcgctccaatctttagaagaaggaagttctcatctgtgtgtcccataataaaaggagcctgtgtgattcagccaccatcaggctgcatactgtcttgtgaggctttaagaaggacatggcattttggctgggttgcacatttccgcagtgaatggtggaaaggaaaggcacttcaggaggatgaaaaggtactaagaatgcaaaggtgaaaaactgcatgggacaacctgctggagaagagactaggagatagagccaaatcctagaggttcttaaatgccaaaataattcttcttctgtgttctgctctcctgagttagctcagctgtcagatgggttgtgtgcatgagtcgacctaccacagtgccaggaggtaacactataacatgatcccccgcttcactctgtttccctttgccaggcacagggagttcacaaccgaaggaggctgtgctcagctggtgggctcttggagcaatgcgccttctgataatccttttagagcctctgctaaatcagtcctcactccgtgcttctcctaagagaactagacattaagtcttaagacatttgagagctgtaattagacttatagggacacaacacaggagttcaagaaatgtcatggatgctttaaagtaggctttgaatcctttttttttttttttgaaatggagtgcagtggtgcaatctctgctcactgcaagctccgccttctgggttcacaccattctcccgcctcagcctacggagtagctgggactacaggtgcacgccaccatgcccagctaattttttgtatttttagtagagacggggtttcaccgtgttagccaggatggtctcgatctcctgacctagtgatccgccggccttggcctcccaaagtgctgggattacaggtgtgtgccatcaagcccggcctttttttttatttttaaatgattgcttaggaacactgaagtccaaactgtaagttgagagccttacacagtctcaaaatctagcacaagtcatcaaataataaataatagactctcttagcagccttccctttaataacaataaggacaccaaatgacctcagcactacagcaagatcctgtggacccttctagttggagaaatccagaaagtcctggggaggaggtagagtcccttgaggactgagaggcagtgagtggctatttaacaattagtatagaagtactaggttaaatcacatgatattactgatatttaaccgtttggggcctataatactgtcaatttcatagggttctggctaatacctcactatgttagtaacaacacagccctatcagtacgtacataccagaaaggaagcagagattatgtctccctaataatgggcaaagttcaactcttgagttgtatttaagtagcacaaataaatataatctggtaggtatttagttcaccttatccatgcaggcacgcagatattttagatcacaagtagaaggtgctgagattggaggcacaccttttctccacaccccatgcagaagcagctaacctcttgggggcatgtttcaggttctcaatattgttctaagaccattctgtgagttcacttactaacttcttacacaaccctacatggtggattctatcatcacccccatcttatgaagaaactaagacagagaaatagtttccaaagtccaatgtgagtgatagcagagattggttttgcacccaagctgtctccaaactctgtgcatttgtattggtcagggttctgcagagaaacagaaccaacaagaatacatatatataagaaaaagtttctaatcagggattggttcacatgattatggaggctgagaagtcccacaatctgttttctacaaactggaggcccagaaaagccaatggtgtagttctggtacaagtctgaaagcctgagaaccacgagtctgtgtctatataagcagtgtctatgtcaatgtctgaaggcaggagatgatggatgtctcagtgcaagcagagagcaacctgcctttcctccacctttttgttctattcaggctgttaacggattgagtgtgcccacccacactgaggacagcaatcttcactcagcctactgatccaaatgccaatctcttctgcaaacatcctcccagacactcccagaaatgttttaccagctatctgggcatcccttagctcagttaaggtgacacataaaattaaccatcacagcaggtcaacagcactctagagctggcttgggatccaatgtgaggccaacagaggaggcagggcatagcagacatttgaagatcaaaatggcaagtttattaccaacaaaagctgggttggtacacagggcttagtacaactatggaagatggtagacatccacctctgaaagacagatttgccacttggtcaactgcaggtcccccttatgggggtgtgctgctccggcaggacagagagtggatgggaaggtcagcattgtgcagacagtctagagagaaaaagagagccctgcaagaggctgagctgagctgagttccttttcctgaagttaccagtcagatactgtctaaaggaataaggaaagggtggtcaacagaggtccctgaagagaactcagggtgacctatgaaattggagagcggaaaaattgcttctttattgtctatctgttaaattgcttctttaacctctatctgacctactaacctgtagctgaaatttagcatttccttcagttatgaaagaaagctataagccagacttacaggagcagggcttgtgactctgtcagcaacagacgtctcagacattttcatactacggtatgactgtgcagagatctggaatcacccttgtgtatatcatgacttcaaaattttggaaattcagacctgctgctaaatcttgttattagtacattaagaaatacatatattggccagaggcagtgcctcccacctgtaattccagcattttgggaggccaaggtgggcagatcacttgagctcaggagtttgagactagcctgggcaacatggcaaaaccccatctctacaaaaaatacaaaaattagtcaggcatgatggcgcatacctgtagtctcagctacttgggaggctgtggtgggaagatgccttgagcccaggagttggaggttgcagtcagttgagatcatgccactgcattccaacttaggtgacagagtaaggccctgtcctaaaaaaaagaaaaaaaaagaaaagaaaagaaaagaaatatacatattactatatgataaatttatatgttttaaagtattttcataatcatattctgagataattaatctctataattctatgtgttgtcttgtataattttaaaacattattctgagaaggaattcgtaggctctaccagacttccaaagagacctcaaaaaatttaagaccctttgctctagaaacaacagcccttcctccactgctctgccctaaaagatgtttcttttacactaaataatcttgtttctctaggtttgatgtctctttcctctacttcatgaatctgccccatctctccattagagtctttaaaacacagggctttaaatggaagtctctcatgctagactagtaggttggagttttttttctttctatcctgccttctcttaatcacaaattgcttcaactgtgcaaaagtgttaaatgtatatttttatttttgttttatgtattcatgtcctgacttgttccaaaaatagttttagggattattaaaatgatgccttttaggatcatcatgctgcaatgtgactaattctagtgattgactcttccgcttacagctgcccaagtaccttgccctgagtttccttttaagctccacttccagtccaggcacagggcaaggcaggggctcctcccagaaaaatgcgtaagaaactgctgccaccaacattgagggatgattcacttctagtttacaaaaaatagaatcaaaattcttgttccagataccactttaatagtttaattacatgtgtacatcaggaaagttttcaccaaaatgagtttgtgtcttaccctaaggatagcccacctcattgcaggagtcttggtaaggatcaaactcagctttgcctggagtagaaaagactaagtagagttaatgctttctttttgttgcataatttctcattgtccaactgggaaattgaaattaagagagaaaaagaaagagacagacacagcctgatgatttaatgcagacctaatcttaagtcttcaattagattttattggtcttctactagcttctttttggaatttctttttttttttttaagtaatagcccacatatttgctccgaaaactcaagtctttctccatattcaatcgtatcatgacatccaattcaccttgttcatttatactgctattttgaaagcctttagaatttgattctctctctcctgaaacttctttgaggaaaaagaaaatatggaaatggatttccttccctatctctgccaaatataaacaattcatacaggaccactagcaagagtgctgctggctcatgtaacatagactgtgcccaggctggaacaagcttatctgggcacactctgggaggagagctatgtatgtggtcagcctcctcagaggatctgaaactcatatgaatttatcagtgcatcccacctggtactgatatgtgtataaaaatatctgaatgggttctttaactcaagactttataaagaatctactgaaagtgatgaaataaaaacccagaaggagactaccaattaatataagcactgtacacacacacacacacacacacaccccacagcagtgccacagctgccaccaccacacccagaaaacaaattacaaacactgtactataaagttctggtattcacttctcaaacctttcttacaaaggaattgataaaaattcttagccaagtccagaaaagggtactgccctggtttagcctgtccatatcctctcttgctatcacggtctcaattctgctgcctaaagacctatttctagtggttctaaacctatttgcaccaatgtgttctttccttttagcaagccatttaatattggctgtaaatgattctcagtctgcagttgctttaagtgacaattttaagtacacagtctttagcaacctcattcctaccgtgattgctttcattcaatgccttctgaaatgctagccacctgtcaacatggacatggtcattatgcttgcaaggcactcgaattctgcctttattctgcacctagagtcactccatcgttggagtcctgtccagcctctgagaggctacagcatttcagaggacttttaaagcaaatgacattaatttccagattgtatccaaatcgaaagaggtctcctatatatgtggaactcatggacctcttgatagttcctggatagcccctttcaacgtgctcctcagggcacatgcaaaaggccttagaattacacccttcattcccacggtctggtaggcagtaccaggggttctcaaccctgaggctgtgacactatgtatattagtcaaacatgagatattttggaaataaatcgttactgaagttagaaaacgattggcttctttaataagtcagagccaattccaggttattcccataacagtggcaactgtacttacccttctttttatgcaagaaaaacctatggacatttgcaccaggaataaaatgtagtctaagacccaagttatctatgccacggacccctaattcttgcaatgataagaactgttattgctgttattacctccatttcccccctcccattttggggtttcagtgaaatctgagtatatacaggaagtatgtggtatcaaagatgaacaaagttggacactagtcagagtggtaaggatagatcttaatcagtactatgctactgcactgaactccaccttgatttgtacagcagtatctgggtgttttaaagtgagaaagagggaaaagggagaagggagagcaagggatcagaagagtcacgaaagtgaaaattacaaaaagcagggaggcaggcatcattccatgtgaaaccatctggtttgctaactgacacttaacaaaagttaggctcctaccctcccacagaggctgggagacaggagccctatcttcaggtgttgactggagaaaaacagtaaattcttgggtaggcacggtggctcacgcctgtaatctcagcactttgggaggctgaggcgggttgatcacctgaggtcagggattcaaaaccagcctggctaacatggcaaaaccctgtctctgctaaaaatacaaaaattagctgggcatggtggcgggcacctgtaatcccagctactcgggaggctgaggcaggagaatcacttgaacgtgggaggtggaggttgcagtgagcggagatcgcgacattgcactccagcttaggcaacaaaagtgagactacatcttaaaaaagaaagaaagaaagaaagaaattcttttggcagccttcagattctcaggtggacacttcaaggggtgctggggtcatcctagggttcagcttgcactgtttgacattatgttactacttgtgcaaatcttcataggccaaggttgaggcctcgttgagaactaggctcagaggacgctggctagagtttggccagggaaagaatctttgtcagtagttgtgtcaacgtcaataactatactagtaaagagtgtgtatggaggtggtggcgggtggggcatggagaaaatttaaaatgtctgatatagtttggatatttgtcctcgcccgaatctcatgttgagttgtaatctccaatgttggaggaggggcctggtgagaggtgtttgggtcatgggggcagatcccttgtggttgggggctgtccttgccatagcgagtgggttgtcaacgagacctatttgttgtgaagtgtggcacttcccatccccctgctctcggtctcttgctgatgtgatgtgcctgttcccactctgtcttctgccataggtaaaagcttcctgaggcctccctagtagcagaacaaaggccagcaccctgcttcctgtacaacctgcagaactgtgagccaattaaatctcttttctttactaattacccagtctcaggtatttctttatagcaatgcaagaacagcctaatacaatacctgagccactactgatcccttttgcaatcaccctgggcagtacaaacctagaaataaccattctaagtaagaccaccagaaatggccaatatttaaccatttctgacccataaaaagagaaagttcatatggtttaatttaatattattcacattgcatttaaacatttaaatctggaaaacagattgacaaaaattacccagatctacccaaagggtctgcaggtgcaggaagcagacagcttaaaatggttttatattgtttcatttcatttcactttaaccaagaagattgcaatgatatacattgttgtaaatgcttccttgtttatgctcatgtttggatagctacatctgagaatagtgatggaatttcttcctcagaagaaattgcaaggagagtacttcaacactacaaaagagtctgtcagtagaatttaagaataattgcattaaattctccagaaatggatagctgttgttttaaattttctgagaaaacatttaacacagaggaataaattatctcaacttgaatttctctgattgagtgtctccatcagtaaagggtgctattatgcctgccactataagttgaccccaaaatacaaattaaaatgtgtgaagtggaggaatgattatattcttttaaagttttcactacattttaatttctcaagataatttggtggttgttggtgttgttacaataaaggcattcagcaaatacattataagtgagctttaccatgctggaattcctccttaatgtatttaactgtatgtatggaactaggtcatgctccattgccaagatcgtaacaattgttatttcaaaacaaaggtgtggccataaatagtttaaacattggcaatctagatcttcctctttttagtacttaattgccataaaatcagaaatgctcagcacttcaggtcttgccttttaattaaaagtttaaaatatatgcatcatgaaaatgccttaaacattgtatcaagtccaggccaattaggatcagagaatgtattcagagatagctttaccagttgacatttccaaaagatttcaacctctgataagggaggaaaaaagaatatggagaggaaaaaaatgttcaattggccattccttgattactgagccataaccatataattttttcaacacaacagtggcaatgcaggttttattagtctactcaggttgatataacaaaaaaccacagtctgagtagcttaaacaacagacaattatttcacacagttctagaggctggaaatctaatatcaaaatgctggtggatttggttcttggtgacatcatctctctggcttgtagacatctgccttctcactgtgtcctcacatgacgggaggagaaagagagaggactctggtttttctttgtcttataagagcactagtgtcttaaatttaagtccttgatccatcttgagttgatttttgtataaggtgagagatgaggatccggtttcattctcctacatgtagcttggcaattatcccagcactgtttgttgaatagggtgtccttttcccactttatgtttttgtttgctttgtcaaagatcagttggccataagtatttgggtttctttctgggttctctattctgtcccattggtctatgtgcctatttttataccagtaccatgctgttttggtgactatagccttatagtatagtttgaagtcaggtaatgtgatgcctcccgatttgttctttttgcttagtcttgcttgggctatgagggctctttttcggttctatatgaattgtaggattgtcttttctagttctgtgaagaatgagggaaaatttctggaatataacatcagaaaaacccttctagacattggcttaggcaaagacttcatgaccaagaacccaaaagcaagtgtaacaaaaacaaagataaataggtgggacttaattaaactaaagagctcctgcacagcaaaaggaacagtcagcagagtaaacagacaacccacagaatgggagaaaatcttcacaatctgtatattcaacaaaggactaatatcctttgttattatcctttgttcatagttatgaatctactatgaactcaaacaaattagcaagaaaaaaaataccatcaaaaagtgggctaaggacatgaatagacaatttgcaaaaggagacatacaaatgtccaacaaatgtgtgaaaaaagtgctcaacatcactaatgatcaggaaaatgcaaatcaaaaccacaatgtgataaccacattactcctgcaagaatggccataattaaaaaataatggatgttggtgtggatgcagtataacgggaacacttctaccctgctggtgggaatgtaaactaataaaaccactgtggaaagcagtgtggagattccttaatgtacaaaaagtagaactaccatttgatccagaaatcctactacttggtatctacccagaggaaaagaagtcattatacaaaaatgatacttgcacacgcatgtttatagcagcacaatttgcaattgcaaaaatacggatccaccccaaatgcctatcaatcaacgagtggatataaaaattatgattatatatacatatatatatgatagaatactactcaaccataaaaaggaacaagttaatggcatttgcagcaacctggatggaactggagactattattctaagtgaaataactcaggaatggaaaaccaaacatcatatattctcacttataagtgggagctaagctatgaagttgccaaggcataagaataatacaatggatattggggactcagagggaaagggtgggacgggagtgacagataaaagactacaaattgggttcagtgtataatgcttgggtataccaaatctcagaaatcaccactaaagaacttatgtaaccaaataccacctcttctccaaaaacctatggaaataaaaaattttaaaaaaacaaaataaatggcagggcacagtggctcacacctgtaatcccagcacttcaggaggctgaggtgggcagatcatctgaggtcgagagtttgagaccagcctgaccaacatggagaaaccctgtccctactaaaaatacaaaattagccggacatggtggcacatgcctgtaatcccagctactcaggaaggctaaggcaggagaatcgcctgaacctgggaggcagaggttgcagtgagccgagaccgcaccattgcactccagccagggcaacaagagcgaaactcagtctcaaaataagaaaagaaaagaaaaaaacataaaataaataaaactgacaaaaaataaattaataagggcactagtgtcatcctgaggatctaaaccttataatctcatctaaagctagctatctcccaaagtccccacctctaaacatcatcccattgggggttagggcttcaacatgtgaatttgaaagatagacacaattcagaccaaagcactgattaacagcaaaaaaaaaaaaaaaacaaaaaaacaaaaaaaaaaacagttaaaagatctaatttcatcttagaatacagctttctatagatattaatttaacaagtattaataaaacacagagacggtcattttaaaactaaggtcctgaatgtccttctgtacatatattgcatctttagcaaactatggccacacacgaagaagcttacattatctttctctttgagcagttatatttcctttctttctactcactgtctgtagctgtttgtgtgtgtgtgtgtgggtgggggggaggttgtttattagtttaacaatttggctcagtgtgctaaaaatagcctatgtgcactgcttttccttttagctttattgttgcacactaatttttaattgtctttgagactaggaaaatctcctgtgaatgcagtgagcacaattgatggaagccgacgagcagattgacgcaaccctagatatggggccacagttctgatggcttcagcactaccacttcttaatcatatgtccttttggaatttatttctgcccatgcagaatctggatattaaatgctcaagttgctataattagatagactctatttttagtaacagactgttttcctgagatacatacagctgctccttaacactggaagcctttttcacaaagctcatattctcgtccttcctttttaatgcccaataggcttaggagggaaaatacaaacaggggttatatttagttttctactcagctatgtcaagccctaaatctagaggaagttataaatacactacgaggaaaatgctcccatttccttttaagaagcattttaataccacagagcattgtggtataaaaagtagagaggagcctgtattaaagtaagagggtaagtaaattaaaattagactttttgaagacattgtcctgtatgtggagctgacgttcacactgggtaatattgagagcccaggatatagcaggtacccattaaatctttgtggaatgtagaaggattcatgctgtgtagcacgtactcaaaaagggttgattgcttgaatgaatatatcattttgtattgtttactctttgagatcacagagaacactctctgaagtaaattccctgaagaaggtgagcattgcaaaaccacaaactattccacacatccccagcaatggatctaacagtcagcatttgcaagttgtctcagctgcttcctctgtggtaaggagctttcattaacaccaacagaagaggcattccctgcatttggaacccctggttccttaacactcggaaacctgctgccagccagtggtcttgcagccaatcccacctcactcctcacctgcttttaactcatttcctaagctctcttggggacctggtgatgggcaccagaaatcaatgtaacactccccttcacaacctcttttcatccttctcaaaagactcctacaccccatggtcacccacctttccatctctcaccccacacaggcactaagtctatcataatggaaggggcaagggctttggcagtcaggaggcttggtgtaaatccagactgcttttacctggaggaggtgggatatacactgagtgagctgtttaatctctaaactttggtttctccatctgaggaataaagggaaaacacctacctacttcagacggttgtcatgagaattacatgaaataattaatgtaaattatcttgtccagcccctggtgatgggtggaagtgctctgtcagtgaggatggttattattattcacaagtctgtgaatttcacctccagcagccatcctaaattttgacactttccttttttctttctttcaacttctgtccattatatatcagttcctttcttcttctcaatgtttctttctctccttctctttgttccactcacaaatcaaaataaggctacttagtgagtctaagaacagcattactaacatgcctacaaataagaaaagctaagccatcaactttgaaatgaaatatttggagcaaaatatagggttagaataaataaatgcaaacacccttaaaaatgagcccagaatattcaaaatgtcttcttcagaatgaccccagaagtttccatctaattctaagcttaatctgcttttcactgagcagtcaacacttaaaaacaaaacaaaacaaaagctagtttcatttaatgtttatatcttttttggagagtagtattagtgagttaatatcgctgggttttgatgtgggtttccattaactactattccacagaagcattttctaatatttttattatacatataccactcttcagccccatcatgggcaaaatcgactaccatggattaggattagccttggaaaccagcaaattatgaaagtgcttccataacatagcatgttccaaattccaaataagtgacttacagtcacgtatggactgacctggtagcaagttgggacgtgcctttttaaacattttctcacactgagcacatcttcctctatctgttattgttttcctaatatgtggcttggaagggagttagacagctctccaacaccgacggaagtgcggaaacccagcatccaaaaaatgactggcagtggtaaaatggtctactggctgaaacataccacttttcatcacagcaaatgtttggccaagaaataatcatcagtctttctccaggaacacctgtaacctcggggtttttttcttttctttttttaatgagagtgttattatactgcagaaacacgtcttattttatgatcagccttgcagcttcacgagaaaagttcatggaaactcccaatacattaaaaacatgcacttgacattctctccacaatttttacttgtacatgaagcaggtgctcacattcctgctgctgtttttctaggactgtgctgtccaatatagactccaccaaacatacatggctatttaaatgtaagtgaattataaataagtaaaactaaacattcagttcttcaggttcagtaaccacatgtggcttgtggctaccacgttggacaatgcaaatttagaatatttcctttattgaggaaagttttatggagatctacactgtccctatatgatacacgcttgcaaggaaactttactgttcttcaccagtgttcaaataaagccctcttgattttagtacatgactactttgaatgtcccagtttgtcacacaagaaagccatcactctgctcttctaacttagtagcttgttgcttcagaaagatgtaaagccacagattcagacttctttcttacacaacgcagaaggcaatgagcaggcagggagtcaatctttgttctaacccactttgttagcaggcaaattgggcaaggacaacaatctagttatcatgttctccctaaatgcaacagggattacgtatatagccaaggtcataacacagctctgcgaagaaagcttccccagtttcctgtatgacatttatgacacttacaaaaatgcctcttgacattttcaaaaacttcagcacatggaccacctgctcaggaagggaagtcagataacagaaaactatttccgcaaaagactgggccagtcttctgcagtggtcatctcagctcaagcacaagaaatattcttctgacctacttccttttatgatttggatacaaatttccaccttctaaaagccatctattaaatttggtatcccagtaagtgtttttattaaatgtgagttgagctgcctttcacttaactctaccatgagcttattaaattaaataaaaattgtaaagaagatcaaagttccttcttttaattcctttagatcctttggggagaccactgtttatctctgtaaagttcaagtctgcgtaactctaagtcagccaaatctgacatccaaccatggaatcttgcggagaccatttcctcctcctttctcagtcttcatattcccattccctgcccagactacagtttggaagttgttgaatgaattcacaagtactaccatttgcactttcacacactgtttaaaggcagaagtatcagatttctcagcactgtgaagaagttggcaactacttcaaagcaatttcgaagcatctattacattattaagcaagggcaataatgatctacaaactgccaaccagctcatgttttcctttccttcctgcatttcattgcaaataccgtggtctctattttcctgtttgaacaccagttattacgttgcctttaaaattatagatctgacagcaatcacaaataagagctaaaaccacatagctaaatgacttgcacagctatgagagctgtggtggggtagaaaagtctgctgtaaaataatttgtcttttgttgttttgtgtagcagtatgtactttgttcccccctccttcttttctgccctctatttctacagatactgtgagactcaataatagcccattacaaatggtcaatccctgcagtaacttggcagatctttaactgagtgtttccatttggtgcaacatttgctaaaacccaagtaaagatgatatgagtacaaatatgctgtcctatattcaaggaatatacagcccaaacttggaaacaagtctaacccacattaagcagcaatgaaaaatgctggaataattacgtgtgaatttgggaaaatgaatcatcctccttggccccctttctattgtaatgccttataaattccaggactgtataactagtgggctcctgtatgccttacaggctgtaagttgcagatgttaagagccgaagtgacaattgaactgccattcctgaaacttgaccttgtcacttttcacaaggcctgttcttacgaagtgatcccttgcacttagaacctatttgtcagcagctagtgaaactctaccctagctgatatctacacttacgtctcccctccctgatagtccacactggttagatacatggagatgaatgactttcaaagccacagtaaccaggtccaccttttcaatgttatccattagtatttggtcctgtcaaaattttcttcaagtttccataaaggaaagaaattccatgaattctaaatgtttaatctattattgatctttatttattttattattattattattatttttgatatggagttttgctcttgttgcccaggctggagtgcagtggcatgatctcagctcactgcaacctccgcctcccaagttcaagtgattctcatgcctcagccttccgaggagctgggattacaggagcctgccaccatgcccagctaatttttgtatttttagtagagacagggtttcaccctgttggtcaggctggtctcgaactcctgatgtcaggcaatctgtctgcctcggcctcctaaagttctgggattacaggtgtgagccatcatgcttggcctggtctttccatttatttgtaaaataggcatggtttagcaattataatccctctaccacacacacacacacacacacacacacacacacacacacacacactcaaatcaaatgctggagaatttggaaataatatctacccaggaaagcagaggcaggtaaagtttagggattatctatcaatatagacagtcatatgagtatttgagaactcaggcctgaggccaatgtctatttgatgagtatacttgggtatagcagagcataaggggatgggagaagtgaaatgggtcactgagtgtcttcaaatatcctattcacaaggtggagccacctcctaactgctccctttgattaaggtcagagtcaaagttaaatacctcctttgacccagccgataaagctcatctaataattaaataatgacctgcaaaactccaatggcattttatgaaaaattgaagttaaaagatgaatttgtgttatttgtcctacattgttcttggtcacaggaataatttcttgccgtcacaagtaatctaaattcaaagggggtaaatcccaataacaatggaagcagaggaaacatttccatatgcaaagggctagcaaaaggagtttggagaaatgatagatgagaactggagtgtgaggccctgaacggtattggctggcttgatcagtcactttatttacccagcttgaccctcaactactgttggcttttctcaaaatatcatatatgttcttaggcagcaagaaagttcagaagaacaagtcacagtctctgaagatcattttcagacagccatttcaaaatggttggggcaaagataatatcattgggatgagtttttagtttacagtttcccaagaaaacatttctaaataacccacacgtaaacacctaatgactgtttcatgccatggtgcgcttcccagtgccacagatttgcacagtcttccccataactgatgtgccctcagacacacaccacccctctaccaccatcacccctgccccataggtctcacttctttctccttaaatcttgcaccgaaggttgagttctgtgttttccaggaaacttttcctgacgaagaatcctaccctttgtcaactcatagccaaagttgattggatatgttacggactgaaagtttgagtcctcccaaaatgtatatgtttaaatcctaaccacaaacatcatggtagaaggaggtggggcctgtaggagataattaaggttgtaagagtagagcccttgggaatggaattaatgccttcataagagtccctagagagctctctaaccctatttccaccacatgagcataaaataagaagtaggaaatctgcaggctagaaaaggaccctcaccagaacccaaccttactagcaccatggcctcaaatttccagcctccagacctatgacaatatattcctgttgtttataagctacccagtccaaaacactttcattatagcaaaccaaacagactaagacaatattcctttagctagttctctttttctaccagaaatatctcatattctttttctatattgctcctcaaaccttgttatttatcttttcatacattgtttcatgtcttcttccccaattaaattgtaagatatttgaaggcaaagatctctgttggcctttattatattcaccatacaatccaacactatgcctaggttgcagtaggcactcaataaatatgtattaatttatcagttacaagaagactcttttttcacctcactcatatctaataatttcttcttaaaattttttggatatgtaaaaaaataaaagaaaaacgcataggccattggatatattcttaactttacacaaatgatacaactttcatccttgctttcagtcaacaaatatttattgggcacctcctctatgacagccatgattccagatgctgagaatacaactgtgaaagactagagattacctttttagtgaggggaatagggagattgttgattaataataataataacaaataaaaagtaaaatagatatgatgtcagatagtgacaggtgctaagtagaaagaaaaagacgtggaagaggattggggaagatggaatgggggcccaggcagagggtacaattttaaatagggtggtcagggaaggcctcaataggagggtgatgcttgaggaaaaacctgacgagaatgggatatcaacccacgtaacatgtagagaccatggaatatgctcaaagaaacaaggattcatacaagtggttgtagaagtccttggcatttcaatgggttctcttctgaggctgatgttccctttctggagtccccaaggtgactccatatgcttctgtgcttacttccacccaaatatgaatcactctgtgacattaatgttttataatatgtctccctccagagactgtgagttatttgaaagcaagagttatctcaattatcaatacaaacctcagaggatttaacacaactctaagtcagcagtgagaaatccataaatgtttgttgattattgaataaatcttcattcaggtaaacaattcatctctaaattcaaaacatagcttatactaatttgagtaaaatggcatttgctatatatatatatatatatatattttttttttttttttttttttttgagacggagtctcgctctgttggcaggctggagtgcagtggtgggatctcggctcactgcaacttccacctcccaggttcaagcgatcatcctgcctcagcctcccgagtagctgggattacaggcgcgtgccaccacacccagctaatttttgtatttttagtagagacaggttttcaccatgtcggccaggatggtcttgatctcttgacctcatgatccgccctccttggcctctcaaagtgctgggattacaagcgtgaaccaccgcacctggctgatatatttattttttaatgtgaacatttggcaaacttttcttgaaaaagaattaaatttcttatcaaaagtcaagtaaagctggccccactccctcttttgtcacttctgactagatcatagagaagtcaccaaatatggctttgaaactgggtagcatatttgctacccactaaaggaaggacagctagtacaagaagagatagtgcaggttcccataggaaatttttaaactagtacacacagtactaatttagccctagagttattaacatgaagaaagagtaaaagttcaagtcatccaaacacacaaggacaagtgagatgacagtacagcctccctggcatgatcacagttgtgtagaggcatcactttcttgctggcttttaagtgggtggggagggtgggcccaaggaggggaggggaataggaggaatgccagtttcttctaacatctcatgaaggagaagttttctctcttttagctcatcttcgttctttcccttaatgactattaggacctccaaacctgagcagtctagcagtctgccatcctggtcatctgtccagaatggttggagaaaggctatccattgagcagccctgaaggctgacatcaactccccactaatgagcttcctagtgacaaagtatcctatggaagtgtattccgatcaaggaaaatctattgtaattagagtttatatagcaagccaaacaaagtcatttggtatcactcaatacccaactgtgagcattgcacagtgtctcttgaagtgcttcaacagaacacagatgactcaggggctcccccatatgctccttggccctgagctggtgtgacagttccagggaaatctgctgctggcttccagccagtcaggatcctgcctgctaggactgttctagtcagttagttggccgggtccagttgttgtcttagtggtagctctctgccatccccagtggtgataaggtgtctggtaaaggctgctacagaggccccccacagccactctcaaccctcctgactcatctggtttccctcctattgactggactattttctgtgcgtgcatccttcagattggcaaatgaagctagatggttttatctgattttatttctgttctaccctagatgctacttccttcagttactaagcattagcaccaagggcacgagatggccatccctggccctctcagtaccatccaacaagtgtcccaggctactgctcaactaggagggacatgcaggaagcatcatctatgaccccacatcaaaaaacaaaacaaaacaaaacaaatgagatacaatgtatcagcctgcacggtggctcacacctgtaatcttagcactttgggaggcggaagcaggcagatcacttgaggtcaggagtttgtgaccagcctggccaacatggcgaaatcctgtctctactaaaaattacaaaaattagctgggcatggtggcacacacctgtaatcccaactactccagaggtggaggctcaagaatctcttgaacccgggagacagaggttgcagtgagctgagatggtgccactgcactccagcctgggcaacagagtgagattctgtcttaaaaacaaacgaataagcaagttatgtatcaatatttatatgacagtagaaatctgtcttttttttcattctaaggcatactctaagccaaggaatagtgtacagagaatcagctatgtgctcctagatgctctgggctgagtgtggccaacacaccagagagaaatggatgtcctgttcagatgagttggcacaaggtagatggggacatgattttgccaatttattataaagacaaatattttgaaggaggtaatcatggggtagctcaggaagattcttaagtctcatttgtctatgaacttgaagctctgcctttagggagcagtgaatattatgaggcagcgtggagattatctctaaaccagtaggcagagacccctgaagcatagatttccaggaggattggagctgggcttgaaattttaattctttattttataggtgaaaaaccaaggccttggaaagttaaaagatgaccaccaagacttctgctggagcttttctgtctttctttctctcctttttcagacacagagtctctctctgctgcccaggctagagctgctggagtttgtctccttttttttttttttttttttttttttttgagatggagtctcgctctgtcacccaggctggagtgtagtggtgtgatctcagctcactgcaacctccaacccctgtgttcaagcaattctcctgcctcagcctccctagtagctgggattacaggcacctgccaccatgcccaggtaattttcatatttttagtagagacagggtttcaccatgttggtcaggctggtcttgaactcctgacctcaagtgatccaccctccccagcttctcaaagtgatgggatcacaggtgtgaaccactgctcccagtcagctgctgcagcttttctgctgagtctattcagacctctgtttctaactgtttatttgaattcatatgtgcttcacactaactctcattcctctccaaattctaatgatgttgaatatccctttcctgagagaagaaccactaaatgttatgaaataggcaaattacatgtggtttccccaaattgctcaaagaaatgaaccctgaggtctccctctgactcaacactcccagatggcgcctacctcttcagaggcctctctctccccaactcagctataagcctcataaagccagagacagtccacattgtggtttttccagggcttagtacataattcattattagcacacaatatgtatttattgaataaatgaatgaatcctcctaatgttaaatgtaggatgaatgtgtggacacactgacaactgtttcttattatctctgactagtaagctctcttggttaaattatttcagcaaagtcatagtttgattatcttatgaactggttgtttgtgttctatccatagaaattattttcatccataatctactggtcttcttgaagccaggcactataactgaaaaaccatttgcatcaaggaccataacaaagtttgtgctgtgtgactcggtagttataattttaggaaatcaatttttaggaaagaatccccaaagcaggtgatttataaatatgcccaaaagtattcatggcagtattatttactttaaaatattgtccacaaccaaagagtaaataagctaattaaagctcattcattaatatatacaaacatttgcttactctctattaagtccctactgtgtccaggcactaccttagtcacctgataaacactggttagcaaaacaaacagcgctaacactctggagcttgcacagttaaaaaaaaatatgtccttgagagcatttagttaaagagaaaaatgcttgacattttatgttaagtaaaaaaagcaggatacaacattatatttcaatacaacctttatatatctacagaaaattattaaaggataataagtcaaaatgtcaatagaagttgtctctgagtgctgaaattgagttatttttctttatgcttccctatagttcaatttttaaaataaattatttctaatgagcaacttccataatcagataaacactggggtaggcaggagagtaatacactcacctgagtcacaggaatctggaactcttgttctaaaaatgcctactctgtgttccttgtaggcagcatcattttttttttaaagtataggtttcccagtctacaaaggccgtttttagcattccttcgtctggcagctgagaataacaagcagtagcctgccatggacagttgctgctcagtgttaaatgtgtttggggccaataagttaatgagttgattgggcaaatgtaaactgtgttttgagatattacgtattataatatccatggaattatttatataatgctacttgtatacaaagtagattgagcatctctgaacatactacaccggcacacacacacacaaacactcatccgatgaagggtaacaattcaatagccgggtgccagggatttcctaaaacggtccagatgttatatcattttattattatcaacacaagtaacttttaaactaaatattatttactttgtatctcttattaatattttgaacaaatagatatttaaacattagggaaaaaatgctttatcaaaccacatgtcctaatttttgtttcagaatctaagttcacctaaaagaagagcaatatagaaatgctcatgaaataacttgaataaagagtcttacctttttaaacccaaagagattatcaagagtgcacaaacatatccaattgctctgctatttgcctgtttggctgtgtgttttaaaacacatgcatgcacacacacacataaaaaaaatgttgagcagaaggagggtgtcttgaaagcacaataagttaggtgaaaacaggaataggcacaatgatacaagtatcagaaattatatagcatctcagctctggttaataggtttaggggagataagatacgggataaagggagagttgggtgtctgggttttctttattattattgtcattataggaagccattcaatcaatacctttgaaaggaaaaagaagcctcaaatacttgattaataaccaaagcggaataagttcaagattatttatctaaccaaaagattagcttttggggcaaggttaatgacagcacattaggaaagaatgtcatgtcacaacctattgcagtaggtacaactactgaaatcgctgtacagtaagtggtcgcaatttattgctgccctcccaactaggtgacttgtagaaggaggtcactacagaaggaaagaaagggaatacaaaagactgttcaaaatttttctctaaattagtagcaaaaagaaaagcaatctctttcagccccaaggaccaaagagtttactgacatgtgaacacgccaagcttagagaaacactgtggggtcagaaagtctgcgaagcagatgccttgattcagaggggacagctggtaggaagaggactgtcttccctggggagtacgtatagattccattccctaaatagcttaaccttctaccatgcaaagaacactgcataagggggagggataaggactcagattatttttttcctgttgctgtgttcattttttgtattgacaaatacaaattgccttgttgtgtttgtttcttaatataacagcaatacacattaatacatgtttattatagggaatatagaggcagaacaacacaaaaatagcaattaatactacttataatctaatcactcagagatgctaaactttaacattctgacatatacccagctgtcttgtatttacaatgcataacatttttaaaaaattgggaatcaataggaacacactgctttgtaacctgccttttaaattttaaataatatcatggtatctggcaatatcattaaatattcttttaaaacatgattcttaacggatgcatggaatgctatatcatatggacaccctctaatttatgtaactattcccactcatatttggaatgattttgacttatgcaatttttgtgatacatattctcatgtataagactttgacaaatctttttttaaattgttattctagataacttcctagagttgaaactgggtaaatggctatgcacatttttcaggcatttggaagctgatgtcaaatttttcttcagaaaagtctgctgattagtatttcaccagcagtgtgtgagacttcctattctcccatatcctcgataacattaaatatcactctaaaaagaatctattggagtgataattattatagtatattgtagttttcattgaaattttgaaaattattgctaaagtttcccttacatttattcatgttttatgttttaacacgcaagagaaaatcaaaattcaattttctattgctcacatctttctacatgaaaatagatggggcacacagacttatctccactcctttcccactcctgaagtaccatgttccttactgtcatttttctactgacatgacagtagaatggttaataaagaggaaagaaaggagaataacaggaaaggatatcaaaaaaagcttaaaaggctggacgcagtggctcatgcctataatcccagcactttgggaggccaaggcaggccaataacttgagatcaggagtttgagaccagcctggccaacatggtgaaaccaacacctctattaaaaatataaaaattagccaggcgtggtgttgcatgcctataatcccagctactcaggaggctgaggcagaattgcttgaacccgagaggcggagattgcagtgagccgagaccacacaactgcactccagcctgggcaacagagtgagacactgtctcaaaaataattttttttaattaaaaaatacaaaagtttagaagaggaaaagcagatggacaagtgggaagtgactcaggtttcaacttctgtggtcttgaaagagaggactcaacaagaagcaagtgaatttttgcaagagatcaccgtgaaaactcaaaaattagaggcactagtgcctctgacagtctgtattaagaataattcaacctccacattcactgtttcaacccacagagcctgcagctgttccccatccctcccaggggaaaatggggggaaagtggttagctggagggtggccacacagcctactgtgcccaggtgagaatacttattgtgtggcattcagtccagtttaatatttgtagattcgaaacatgtcttagtttgaaagaaaactatgcatttactgtattgggttgaattgtgtcccctgcaagataaccattcacctagaacctcagaatgtgaccttccttggtataagggtcttggtaggtgttataaaggcaaggatctcgagatgcgatcactccgaaatagaatgggccataaatccaatgagaagagctcttagacagaaagatggaatgagtgcggtgactcacacctgtaatcctagcactttgggaggccaaggcgggtggatcacttgaggtcaggaattcaagaacagcctggccaacatggagaaatcccatctctactaaaaatacaaaaattagctggatgtggtagcgtatgcctgtaatcccagctactagggaggctgaggcaggataattgcttgaacccaggagcagaggttgcagtgagcaaagatcacaccactttactccagcctgggtgacagagcaagactctgtctcaaaaaaaaaaaaacagaaagatgcagacagagacacaggggagaaggccatgcgaagatgaaggcagagactggagactgtgctgccaccagccaaggaacaccaaggatagccagcagccactggaagccaggagagaggcgtggaactctccttcagaccttccagcaggaaaccaccctgctgaaatcttaatttggaacttctgtcctccagaactgtgagagaatacgttttggttttaagccacccagtttgtggcactttgccctgggaaattaatacagtcaccctgatttgaagaggccatcccaggagcttgagagagtgaggcaacttcctagacacaggaaggtgaaatgaatgggtggacaccttcatcagcctcctttacctacttagcttcagaactcagttttcaagttgttacatccacctcttcctggctcaagcaggagatgggaagacatttctctggagaagtcaactgctatagctggtggtcctactgaatactctcctgtgaggcctgcaagtcagcaagctctgtccttgtggaatcggcttccaatcacctttccatgtagcacccttcactatacatggacaccaaataatcacaaaaggcaacaaattcagagaatcaaaagaatggcatgcacagagatatacaagttgttggagcattgcattctgtagggaactgtccctccttcccacagcccaagatccctctggtttcctctcagttcttacagtatgacccagctgccttagccttgtgacaattaaaaaaaaaaaacacttttatatttattttattatctctttcagatgctatgtaccaggaaggttgggtctaaattttatacatttctcctttcctcatagcattgcctcctgaaaatagtctctgtccactagactaaagttgagcctcagtacatttcttctcatacacatattgtcagcataaccttggtgaatcaaccagcaaatccacgtcctaagagtccccatggtggggcacattatccacaagagctgttatgagttgagtgcttctagatgccaggcagcaggcagaaagcttgactcagattatctcgttcaatctttgcagcaaccctagaactaggaactgcaattgtctccattttatagataaggcaactgagacattccaaggttttccaacctgcccaagatcatacagtccagatttagacccaggcaatctaattccagatcccgggtacttaaggcttgtatctgtttgttttcacgttgctgataaagacatactagagactgggcaatttacaaaacatagaagtttaatggacttgctgttccacatggctggggaggcctcacaatcatggtaggaggcaaggaggagcaagtcatgtctcacatgggagcaagtcatatcttacatggatggcagcaggcaaaaagagaacttgtgcagaggaattctttgaaaaaccatcagatctcgtgagacttattcactatcatgagaacagcacaggaaagacttgcccccatgattcagttgcctcccactgggtccctcccacaacacttgggaattcaagatgagatttgggtggggacacagccaaaacatattaagcattaagctagttctttgtctgacatcatctggaattcacaatatccaactacaggcctcattcacccctcctccatatagcatccctagcactgtaggtcacatgcactcctagcttaaatctaagggctcatgccaagcagtctgagagggaatgtactagtcagtgtcatagatggggctctatgttgtggagtggaaagtagccaagcccacagcctcatacaggatccctggaggatcccagccagcagggcttctggtcagtgctcctacaaggggactagacttgtatttggaaaagtaaagggcacaagagaagagaaagggatcaataaccatctttcttttctttccctccatttccacacaaactcaggcaaacactgcttactccagatagtcatgcagattgaatataaagtagtgatagtagttatggataaaaatctaacccggttcccaagtccctctgtggatataaattaggccttcaggaaagtagatgaactcctccttggggcctctagaataccacagcttgctggcacaagtgattatacccagtggtagaattaattatgccttaaaagaggggctcagatgtacctttgaggaaacttttgatcttgcaaacagtggttggctgaataatggtcccccaaagatgttgaggatgtaacctccagaacctgggaatgttactttatgtggcaaaaaaactttgcaggtatgattaaattaagaatcttgagatgtgaggattatcctgcattgccaaggtgagccttaaatgttttcacagtgttcttgtaagggataggtagatttacctccagatgaaggcaatatgaagactgaggcaagatgcaatgctgctggttttgaagatgaggaaaggtccacaacaggaggaatggaagaaacactctagaggctggaaaatgcaaggaaatggattctgccctggagaattggaggtcacatggccttcctgacaccttgatgtaggtccaatgaaactgattctagacttctgacctccagaactctaacggagtaaaggtgtgttgtttaaagccagcaagtttgttaccgcagccataggaaatgaatacacagactcatacccattcacgaagaacagctagtttatcctgcatttatttcatagcctcattttcctttttataaaataagtagcgaatctggtcattaggtgctttgtgaacaaagaagggcaatagctgctcaatcaaatgccaccactatcttctagaaggcttgcttctcacttcttctgacctttggcctataggcttggaggaaagtgtaagtacaaggcagttttcagaggtgtccactgtatagcagaggcacctggcagccctaactgaagcagaccctgagaatggccctatggtcttaaggaggatgtgtgtttggagtcccaagctaaggaattcaggagtgtccaacccagagtttcacaccttgtctatcaaggacatctgaacccttggcccatcccttggaatgcataccacacaggggatctaggccctctgttttgggttaaatggaggttgctgggtggagggtactaagtgaaaatgctgtagaaactgcatgctttttacaaatggtagtggttcttctgttcaacctgctgcattggactatccctggatgtaaattcccccagtaaaccctatgtttcattcactgtcttgggtctcttcttcagtgtctcaaacatggtgcaacccctcttggagtcagcagaggtccggcacaacatccacacatcccaaagctcattaagattttctggttttcctcaacagcaggtagcaaagcaaaaaactgcaaattcacctgttactatgatggtgcagttctaaaccgcttctccctttattgccatactacgtaggtgtacagaggcaaaatcacagtgctacgatgatgtccacagatcaatggcaatgtataacattcctctcacttatcttcaacaggagggaaacaaagatagaagacaaaatggtcttagccactgtaacccaagtcctgttgtttgagtcaagttgacttcgagtaagaggtttgagaaaattgctcaagactttgataaacagcgtttggccacattctgggtacttcagatcttctggcagcattgggtgatagaaggcaggctggtcttagatttagataagttcacatttgatacttcacatctaactcacaatgctttcacctgtaaagtgagagggtcagattagattggtggttgcacactaaaatttcttatataactgattttattggcatgtgttgtctaaatctagtttaaacataattgctcaatgtaccaattagaaatagtgctgcttttctagaacataaaggcaattaaaattatttttccttttatagataaaaatgcatttgtggtccatgaaactgttagctttgtgttacttacatggcaagagcttcctctttctctttcatctttgtaaaggaaagtgtttaacttgctggaaggcagagctggaaggttgaaaagaccctccgcacacatgaacatttccccaaagtctgggagattggagtgtgaaacggtttggctgtgtctccacccaaatctcttcttgaattgtagctcccataattcccacatgttgtgggaggaacccagtgtgagataattaaatcatggggctggttctgatggttttataaggggaagccccttttgcttggctctcattctctcttttgcctgctgccatgtgagacgtgcattttgccttccaccatgattgtcaggccttctccagccacgtggaactgtgaatccattaaacctctttttctttataaattacccagtctctggtatgtctttatgagcatcataaaagtggacgaacacggagtgattctgtgggtgcacacaaagctgggattccttcctgttcccttaacacaaatgctcttctttctgtattacatcagtgccctgccttttgactgccctaaattaactgctacgaatcaaaaatatcaaagtttacagaagagaagtccactatctctctctgtacagtggcctggctaagggctctgaaaaagaatcctggctccaccagcaggtggttaggtgaccttgaacaagccacttagtttccctaagcctggctgggaccacttgaaatggggagttgggtgatctccattcgcttttggcccttaatgcctctctgacttgtcaattgctgtttttggcctcgccaaaatccaaaaagggtaggaggagaggtaaccaggcaaaaagttctgacgtgcttagtactgtcatgaagtggtcccatgccctctgggaataagagatgtttcaggctgacattgtctctcatgtgtggggacttcggaaacctgctcctgggttacaccaaatacaactttttcaagagcaaggcttccttcatctgtcagcttgtgttcccagaaagacactccacagctggatccttaggtttgtgtcagacacctgtgaccactgtgccctgtgactgctggggaacacagttctttgagtgagattagacttagctcaaaaagtatccttaaattccagcctttgaagaaggctggggcttccagcaaacctctctccacaagatcctcctgacaaatcatctacaaaattccatattcttgacccttttatgttcttcatctaagcaaaggtcatttgagtaagatatccaagagctatataactggctctagaatatatcttttgaaaatatgcatgtggatgaccttctcattgataaatttgctatctaatatttatagcgcctttacaaattgaaatataatttattcacctgtttaaagtgcacaatttggtggattttagtgtagtcatgagattgtgcaaccattgccactatttagtcttcaaaagaaacccaattcccattagcagtcactcccattctttcctcgacacagcctctgacaaatactaatttaccttctgtctctatgggtttgcctattatgagaatttcacagaaatagaatcacatgtgattttttacttggcacaatattttcaaggttcaccatgttgtagcatgagtcataacttcattcctttttatggcctaataataccatggtataggtataccacattttctttattcattcatcagttgatggacattgggttgttttcattttgaggctattgtaaataatacataagagtttttgtgtgtatgtacactttcagttcttaattacatacctaggacggaattgctggatgacatgataactttatgttgagactctgagaaaatgccaggctgttttttaaatggctgcaaccattttacaatcccaaggtatgacaattctgacttctctatgtccttgctaacccttgttattgtctgtcttttttattataggcattgtcatgggtgtgaagtgaaatgttgtgattttgattggcatttctctgatgactaatatgttgatcatcttttcatatccttattggccattcatatatcttctttggagaaatgtctaatcaaattcttggctcatttttaattgggtaattcatctttttgttgttgacttgaatgttctttatgaattctgaatactagattaatcagatatatgatttatacatattttatctttttctgtaggttgtcttttcactttgttggtagtattctttgaagcacaaaggttttaaattttgatgttgtttaatttattttttatttgtgctttaggtgtcatatgtaagaaataactgcccaatccaaggtcataaatatttatacctatgtcttattttaagagctttatcattcttgctgttaaaataaggtatttggtcaattctgagtgatttttatatgcagtgtgagcatttattgtatcttgacactgcattaaaaattccaggtcagcatcctgttgcataaggacataaattatatttttataaataagaggtggcaaaaatatgccactaaagaaaagtatttaaacaccttaaatagctattagttactaaaattaaaatattatttatatgtacattacaaatcatcctacgtattgaaagagataacctaaggtccttataaggcaacaaattattgcctctatttgacttactatttttacttgaaagtaatagaagtgatatttctttaaaaagtcataatgtgtaacttttaatgcatttgagttactccaacacttaacaactcatttctctaaggaaaaatacctgtacaaatgaaaatactggtcttatggctataacctacattaggcatatgttaacaaaaatatttttacgcagaattgtttttgctaaaatttgggtacttggcaaagagaaatattcttgcagcattctcagtccttcttaagtgaagtcttagataaagtgtcaagaaagagaactgttggcaagctgccatcagagttcattgcattcagaaattcaagaaagcacaaagaaatttctaactctgtaggtgtgagaggagaaaaggggaaggaaaagtagtgttcaaagatgtaagaaaaaaatcttatgatagagacagctgaaaaataatgaaaaatgtgcttttggggtcaggctttctgtgtctgcaactctgttccaccatggccagttctgaactcaagcaagttaacttctataagcctcaggttcttcctctgtaaaataggttttgtggtagtctgtcttgtaagattgctgtgaagattaaatgagttaatgcatgtagagcacctagctcgatcccttgcttatagagagagcccaataaatgttagctttattattaattattattctaaacaacagaaagcttgcacagggcttccacattgccaaaaattcttggcttcagcagttaaattccaatttcttggagttattatatcatatataatttcaggataagaccccaagcaaaacttttctgtatgcaggtaaattggattgtcattccagcctttggtcatgaaatttggggatctaatattacactcagggaaaaagcttggaagacccatagagtagttattacaccatgaacactgaggaagagccacctaagtaaaaatgggggagccaaaatggcagaaaaatgaatcctataaattcagtgaatcagtaggaaaaagcaagacacctaaattctagcccaactctgacaataggcaagacagaccacttacttgggatttcatcagatgatcattaaaatcaactccagacaaaacgccctatgtttacaatttcaaaatgattgtgtccattcatttattttcaactgaacgcaacactgtacaagaaaagaacattttgaagattatcacttagagtgagagtacatataatcatattagcacagaatttttaacttcctttttaagttatctatttgattttttgaatgggtaatacatcaatgtgactcaaacgagaaagcgtacaaaagggtatactgtaaaaagccctcattcatcccagttccaaatctctcggcgactcccgaaacatgtacacaccagtagccatgatttcactttcttactatccttctggacactgcttataaatttatatgtgcaaggtaacaaaacagacctgcttttcctccttttctacacactgataacatacaacgcacttctgctccctgcttttttcaaatgttgcatcttggagagctttccacatcaataacaaagattttcctcattctcgtccttatagggatataacatttcattgtgtgtacatatcatcatttgtataattagtcccactgatgactagacgggtttccagtccttctttattacatgcaatgctgcagtgagaaatcgtgtgtgtactcccattgacaagtgtatctactgcgtaaaattcatgagacaggattgtggaatcaaaggtatatgtatttgtaattttgatacctaatgccaaactgcttttcttacagtaccaatttacactttcttcagcggggaaggattgacaacccattgtgtttttaactttttaaaatttttgctaatctgataggtgaaaaatcatgtatagagtaaaccatatattccccatggatttgaaatgccccttcattcataaacaaaatttatgaatacaaaatttatgaatacataaatgtattttagttttttatagttagcccttccaccattattcattccagagagaaattctctggctatttttacttacatacttttccatgtaaacgttagaaaaaaaattcctacataggaaaacaaaacaactggtattttcattgggacaatgttaaatgcacaggttaatttaaggaggaatgacaccgttacgaggttataccttccagactcaaaatgtggcatgtctttttatatatttcagtcttatgttgtcttcctcagaatttataagtgtttctcacatttggcttgcatattgcttgttaaatttacgcataggtagtttacctttttagaagctattttaaatggtatattttctatcatactttcatactggtttcgaatatctataaaaaggctattgattctcctaatatgttacatatgttataatcttatacataacatttaatgatatcttttcatctttactggaattcttccagtgtttctccactaggcacaatgatgggctgtgtggtatagatgtggggggtgtgtgtgtgtgtctgtgtgtgtgtgtgtgtgtgtgcgtgtggtggggtgtgtgtgtgtgtgtgtctatgtgtgtgtgtgtgtgtctgtgtggtggggtgtgtgtagtgtgtgtgtatgtggtggagtgtgtgtgtggtggtgtgagtatgtggggtgtgtgtgtggtgtgtatggtatgtgtgggtatgggaggagtgggttgtgtgtgtgtggtggtgtgtgtgtgtaggtggggtgtgtgtggtgtgtggtgtgtgtatgtggtgtgtgtgtgcgtgtggtggggtgtgtgtgtatgtggtggagtgtgtgtgtctgtggtgtgtggtgtgtatttgtggggtgtgtgtgttgtgtggtgatgcgtgcatggtgtgtgtgtgggagtgtgggtttggtggtgtgtgtatggggtgtgtatggtgtgtgtgtgtgttaagctcctatttctattttactaaaggatctttttcatttaaaaaatgtatgttgaatattatcaaaaatattttctgtgtatattgagacaaatgaccttcttagtttcagctactggtttgctaaattatgttaaacttcttgattttaaattatgcttatgtttctaaaataaaccccacttgatcatggtgaattattcttttatgtgttactggagcctctttgccaatattttatataggaattttgcattgatagccatgtaatattgtttatgggcactctctttctgctctgtcaggttttgaggtgagtattatcctggcctcataaaaaatcatttaggagctttcccttattctgccataacacaacctgggtaacactggagttatctgctctgtgagggtttgggagaactttatgaaactggggccaggggctttccaaggtttcattttcacaaacttgtattttgtttatagaattgggcctgtttttattttagtttagttttgttttttaagcctcagggacagaaggttgggtttgtcatacatgccccttaattcatgacacagtattactattcatttcacaagtctccatgtttttacttttaaaaacacatatttttcttaccctcttttcccttccattctctttccgtcttatataggcaaccattctaatatgtgtaatgtgtatttaaaaaaaaattctctgcaacccgcaaagtgcattcattcttttatttacacaaatgacactgttataaatatcattctatttgttaccttttccctcaagcactatggtttaagattcatccaagtcactttgtgaatatctaatccatagcttctaattggtgcagtcaactcgaaggagtggatccacttgatttgacatcactattcttcctgtgatgggcgaccttcttaccacaagtggctatgcaattaataccactgcacatggctccttaggaatccatgtgagacttcatccggtggaactgctagatcatagcctatgtgtctatttaatctgacccctgtccaccactcctaaggaacatatgtgagaattcatttggtggaattgctagattatagcctatgtgtctatttaatctgaccaagtagggccagattgtactccggaagagctgaccaatctacactcccaccagcagcatgtaaggatctttattccccaacgttcactgattacttagttttctaattattgtcagtccagtaggggcacactgatataccactgttatttcaattttgaattttcttcagctactggttagttttgggggcatcctcataggtattatatcttttcatatcctttgcccacttttctaatgaacttgctgtatttttcttttttattttcaagggtttcttgattaatccaggtattaatccttagccttagacgttgcaaagatatctcattctgtcattattctatcactttagtcataatgatctttgctgaacaggaatccttaattttgacttaatcaaatttctcagattttttaaattcatgatcttgtttttgaagttttattttaaaaatctttccctgctctaggtaacaaaggtatttttctatattttttctattaacttaagagttttttcttagatttaagtttctaattaaatctatttagaatccacctttatttgagatatcagggaaggatccatttgtatttttctccaagtttttttgctaccaccttagttggatatgtagttataatgttaggttaactttacatgtcaacttggctgggccattgagtccaaatatatgatcaaacattattctggatacttctgtggtggtgttttggatgagattaactttgaaattggtggccttgattagaacaggttgccctccataatgtagttaggccttatccaatcagttgatggtctgcatagaacagaaggatcacctcccataagcaagagagaattctgcaacagatgaactttggacttgaactgcaatattggtggttcttctgtgagtcctcagcctgtagtcccatcctgcagattttagatttaccaacctccgaaatctcatgagccaattccttcaaataaatctctttctatataaacacacatcctgttggttctgtttctctagagaactctgactaatacaggaacttcatctttaaatacaatttattaaggaccatacattcaaggctttggccttgagctctttattcgtgtcattgttctattggtatgattggtattaatatttcctttttattactgtctatgtagtatgtcataatactttataggacaagtcttacttctagtccccttttttaaactgacttaataatttataagttatataattttattcctccatgtacattttaggataagtttattaagcttccttttaaaaatataaatgtatggcgaggcgtagtggcacatgcctgtaatcccagcactttgggaggtcgaggcgggcagattacttgagatcaggagttcaagaccagcctgaccaacatggtgaaacctcgtctcgactaaaaatacaaaacttggctgggcatggttgtgcatgcttgtagccccagccacttgggaggctgaggcaggagaatcacttgaatccaggaggtggaggttgcagtgagccgagatcatgccactgcactccagcctgggtgacagagtgagactctatctcaaaaaaataataaaataaaataaaataaaataaaaatgtacttttgattaggttcgcactgaaattatagggaaatttgtcacaaccaagagcataggtatttctccatttttcttaatatctttcatgtcttttattaatattttctccatacagatcttgtgactcttggttaagctagctcctagaaactttatacttttgttctcattgtgaatggggtgttttttttaattacattttctagttggatattgtgaaatgctattgattcttagagaatgattttgtatccagcagtcttattaaactcttattcgttctaaaaatttttccaatttttaatttttttcagatttatgatcataccatcaacaaataataacaatttaactctttttttccactgtatacacctttggttttgttttgtgttttgttccttaaggcattggtgagaacttcaatttaaagaaactctttctaatcctgtaggactactactcttttcagagtgttttagtccattttcacactgctataaagaatacctgagactgggtaatttataaacaaaagaggtttaattgactcacagttccacatggcaaggaagacacaagaaacttacaatcatggcagaaggtgaaagggaagcaggctccttcttcataaggcggcaggagagagagtgcacaggggaatctgccacttttaaaccaccaagattttgtgggagcttcctcactattatgagaacagcatggaggaaactgtccccatgatctaatcacctcccaccaggtctctcccgcaacatgtggggattacaattctcgatgagattttggtcgggacacagagccaaaccatatcacatagtaaatgggtattaacacatacgaaaagttttatttgcatctcttgagataaacacctgatttttcttctttagtctattaaagtaacaaattacatttataaactttacagtggcaaaccctccttgttttcctaagataaaaatcttaggaaaggcgatactttccacacccagctaatttttgtattattagtagagacgaggtttcaccatgttggccaggctggtcttgaactcctgacctcaaggaatcttaggagattgcaccactgcactccagcctgggcaacagagagaaactctgtgtcctcctccccctgcccccgccaaaaaaaaaaaaaagaaaaagaaaggggggtataagtccaactgatttgcataggtagggactctgaatcactaaaacttggatttaagtggtaatgtggtccatggcagcccccaggctagacaggcttaggaacatttagactatatctgaaattaaaatgtgactcaatgggaaaatgcatttctgtacattaatagtaaggttgcttgaacagaaacatgagattgtggatgtgcataagaagctcttactctaacacatacagatgtgcacttttgtctttaaataagaatccaagttaggactgtacacaataagaaaatacttcctactacaactactacttttgaatagaatttaaactcactttgtctttctctctactataccatcctctactataatgcacagacacatacaacatgagagccttctggcgttttctatcaacatgcattgggatttcacattccccctccaacagtccagatcccctcaccatagttcagaaaaataaaaccaccttgtcacgaacccttgtccagagaccacttcttcctcctttgaattcccatgatgttttatctgcacctctcatgaggcttatctctttctgtcttatattatagttgtttacgtgtggtacatgtcatggtcaagagggaagaaagtctgctggctttagagtcagacctgtctcaggacagatcccagctccatccctcactaagtgggtggccttaggaaaataccaactcttgggagcctccattttttgttttggcaaaatataaaataatcctctctctcataattgttttgaggacagtgcttagtaaacaacaaaaagaaaaaactcaatcatttttattgctatcattactagtgatgttatttttgttatttcttatgccccttgctaatgtatttgtttatccattcattcaacaggtatttattgaggacgaactatgtgtcaggcactggttgatgacatggaaaaaaaaagacagagttttaggggtaaaggcagcaaataaacaggcaaacaaataaatgcagagataatttcagataaagatgtcctgtgaagaaacgaaaacaagatatgcaacagagagtaagagaggccaggggagataagggaaggcccctgggaagggagcttctgggctgagacaaggataaaagggaagcaaccacctatgagaaattctaaagccagcgcatcccagaggtgggggcaggacggccaatgggaagcctctgagcggggaatgaactgacagcagagtaagcaaaggaaaacatggtgtgtggcacgcagagatataggcagggccagaccctgcagggcccagttggccctgataaagagcatggatttcatcctcagtgtgattggaaatcttgaagtatggttcactgggttgtactcagaatcatatctgcctcctggagagatgctacccagcagccagcccacagatttttgcaagaggtagaggtggagagagggaaagaagactgaaaagaagagagagaaggcaggagagctggagggagcaaggaaggagggagggagggaatatcacagcagacagacatccaagcagatgaatctgatgtcagggattcaatgaatccccctgtcagggactcagtgaatccccactgccagggactcaagtccagactgaggctggccttggtgggtggggacattttccatcctcctgtgaacatttggtgtcacactggtctcattcctcgggtggtcccagatggcagtggggggctggggaactgggaggtcttgcagaggaacaactcctcactgcctctggcactcatcgctggcagttctgtctctcaggttgcagataacaactgtcagatggtctcactgtgaagcaataagcttccctaaaacaaggaggcaggccaagcgccagaaagctgcagtctggacaaaacacacagcctggaaagaattaaaagttcatgtgcaatgaacaaagcacctcagggaaatgtaaggggttaaatataagcgcacaatgttcccaacgcccttgaacacacaagtaggaaaatcatcacgcatccttggtaaagggagagagaagcacggagagaaacaagttgatgttcccatatgagaactaaaaatactgctgtgaaaggttggccctgcctaagaatggagggagagagaaatgaaagacagtaggggaaggtaagaaacaagacaggaggaagaggcagagtgcagccctgctcaaggctccaggctcctttctcacgctcagggcgctcccttcatctggataacagagcctggattggcagggtttctcaggacaccctccctgccgatctccctttttcaaagacaccgtggtgaggggaacccagccaccgcggtcacacgattaacccaagtcaatagaaaccggcgtaaagagtgttttagattaattcccctcaataaagctaaaattcacctgagttgtaaaaaactccagctgatacaaaataaactacgaaagtggctttaacgcatctgaaccaatgaaagagaaacaacaggctcttcttaaatatttttcttcttacattttgatctgaaatataaaaagaactgaactcaaacctggccaaccccagtggcaaaatggtgtatgaggtattttccaatggaccagcatctccgaaagaacactcctggttcagaacaaaacagtagcacttaaatgaggaagaagtgtgagagtgagagaatctggaatcatatgtgaatgcaccttaaagttagcaagcctggattgatgggagtttctagttacagctcctgtctggaggaagcaatgcagtagttagaattaaaggtagaactagctggcttgtttcttattcctaacttcccgtttcctcatcagggtcagttcggtgctcagaaaactgtataagtgcggttctgagaagcagtgccatgatcacaaaaatcccatcttggcttcatcctgaactttccttgaacatctttttttttttttcttttttatgaaaaagataggataaggactacaagcaaggaatttctcctcctgtctagggccttttaaacttcacagttacaaaaaggtagagcaaactggaatgaaggaagagatttcgtccaaaagttgtgaagctgtttagaattaaaattattatgtaatctctacaatgtactgagggccagctatggatgaagcattttcaaaatgctttgcctatggcagggtacctttcataacttcccagacctctgcagagtatcatcatccccacgttgcagatggtaaaactatggcatagagaagttaagcaattttcccatggcctcttcgtgagttagtggaatttccaggttggcctagggctgcctcatttcaatggcaaagcccattttcagaatataaactcatctctccataattgatacaagaaattaaatggcagatttcaatggcatgctcatcattggtgaaaacctccaatggttgattatggtttcactgggggctcaacatttttatggaacaagcacatggtgtgcaggcttcctacctgacatgctgtagtgtaggttctcagagaagatattttgagctcataatctccaacgagtaatgtacttttcttttcccccgagacagaatctcactctgttgcccaggctggagtgcagtggcgcgatctcggctcgctgcaacctccacctcctgggttcaagcgattctcctgcttcagcctcctaagcagctgggattacaggcaacccccaccatgcccggctaattttgtatttttttagtacagacggagtttcagcatgttggtcaggctggtctggaagtcctgacctcaagtgacacacccgcctcggcctcccaaagtgctgggattacaggcatgagccaccacacccagcctgtacttttaaaatttttggctgagagtttctttgtgtcacgaagatcaactccatcgctggggtacggaagagtaaaaatagatttcccattagtagcaacaaggagttgtttgtcagccagaaggaaattctttagttcttttcctgtttcagttctttttctgccaacataattaagcaaggttcatgttgggataagtcagagccagcttcatgtactggtggaatagtgggtcatctatagcagatgccttcagagatgtgagtaaaagggtgttgaactcagacaggacttgacagcaccagtcaagtagggacccccggactccaaaaacaaaggagaggaaaagtatatctgtggtgaatttatccagaattaaaattactccaaaaacttagaaaggagcttttttcatttagcaaacatgcaagttctattaatttttaaagtaaagttttatttatttatttatttatttatttctgaaacaagggtctcactctgtcaccaggctggagcaatcatagcccactgcagttttgacctcccaggttcaagtgatcctcccacctcagcctcccaagtagctgggaccacaggcacacaccaccacatacggctttttttttactttttgtagaagtggagtctcactatgtgacccaagcttgttcgaactcctgggctcaagcgatcctcccactttggcctcccaaagtgttgggattacagatgtgagccactgaactgggctcaaagtacagtttttttggttgttgttgtttgtttgtttgtttttaatgacatggaagggaaagggaccacttcatcataatagtttgcaaggctcactgtctataacatgctaaatatgtctcaactctccccctaaaatatgtccccacactgatacctaaaatgccaccattagcaatcagtccccttttgctaaaatgttctctttcttccctcagggtaggttttctttttgagacaaatacctgggagctaatacattaatttcatacacctctgggaaaaaataatgagcttgtcagatatgtattctccattccagaaagactctgggtcccgtgaaagcatttggtaagggggagtacccactctcagccaaggtgtagcaatgagaggagaaagaatagggacaaatttcactgacctaatattcttgtcctagggcagtccctaattctataaaacttgttatagggaatcacaaaagtcatgattcttttaaactcaaacacagagttttattacaactacaaactacaaaacccaaccacagccttttttctctgatacacatgtctgaggagctaataccaacaaccaaaagaaacggctaaactaacacgtctcctgcttgaacctgtggcctctctctgcctgtccctgtaatgtgctgttgaccgtggagttggaagggatgctggctcacagcctgctgtcctaaggaggatgacttctttcttcacttggtgtctcagttgacccgctcaggaggcgtagctgaaagtttagcatcaaatgtcaaaatcatgaaatgttatgcttttacaaaccatttctctgcaatcacagaatccttggtgaattcactggaagtcacaatcccttttccccgggaatcaaaaatggacacagctacactcacaaaaaaaaaaattgcattcaatttgagagcgttgagaaaattctgaaccccaggttaagatcagatgtccctcctattttataaacaaagagctggagagccagagaaaagaagtgctttgcttgaagtcacagttagttagtggcaagacaaaactaagatctgaagttttcacacggtcattaaaagaaatgctccccgtcagatttccatctgtcaaacatttcggcaaacagacatgggagggttactctattcaggaagaagtttgtttagctcagccaaacttactttatttttcaacagatgaagtaaaccagactcagaactctacatcttttttttcacatatgggggatgggactctcctaactggaatagttggtgtgtggcggggaggagaggaggatgtgtaattaaatgaaacctttgaatttaaaccagaaacaccctgctgatgaaaaaaaaaaaagaaaaaaacacaaaagttgctgttttagacaaatcattaacatttcctcctcgaattgtatgtgtgtatgaatggggtgtgtttgtgggtgtgtgtgtatgggtggaatgtgtttgtgtgtgtggctggctgtgtgtgtgggtggggtgagggtgtgtgtgtgtgtgtgtgtgtgtgtgtgtgtgtgtgtgtatttggcttccgttttttgtgaaaagcaaatgagaagcagcgtgtaccccattagggtagggaaaaacttttaattaagagttgagtgttaagaggttaatacgagacagccaaggagcacttccatcctgactcaaccagaagccttcagaagcgctggagaaggaagttggattaaagagcgggacctggggaggggcacaagttgtgcctggagcatcaaaactgaaaatcaagagattctccatggcattttttgtcaaccaagtgacgtaaatgtttaccaggattttaaagaacatggtttctttttcagtttccgtgtgtttggattattaatgaaactaagttggaatcctactttctaactgggtgaccttggacaagtccccttctagaatttagggtgtgatgaatgaatagtgggattttatgatgaaaatgccaaggaaataccttcctattttatctgtgactcagtttagaacaatggttctttttttttaaatccaataatccccacatattttatccgcctctggtaggttaccatgcactgtcttcctggacagaattcactttcctgcgactcatctctattctcagcactgcagctgatcataagttagaaaaaaagaatggaaaagacctgcctgtttattgtccctcctatggggtgaggtcctgccactctgggtgccacagtttgctctgaacttcctgtggacccttgaggaaacccaatgtctatttgaaaaggaccactctaaatgatttctactgtttttgtttttttatctagaaaaattgaggcatcaacaaaaaagtcatcctagctctactctaattaagctgaactgtatttacttgcccagctgtaaaatagtgttctggtgtttgtagataaacacttttaagaagtcctattagcacttcaacagtcattgcataaggagtcagaggggatcataaactctatccaacagcacttgtaattgcagcaacaaagctccaacatcttccaggataacttttttagcaggtccgggagaatttcagaagcccagggcaagggggtttgcctcagatcccaattctttcttgaaaacagctatggcaggggccagcaaacattttctatgaagggccaaatagtattttacttttcaggccattcagtctttgttgcagctactcaattctgctgtcgtggtgccacaggcaatatgtaaatgaatgagtgcagttatgtttcaataaaactttatttacaaaaacaggcagcaggctggatttggcctctgggtcagagcagggaatgatctttgatttatagactatggagtagcaagtttaaatgtgggggttcactaagattctcatccaaccccttttgtatttttaaataatattttattattttctttctccagataaaaagagatatgattattataaacactcacagaaaaacagaaaagaaaaattattcacaatgccatcagacataccacttgttaatattttggaacagagtcttccatttacatatatatatctatacatgtatatatatatatatgcttattttatagaattaggaaaattctgtatgatgctgtatacaaaaatttacctaatatccttattttcatgctacttcctacataagtttagacaaattttactaatttttactttacggattgtttgctttttgggagcaatgaggaactccacctgtatcatttcttctctcacatttacaattatgggactttagtccttgagatttggggcaactaacatagaaatggaagcagataggatattgcctaatgaactccaataacgtgttcctccagggtcaggtgtagaacaaccccagagagaaggggtgtgtgtgtgtgtgtgttattggggaaccatttattaatatagtttcctgtagcccttgttaaaatctgtattgttttaagccctttagaaactctgatataggtggtctgcagctcaagttctgaaaaacactgagtgtatatcagaaaagagcttcaatcattcattcacttcaggtgaggactcattcttcaattcagatgatacccaagcatccgcctcccatttttcccattgccaatcttggccatttttctaatcattgatatccctaacagataatagtagaagttctcatttaaaagggtttacaggaggtaatacataaatcctaacgcctaaaacaacagctgttaggatttcatgtggctttcacatttaacctactgtcctgtgtgttcctaaaataaagccagatatttcaatcgtgttgctgaaaagaggtgcacttattgggaaaatcaatagggaaccagaaaatgacttttgacacaaatgatctaagctagacaccaagacaaagaatggaaataaatagaataaggccctgttacctcgtagggtgaaagttatcagttggacagagctttactttcaggcttctgtgagatgatgtttgctcagcgaatttgtcacacaaggcagctggagtaacaatgtttttaattaatggaaaattattttttaagtacttggaaaccagaaatttgcagcggtgtcaatgagaatataaaccatcaagaagtcctcaggctaagcacagtggctcacgcctctaatcccagcactttgggaggctggggtcctgccctcgagtggactacttaaggtcaggagttcgaaaccagcctggccaacatggtgaaaccctgtctgtataaaaaatatgaaaattatctggcatgttggcatgcgcctataatcccagctacttgggagactgaggcaggagaatctcttgaacccaggaggctgaggttgcagcaagccaagatcccatcgctgtactctagcctaggagacagagtgagactctgtctaaaaaaaaaaaaaaaaagaagtcctcagtatggcaagaagctcctcccctcagcagcctgtgaccacagacttactccttatctacctctaggttgctgggaaaataaaataattgatataaatcctagtggctagcccacaatgaatgcagaataaatgttgctattgtttataatagaatcagtgaggtaattacagattctccttgaccattaattctcaaaggcctttcattgacattttacttgctattttgtttctgtatatgtgtaaaggtaataagacagttatgctataaattgcaccattaatacattccaactaaacttccctcaaattaatactaattattgatgtttacatataatttcaaagggattagagtgatgtttgctttgcaataccattgggagggaaaaatcagtgtttaagtataaatggaggaagataatataaagtgaagatcaaataatgactttaagcatttactaaatcatgttgtgtgctgcttcttaacaataaaaatatcgcttacactggcaaacagaaggaagatccctctagcctggtgcaccaagtaagggtggaaaagtcagtctttatactctcagcggagcatcatgctcataaaaatttttgtaataatattaaattttttaattaatattttttgagatgggattttactctgtggcccaggttggagtgtggtggtgtaatcatagtttgttgcagcctcaacctcagaggctcaagcaaccctcccacctcagcctcccaaatatctggaactacaggtgcacaccaccacatctggctgaatttttaaattttttttacagatagggtctcacatttttctgcaggctggtcctgaactcctagcctcaagtgatcctcctgtctcagcctcccaaagcactgagattataggcgggaaccaccatgctcagccttaaatactaaagtgtccaataatgtgagtttgccctgaaacataggacacatcaatcatcttctattttaaatggtttaagcaagatagctcacagaagttgggggtgcttgactgcttcaatattggcaacatgatttattattttcaaaaattataggtgttattatcctttctagtggagaaatgacccacaaatctccagttgtacagaaatcagtatttcccaaactttccaagcagaagagtcacctgcttaaagatacacattcctagaccactccagggaatcaggatttctaatagcagctctagtaatcggacaagtttgggtaactctttccagcactggttcttagcactcaccacttgctagaatctgctgggaagcatgaaaaacagcagcaacaacaatgataacagatgtccaggccccatctccaaccaatttaatcagtatgcatctcctaagttggcctggccatggatgtgttttctaaagccactcagatcatgctaatatgcagccaggcctgagaaacaccaactgctttgcctcggtactcagtgtcattggaactagcaggactggcctcttctgggagctggttagaagtgcaggatctcaggcctggccccaggccctgagatgacgatctgctttttttttttttctgagatggagtctcactctttcacccaggctggagtgcagtggcgctatctgggctcactgtaacctctgcctcccaggttcaagcaattctctgcctcagcctcccgagtagctgggattacaggtgcctgccaccacgcccggctaatttttttgtatttttagtagagagaggttttcaccatcttggctaggctggtcttgaactcctgacctcatgatccacccgcctcagcctcccaaagttctgggattacaggcgtgagccacctgtacccggccgaacaaattctttaagagatctgtgtgcacactaaagattcaagtatgcatatcaagggaacaaaaacctttccaccaagaggatggatttttgctcccctctcccctctacctttgccagcactaccatcaaaagcagcttaaaaccttgactgaggtctttttctttatacacttagccattgaaagccaactgaagagtgatagggtgaggcccacctatctgttccaaaatcatttaggaaagcatgttaaacagcatacactgctcttacccaatcaaatgtctccgcaaaatttaattggcagtttgtttcatgtccagcaatcaaagacattaaggaccactaatatttacatccatgaattcatttagacagttttctttaattgatgatgaagacactacaattctaagtaccagacagaatcaggaaaaaaaaaattgaaaataagcataacactataaagaaaacttggaaaagtgaaacacttctaaataaaaaatatatacctggcctggcacccattacatatatacataatacatgttataaacatatatacagtaaatgttttggtagcaatacagaccatgcattggtctttgtgtacacagatgaagtagcaccggggcagcaccaccatcttaagatgataaaccaaactgcacatacattaaatgaaaatacatatatgtttaatttggcccaccctgtagccaagaggtgtaaggaaagtactttgcaagaaaaaattgttttgggaactacattcttaagccaatggtgaagttctaaaaagaaaaagaaaaaaaaaaccctacaaatgtctatgcaaatatggacaagttttcctgtttactgaatttgtcctatcctatggcatactcgttaacagcataagcaaagagagatttaaatgccaagtgaatggcagaagtctaaaacaccagatcttttggtgtatacgtcacaaatggcaagtcatacacaaactagaaaagaaagctaactctccacctaagtcatgtgttttctagtcatgttagctaattataagctctttattcataattaattcctcgagtagggttaagcacctccaatatcattccacctcctccctgcccctaatgtgatgctctgtttacaagtagtgggagacacacaacaggctacatattctctacccatacttaggagacagacttacagaactacggaaggaccacaaagatcttctgtggcgctgcctcagaaaggacccatggccccagtgtttatcctcggtgttctactcactatgaagctgtttttgttctccataactgagctcacagtctagaggtcttttagtcttggcaaggtcatatttcctcacattcctagaagagcatgcttcttcctctcaagtttctcacaagcctatacatctatatatatatatatatatatatacacacacacacatatgtgtatctatatatgtgtgtatatatatctatatatgtgtatatatatctatatatgtgtgtatatatctatatatttgtatatattcatctatatatacacacacacatcccacacacacgtcacatatatatacacacacacaaagacacacacatgtcacatatatatacacacacacatatatatacacacacacaaacacacacacacacacacacacacatatacagcattacctccaactaacattcatcattcatggcatcctaggaacattaactcccctgtcaagtcattgcaaagaagaaatttcatattggcttccacccattcttcttcccattcctaccaaaagggtcacatctctccccgccaaggtcttaattcacagtgtctggattcagggcctccttgtgtgatggactaacctacagagtgctctgcaaaagcagcatgagaccaaatatggggtcattgtcaccagcagttggaagactgcacatggatactatttgtcatggctctcgttgtcagtggatggtgaaaccctttcccccctttttttaaccacctgcagtaaataaatataaagtttccgactttgtggtatattgtattcaagatgcaagattgaataaaacagggcttcagtattgtaaaatactgtttcttaccatacagaaaaattgtttcttaatacttcaaatgtctcaaatttaaatgatagctagaagacaaaagccagggaaagaaaggttaaaaatctctacttctggctagatgacttttagtagatccatttttgcagtcactggattagtcaagagtccttgacctttgaaagtcagcaagaaatagccacaaatgtaacatcagtactgatttctcattattgactcaggtggttgatcattaatggattctcttcacttctagctggttctagggccattcttttgcccagaatgaagatatcatcaaagtcataaaacatatttgttcttttcgcaaaagaggattttaaaactctgcttaagtctctaaggaaaaacgctgtgagaggttggtgtcatcaagaaaaacccactaacttctaggttaaccagaggccactagaagcctcaataatgaaagcccttggctggcctacaaatgctttgaaatggataaaagccaactctcctcaatgggaactgaacacaaggactcagcagctgacgttgctcaaaggaaacccttcgtgtcgccagagtatgaacttttggtttgagtaccagcaacttccagttttaaatcggtagtttgatgccaccatcaaaaccagctcaggcaccactagaagcagcttaaataagaatttctacctttatgcttttcgactcaaaaagtcagagaaatagaaaccaagagatagatttttccagtctgttcatttctgctctcattcaaaacatgttgataattccacatgtagaggtatctcggtaacacatattcaaagtgtaggttccttgagaaataataaccagctttacaggaaaatggttgggagtgactttgttcattgatttctctttaactatttcagtcctcaaaggaaaagagcagggcagcttgctctcttcttccactagcaagagtatgaatcagaatgcttgaaaatatgaaaagttagtttgactaagaaagtctttttttacaagagtaaaaaacaactttcatatcagattttcaaaatgggtagtgctctctactaataggaaatgatgtaattctgcaagttccttgaaaacaatggattcttatgactctagaccctatttatcttagaaattgatgagcatgcaaatgattaaaatctgcaataacggacactgcacaacagtctgtgaggtacatgccacctggctgaatgaacagtaacacgggcctcagcagtgtgaggggttccatttatctccgctcccttttgagtagagctggggtccccaaacagttcatcaggaggcagcagccactacaatgccctccaaccctggcccctaccttgtagtccccactcccacccagggagcttaggcgttcagagaaataaaatgttgctcctcccaatagtagggatgcgaattcctgatagagagatagaggctcccacagactcagagggagcctgatatttgcattaattcatttaacctttaggaagtttcctggtaaaaagatttaaaaatctgtcggcaatatctttaaatgcattcattgccatttgtttttcacgtggaaaaaattccaagacgtgtatactttccaaacaagaaaagaattaacattttcactgctggctaggtgtttcagtagcaggtcattaagcttttctgtgctctctgtacgctgtgttttgttaactaatcactaataggccagcacccaccaaggcaaatgggccaattacattcagttaaataatgtaacactggaagttctcaaaaaatatgagataaggtaagagtcttagggaaggtgacacatagccctggtcataatgaaaaacacttactggaattttaatttctggttagcaacagctcacttgccttaccatctttctcaagacaatgcaggaaatgaaatatatcataatgtgtgcacagaaaaaaatggtgggaatagagcaggaaacttacagaagtggtggggggaggggacagaagaaaagatcaacagtatctagtttattatgaatagaaagacatttccagaatttacaaacgcccacattgttcattccaaagagagcttttgaattgaaggaatcacccatctccttctgtttacaatacatgcaatggaagactttaatttcctcttcttataattttgcttccattcaattaccaattttaagctgacatttgaaaacacccagccaaatatatccttcttcagtttaattaacatggcctattgtcttacaggaaaaaatacaaaattaagattaattcttataaggaactcagctcaacatcaggtttatatgacaagagatagtatcagcaaatataactatacaattgagaaccatctatggcactatgattcttatattatgttttctgaattacaatcttaaaacaaggatcataccctattctactcttttaagccttgttttaagcatttgctccactctttacaacagaacattgtatacctccatcccacatccaaaaaaaagatgtgctgtaagaaaagttacattttcatttaaaaaattacacatataaatcaaaacctatgttaaatatttaatactctctccacccaacgtgaacagttttgtatgaaataatttacaatgatgctttgtcgtacacagtttcagcagcagatgaaatgtatcttgaaaatgcattgagagtaaacccattctctcatgacacggtggtgggcacatcagctcactgtggccagctaagtccttaaggttgaagatgaagtttatgcagactcattattctggtgtcacagtgcatttttttttttcgcttggcacaatatagaacgtgcagttcagtcaatgaaatcctgaggattggataaagtaaacaaactgaaatggatgcatcgtaccatctactgatgaggaagatatgaggtcctagttgtgaatcatgaaatatttagagtctgggtacccatgagttagaagaggatttgctgaggtcatttaggtcttcattctgaaaagaaaaaggaaagaattcagcaccacaggtatctcaaactgcacaatcactactttagaacctttcttttacaaggggcagcgtcacataaactgaagttacaggcacaaatagtactgtccacctaaatatgatcaacaaactgtatttagctttttatttatttcaaaatgcaagagtctaaagaaatcactaaccaaaagtcatcaatgtggaatctgtaaacaaatcaacatgatctggatgtttcagaggtttagcaaaggaaaaatagaaaattctttggtgttgtgattgaagcaaaaacatacatcattagttgctatgtaaaatgaccatccgacatgagcgggttgtagtcagtctgtgttgtatctccttctggttgaaagtcagctgcagattttagaatttgaagttgcagagcttcacatgacaaaatcggaaatcaatttttcatgtgcacaaacattgtttgacatgagaattttagatgcaaagggagacccaagcaaaacggacctactgaatcattaaataagaaaacaaaaagattcagatttacgtctaatagaaataagttatttaggcagaagcacagcatttcttctttgcaagtcaagaaggtaaattttaaagggtcactatccgtgattccccttcagagtgaagactcttttttttttactttttttattattatactttaagttttagggtacacatgcacattgtgcaggttagttacatacgtatacatgtgccatgctggtgtgctgcacccactaactcgtcatctagcattaggtatatctcccagtgttatccctcccccctccccccaccccacaacagtccccagagtgtgatgttccccttcctgcatccatgtgatctcattgttcaattcccacctatgagtgagaatatgcgctgtttggttttttgttcttgtgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccttttcaacctcataaagcatcttttactcaagtattacactacctagtcttttacaggtccttgtttttcatgcattcaaaacttatctataaatatcagtatctacagagtgcatcaaagggtatttagcagagagtagatcagaaatacttgttgaatgagtacgtggttgcactaaatactaggaagtgtagaaagctggattctgttggaagccctgccttctagtaattctagaaaggaaggcaagttctgttcataaatacatggcatgtgaagtagacatcagtacatgccaagatacatgcatgggggcaatagctctagacacatggaggatggaaagaatcctcccagctaggggtgtaaggggagcatctcactgacacacctggcttggttttggaagaaaaagaataatgtggggatgtggaaactgggattgtgtctatgttgctttggtgttgcagtcccagaagataacacaaggcttgccacgtggtagtacttaataaataggagttaaataaatgaaaaggaaaaggacgcttcccattgagaacatatgacaaggtcctacagggtgagatggtagccgtgagcaggctcaagtagaggatgtggcttcactggaccccaagatatctaaggagggatagaaggaattaagtctacaaatgtagcttgaggtagatggtgaagaaccttgaatgacaagctaagaggactttatctaattatagagacaacaaggacatgctacattgacataaggtcaagatgtagcagtaataatgcatatcacctacaaggatagtgacagcttccaaaatacacgcaacgtaagtgtggaccgatatattagggtggagcaaaagcaattgcggtttttgccataaaataaattgcaaaaaccacaattacttttggaccaacctcatatctttttccctctgtctcctcttgaagggaatgatcatggctggcatcagtcatcattcattacgcaatggttttctgataagtcaaagtttaccaaatgatgactctagttttaggagatttctatttatttttaaatattaactctgcctctaaaagacaggtaaacaaactgtatttttaactcactaataaagacttggcatgacgatcacaatataaaaacaaacaaaaaaggaagcattccaagtttgcccctttaattgccagagaaacaggatttactctgtgtgtctacaattgtggtgtccacaaatgaaaagaaagcccgtcccttcacaagccattggtatgctaggaaactccccacaacaagctccagatctcttatttactgtcaagattctcctgaatgcatataggaatgttcccaccagaatttctagattagcgcttaacagagcttcacagctctgggcctctaattaggcaggaaggccacactttattaaaggacttgtgacaaacaaacaaactgccgaacataaaatgggggagaaagcaaagggcatatggtatgtttttcatttcatatctggctcttctccagaaggggtgggtaaacagcttagtacaggaacacactgtaccctcttttatcatcacacgtaccaacctgcacggatgcataaggacagagacccagggccctgtgaggagagggaaaaacaggtggcttcactgggtgctgaaatctgttgctttgggccacttggaaatgatctctgtcattatccacaagtatgttcaaagagcagggaataaaaggacgtatcaagtgcatcgacaccttccttccaaagtcttacttagcacactacttttcaaagccccttatcttaagtcctgatcaacacttgtctcaaaagggaaagtctgaagttcacacctgtttgtctttgtacagggtgtgtgtatctgtgtaggcacataaagtttagctaccaaataatgacatggacatccttcagtgagaactgtccttcacaacagccaacttgggggctgcatacttattccagtcatgcagccattgtttgcagcatttttggaatgcctgctcagccttgggcatattcttttgaatagtctctatagcagccagtcttagccctctgaggacacgtttgatctttggagacagccaaaaagctttgagagccaaatatggtgaataatgggactgattaagctgggtaattgttcccagcgaggtattatctaaagccaaagagttccgaaaccgaagttccaaaatcagagttgtgtacaacacttgctctgatgagtttgttggaaaggaagtctcctcactttagagacagacctcaacatatgcttaatgagactaaagttcatctgtctgtatctccctagctccacatactcacaatcaagcaaggctgaacttgaataaagcaactcactcaaaaaaggcaaacatttgcgtaacttaatatattttttaaaaaagaaaaaagcaatgcccatactagggtcttgcagtcagtcattcaatgcaataagcataaatacaatgataaagactggaataagcaggggaaaagcccgcataggcgtacatatgtttaatacactttatatatacaccacttcaattgactgaagggagacaattgacagaccagaggtagcaaatattgctacaaagttttacaaatgcaaaaattcatttgtaacaggcagaaactggaaacaaaaaggcaaaacatttccttaagagaagacactgcaaatatcaagtggtgatattcctacaatgcattctgtctggttacatcattggggaataacttctgaaggcagaaatacaatgcacctgtcacgagatttagtagcaggaaattacattttgacaaaatttcatcaccacatcagtatctactatgtccttctgcgtgtatattcttgtaagataaaacccacctaatcctgttgccagtaatgaaaaatgtaatttttaaagcattatcaaataagtcaacacttgagcaatgctacttgacacctatggattattgcattattgcatctagtaggaatttacatcttctgggttctacccacttaaactatgcctataatagctgaaaaacaaataaagactttgcttccttttacattgtctcagcttactgatcgtttttactgggaaagcagctggaaacagcacaagagtataagtgtgatggaaagatctgtacactcagcaatgcattcttggtcagaacaattgacaaatgttttcatcctgtatttatatgttttgaaacttcttgccaatatgttaaatcaagggcaatatagtaataaaaatctagttggggcattgctagtcgtttctacttttactagggaaataagagtaaaatattttaagttgcttggccactgtcacatactaaattgttagaaagtaactcttccttatccaactgtgctttaaaaaaatgaccgtagtgatgaccttttttcaatagaggtcattgtttgaaatcttatattgtagatggaactagaaaattaatataaattaatttcctccacttaaagaaatgaatcaaaacagcatatttctctttcagttaacataaacagctgtgtgctttttaaaaaaaaaagtatcttgaatataatacagaaaatgtataaaatacaggaagatgtaaagaaggaataaacatgacttatattccccatcaccagaaaaaccactactcagctgtggttgtaatttcacaatctacttaaaggatttgaacttttaaaatgctgcatttaatgtcccctcaaaaagtctaagtaggaaaggaaaatactgttttaatcatacttagatctttcccattcttaaaaatccatgatgagaaaaatttttgaaatgttacccaactttttaaagcatcctggtattccatccctttgccatcatcccaacgcattgtataatatggggagagtaggaatttgaaagtaggaaaatcttctggctccctggctttagtttccaaaagcctcagtatttaaaggaagggcacaggcaaaatatttggaagagccaggagaacagaaggattcctctcaggttagaaaagattcccttcatgagagcagaggggtcagtgggtagctctgtactttgcaagattctgacaatgatgcctgtaacctctctctattctgtcttcccacgtctgttgatttcctatttcacacaattacattaaactgcatacccctccctcctaccacaattcttcagttacctcactgctgatacacttaatttacagtaccactaactggaagcaaatcatgtcttctagaatgcttattaataaagcaccttacaacacacacattcagcatacctgaatctggcaaatgagcccagtaaacacacacacacacacacacacacacacacacacacacacataacacacacacacatattatcatcagtctcaaatacctttatagttctggtaatagatgggtgttgttcattaaaattcatacctccataaaatcccactataaaatctcagatgaataaaaatgaccactgacctatggatagactgtgaaacgcttattaaaggaagttcccagcttaaagccttggttctagcatttgagttagtagcacagaaggaggaagctgcattctcctggtccagcgctattaactatggtcatattgctgatacaaaaagaagagctaaatccagagagcctctaaagtctgggacatgggataatctccccgttctttacaagggacagctgggaagtatgggggcaagctgaagcttggaaaaggagaaaactaaccagtgaattctcaattctcaactctaaggccttcagatcataatcacacacatcaagtgaagattgagctaaagttagaggtaagaccaacatgtttgctacttggatgttgaaaggagaaagccattttagctaaagaaaggaaaccaacttcttttaaaacaggccaggattgagctggaaagaacttggttttgtggtctcaaatggcaaagggtaagccaaccagccaagccagtgctttaatggagctgcttaaatagcacttttgcctggtgcaagtcacatgggagagggctggtgaaaataacaaggttgctggccagatcttccagtgcgcagggttgccaaggaagaaaattcagggagagttgccaacatatgagaggccatctcgctccagttccccttttgtcccagtgaaagagcttctggcagggctggtgacttcaggagaccaccaatgaagaaaggcacacgcattatgaaaaaaaaaaaaaagaagaccgaaaggcgaccatcaagcctgtcagctctggcagaggctactgggctgaattctgtcagtctcgtgaatttctccttccccagctaccaaaggcagaaggagattccagaaacttttcaggatggttaggaatttgtggagaaggcagaccaaaacaacatttagttctcagtaattaaaagtattctgtcagtgatatattaaggaaatctgaataaatattaatacatcttttaagccaaagaatatccacttctgttatttcccattctttttattaacaggaagcatgctgataaagaaaatgaggtcaagaccataacagctcctcccctcaattgcaaatcaaaatgtttccaatctcccttttaccaatactatagtttgtcctatgtacatgacagattcaaggtaaaaggacttaggaaaaaaaaacaaaaaaaaaaagtccctcttcatttcaagtcagaccacacgtactctcaggcaggaagatttaattttttttttttggagacagagtctcactctgtcacccaggcaggagtgcagtggtgccatttcagctcactgcaacctgcccctcctgggttcaagcaagtctcctgcttcagcctcccaagtagctgggattacaggtgcacaccaccacacttggctaatttttgtatctttagcaaagacggggtttcaccgtgttggccaggctggtctcgaactcccaacctcaggtgatccacccgcctcggcctctcaaagtgctgggattacaggtgtgggccatcgtgctcagccaggaagctttaattttaacagagctcaaccaaaataaacctgttacgaaaagacatgaaggtaatatgacagaatattccctactaagtgagaatgtcatacgaatgtctttcttctgctttcatgggcactatttctgcagcatcctttccctcacagaaattacatttcagttctgaggtttctattgtaatttcacatcacttttgggtttggggttttgtttgtaatggtcagattacaggatacaggttttataggtctggctttgatacaaaccagtagacttgcattaaaatcaaaacttcatttagtgtatggatggtgaaaattgtgtgcaaaactgtttctataattagacaaaagggaatcaggcagagcctattttcactgcctttgctttttttgttaaaaactaatagatttctcattctttgccctctccctggagtcaaattgcttcaagaaagcaagcgtctgattttacatttgagtaactgtctgactacccaattgtttctcaagcatcatcagtttttccataatagcccaggaatcaggcaccaaacaagcatttgcatagacaaccctggtctgcagcggactgaggtaagaatcattaacaccactgacatcacttttggcagctggagaagtgggaaaacctgtgtttaatctatttcctactcaccgcaagttttagctagagtccccgataatatgggttgtggttcactttatggaagaacttggtcatgtaagaaaaatctactgaattgaacaagcatcttccaaaacaaccatgaggtacctcagctgtggggccatgatcttcccataggtttttctgatccttaaacaggcctaacagaggacaatgccactcccaatagtttctaataggggcaagctcaacctcagtagaagattttccctacaacatacatctaaggcaggggtcctcaattcccaggctgtggaccagtagagatccatggcctgttaggaaccgggctccacagcaagaggtgaatggtggatgagcataagcacctgaactcggcttcctgtcagatcagcagcggcattagattctcacaggagtgtgaaccctatcatgaaccgtgtatgcaagggatctatgttgcacatgctctttatgagaaaataatgcctgatgaaaccattcatcccctcacccccagccatggaaaaattgtcttccatgaaacctgtcactggtgccaaaaaggttggagacccctgatctaaggaacgtctccaggaagccatcatcttacagaagcaaaaaaggtttagcctttgttttcctttctgcattgaggagaatatcagggggaaaacgttgagaagaatttgatctgggattctttgaagcgaactgttctttaaaaaaaaaaacaaagtggtctaactattgaagaaacactccctctctgaaaccagctgaaactgattataatacaagtatatggcagcatatttcaaatgtatttgacccacagttctcatttgctttacctgaagaatatctgttatggaaatgcaagtcataaagatttctgggctatgatagtaattcttcaacaaaagtcaatgtaaaaggagcaaggaaaagtataccattcatcttagatttcagaaggccatacacaggcaggaaccatattaattagctcatgttaaagagaaagctattaactgttgcttacagtaaagtaataatgcaataaatgtgtgtttcccttgagttgcctctttctgagtgacaagtgagtaacctgtatgcgattttgaattaaaaaatgtactttagggaattcaaccccaaaaaaggttattttcagaatgaagatggaactattacatggctgtcatgctttttaaagactgataattttgtttaagtcaaaacttatttctgaattaaaatttgaaaggaaactaagacaagttccattatcccatctctcagtgttcttttctctgtgatttcaggcaagttgctcaccctccaaaatcccaaatgttttcgtctgtaacacaggagagcattgcccatttcacagggttctcgttgagattaaatgagataatacatgacattttcttatcattgtgcctgacacataataagccctcaatcattagctcttagtgtaactactgttatgaagaactagaaacccttggatcccacatcttttcctgatacctgaaaacacaccagccaaaaacactgtggtggaactagcaagcaaggatgaatccaccaaccaaatgccaggcaaggactgaatcagaagccaaaatgaggatgcatcttgcgaagagaggacaaagttatttcagaaaggaggaaggggaaaatgccagaacaaaaagaaaaagtaaaagtagcagtagtagtaaggctaaagatatgatatgtaatacaacgttatacaaggacctgtctacctacacaggaaagagtacaaattcaatattgagacagtagcattcacgtacaaaggggaagatctcaaatgaatgctatctacagaaacatcagaaaggccacttttattgcttgaaaaaaatcagaagcttgaagccccccactctttctaagtctgctaatgaaagacttctaatactactgaaagtatttacaaagaaatcacatgaatatgcttaaatgggtgttcagtgagattcttatgcattatttctaggttctaaagcatgtttatgattgttgggggtgggggcagggaattgggtggcttttgtttccaaattcttttccccaatctctcatctgaaggaactgaacaggagtgtgatctagccagtcaatgctgcttgagtaacttgatgaaaaattgaaattgctgccagatgcacatctaattgttggcagctggaagaggagggagggaaatctcagaaagttaatctaaaataattgataatgcatccactgcttgcagctctaaggtcactgaggcagacaatggtgcaaatttctaactgactgccttgtgtaaagaggcaaaatttttccagttgacaatgaggggtcgacctttcacctactgaccccaaagctcctgttcttttgctttcatctttcaagtcttacttccactttgctcctgcccctctctattttctccattatctgacatttcagcctctttctttttaatgtggaaaaagccacttgcttaaaagtttcctagcagcattcttttttttttttttttttttttgagacagagtcttgctctgtcacccaggctgggctgcagtggcttgatctcagcttactgcaacttctgcctcccaggttggagcgattctcctgcctcagcctcccaagtagctgggactacaggcacgcaccaccatgcctggctaatttttgtacttttagtagagacggggtttcaccatgttgggtaggttggtctcgaactcctgacctcaggtgatccacctgcctctgcctcccaaagtgctgggattgcaggtgtgagccatcatgcccagccctaacagcattcttaaacgaaactgcatatcacattattgcagggttgagctgcttgtctggctgagctaaaagcaccccatggacagttgtgccccattcttaataaacaggtagtgacaacttttagctaaggaaccgccattaagaagtatttatagtgactgttatggactgaaacatgtctttccttgcaatttatatgttgagatcctaaccctcaacatgatggtattaggaggtggtgcctttggtaggtaattaagtcatgagggtggagccctcatgggtgggataagtgcccttatgatgaaacatgagagcttgctttctgctctctaccacaggaggctacaataagaagacggccatcgtaaaccaggaagagggcacaccaaaccagggtctgtggtgccttgttcttggacttacccgcctccagaactgtgagaaataaatgtgtgttgtttaagccaccatcaactcaattttgtaataacagcccaaactaagacagagactctgaggggactacagtcccaagggaaataaatggggtcaccttcagacccatggaagggccagacagaagccatccatctggcctttggcagaaacacgctcatgaggctcaaccaatttctctttgcagacaccctccagtctccaagcatttcactaaatctctagggtaatggttctcaatttgtgtgggtgaaaaaactttgccccacagggaacatctggcaatgtctgcaggtatttctgcttgtcacaaccaggaaaggggttggggaggagagatgctactggcttctaatgggtaagggcctggaatactactagacaccttacaacacagtggagagtctactgcaacaaattaacagtttaataaaatggagaaaatacctggtttcacaatcatttgcaaagctcagggagataatgagataaggctgcagtgaacaaggagacacattacttacgtgacccattcatcacgctcattgccctcaaatctctgagagtccaaaaaaaaaaaaaaatcctcaagggccaggcatggtggctcacacctgtaataccagcactttgagaggccaaggagggcagatcacatgaggcctcaggagttcaagaccagcttggccaaatgatgaaaccccatatctactaaaaatacaaaaatttgtcaggcatggtggtgcacatctgtaatcccagcaactcaggaggctgaggcacaagaatcacttgaacccaggaggtggaggttgcagcaagctgagatctagccactgaactccagcctgggaaacagagcgagactctgtctcaaaaaaaaaaaaaaaaaaaaaaccaaaccaaaatgttaaatattagattccttctgttccagaattagtagactttaaaaaataaattcactttaaaaaataaatccactaaatttattctctaagaggctattcctaaatcagaacactgtttcatagaggttttccctactttataagataaatatccacacctcggaagataatttatgatcaaaaaacaaacaaacaaaacaaaacccagtagtcaaatgcaagactgagatacaaatcatagttgctgtttctgtgtttaaaatgtcttctcaggaagacacttttaggtctgctttcccaaaacttaatattgacaaaaaacagcaaaggggggatgctcggggcacatatatcatcatccgtgagtacacagggttccagattctaaaaattagacaatgaacagaacaagttgatttccaggtggttaaataccagggttttcagattgaaccctgaggcagtggtaagaagaacagatcctccttaaatatagcaaaaggagctgctgcaggtcccagagtacaccaagaaaacaacagcttctattctttctagaccatagcctgagacgctgacaaaatgctttcaaaataaaagggagccacaaaatttcaccttactatcaaacatcaacaggctataattaacacttaattaacagcattatggtgaaatctgcttattctcctcaaaaactgcctgaagctttttttccccattaaattattacatgtcacaagcgggccatggcctacctgttcatttggtttctccacgctttccttctgtaacaatgtaagcaagagttgtggccaggcaaacgtccttggaaagccttaccctttagagatagttttctttcttcctgaattctcttcactcccaaccagcagcaatactcaccagggcccctaaacacagccactgacttgccccacatcatttcttctgggattctctttgtgggaatttccagtagaaacaaagaccttcccagggactcttgagcagaggtgggaggattgctaagtccttgctaatttcccacctctcaaacgcatagttagaaaaagtcaataggaagttgacttgagaaccatttgccataagtcagtaagctgggacccttctccatggtggcctcctccgtctgccttcaaccatttagtggttttcttgcactttttccagagatagatccaagaaataaaatgaaaactgaacaaaaattcaacttagtccatttttcccacctgagagttctatgaaagtgggaaggaagatggtccaatgactatccgaaagatgcacctggatgagttattccagagtttaactgccctattctcatttctacaggtggcatctaccacgtgaccaagtcaccatataaaaagctcatgaattaatatggacagagccatcaaaaagtctcaggcctggtattatgagggtttccttgattgtgtggtattgttgacttagaagcattaaatgagtggccgagagtcgtggctcatgcctgtaatctcagcattttgggaggccgaggcgggtggatcacctgaggtcaggagttcaagaccagcctgaccaacatggtgaaatcttgtctctactaaaaatacaaaattagctgggtgtggtggtacatgcctgtaatccaagctacttgggaggctgaggcaggagaatcacttgaacccaggaggcggaggttgcagtgagccaaggtcacgccattgcattccagcctgggcaacaagagcgaaactctgtctcaaaaaaaaaaaaaaaaaaaaagaatcattaaatgtgttgtctgagttcatgcaactggttagtagtagcactagggtgagactaagcgttctcctcactcccaaatcagtaaaatcttaatagcataactatttagagaaacagaaagatcctaacaaaagagagaaaacaaggtgatattcaacataagggccaaagaagattcttagctgccaaatcactaaattaaaaaatggggacttccacaggtgaggggggtaaacatacagcagtaaaaaagacccaaaaatgtcttcagtgactacaaacgtattgtaaaggaagaatacatatcaaatttagttcaaaatgttttaatatcatgggtattagattaataagaagttgaggtacataaatacttgctaaaatatttccactatacttggtaatatcctagtcatcaatataggaccttgtctagctttagtgtccactgttaagccatactaaagaaaagcacagagaaaatatccagattataaggatatagaataaagtggcacttctctaacttaaatgtgcttaggatctgctggggattttgttaaagtgcggattctgcttcattaggtttggggtggggtctaagattctgcctttctaaccagcttacaagtgaccccagtgctgtgggtctaaggaccacactcagtggcaaaggagtaaagaaccaaaaaggaaggaggaaacctactatttaatttctataaatgaatactaagagggcttagttgagggccaataaggaggctacaccacaagccatgtctgcagggtgaatgggctttgactgcagaaatagtttggaattaaaacatgaaggaaattttccaggtgggtaaggttctagaagagttaactagagaagaatgagaaacttctgccgccagggctcttgaacaatacagatttggatgactgcaaagaggacattgggggaaaactacaatagttagaattccttaaaagactccacacgggtatttttttttttttttttttttttttttgagacagagtctcgctttgtcgcccaggctggagtgcagtggcgcaatctcggctcactgcaagctccacctcccgggttcccggcattctcctgcctcagcctcccgagtagctgggactacaggcgcctgccacgacgcccagctaattttttgtatttttagtagagacggggtttcaccgtgttagccaggatggtctcgatctcctaacctcgtgatctgcccgccttggcctcccaaagtgctggcattacaggcgtgagccaccgcgcccggccgggtattttttttaaaccctgcttagtgttcaggctaaggagaaaggagggcccagtgacagaggcagatgcacaggggagggaagagggatcgaagctgtgacccagtacatttctatctctttacaaaatgaatgcgggtgactctgacacctgagaggctcagttaggaggaactgaggtagggccacgtacgttagctcaaaagtgatagaaccaaaaagaaacaggcattccccaaactcagtgaaatacatcgccctgccctacagccatgttttaccaaataaaccacaaagcacaaatttgagactagctcccaactccacatctttattacttgagaggcctgcagttataaaaagccacaaaactgccaactcagatctcatcccaaataaatgagtagaactgatataacaggtaaatgactatcatggtctataacaacttcaactttgaaatatcaaaagtattgatattaagacatgcttgctcccattttctgctgagtattaatttatcctcagaatcttaaagaacaagaaggattccttgtgcaggtagctcattcccagaaccgtagatgcttccagagaaagatcccgaagcagcacattttctaatatcagggggagcacagaggcataatgactcaaaggtaccaaaatttagaaaagactaaaaaataaaaagaaaggatggtctgtgtgtggtgataacttccactgaggccagcagacagtagcaaactggtccccaattcctataggaaggcaaacaggccctgaatcaacagcacacacttcagctctacttattaggaagtcagccacagattcgcttttccagtaaataaagttttatggcagtcaacaggccttaattattacatggcaatttcattcaccaggcctaactctggtctctaaccccaaggtgcagctttaccactggtctgcaagcataggctactaaagattttaggaaatgataggaaatgatgaggtggccagagatacttcccaagagctaatttccaaaccactgctggacagtgcaattcacatatcgtgtaattcacagagttgttttcctaaccagttgagacagagtgagaatacattttaccaagggatatgggatacaatgagaatgtagtatgtaacctttaaaacggtatccagtatataatcctgcctgtaaggcactcactgctggacccatgcgaccactggacagcaggaaggccccagctccacttactggcgtgggacctcgggcacttgatcagcctcactgagctgcggtttcacggtaaaacagtgataaaattacctaactcactgtgctgttgtgaggattcaatgagatggtaactgtaaagcacgtggcacagatcctaacaactaacaaattacaggaccatcaattcactctatccagtagcaagaagccaccagaaaacaaaatggccccgagggggtggcaaaaagaagaactgaaaagggatggaagggacttgacactgaagctctgcctctttgcagttttatctaagtgtttgcagagaagagaacctcaaaaaatcatgccattaaaacccagacaattacattaatcatgagatatgacaggccttcaataaggaatattgccaaattaccactgttttatcactgggtataaaggtacttcctgttttgctttaaacttataattttaatcaccgactcattatttaaaatggattgcccttaactaaaagggcaattcaaaagcaccctaaagttttataacctgcattattacacttcattagctgaaaggtaaaattatgtctaggcagagtagaatcataccatattctaaatatgccatgaaatgtaattttctgagaccgtgaataaacttacatttgattacaatcctttactaaactgtttaagaggtttcttatctctaactttctacctgatccattacagtgttttatatataactggtactcaattaataaatgtcaattaaaaactgtgtataccaagaaaggatctataagaaaatcataggtactcataaatatagtctaaggtccatatgacttgattaaggagaagtaatttcagccaaatcaaagataatggactctgaagtctttgtgacgagatcctcatagttggcagtgttctaaaggggtttgctaactttttgaaagtgttattttcttttgataatatattgtttaaaactcagcactgattgattgattgattgattgattgattaagacagggtcttgctctgtcacccaggctggaatgcagtggtgtgatcacggctcactgcagcctaaacctcccgggctcaaacaatcctcccacctcagcctcctgagtagctgggactacaagcacatgccaccatgcctgcctaattatttttattttttgtagagatggggtctcagcacgttggctaggctggtctcaaactcctgggctcaagtgatcctcttcccaaagtgccaagattataggcacgagccaccacccttggcctcagcctatcttttaatgccacaaattaaatatctctactaagaaaataaagcaattttaatattgatgacaatggttctcaaatcacaatagtatcctcctccctcccagtatattttagtaaaccattcctggagtgagggtgggtttatttcagtaaaccattcctggagtgagtgtggggtggttagtaaactaacccaacccacaaacacatacacagtaatttagaatctccaaaaacaatatagccatcatttgttacacgttaggcactacgtgaacagcgttaatatgcattatttcatttcattctcgccacgatcctgagactgcattatcattcctgttttaaacacaagaaaaccgaggtttagaaaagatgagtaaataaattcctcaagatctcaaactagtaaagggacaattaggattcaaaatccatgctattaaccaaaaatttatagacaatgctataaaaagcatgggtggaagtactgtcaaatctttcatctaaatagagtccactggaatatacaaagttatttttataaaaggaaacagggtaagctttgtgtttacaaaggtaatgagaaattacatactgaaatgccattctgttaaatctaaactaaatcagctaaaacaacatttcacttaataggcacttggatatcagaaataccttcacttctagaaaacagcttgcaaaagagattgtcattataaaagcacgtttttatctcttattatatgtcctcctataaaaacactaaaatgaaatctcatttccagaagagtctagacagtggtagacacaacaaactgggtgtgactaatattttgacaaacacaaacagccaaaaggtaaagcgtgaggcctgacatttattgatcccataaaatagaaacccttttagctctcctgccacactgcatgacctggtaggcatggggatatttttattcaacagctttccttcggtccttccatccttttttagaaagccaaaataaaaaccagaaaaggcatacttataaagtcataagccatatgctataacaggtaaataaaagtcctttgacgttagaagccacgaaagaacagaagattaaaaagtaaatcataaacagctgcatctcgcctcccagtgtttacattcttagacatccactttttaaaaatattccctctgtagatcaaaacatgctgtactttgagaaggggaaaacaatgacgttaacgttaaaatattgtacagtttacatataaacagagctaagtttatgcacatcattctagttggcagtaactcatctgaatggctcaaactgagagctataattaagtgtgttaattatctgtgtacacaaaaatctaaaatatatatgttccttattatagagcatagaatacaactggtttaacaaatcaaaataatccaaaaagctttttcaagttaaacttgggtgctctgaagctggatgaaactaggttcaattactgggggaagtctgtttcttcatcccatccttcccctccccacaactttgtattcctttccctcagtaccttttctctttcaattagtgccacccacaaatactgctcagctcattactgacactcaggctttaaaaactgggtggccccataccaagaaccatttttaaaattactgccttcaagcattaaaatgctaatccaacagaaagcaaagcttaagagcatggagctcctcctcccaaaaacatacatgtatatgggagagaagcacggatgagccacatgtttaaaattctagtttgtaacatattcaagagataagcagttggcagaaagctttcaaaacacaatgcccattcacagactttatgcactcactttcagccttataaagggaaatacttcattctaagaaggatctaagttttaacataatacaggccaacttccatcagaagcagcaaattaatatcagtggtaagaaggctagtaagttcaggcagatacaagatttaggggccctgaattatcattaagaaagcatttatcttatacccgcatgtctaaggtacaagccaaggtgagtcaccaactcatctgactgaaagttctgttgctaaaatctggtatcgctgacctcactgaatcaaaacatatatgctcctttgaaggtggtgaaacatccctagtcagtgaatcaccatctctcaaaaatctccaaggattataggtaaacatgagccctgccactacaagtcaaagtcttgatatccaaagaactggctctggtgttaatgcatgcccaaggtttaatgaggatgaagaaaagaaaaaaaacaaactaacatattttccctttagaacacaactaggacacatggttttttaaatcagatgacttattgatcaattataatatgcttattgatgcagaacaatagcaacgtgacctaaggctcagggattcaatccacaactgggataggttataaggaagaacagaattgtctcctttaaaatacaatggctctggctgggcgaggtggctcacgcctgtaagcccagaactctgggaggcccaggtgggtggatcacaaggtcaagatatagagaccatcctggccaacatgatgaaaccccgtctctactaaaaatacaaaaattagctgggcacgatggcgtgcgcctgtggtcccagctactcgggaggctgagacaggagaatcacgtgaacccaggaggtggaggttgcagtgagctgaaatcacgccactgcactccagcctggtgacagagtgagactccgtctaataaataaataaataaataaataaataaataaataaataaataaaatacaatggctgctttccctaacaggctgtatgtagccaaagagaggcctaactgcttatgtgcttgcttccaatgacaaagtgcgtgtgtaagaagcacagatatacttgactgtttataaactactgcaattaataatttatgacaacgactgcaagtcatacaacatctgagggtacctataatacactaagcaagaagctttcactactagaggatggtacggtttgaactctcctggagccctggttctgggcattcagtaggccagcagttcccaaacatgttctacagaacatgagctccatgagaaacagtcttgtgaggctgaggcacagtggctcacaactgtgatcttggcactttgggaggctgaggtgggcagatcacctgaggtgaggggttcgagaccagcctgaccaacatggtaaaaaccaatctctactaaaaaatacaaaaattagccaggcatggtggggtgtgcctgtagtcccagctactcaggaggctgaggcaagaaaattgcttgaacccgaaagtggaggttgcagtgagccaaggaaagaaatagagtcttgtgtccaaagacatttaggaaatatctccctcctgacatctctcatctcatattagagcttgatattttgtttaaccatgtgtttcctacacttataatctgaaaatatgtagttttcatttcatatctgtgctaactactctaacatcttgtaaaatacattttgagaaatactgcattaaaattttccctcaaaaagccttttcccttgaactttgctattcacaaagcattctgataaaatattcaacaaaagatacataggcataagcaaaagaaacatattttagaatagaaaagttgatttaaaaattaacaacaaaatgttttatttaagaatatcacatttgtgtttttagccctaaatttctaatatggtttgtagttaataagaaaaatactaacatatcaataatttacaatttgccaaaacatttatgtgtcaaaagaattctttgcttctctgattttgaaggaaaagaaaatgagagaggcagagacaaaaaaatggattaaaaagtggagagacagcttcttcccctaattattcacagattccatttgaattcagaaaacgattcttcacatttcaggactcatgtatgaaggttgttttatttttacttcatggaattggtggatgaatgttatataaattattactgcacaaataattttaaataatacttgaagaatgagacaaaaataatattttaaatttctagaacagcagctatatcattagtctactaccatgaccactaccatgaccaaacacgtgatgagtaagtctaaaatcataaaaacaccataagtgaaaatcgaatacctttattttctaaaacattaagcagaatgtcatattaccttttagcctaaatactttcccaatatacagttgaatatcaggaaaatgtaaaatttgaatgcctaaatataaatatttagacttgggtagaaattttcctcttattagagggttaaactttgatataatatagaaataattataatgaatcagacaattactttgatccccttcttggtttccaagaggctgtgatgatacacaatattttctaagatatctctatgtgcctcaagtatctactgctagaaatgtggaaatgaaacataaaaggcatcatgtttacagggagtttaaaaaaaaaaggtgtcagtgaagggatgaggttaaatgattggatgctaatggaaaccacctccaaattagccagacaggacacacccaacctacccttcctaaaatatccaaggaagtgaaatttgtgatgctctacagatagatacaggtactgtctttcaagaccttcttgtaaattcctttagcaaagatgctcattgcacattacaaattattttgcccagtaactgtggaataagtggttgtgtgattatacattcacttctatttgtgtccagagtatgactcatagaggcccaatgggggataatgaaaaaatcggctctaatatccaaaactgcctgtgtccggggctggtgcaagggattacacaagcctcaaaacacaaataaaagtcacaaactagcaagtaatattcattaggcacccatgtggttttgaaagacaattccaaatgctttcttatataaatgtgagatatggttgctagatttttacaatgccatgctggaaaatggaaaaattctctctacaaaggaaaacgtttagtctggagaaaatgtttacagaggtttgcagcaaataaacttctaaatatagtaccagcacttaataaagggtcaaataagctctgggttcttgagcctgaagttttcaaggattttgacacagccccaatgaaccatggcagaaccatggcagctggcaaatgccctgaaccattagccatcaaacagctgctgaagcaagtcacattccacaattctgtagcacttcctatcatatagtaacagttggtatgtgcccaaatttattttctcactaaagctgaatgaagatcatgtgagcagagaaacacttttatgattaaagcagatatacattttcagatgtattttttaaatgaatggaaaacaatgaaaactttttcaaaattcatgcaaagacaaataaacacccttttttgatataacttaaaactacatagtttctttatagcagagaaaatacaagagaatcagaagtcacaataaaatgcaaatatgccatgaaaaacaaagccatgaaaatgcactgaaatgttttgtctcctagcactctgttggaacttgtacataggcttagctgagaaagaagagttatgcgctgggtgctgtggctcacacctgtaatcccaacgttttgggagtgcgaggcaggcagatcgcttgagctcaggcgtttgagaccagcctggccaacgtggcaaaaccccacctctatttttagaagtacaaaacagccatgtgtggtggcgcatgcctgtagtcccagctacttggggggctggggctggaggatcgcttaagcccaggaggttgagctgcagtgaaccgtgattgtgctactgcactccaggctgggtatcaaagtgagaccctgtctcagaaaaaaaataataataataatgcatatagaataagtctaccatccaaatgagtcatttatgtgcacaaattaaatttttttctttttttgtcttattgcaagattaaaaattaattttaaaactacaattcaataagtggctttactaaaatgttccttaaaatattattttgacaaaagccggcatcaagaatctcattcttactcctcagagagagttgaaaatacccaattactttataaaatgtcaatacaagaggatctcacagatagcaaatctaatagtgtccagtccacacttccctacaaatacatgcggtcataattttttttaccctcttaatctgctgtggctccattagtaagcccctaaaaatgcaacctggcatttacattcttgtccatctggaatgtctctgcatcagaggaaaaccctcaaccccacccccctccacaaaagatgaacaagtgcacagctggtataaatctgggcacgtatgaaggcaaccacttgcatgcatgcatacacaaggctaaatgtttaatccctcaagcaccctcttctacccattttcagatgatgctaggaaggatatgatttgcttttttaaaaaattgaattatgtacttttattagacaccaaacaattccttattgaaaagatattgcaagaaaaaaagcttgaaaacttgccatcaaagctgtctgaagtccaaagtgctatcttttgctgtcaccagaagacttggaaccaaataggcagaaagctaaggtcaatcttgtgaaagtatgattgtgaaacctaaccctagacctctgtcctcttcagagcagcagattcacatatgtgcatttcagcagagatgcaggaattgctgatgttttccatgctgcttccatgaaaaccaacacttgcagggttcactgccagctcatgatgtgaagctaaacttagaaatcaagctgggttctatattgagctacaccacctaagtagctgtgggcaggaatatgactatatagacaactccaattcttaactattggtttttaacgagaagagcagaccaataaaattcagctttctaaaacaacaacataattgctttggaatgcattttggtaataaatttggctgctgtaactgaggttttgagaggacaactacagggggcactatttacaccattctgggtgtgaaaacaattccatggaattgtgctgtacacagcccaggtgactgccgggtttattgtcattctataccaacttccaagagctctatcccagggaaaaaaagtatccattgtatctctctgatactttcctactttgctatattcctctgtttctttctggcccccttctccactctggtcaactgtcacttatagtgacagttttgtttcttatcaaactttaaatcgaataaaagctagttgagcttccagagagctttactcttcccacaaagaatcctaagttgtagatgattcagatattaaaatttgagcagaactagaattttataggtacctcaataaacctgaaattccccaaatccaaaactctggaagagttccctaacataattagctacaaattttcaatcttgaaacttaaatgactgttccatgaatgcagtttggaaatcatgacaaagccataagtacagacatggataacagaggttgccaggtggcattatgttccatcataaactacagaaaaattaaactgttccattatttttagccaagacctctggttattggattgcatgggtgccctgcattccgcttatccaaaaagcaagtcagaaagaactaaaatggcagcatagaggctgagctgttgtcctacaacatagcccttgctcattacagaagcactaggcaccctaaggttcattttgttccaacaaccagcaatcattattttccagaaaaactgagatgtgagtttggtttgatttattaatttagttactcaaaatcttgaccttagtgactataaatatgctctatcactattcaggggtggcatcctcacttggaatctctggccagaattctttgggaagttatcattgatatcttattgcattgacaattaatagacagacagctcatacctcttgagatattactatctaaaatgccatcagaacataaaaatgcaaaaaaaaaaaaaaaagagagagagcaaatctttatctaaacataagctttacctaccacaggtaacactagtgaagcatctgtataatttactcattgcactaaaagttttagccagtgaagcattggcaaattttctaatagggtcagattgcaaatatcttgggctttgtggaccatgtatagtctctaccccaacaactcaactctgccattgtagctcaaaagcagccagacaatacataaagaaatgggtgttccaataagctttccagaaacaggtggcagctggatttggccctagtttgctggctcctggcctactgtaaagccagaagaactataggttggtgcaaatgtaattgcagtttttgccattacttttaaaatgccaagacctgtaataacatttgcaccagccgaatacatatttcattgtaaatcaggaataaaaatccaaaagaggctgatcataagaacaaaatcagctcaaagtgacaagcctacaaatataaaacacctttccaatggaaggaatcaggtaaaactcttacctaacaagtggtctgccagagcgttaacaggcgtgcatttgttattcttacaaaaaagtataatactcttgcgatcatccagaagagaaaactcatttgggaacatttatatcatcatcttcctttaaatgcttttacaacaaagaatgtacagtaactttctgaatagaaagataaagggggaaaaatgatgatacagtacctccaacggcaagaaagggaagactgttggtttcaggaaaaaagaaactgaagaaaatgcattgctgaaggccttgtactgctggaggggcatcttagtttgaattcaccattccctaaacacttcccataccatcctatttttggtttctttttattcaaattactacatttttggggtttttctttttataccatgttgtgctttctacagtcttgaattacacaagattctcacagtcctgcattaaggctgtcttggaagactactgtccacatttatgacaaaaatactacaacaaaatccacaaaaactgccattcatgcatgccacatctcagatcctggtggttaccccctttgaatgccaacgtgaaaatgaaacgagcaatccagggagcttgaatttcaaggctattttttaaaagatgccatctgctttccaaaagcaacacagacacagaaatagttctctccttgactagctacattccaaaatattaggtcatggtgagtgcatcccattgccaatggcccaggtatctacgtattctggcctttctctcttggtttctgtgatactagtcaagttttatttcatctagaattattcactatcctcccagtaattccaaatcacctttaattgccatttaaaaaaagaccctacataagtcttccattcaaacaaacaaacaataactgacttttgaatcaaatttctttttagcaatacccaagctactcttttcttcattgtggaaacctacaatgaatctcagggtactaatccatcctatgataatctttgggccaatcacttagtaatcagagcttccaaactcatttgtatgaccgttgtatagtaaatgaacttcaaatccaaataaaatgaaaatccctatacacaactctgtagttcatgccaaatgatgaaaaatggatcatggataaacttcagcagaacacactccaagaatcatttccactcagtctgaaagtaagttttattatttccccccatactagatttcctaaataatatttccttttgctttttctgcactgctatggtgtatgttcctttagaaacatcgaaggatcactaatggaatgtggcaagaatcagagctaaaaatacagctttttggccaggaacagtggctcatatctgtaatcccagtagtttgggaggtcgaggtgggagaattgcttgaggtcggaagtttgagaccagcctggacaacatggcaagaccccttctccaaaaaaatataaaaagttagctgaacatgatggtgctcatcgtagtccaagctacatgggaggataaggcaggaggatcactcaagtcgaggagtgcgaggctgcagggagccatgatcactttaccacattccagcctgggcaacataacaagaccctgtttcaaaaaaagaaaatctatttacctacagagagacttttaaaattgtcatgaaaagtatctcaaagcctgacacatacatcattagtctcaatgaagaccagaaaaaggagagagaattaaagagggtgacattagcattcctagaaaagggagttaaagcagatcacagtgagggtgcgccacagcataacctctgtgaatcctcgcgcaattcacctcttgggttgccgtcgtcaaggtttgattgctcatctatatgcgagcagatcagaaatggaccagctgcctagcttgctgttctacaagatgtaccataagacactaatcaactactccttaaagacaacagtgtacatgtatttttaagcggtggttatagaaatgctgtcgatagtgtacttagaagtctatcgcacaaactttgtttcttgttaattttcctcaaaggcaagaaaatctacttatacttctatttcactccttttgaattatatatccttagctctcgcaagcttacactatagcttcaccaattcctattctttttataaatattactcattcattcattcattcatttgagatggggtcttgctatgttgcccaggttgactcaaactcctgggctcaaccaatcctctgatcttagccttacgagtagttggggctataggcatgtgccactatgcccagctcaccaattcatattcttttcttagaaaaaatctgcttagacttacctccctcgggaaatacacagttgagctgaaatggaaattagagacaagataatgcctttaaatttttattgactaacaagtagcaaaaactcttactgaatcactatttattgtcatataagcttctttgaagggtactctgtgcatcctactcctggactggtccacataagggccaggaagactttttatcggggccctgtggggaatcgccaacttatctgggtttcctacaaagttgactaatattgctctctgtgagttctctaaaacaaccccatgagcactaatggactttcctaggctcacaggagtaaagtatccatggagcttttccacctgcctactcaacagctggcctcacagctttggagcaacgagaaaactccagttcctactttgcaaaaattggggaggaacaggaaaggctttcccacatttctcctctgccacttccgtaaaagaactatgcaggatgtcttcatcagctgaacataacaggaaccaaacagaagccactttaaaaagtaaatctgttgaaaacatggacctaatttttattgtaaatggatttaactgaaattttacactagggaataaagctgaaatatatgaaaaaactatattaccttatgtttaacaaagcatgttttaattgaatctactagaaaattcttaaatgaacaaagtttgatcaagtgttcatgtttttggattacttttccttcacgtttcaacttcgacttcttgtttggtcatcatggaacaaccataaaaagaatcatttctgtagaaatattcaaaggttttatgaattttcccaaggccctctcttaatcttatatatatatatatatatatatatatatatatatatatatattttttttttttttttttgagacagggtctcactctgttgcccaagctggagtgcagtggcacgatctcggctcactgcaatctctgcctccaaggttcaagcaattcttgtgccttagcctcctgagtagctaggattacaggcgtgtgccaccaacctcagctaatttttgtatctttagtagagacggggttttgccatgttgtccaggctggtcttgaactcctggcctcaagtgatccacttgcctttgcctcccaaagtgctgggatgacagcgtgagccaccacgcccagccaatcctatactatttttaccatgcattttagaagtactaaagtagtcattatctttgatttgtttcttcaacagttgactcatctgctagatctttactggtcattgactgcttgtgaaacccagcaatccaccagcattactttcattgactttatgaaatgctgcatctttcacaaaaggtgtatttccacactgaataaaactggatgaaggatcactggtattaagtataaagagataataagcaagggcagagtttagaagtgcttagttcattagtgaatatttttgtgtcttctgcttccctactaaaaccttataattgcaggaactcaaataatgaagatcactctcttgccaccattccatatggtaggattcggtttcatcaacccactagcatgccttcatgaaaccatagagccagctgtcgagagcagctcaaaacaagaatgatcacagaattaacacctaaaagcaaatggtataataaaaaacatcattaaaagtttactcagccaacataattttccaggaagttagtaaaatcaagttaaaaaaaaaaaaggcaatgaaggtcaaagcaaactcacatttacctgattagtgccaaatgtttctactacaggttttgcatgtcaccagaaaaaaggcctgatatgtaggtgttagagcagaatagtatctagcctacaggaagattaaaggattaaaatgaactaatactctacttcctaaaacatacagacttctacacagtgccagtcaaatggcagccaagtgttatcagcaaggctaaatttggatcacataacctaaaaaccacttaagataaaaagagtgctgaaataagcgcaagccataataagggccaatgagagaatgggtcacgtcaggtgacatggtttccaaaataaaaaaaggccaactcaaaatacaaaagaactgggataaattcttgatagctggaatgtttggtggaggcttaaaatgagcaccttacaccccacccccaacaaaagggcccttagccattctttatagaattgagatcctgctttaaagaaaccagagcacacatgtcttgcaaggaatgcattaatgatcataacctgggtggccaagcatccagacaggcctggaactaggactgaactctggtggcaatacgcaaagggcctggtttgaccaatgggtatctcagaagctagtgcagcctgccgctgtggcaagactaaaaaagaaaccttttggagccacccctaaaataagcctcggtgatgctggtaatgaatgtatgaaaatctagggtagaggtggctttagttcattatctaagaggtctcagctgattggcactatcaaactcaaaggcatgaggagtaacacgtcacacagaagaagtccatgtccctctagaataaaacttagtaacatggtgagtggtccaggcacacacactgacattcccaggctttcatcatactttgaatgaaattcaagcaacttcccatggcctatgaagccctgtgagaccctagcttactaccccaatcacaccttctaccccatccctgctgctccagatgcaccggaacataggatcgttcccagcataggattctgcatctgctgcttctactgggacactcttcaccagcacacagcctcgccccataagtctctcccttacttcactcagatgtttgctcagtcactgcctcctttctggctacccttatcaaaaatggcccaccctacccattcttctctatccctttacactatttcattggttatcatttgtttcttcccttggaataataaaaactccacgaacacagaaacctactatctgtctgattcaccacatagtctctgttttccaaaaatgtgtctaggcacatagcaaatctcaacaaggaatgagatttggaataaatgaatggacatatacttgttgcattgatacaaatatattttataaagtaatgaaatattaaaataataagcaaataatcatcaataagactaaaataaaccaaaccaaagccaaagggctaatcaaaaatttgaatgtttgtgtgctaaatattgtaccaacagcagcttagtaaaccaccctgaactctcctctgtacctgctgaccttaaaattcatgtgaaactaggttctggctgttactaaaccaatctaaatgccatcaaaagttctccaaaatcttgtagtggcgctatctcggctcgctgcaacccccacctcctgggctcaagcaattctcctgcctcagcctccggagtagctgggactataggcgccccccaccacgcccggctaatttttgtatttttagtagaaacagggtttcaccatgttggtcaggctggtctcgaactcctgacctcacgatctgcctgcctcggcctcccaaagtgctgggattacaggcgtgagccaccgcacccagcgaatccttctttaaagtaaccagagctcactgaggcaagacagatggtgccttcagtgacccattctctaacaacaatgttgtaacacttgtctgcaaaataggaactcatgttcaatatgttttatgtaactatattcaatatattgcaatattgtttatgcaactgaagagaccatcagaacctagaaactagtaataggattctcccaactcaatactcccactatcaccgaatcactctgtgaccatatattcttaaagcacggaatacatgccaaagatgaaaatccactaagcagagtcaaaaaagagttatgaacagatgatgaaactgaagacaactaaggccatcagccttgccctgccaaagatggtcactggcagtgcagtacacatggacactgaactcaggacagtccaggttcaaataatcagtgaccggcaaggaaacagaagctgctgcaagactgcccggagtgtcttcagaaagcaattagatctatggaagactagaccaaggcaatgcaggcctgcagcaccccaaggaaccacagagccatttcgaggctgtccttccagccaaccagacatggatggaagatctagacatgcagatgttgttttaggtttccgacgcgtttcatgggaggcttagaaacttaactttcacttgaaaagcaacaacttatcaacccatcattataacctcaaagttgtttaacaaagctattgttttagtaggaatgaggcagataacagggaaggactactcttgtcgttatctctagaaaactttctatttatgactccagaaaaacaggtgcatataaaaattagtcataagccaatggaatggagtcttccaacttttctgaatttatcggtccattcactgatcacaagtatacattcatcttagttgagacatatcagccattgatcgccttactgccatataaagtatggccgttcaagtcttacaaaatgtagcctcccagtttcactgctctcctgtctggtaagcagtggaggcactaggaaatctactcctctcccagaaaggatataggaggttgaaaaaaaaagagcagtaataaagtcctagcagtcatgaatgcattttgaaaactttatgactagggttgactatgtcatagatacaggcaattgattaccagtgttcagaaagtattttcaagcagggctaataatcaaacactccacatatgaaagagaaaacttcatttaacaagctaccttttaaagcctttaattattctaataaattatgattttcccctcaaacatgtgtgaattgctgaatggcatcttgcccaatagaatttttcaaaagaaacttcaaaaacaataaaactaaatatgagtgtggtctacttagcttctttgataaatttagtatgatacattgttcataaactcctccaccctgcctaatttttcctaagagtacttaccactatctgaattaacttgatctgtttagtgcctatttctccctctagaacataagctcagaagtgtggaaacgaagtcttattcctagccctattcccagcaaatagtaaagccaaaatagtgaatggctttacaaatatttgaggatcaaatgaatgaacaatgacatctataacatacagtctttggacacatatatatgtgaatatgcaacatatatgtacaacatgttgtatataaagatacaaaacagacaaagcattttacacatgtacaacctgatgtagtatagcatgggagaaaacattaacctggagatagaatatcagggtttttatttttgtttttgtttgctaactctaccatgtaacagctgtatcatcttaaccaagttacttacactgtatggtcctgagtctatttgtctgtagaaagaacattctgagctttattatctttagggatacttttaactcgaatatttttctcaataaactggactctttggaaggctgaggtgggaggatctcttgagcacaagagtttggggtaagctatgatgatgccacagcactccagcctgggcatcagagtgagaccctctctctttaaagttcatgtatatatatataacttttggagcatgagaactagctagatcctgtcactgtcagtgacggaagaacgttggtagtgtgggctgtgttgtttgtgattttaaaggttaccctatttttatgggagggagtggtatatgtaaatatgagcacattcttggtcctgactgtgtttatcaaggtcagaaggtgttggggaaggatgacggtgatagggcatggcatggctgctgaggagtttatagctgggtcccctttcctgttcccaagcacatggtatcagccggctgtccggtggctcagtaggctcactgtgttccaaaattacttcagagcattcggctccaccactcaaggaaaagcaaaatagaaaatgaggagaggaacaaaggagtaggttggaggaagggtgaaattcataggacagttttacagagagccatgaaccacagttagttactgatttataattacccagaggccaggagttagaattttagtagtttcgttattttgctttccttacagcatggattatgtaaattgttgtatatatgtctcttgaatatatataatacatatttaaacatacatataatatacttaaacatctatatatatgtttatatacatatataaatccatctctttaagatgctcatgccttctgcctggcacagcacacagcactggatctctctgtcaaagagtgctgagactcaagagtagagtcaagaattctacagaagaaaacattcagcactccccagtcatacttttattttcaagtttttatatataattaaatccacaggaactataaaatgcatgtacctagctccttttaaagtttaataaatatatttcagccattaatcctgatttatacttacagcttgtaacataatttagcccacatgtagaactttgctttttctatgccaagctaataaatgcaacccagtttcctagaatttaacagtacaccatactcatacttcataaaataaatatctgaacaagagactcaacactgttgtatcttttcaggcactcaatcttgatatactcttacagccaagaaatctaggaagctggctgagttcaaaaaatatttttaataaggaaggaacaaaaaccaaaagcacccctatgttctaagggtgaaaggggcgttggtgggatataactcaaaccatgacaaactctgtgtatgagaggcaattcacagcttacaattttactttcatatgttatttcatttgatccacaaaacaacattataagacagactggggcaatattactatctccaattttgtgaaccagaaaatcaggtcaaggaatgacagttcccaggaggtggcagaatcgggaataaaattcacatctcctcttttcttgtccatgatggttctatactttcatttgatctttcacttataatagtcaacctagtcttgcactaaaacaaatacagaatcaatactatccacacacaatagatatagctaatgaatgagtgaacagtagcgtataatttgtctcttagccaagcaaatactatgagtggcaggaaatgacaggaccttatcaagacaggaaaaatgatgctggtaaattctttctcttccccctacatggacagtaaaaaaaaaaaaaaaaaaattctaagtcctcttatagaagatgattacaagaaaataaatcttgggatcaggaaagcagaactgaaacctaaagcttatcatgctgataaggatatttacacaggaagcagtaagttaccactgcttcctgttttaagtatcttatctgtaagacactaaattttttttcaccacagaacctcacatttaggacacttcccaaaatagcatcttctgatcttcagctgtcagctgaagttgtttcataaatagcccagcatatgtactccagagaactggtcacactctaaatgcaaatatagtccagtaataccaattccttttaggctttggtgacagcatgaaacaagcaaaatcaaacagccacagaacttctaaagagaataccgtagaggtctgtagctaatgacctatgtaactctagctggactatttctggaaactttgaaacaaaggccattggcagatatatattcctgttttttagtatcagtttataaaggaacataaggtttgtttcaggttagttaatatttaaacaattaaaaacaacttttttgcaaagattcattttggtgaataggatgtatatatagaaacagctgggttctctgtttgaaacaactcttctggggcccttcacagtcaacaagtacagacagccaaactgattataagggaaggtgtttgaaatattacacatgaaactctaaatatatggagaaaacacatacatacacactggtataaaagaagcctcactgtaatctgtatgatctagcatgtcaggaattctactgcaagaattatacaacaagctgagacaatttcggtgagagagaaagaaaaatcaatgtctgtgtttttaaaagaaaaaaaagaaaagattgtgtagaatgggactgtataacttgttagcttgcaagttaaaaaaaaaaaagaatgggactgtagagcatacctgggattttattttcttttgcatctcggtccttaaacaaaacatgtgtgcttttgtgaactccttcctacaccatcgcctgcccctttacccagcagcccctccccatcacatctcccccaggaaggcgaagaaggggttttgccttggttaactgtaaccactccaggagagtagtcttaaggctgattccatgctgtacctagtaaaggttcaaaagtacttgttgagtgttgaaagactgtataaatatgatcctcaagcccttttagctaattggatagtagctgccctttttcacataaaggtgatagacagtgaggcatggcagaatggccctccttatgatcccagagataattccctgtagtccaacagagaaagccctgttcctacactacagaccaggcagtccaggcagttccagattcccactggacgtccggaaagcacaacagccaagcctcaatgaacttcattaacttgattccccgagacttgagagtccgttatagtaagaaagaataaaaatgttgtaaatgtctatactgaatcaaaatcacaaaatacttttttaaaaagactactggtagataggttcaaataaatctgttttttaaaatgcaaataactgtccttcaaggaagagggcttaaaaaggctctgatgatcacagtggttccaaggtggtacataacctataaagttctgtctctgaaaaagtaaaacactaacatggggcaaattaaaatggagagaacatggggaaatcgggaagcaaatgtccaactatgtccagtgtggagttggtttgaaacactgtactacagaatgttggacaatttgggggaggaaaatgatgtaaaaaaaacaagcaaacaaaaaaaatattcaaggtttgggaaagagccacaaaattaattgaagattttaaaaataagaatgatgagtaaaacctaaaaatgtttagtattaaaggaaagctgagacctgacttcacaaatgtcttcaaacacatgtagagaaacatttcataacaggttggtggtctaggtaaataaactatgtttcatccatacaagagtattaaccagcaataaaaagaaatgagctatcaagccacaaaagatgtggatgaatcttaactgcatattgctaagtaaacgaagccagcctgataagaatacatactataatgattccaattttatgacattctggaaaaggcaaaactgtagagacaataaacagatcagagattgccaggggttggggagagagaggaagggttgaataagtgaagcacagagcattttttagggccttgatactatactgcatgatactgtaatggtaaatacaagtaattaagcatttgtcaaaacccagagaatttatagcacaaacagtaaactttaatgtatgcaaataaaaaaatacacctaggaagtcactgatcccaggatggaatgcagaatgtgacaaaataatctaaatgtgttataaattcatgaaaagacttcagtaaaagaggtaggagaataaggtgctgaccgaagtaactctggaaatgaggggaacctataagactaaaggcaaaagaaacttgacagaagcattgtactctagttgataaagttgtttcccatggggctagagttaacaatcctgaactgctatgtatatgtatgcagtgaaattgaacaaacaattaaatggatcaaggatagtaacagccggacttcacactgttgaggtgggaggtgacagataaacaaggaggcgagaatggtccatgtggaaatggattggagttagagacagcaatgtgaactcatgcttggcttagtacagatacagatggttacatatagaaatatttatagatatgtgtatacgtatgggttagtacacacatacatttccatgctctgtcagctgagaaggcaaagaagaaatgacatctcagtagcaacaaacactgctagttcccagatcttagtttccaatataattgtccatcaggtatctgtgggggattggtttcaggattcctgtgcctaccaaaatccatggatgctcaagtcctttgtataaaatggtgtagtgtttgcatataacctatgcacatcctccggtatactgtaaatcatctttagattacttatgatacataatacaatgtagttgctatgtataagtgttataccgtattgtttagggaataatgacaaggaaaaagtctgtatatgtttagtaaagatgcaactatccttttttttttccttgaatagttttgatttgtgcttggtgaaatccatgaatgcagaacccaaggttacagagggcagactgtacattctccaataaaaggaagcagctccttagagaaactgatgattttagaactggggcaggaaataaacaaggtgatcctgtagtatattggagtgtcaaaaagtaagggaatgctcaaaaaaaatacaaaagcaagaacccacaatgatgggagtatgtcaaagggacacaggcgccaactgaaagggctaaagctggaacaatttgagcaacaaaataaagtgttactggattatgacctgaagtataaaataagcagccatgagtccatactaatataaatagaattgactaagtaaataagaagcaaatctcctgtgcagaagaatcgtgtgtgagtgtggggtggttcgggtgggggtgggtagataactgcccaatccttaattgtgggttgtgtattgtgactttctgccaaagagcacaatatggaaaggcgggaaaaggctaaatttatagcagaaaaacctgacaaacactccttcagccaagttatcaaggtcaacatcgaccttgagaaatcctgttgataacaggtacacttgataggtgatgaaatggcacctatcaaggtgatgaaatggcactgttacaaagtgtaatccttggttgggtgctgtggctcatgcctgcaatcccagcattttgggaggccaaggtgggcagatcacttgaggtcaggagttcatggccagtctggccaacatggtgaaaccccgtctctactaaaaatacaaaaattagcctggcatggtggcgcacacccataatcccaactactcaggtgctgaggtaggagaatcgctggaatccaggaggcagaggctgcagtgagccaagatcacatcactgcactccagcctgggcaacacagtgagactctttgtggtcttcatccccaaaacacattactcagtctaatcatgagaaaaacatcagacaaatcccaaatgagggacattctattcctcaaaactgtcaaggtcataaaaaacaagaaaaatctgggaaactgatacagcctaaggagacacataatataatgattaaatgccatgtggtatcctggatgagaccctagaacagaaaaacaaggacattaggggaaaactgaggaactctgaataaagtatggactttagttaacaataatgtgtcacattagttcattgtgacaaatgtattatactaatgcaagatgttaataaaggcagaaactaggtatggggtacatagtaaatctctgtactgtctttgggataattctgtaaatctgtaactgtcctgaaataaaaaagtgtattttaaaaatgctattgagttaaaaatgagtgataaaacaagcttaggtgactatataaatattcaggtattttgttttccaaaggattttcaaacctatttaaagttccttaccacttatagaaccccaaattgtaaactgtatttgatgaattattgttcttcatagaatagttagatgatggaaaatttcttttagaggaaactcgctgatatggcttggctctgtgtccccatccaaatctcatcttgtagctcccataattcccatgtgttatgagagggaccctttgggagatgattgaatcatggggcgggtctttcctgtgctgctctcatgatagtgaatgagtctcatgtgatctgatagttttaaaaacgggggtttctctgcacaagctctctttttgcctgcttccatccacataagatgtgacttgctcctctttaccttccgccatgattgtgaggcctccccagccaggtggaactgtaagcccaattaaacctctttcttatgtaaattgcccagcctcgggtttgtctttatcagcagtgtgaaaatggactaatccactgaccctattattaagtttcagcaaataaatatatgttgtatttgaaacccagaaaagtcatagtcagtttaattagaattgtctcatcaattataaaatattttctatttataaatattttttctaagcatttcttagaaaattcatttcctgtcttatttcctcttttagcaaactgattagttgcagtaccaaggttatgatttttccatttattcttctgcatatttaaatatggtcatcgtgttttattttaaatttgtttttagaacttaatagtactttacagtatatttctataatttaaatcttctgataaaaatataatttatagcctcatgatttttaaaaaaggctatttgtcaccactactaaaatcagaatgagggaaattctctcacatgtaaatgaaggatttaagttagcgataaaggaatttcctcaccataaaagctgttatccactagaaaaagcaaccttaaaattgtgagatttcttcttgtgatgtatggatttaacaggaatatgcctgaagatctttacttgtaaaatacacagcaataccaaagtaaaagctttttacataagagcagtttcaagatagtctttcctcccaaacattaaatagttttctaacagaatttaaaaaaaaaaaacttttggaaaagaaaggttagagtatatacattaccacttttgcataatagtcttaaaaagaaaactctttacaatacctagtgaaaattactaccatccaaagctgcaacataagctatggttcatgacatccctgttccctccaacacccaatgcccagtacacataggtggccacacttgtggccagccccagtcttctctagggcttcccagatgtaccacatactcctaacatccttctctcaatatgtcacctgttccagatctcgactttcatgtaagacaatctctctcaagcacatatacatcaacttcaactcttacttccttctcttttataatttgccctattacatcacaaaaatgtgccctgggaaagttggtcctctatagctttctcactcacatggccctcaagaaaggaagttctaagaaagcttgaagttttgtctgttttcttcacagttgtaattcaagaacttaggagtatgcctggtactcagtagaaattcactaactccttattgtaccacttaaccagaatgctctctcatgacaggtctacaaccatttgagtcttcaacgactccctaccaagatcttcatgattggttatgatttcctttaaatttcaggttcagcaattacaacagcttacttctgcaatgaatggaaaaatctaagaaaatattcaatacccaccaagtattagcagtagtaatgtagttaacaaaaactttattttcctgaataggatatgattctggtctacagataaatgaggtgttggtatatttccatattgtgctttaaaatcctatggtccaacattcattcattatttagatacaacaaacagtatctaccaaatgccagactcattccactgagcattcaaatctactcagccacgctggtgaaaagagaaatagcctagctcaataccagacacatatctataaggacacacatcttcaagttttagaaagcagcaaaaatgtgaatcaaccgtgaagggccaataaaactgaagtcttatttaaaataaaatagaactaatttatattacagatcttgtggagttgtgggtttcatacccaaatgtgacaaatgttctgctgtaagtactataaaagttcttggatcctaagttttagctcaatacttcaaatgtccaacaatatttaaaaacaattgctacagtagcggacacaccagtttagaatacacattccattactttggtcattacaccagtccagcctcaatgaagtgtggaaacaaaagtcagggaatgcaggggaaaagtctcaaagcaattaggttcagttttccagaccaaggtaacatcttagcagagtacctaccaagggctacactggcaaaatggactcatttaaatttaattccttttcctaaaccttatgcatattttagtagaggggctaattagcaacaaagaggaagaaaaaggaggagcaatgggacacatcaggagggaaatctatgaatcacaaactttctaactgacctctttttaaaaatagaggtagcagccgggtgcggtggctcatgcctgtaatcccagcactttgggaggccgaggcgggcgaaacacgagatcaggagttcaagaccagcctggccaacatggtgaaaccccatctctactaaaaatacaaaaaattagctgggcatggtggcaggtgcctgtaatcccagctacttgggaggctgaggcaggagaatcgcttgaacctgggaagcagaggttgcagtgagctaagatcacaccattgtactccagcctgggcaacagcatgatattccatgtcaaataaacaaattaattaaattaaattaaattaaattaaaatagaggtagctgtgatataatgcttatttttcaaataattttctcattgcttttgatatctgaaacgtcagtaaaaatgctatgctatgacctagatcagtaagctacaattaacatcagaagaactatactagtagaataaaagttgatgagctactgttggaagcacaaaaataaatcttgtcaaaacaaagcaaagttcctgtcaatcttcaaaagaatggtttgggggaagggaggaagtgtccaagatttaagatacataggaagttgcaattaattttatccaagtttttatattcagtcataccagattacagtcttgtaattttgatggactttttaatatatctgatattgttaaatctgaattttttaaatattggacaaatgaaatggtttgagatactcaaaaaatatccacattattgttcttgtttgaaacttttctaaagccatcctctcccttgatccaagactcttccctgaactgttgataaatatgttttcaatgtgtcaagcgttttgtgagcaccaacttggataatggagtcatgaaatgaagagtgagcctactctcaaatagctcacaatttttagtaggaaggagtgccataaaaccagtaactgaagcaaggacaggtggtgttactgcttccatcatccttcatgaaggggtaaattttctgaactaaaaggagaggcagggtggttgatacacttgaacccagctaataaaagatttgggcattttctttggtcaatgcatttaaaggcattgattttacattgcaaatgcaattttacttactttcgctggaaatccattcagaactcctctcagctaagagagttgttcctaaacaacttctgccattatttttaaaaataatatttcccatccacaaaaaaggaaaagaaaagaaaaatgctgaagtttcctaaagtggtgagtaacagtaaatcctgagttggggtagggagggagccgtggaatagggctctattcatagagaagagacacattaattaaaaatccacctaaaaggagccagtgaattagatcgaattgggtggtatgggtttttgttgtgtacttgataatgcaaagacgctttccatgagcccatctaactaatacagcgtggtgggaagcaggctttgaagacacaataacattcctccagcgagcttcaagctggaggctaaagcaccagccattcatttttccatcttgagacacattcttcacccagttcaaaggcccaagaaacaacaagcctgtacactttctgaaggtcggcctctgtagggacttgtgagggactaaaggctcaggctgcaaaatatttttaaagaccaagttttaggaatgtaaccttttttattggactgcagtttccactcccttgccctcctcctcacccctaaatacacacacacacacacacacacacacacacacacacacacacgtttgggcaaaagggagttttaattatactcttggtaacttccagggtactctacaaatggaaataaaatatttttagaaattaatttattacctattcttttaaaaatgtaatattaatattccttaacctaaccagaaggaatgggattcgctttgaaaggaagttattgtttagctgtggttcaaagagtatgctggaattgggaaggggggcagagggagctagtaagggtgggttaggggggtggactggagctgccaagatcacaatataaataccaccacgttcaactttcagtctctccctcttggctcccctccatgacatattttatacagtgtcttgttttgttttgttctgtaacctcaggaacatttacggtatttgagattctggtaaaagcaaaatgtaaatagtagctgatgggagagctgggtgaagagttaactaaagtactgcctttgctttgagtaggatgtggcaaaccatttgcatttgctttccaataatcagcaactttgtgttacccaaatctagatttatgctcaggcagcgaaagccctttcaaaccatttcaaagtctctgactccatttaggcccttgctctccacctccccagacaaaatgcccagcgccctgcaccagttctcatgtggctcagtttgttgtgtaagtggggacaagcagtaagtcattggtgaagagacagtgggaagatatcccctggctctgcgttcccttccagtaccatatttgctttcaagtcctatgtgagccacctgaggactgttacaaagtgtaatccttggttgggtgctgtggctcatgcctggaatcccagcattttgggaggccaaggtgggcagatcacttgaggtcaggagttcatggccagcttggccaacatggtgaaaccccgtctctactaaaaatacaaaaattagcctggcatggtggcgcacacccataatcccagctactcaggtgctaaggtaggagaatcgctggaatccaggaggtggaggctgcagcgagccaagatcacaccactgcatgccagcctgggcaacacagtgagactgtgtcccaaaacaaaacaaaacaaagtgtaatcctctaacctagttcatagtagacatctagaacaaatagtatattttcaccatccaccaatggcactaaaaatagagacaaccgcatctactactagaaacctcaatagtcatttttcaatgttttacttaggggtgagctttcagccttcactcaactaataagaggtattcttaaggagatctaactcttaaaaagatgccatcaagacctgaatctgcacttggcccacaaagcatgtaatataaaaatatgtgtttctcctttacaaacctgaataatagaagtacattatgtattttctgaaatcatttcctgcccctacatttacggtagtgcccattattctacttcataacactctgcccttcctcttcctcatgccacattttgcagtagcatatttctttatttacttgtttatttttgccccctgtaaagtgccacaaaggcagggacacacgtatttcagtctccactgcctggctcacagagaaaaactcaatgaatagttatttaagggaatataagtgtttgtgtttttccaaaaaaagtagtatgaaggaaatcactgatatttcacccaaaggtagaagtgttcactataaacatctaagaataattttattctaaatgttcaacatgcagttgataaacatttactaatgacaacaaaataactgcatttagtatactatggtatcacagtaagtcaaaaaatacagattttctaatagtatctctattttatccccttgatgctgggtgtggctatgtgacttgctttaggcaatgggatagtagcaaatgtgatataagcagaggcttgaaaagtatttatgcactcattgcttccctgctcttgctgctgggaacctgttcaataccacgtgaggactgggtcagtctgctggggacacgtggaccagtcaatagcaagcaccaactgacagccagcatcatccactagatatgtgaggaagagcatcctagacaactagcccccagtcaatcctccaactgactgaaccactgcattcaccctgatgagacaagcagaagaactgcccagctgaactcaacctaaattaccaacacacagaattgtgacctagtaaatgattgatgttttaaagcactttatttggttgtggtttgttacatattgaaagctaaatgatatatacacctgagaaactagatagcttcatatataaaactctttaacagctttttaaaaatttccttcatatggatgaatttcattcctccttactttaatctggaagaaaactaacactactgctattactatactcttattggtaagtcaccaaaaaaacgatcaaacactgacgattctaattcaaatgtttttttttaatttttttatttttattttattttttattttttagatagagtttcgctcttgtctttcaggctagagtgcaagggtgtgatcttggctcactgcaatctctgcctgtcaggttcaagtgattctcccgcctgagcctcccgagtagctgggattacaggcgcctgccaccacgtgcagctaatttttgtatttttagtagagacggggtttcgccatgatggccaggctggtctcgaactcctgacctcaggtgatccacccacctcagcctcccaaagtgctgggattacaggcatgagccaccatgcccagcctctaattcaaatgttatctgttaccacattctcgaaagtttctattttgtagcaagagctaccccattctattcatcctcttcctggaccacaattagcaagaatagcagggtaccagtcataaatgtttttgaccactagagaagctcctctttgcttcaaggtagaaattatctcagcaatacacactttccttaggagacagggtagattctccttattccattcctgtccagtgttaataactttggagaaaataagtgacaggacatcactagtgtaaataaatttcattaattagttgtatgtagtcttatgtataaaataaattgctcccagaatttgaaatgttgaaagactattccaataaaaagcattaattcttttgagcactgaaaaatatgagacattggtatccagaaagtcttcaaaaagatccttaaccttaatacttaatcccattataccatattaagaactagttattcactcagtcttgggggaatgaatgcctaagtaccatgaaagtgaacaggaaaagaaaataaagtagtaaagatttaaattggtggtgtttaaaaacttaagacacttttctggccaggtgtggtggctcacacctgtaatcccagtactttgggaggctgaggcgggtggatcacttgaggtcaggagtctgagaccagtttggccaacatggtgaaaccctgtctctactaaaaatacaaaaattagccaggtgtggtggcgcacgcctgtaatcccaactactcaggaggatgaggctggagaatggcttgaacctgggaggcgaaggttgcagtgagccaagattgtgtcactgcactccagcctgggtgacagagtgagactccgtctcaaaaagcaaacaaaaataaacaaataaataaataagacacatttcttaatttgaacatttccaacttgaaaaaccagatcattttttaacctatgcttttcccctttcactgttatgctagattaatcactagaaacttttcttttttttatatatatactttaagttttagggtacatgtgcacaatgtgcaggttagttacatatgtatacatgtgccatgctggtgcgctgcacccattaactcgtcatttagcattaggtatatctcccaatgctatccctcccccctccccctaccccacaacagtccccagagtgtgatgttccccttcctgcgtccatgtgatctcattgttcaattcccacctatgagtgagaacatgcggtgtttggttttttgtccttgcgatagtttgctgagaatgatgatttccaatctcatccatgtccctacaaaggacatgcactcgtccttttttatggctgcatcgtattccatggtgtatatgtaccacattttcttaatccagtctatcgttgttggacatttgggttggttccaagtctttgctatcgtgaatagtgccgcagtaaacatacgtgtgcgtgtgtctttatagcagcatgatttatagtcctttgggtatatacccagtaatgggacggctgggtcaaatggtatttgatcactagaaactttgtgaacctgaggattgaaaagagacgtggaaagtagtgtgtccttttttttccctttaaaagtaacaacaacaacaacaaaagagaacagtaagtctgtgatacaaggtgtattatctgctgtgcccctttaagtgctgaaatttgggatctgagcatattcttccatagaagacttggagcagttgggcatttaaccaactttttattacaaagcttcaaaatttataagcagtctatctctggaaagataaacaaaacccagcagtgatggtggcctatgagaaactggggacaaaggtgggaggaagccttatttttcactctctaccttaaaaaaaaaaaaacaaaaacaacaacaacaaaaaaaaaccaaaaaaaattggaaacttacagcatgtacatgtatcacctatacaaaaatacagagaaaaaaatagtgtgaagagacccagcaagctattataaaacttggtagtctaaaaaaaaaaaaaaaaacttttaaaacatgtttctgtaagagactaccacaaacttaaaaataaacgtgactgcatatcatcaaaacagagggagaaaaatctcaaaagcaattatacttgcagccagaagcaagcaaggaaccacagttcaaagtgttggaccttttcttcattaaaaataaaaaccacccacccaaaggaaaaaaaagaaaaaagtccttgaataacaaagctaagatagcaagaaaagactttaaaatttattttgtagcccccactttccccccaggtttcctaacactgaccaccccataacaagtccacattcaacccctcttcatttaacagctggatgcctcttcttctggttgctttcactgggactaaagatccaaagcaaagatatcttttttcctgctttttgtcaatattatgtttgcaagcttaatatccaaaaatgggccattcttccaaatgagagttccttcctgattatttagtatgctgatggtattgtcagacaggaagccatggttagaaagattcagaaaaatacaaacctttaagctagatgggcacttttgccctttaggtttatgaaaaatgccaacttttgtgaactacacaatcggaatcttgatttggttttcccggataacttatgtcataagaaatttggtaactcctttggtgatctcctctcagtaccatttttccctccatttccatgaatctaccttcatcccctttcaataaaaggtgtactatttggaacatgataggtgctcaatagagcttactgagtaaaagaaggggaggggaagaacaagaaaaaatggcttagggcctatttgacaaaagcagataatttatgttagggttgagaaatgggtggtgggcttgaatagtattaaagacaattaaagatcttctgatcttctgattgtccccacaacccctaaaactcaagggtaaacataattatttttcatatccatagagccctccaaataatttttaagtgaatagggacatgatgattggagaagattagataaattatagttgactacttagcaattactcaatattccagtggcctttaactaactgctaaatgtttataaatgtcttttattattttgctagctcacttagatcatatccttcctaaaagtaaaaatcatgactttctgtgcaaaacataatttgtttgccacattacatatattcaaaaaaaaaaacgtctctttgatcatttcaacaaacgtgagaaaacttctcaagattaagtgatattgttcagcaatatgacctaaatatgtcagggaggatcagagaacatgcattaaagtattctttggtcaacaataaaagtggagtgcaaggatacatatgtaatatgcaatatttataaaacttgggatggtaaaaaggaatacaatgaatgcaatccaactcagcttactcaataaaacattcctggtagagtaataaaaccacaaaatctctactctgctttaagaaaactgcaactagaatcatagtctgacccatgtattcaactctactgccattatcaatggaaaatacagaaaaagggtcaaaaagccttttcaacataaatacatctttttcaaagctctattattcaaagatcactggctcactgaataagcacaaataacatttatccaaccaaatttatttcaacaaatagattatagcagagcctgctgcaagaatactattaaaatggaaagtgttccttttatcatacatgacagtaccttatacttgtccaatccatcttctccctttttgtgaattaagaatgggagaggtactaccatttccaaagtataagacaaaaatagaagcaaatagatgatacttactaacctatcttcttaaaaagctttacaataaatttttgtaactatgtcatattagtttgaaattagtatgcaattattatatcatactaacgttaaaatgtaattttaagttaaaattcaatatgattacactttctgaacatgtttcaataacattttaaagacagctctcaaagtctgctgcatagctatggactaataaggtaacgaaggaataaatcagttacataattataaatgtggtagaggcaggatctattattttacatgcaaaaaaatactagtatgaaaaaaagttacaggatctttagtgtgaaactggcttcaagcatgattcacaagaagctattttccttgaatacaatttccagtaactttgtaacatgaggaaataattgaggaaatggctttctttaaaacaaaacaaaaccttaaaactgtgaaatgttccaatatactaaattaccaacccatcaaaataaaaggaaccatttatatactattcagctaagacacatatctgattatagtgagaggattggaaaagcataagtccgtggagtttcttaagaggcaacagactattttaatgacttgtgaaatccacatggagggacaaaaaaggtcggagcttctgaatatattggcaactcaacagtcaagataacacagggttggaaaagcagtgttggctcaactaactaatcaaaaaccctaaagcacaaaaaatctggacaacactaattttgccagcaagagaaatattgagttgtttcatacacctaagagagaaaaataaagctaaagaaaaaattgtggaaggcctcctatagtccccagttggcttctcaaatttccttaccattcacttaaatggctgtctcactgaagaacactgatggtacaaatgagacacattatccacaaacacaccacccctgaaaaagaggtgatttccaacaggatgcatgtgttaatttccacagtgtgcactggttaaagcttactctatagtgtggggaggggtgggatgtttctgagagctgaccttaggatgtaggaactagcaggtgccttgcattcccacacacattttatttttaaaaaggcggaaggaagaggagcataattcagtctagagatggttccaaaaacttaggctggtcgatcaggagggtttgtcttagggtttgttaaaactcgaaaatgcccccttgaagcaagaaaagttaatgtcaggcctgaatcaaacaatgttttccttccaggccccagtctgtccataaagaatgtctgatccaaaggctagaaatggacagaacaggctattctcatgctttatcatgaccctgtcaacagcttcttcggaaagaatcctcattgcaactgacccattaaagagtatcagtcattttctccacaacattcctatgtttagagctgcaaaggaggttagaataatttagaacaaaatcctcaagttactgatgaagaaataggtccagagaaattaagtgacttgcccaaggtcactctgctagtgaagggcacaggctgtgttggagcccaagatctctggctcccaagaactgctttttccattgcatcatttaagatagcacaaagctattttcctggaattgtgatttaaaaaaaaaaaaaaggtggcatgccctttggatcccaagtctcttcctgtagggcaatgctggagatagtatttattgagggggaactcagagaaatgactacaatatatgcaacattttatggatttatttttactataaaaagatacctaaacaattgcaaacattaagcaaattattagctgctcaaacttttctggaacaacagagaaactctctcccactgctcagtagcagttttgggtcataacatttgcacctgcttggtacgtttccacctgtgatgtttcacttggcccctcagaaaaagcgctgccctgggatcttatgattcagtgatgcaagagggatgttggctggtgagaaatgcttatttgagagggaaggaggaggaggagaaaatactcccatagcacttttctttcttattttccttattttagaaaggccaaatctgaacacattttccatcccatgtagtaatatatctcacataattttggttactggagggtacacaacacaaatctagcaagctttcaaaatcgatgtgcccagcctaaattgacgggctgtcactgggactgtcaatgatggaaaaatgaatctgtgtctgagaacgccacagcatttcctccaagcctttaaggaacacactacccaaacccttgtcacaccgggttctcaggatctgcaagctgcagtcccgtctttcatttcgctgtgagctccctcacagcccaggaggatgcgttttcccagctcttacctagctctggtgctttgcagtaaagtgtatggagcctagggcactttcaagccaaaggaattccccctccccccatgacccaaaacgatggcatccgcagcactcgcaggtctctctccctcccttggttgaggggggcgggcaggaatcgcgggccaaccccacctggcccgcaggcccgcagccacgtgcgggactccctcctgctcgcggatctcgagaccggaagacgaaggaacgtggcctcgtagtaaaccgtagtaaagagagaagggaaacaaaatggggctcgtcacatggttacggcctggatttttctcaattaaaaataagagcaagtgtgtgtttccggcccccgtccgtgggctggttggactttttcattcttaggattctgatccaaatgcaagaatacagctgagggcacaacgtcctcagtcggcgggcgcggtgcagagggggcctgcggctcggcctgcgggcacccgcgggaaagaggtgccaggcagggtggcagaaagcggcccagggacgcccgcccgccaccaccgccaggggacccgcggagagccccgccccgcgcccgccgcggctcagccgtttcacatgctgattggctgtggtgggggccaatcagcgcccaaccgccccgcccgcccgggacccagagccgcgcggctgtgcccgagggcggggcctcgcccgccagcgccgaccacgcggcccgggaaggggccccaccgccctggatgacccgagacgggcgggggcgggagacccgagggcggtctggctgcagattcccccaccccgggcgaaagggggctcggaagagggaggagaaggaatgcaggaagcggaggtgacccggaaaagggaaagtgccagggccgagagggtttgcgccagccaaaaaggccacagggctggggaaaggggagggaggggaggcaaccttggaggtacggaatccttgacatcacaaaaaaggaaactgaatgaaaaagaaatggaaagagtctttttctgttttttttctttttcttttttcttttaaagggggagggcataacaaagaatgacaaaaacaaaaaaactgaacccaaaaggcatggctggggtctgtgtctttgtcagctgcagtttcaaaactaaaagataaatttgatgccaggtaaaggtggcagggctgctatgaccgagtctgagaggctctttttgccctgcttcttgggctctcaatttactctctgcagagagtgggccacaagtactgcgaaattctgaaaaggagcaaaagaaaaaaaggataatgtcaggaacatgaaataagaggtggaaacaaagggatggcaggggatagtactagaaaacgagcaagccagaactaagaggctatgcaagagaaagggcaggcagaaaaggtcactggactacaggtaaagcagacaggcttccaacaagtagagctcctgagctcagtgcttcacaagtgttctcctcttaacagacaatgaaaaattttaaacaagccgagatgtttcaacagagcccacgcctcatcatacctctattcctttcaccgagtctcaggttttacctgagaaatgaggaaaagaagcaaagacagcaattgctgaggaagtgaggaaaataatgtttgcacacacattcggagcagaagctgtttgccactcacaggtctgacttctgtctgtttcagatagctatagaataacatctttggactcaacagggcacaggcaagcaagcagaattgaggatgtaaatgtgccaggtagcatttggtgcctcactttaaacaccaacacaaacatctcaaatacgcattgtagaattttcctggcactgtgcaaagcatggtcgattgttactccagaattattagaaataggattatatgattattccagaatattttattttcccaaagaaggttaaggatagaattttgtagagtttttgtttttttaatgcatccaacacataggagaattttattttaaagccctttttaaaaatgaaaattctagttggtcatcaattctcttcagagcaaacatcatttattctactctataaaaagaaacctaaacaaattaagatgacaagtaagaaaaacttattctctttatctcctttaaaaccaaaattttagttctgctgggctggttttcttcaaattctcattattttaccaatgaggcactttataatacaaatgcttaaagtgttgagggattctgactcccaaaaacatcatttgatataacaagatttgtactactgatgttgatatacacaattaaatctttcttctagtgaatgatgaaaataaatgttgaagtaaatactgatcaaataaatgctttttgtaacatatcacccaaaatcttcatttgagtgttcatatacctttttcttgttctataaaatagagaattatatggatcaaatattggaaacagaattaagaagactatgaacacatgataaataaatacctgtcaataggaaaccagggcacagattaatttcttatgaatggacacaaattaagaaaaatcagtgcttttaaaagctcattctgtggagcatagataaaattcacaagataatcagtttgtcagagtaaagtgtttccaaatgctggaaacttctgcattgccaactcatcacattatttgcaaactgtactctcttctacccacaattatgaccaccagaaaacaggatcaacagaacgaagggcaggctaatttcctattacaaatgtttttcatttttaatacggcattagccacagaagacctaaagccaactttcagcatttactgtggtgtctacttttgaacttaaaggcacacagcaaataaccctaaaagtggagggtatacagtttagcccttctactcaatgcaaaacaaaacaaattaaggcatgttcctgacttagtatgcattcttctcaacaaataaaagtaattttacagaagatatatagtagcccccaaatgatatctgtaatgtctcagtgcaagaagagataactataaggcagacatcctaggatgaactcccataactcttaataatgggtcccagacacatacagagtttcctgcatatcctgtacaagagaggccaggcccgtgggatggtgggtcggtgtgtgaataatatttcacaaatcctggtacatgaacaaaaggagaacgtcacccataattactttcttgagagatcacaaaatagataggtacttctctctaaatacatatttctaaaaagctcttactcctgatctttttagggcaggatgaatagaaatcaatgcttcccgctgctgtttatgttgccctagtattatgaaatcacagaacaaaagtacagagaacaacttgataagatcacccttaagggctcccagaaactattaagatagtttaagataaggaagggtttagcccctgtgttaacaaatattttttgtagaactgtcccttccaggggctgacctaaatatatagtgaaaagaaaacttcaacaaacaaatcaagcttcttacggaggaactctacaaaacgcagaactggcataggatatatgttttaaaaatactgcagtaactacttcacttgggaattctcaaacgaaaaagccctcctgtggctgctcctacatgtttgtttgactctctgccagatgtcagtgtggggtgagcatcttgtgtgccctgagaatgtaagtgcattctccctgaggaagcagtgggaaagaacaggaaggggcagaggcgaagaacagaattcaaggacaaggttaaaagcagttttgtcttctgactttgtcaccatgaaacgcacctgctgtgatgtccagttgagctactgacggtcctctggctgcttctggaaactgatgctggcataggcgcttaaatcctcacttgagcggcgggtggagctgctctcaccgctgcccaggggttgatgagggggtgggggtgggggaggctgcggttcaggggtgcactcctgagggcactgtttgaagtccttgaccaaatccaggtctatgtagttaagaccattctccaaacccccagcagccccacacagtttggctggctccttgggggctcccccaagctccccaggcctcagccacacattctcaaaggaagcagagctgtggcgtttcacatcctcgctgctgctgctgctaccgccaccgccccctactgctgcccccgctccaaagggcactgtgttgcccacccgggtggcactgggtgttgaggagaaagtctcggagctatgcctccgccggcacccttgtgggtctgcacggatcactttggcactctggttgcggttaggactgaggttcacccgggtgaaggcgctcatgcccccaggtccttgtgggccccccagcagggacgagtgggcagccagctctgctgccccttgaggcccagtcggggaagcagaggctgctgaggatgaggaggcagcagccatggtggccctgggcaggctcacctcctctgcagcaatgcctgttcgcatgtcagcatagcttacaggggcagctggcgaggtgtccacgtagctctgacggggacaactcatctgcatggtcatgtagtcaccccggctgctgggcactgcccgggtaggcctgcaaatgctagcagccccgggaggtgcagggcccagtctgcccatctcgaccccagtgctctcctgccaggctgccctccggcccggccccaggtccatcttcatgtactcctcagtgccagtctcttcctctctgggagctggctggagctgggatggacacctgacagaaggtgagctgtggaaagccaccgggccagacaagtagccagactgatcactcccaaattcaatattgacatattcccccgggctcttgggctctggagggtgcagcaagggctgctgctgctgctgctgctctcgggcccgaggtaaggtgctggccttgggatcccccagggacagcctcgtgggccgggccaggcggctattggtctgagcagctgtgtccacctttcgaggcagatggggctgcagaacctgatggtggggatgtggaaggctgggctccagcctagccccgcagtatcccccacccaggctgtcgctgctggtggaagaggaagaatcatctgctgttgcagcatagagaaggcgaccagagctagtggaaaggcggaggtgctgatgccgggcaccctcctccggctccccggggcgctgggtgtgcttaaaggatcttggcaatgagtagtaggagaggactggcttgtgctgggggtcctcagggccgtagtagcagtcggaggggctgctggtgttggagtcccccactggtgacatgttcatgtagtcacctgtgcaaggtaagagcttaccaccgctgctctccactgggggtttggggtgaggcaagacatgagagtggtggccccctaccccgtttgtccacagctttccatagctggtcccggaagggacggcgttgctgctgctgctgctgctgctggggccacctccaatgtcaggagagcagccaccgctgggggacatcatcatgtagccattggggtccactctctggggatggcgtctgatgggattgatgatctgctgtggggcagatacgctcttggggctcatgggcatatagtctccactgccctttcggccactgggcactggggccacccctggggacatgggcatgtagccatcatccgtgtggagggtggagctgtctgggcggtggtgccccccccgacgctccaaggggtgcatttccagaccctcctctgggtaggagcgggtgggcacgaaggcggagtgcctgtgtcccggcagtcggcctccactgccacctcctggtgggtaggcaggcatcatctctgtgtactcctcaatggaagccactgaggactgggacggggtcttctggtgggtaatggtaggggatgtgcctgccgagtgagttctctttcggaaccgattatccagatctgcagcactggctgcttcatccccagccaaggctggactcgtgcccaagcctgttcctggggtgcagcggtggccattgccaccccgagacaaaatgtagtgaccgttgggggcggtcagggtggagggccccttgccacccatgcagatatagttgcttagctcctcctcaccgcgggctggtggggtgtggcccagggaatccggagtgacactgcggaaggaactccggaaatcgcagggactggagccatactcatccgaggagatgaaaccgccatcgctgggggaaccagacaccgaagcactagatcgccgtgggaagagacaatccgaggtggagccatggccactggtgctactggacgacagactgaccgggctggtggccgaaggcgagcagcgggaagccggcatggggatggagcggctgtggttgagcggggggtgcagccgggcgctgccccgatgccggtgggcgtgggttctgttggtgctgggactcacagggctgccgtccaccgaggctgggcgggacatggtgccttcgccgtcactggaggcgcggacacggaaggagcctggcttcccgcccaccatgctggccggggaggtggcggtgatgctctcagtgcgtgatcggcgggtcagccccacctggctgggcgggggattgttgagatggtgccggcgcagggggacgctgatggggttagagcagttggacgaggactggctcttgctgcgagggcggaactcatcactcatggcccgcatggcctccaggatggtctcgtgcatgttctgggccaccacagagtcatccacctgcatccagaactccccgggccccgtcacggcagaacggcccacctcgatgaagaagaagttttccgagtggccacagcgcctgatgttcatcagctgcagcaccacggccgctgcctccgagttcagcttcacgaagctgatggtcttgctggtcaggcaaaggcggtagataccaatcaggttctttgtctgacccaggcccttgggcttcaggatcacttgccagacctctttgaatgcgggtcctgggggcacgtcaccgtagctcaagtcctccccagcctcaccaaggccggagctgccgctgcagctgcccccaccacctcccgccccgagggccgcagctccgtcgtggtggcccttagcacggttgtgcagctgtaggagagcctggtaccagctgtcttgctcggcctcgctgtccgccgcgatggcaaagtgctcgtcccgggtgtagagagccaccaggtgcttgttcttggagtcagcccgcttgttgatgttgaagcagctctcaagggggatcgagcgtttgggggcgctcgacttgtgccgccacttcttctcgttctcgtagtactcgaggcgcgccgggcccccagcctcgctggccgcgcgcagtacgaagaagcgtttgtgcatgctcttgggtttgcgcaggtagcccaccttgcgcacgtccgagaagccatcgctctccggagggctcgccatgctgccaccgccaccaccaacgctgagcagagggaggctccgaaaaacaaccgggtggggggcggaggctcctcgccgcggcccggcacatgcaaacagggctggaggcagcagaaaccccgactctgaaatccacgccgccccccgcgccggggaggggcagctgaaggaggacgcagctgctgagcccaggagagagcccgaccggagttttcgggcgcttcacgcccggcggggaggcagtgcgtccggggtgagggcagccccgatcctccgagagccaagtctcctctcagccgccgccgccaccaggaaggagcgaagatgcatctctcgtcgccccggctggagtccggcacagggaggcgacagtcgggggtccctgcggtgcccctccaggagcgcgcgcgcgcgcgcgccttccctcctgagttcccctctggaagcagcgattcccgaggcaaattaaatatccttgggcagggggaggcgggttgccaagtcccaacgttgcacggggttctccctcctccttcgcctcctcccaccccccaaccgtcccagccgccaccagccgcccaaataccagctcagtcgcagagaccgcggcgctgcggctgttgctgttgctgctgctgctgctgctgctgctgccgccgcccgcgggcgcgtcctctgcagcccccatccgggcccatctcggcgggtggagaaagtggcttttccatgcgaaacgataccgggcagccactgcagctggggaccggccggagggacagactcatccctgcccctcgctccaggcggctggggaggaggggaggggacaagggcgagaggggatgggggaggtttgggaagggttcggggaagacgcctgttcctcgggaggcgctgccgctgcagttacttctcccctcctccctcctcctcctcctcctcggagagttgccgagagccccaaccaaaacaagcggcggcgtctggctctgcgcgccggccccctccgaccgcgccgccgtctcactcggaggagaaaaacacgtgacggagcctccgcgctcggcagccgggcagccgccgccgggaggctcccgcccgggtctctacattccgggccgagcccgccccgcgcccgcccctctccgccccccagccgtgctgcagcggcgcccgcgccgaccccggcgcagcgctaggacagcgcccctgcgcggccgccagctccggcgcagcgcctccctacacgcgcgccaaccggggcgcccccggcccgcaggaatccccgcggcgggcgcaggcgggggtgtttgggtggctacccgaaagcacgaggggagtctgggaaaacgggagggggcgagctcgggaagacgcaggagtgagggtggggggccacgggggggcactgcggctacagagccccgagtgggaggccggggggaggcgggggcgccggagctgggctgcctcttacctatcaggtaagactgacccacgggagggaggtttctagtcaaggctgtttcccccaggaaatttaaaagctagatttcggcttcagggcgataggccatggtgaggggatctgtattttttaaggtttttctaaaggacttctgggccagccttccaccttgggatccccagatttgctgccgtgaggtacctggaaggaacagagggacgcccaagggcagtgactgggggcagttatggtcactacaaaaggagaacagggatccccaggaagtgtctcacgtccggcgctgtggaattagttgctgatcaagtagggagaaaatgtaaatatcaccttttctcctgctccccttgcccatccgtgtgacggggggactcacacctaaggctgagggcatgggggaggggaaatgagaggtcccttatcatattccgaagtctatccgtgactttaaaaagctgttagggaccttcagagggttcataaggccaaaaccctactgtgcaaatattggctgaaatgtttgtttcacacacagctcccacacccattgaaccaccctataagtttttaaccttgaccacaaggataacagggagaaaacaaggatggtgccagctcaactgtacaggaaaatggttacttcatgagtggaccagatcagcagcctgggtctacttgaagcgcccctttcagggtcaccttgcggtatcagtctccccacaaacaaacgctccccagagtttttttattttttaagccgacctataaacaagcagtttgtccctgcttgctcgcctggcactaaggacccacagagatgtcactcggtttaatgctgtctcattttgatgcctggcccgtttggggttgccgcccctttactacgccgggaccctcctcggcctcaggctcccaggcactgcaggatgctggctgggcactcagcagtcgaggcgctgggcatgctcagtggctgggacccggcgggccgcgggggagcgcgcctcggcccaatgcggctgaggggcggagcgagtttcccggggaggcctgctgattggtgggatggcctgtttttcaagccttgcactgcagagggaaggtgggggtagaagggttgagggtaccaaggtaggttgcaaagcgtagtaaaaaaagaaaaagaagatgatgatgatgaaggagaaaaagaaccataggcgccattcaggggtgtgcgatacgtaaattagggggattgggcatctgcagaggggctcctccccacccaagcctgggagcctctcgtttctcctctccccttcctgttcccggtcgtcatgcagcctcatctaaacctggttaatctataatttgagtacacatgttgaattgaaagccctcccttcttttcctctgacagcttggtgatgtgggcacacgtgcccactacagcaaggctattaatagcagatatttggaaatggaagcgaggcggcactcacagtgaccgaaattctgggggtatagagtgccttacagggggtagggcagggaggtgcagaataaagaagcctgaagttggtggaaaagtgtaactgtgtgcctggttttaccctagacaagaaaaaagagagattataaaagggttgtttactagtaacaatgtaatccagataaggccaaagggcttttcacaggtttgatgtttagcgctgggatgggggtagtggagtaattaacattttgtaagacaacaaatcaaatccatggacatttacttttcaaatggccctgtccctacctccgtccctccaccccccaccccccaaaaaaagctaaataaaggtactgtacctctatgggggaaaaatactcttttctggaaggaggggagggttggaaaatttatttgcacgtacctcacaattatcttcataggaaggattttgatcataaaaagctaattatgataataaaccttttaaaaaatatatctctcagtgttaaagcatttctgctttaaaaaacacaatttcagttgctaaatattcgataaaaattatgaaataagcctcactgctgtgacaaattatgttcagaccaatgggtttcctatggaagataatcactgatcataggatattagtgccattttttctacttgctgatgttttactaccaatttaaaggtggttaatatttgttataattatactacagtaaattcaattgttctctacaattgttttattaatgggctaactggaaattcatttacatttggttcatgtaatatatagaatagaaagagacgcgtttgtgggaactcactgaagtaatgctgagcaggtatgggtattattctgtcacctaagctaaattagtcttttggtgtattgtaatgaaatacactgtatgaaaaatttactccccactgaaaattcacggaacagaagaacaagctattaccaaaatctgttgctcaatgctgccatctataggagagttagagccgatttgtgtaatatgctaaggttcattttaaaagagggctaaaatagtgatttcatcacaacattgcaacagctacgttgatgtcactaatacagtcctaattcaaggagttaagggtttacatgctatggacgcactttggggcaataggtctacaactagctttaaaattgagttattggtttatgtatgatactatcaggaaaataatgcaaaatttatagattattacatatatctgtaaagtgcttgagttgggtggatgtaaaactaaacatttcaaaattataaaacactttttgtatcaaaacatatgttttccttaagatgtatgggtcataactggaggagctatttaaatactggcgtctcttagaattaattttggcaatttagaacagtgcttgaaggacaattgaatgtggattttctcactttaagatctgtttttattttaagatggctcaatagtaataagcatttgaatgcttactctgcaaggcaatatgaaatagataaaaagacagcttcttacagctttgatggggtaataagagagtacaaaataacaatagttgatgactaaaatgtgtgtgtgtgtgtgtgtgtgtgtgagagagagagagagagatgtcaaataacaagtggtatttactttcatgatggatgaaataactacttaatttttacagaagagaggagccttaagcttgaacttgaaatgggctataactcagataaatggcaattattttttcccactcaagttttttggaacacctacttgtgttaggcactaggctggacactgaggatttagatatcaaagacatgctgcccacaggaaacttacatcgaaaatggcagatgaacacaattgcagagcactatgatctcttttgtggaaaaaataggcacagggcaaatgagatcacataacaaccaactgccttctgacataaacattatcagttacagacagtgcaatttgggaatctgaaaggtgcctcttcccttaaaaactttgttttctcatgtaattaaaatctttcatctgttttatttaaaaatatataaaataggccaattaaaagagagctgaaaagtcacacttggcttgtaaatcggctagatcagggcttctcaaacccgaggatcttgttataatgcaggttctggttaaatgcagaaggtcaagggcagtctgaggcagtgcatttttaacatactctaggtgatgctgattctgctgggtaagtagcatagttctaatgactgatgattaattgaaagacaataatttggtgctgtgacatgcaagcaaggcacttatactttagtattatatacatatacagagagaacaacagcaagaaaaattctacttaactgaggcttcattgtatttgggcttctctcttttcaatcacaggcatcaaatctttctggtaagcatgaagagttattatcaaacagttgtgttagtgttttccaaggtgtgattgaaaatggagatttcttacctcatcccagtcctgctaaaccaaaatctcttagggaaggatgggccccccagcattcacagtttaagcagcattacaggagattattatttacatcaaaatttaagaatcattggcttaaacacaaagaaaaaaatgtaattttattcttccagaattggcaaatgcacagccttaaccagtcaacaaagatcttcacctgtgggctgtttactacagctgggtggagcaggcaatgacccaaacctgcatgagtctcccaatatgaattgattttcctttgaagaatatcaattactggcaatcagctagtgagaatccagttctgctctcatcttgatttcatccctcatctcttctagagaactgagggaaaataaatgcaccaagaactaacatgggattttggaaagacagtaatgccctcaacagatgatttcaaaacatttgctgtttgaggagcaaataaagcatgaaataaacaggtggatgaggttggaagaaaggagggaggtgaaaactccatgccactgtttaattctttcacttcagaaattctactgattgattggtgatttggggagtggtgaagagaatccataactgatatttgtctaaaaaacttggtcctggtccaggcatagtagcttatgcttgtaatctccgcaatttgggaggcagaagcagaaagatccttgagcccaggagttcaagtttgcagtgagctatgatcatgccaccgcactatagcctgggtgacagagtgagactttgtctctaaaaataaataaaaagacaactagctttttcttttttaattttcttgatttccttaactattatattctcattttcttgtttgataagaatcaggggtctgccagtcaatttgttatcttagacaatgccactaatgtttttggtcatttaatccagagaaagaacccccagctgttttgtttgtttgtttgtttgttttgttttgttttgaggcagagtcttattctcacccaggctggagtgcagtggcgccgtctcggctcactgcaacctccacctcccaggttgaagcaattcttctgcctcagtctcctgagtagctgggattacaggcatgccctaccacgcccaggtaatttttgtatttttagtagatacggagtttcaccatgttggccaggctagtcttgaacccctgacctcaggtaatccacccgccttggcctcccaaagtgctgggattataggcgtgtgccaccacacccaaccactgtttctcatatttgaagagccaagtgttatatctagataagcatatgcttagaaagatttgcagactttacaacaccttttgctggttttgcccccttctttatcttaaatttgtctttttggtgcagtgcactctaaactttctaaatttaaatttatatttaaaatctaaaatttgatagcccaaaaatgtcttcacagtaatccctcaacttcatttgtttattttttaatgtgaatttcagtaatgatgaatgtcccatgccctctattcagtgggcaggatctagaggtagagctagttggttttactgttggtcatattaacaaagaattgctaggtcaccatgtccctctcattcttctcacatcccctcctcaattgcaaggcaaatcatcataactttttctcagtaatgatggatattccgtgctctctattcacttggcagggtctggtggtagaactagttgatttcactaacaaagaattgctgggtcaccatggccccctcattcttcccatatcctctcctcaactgcaaggttaacgaacatctctctctctctctttcttcttcttctttttactgggtctcatcactccaaggttctttattttaagaaagaaaaaaaaaactgactagaagattaaggacattagttttctgtggattgggaagatacaagttaatttgaacttaagaaatttgtaattgcatcactacctgtggtgttgtccggtgtgactctacaagtgggcagagggttacccatatcagaatcacctgtggaattgttcaaatcaaagcttcctgtgtcccacctctgatccttctaaatcagatcctctgtaggtcaatgtgtagttcccccatttcccattcccacctccatgagttttatgtatgctaagatttgaaagccactgatcggcctatctctaaaatcctagattacaaatgaagacattaggaaatatatgcaatattaacctccagcaactgtcacaagtttggtcaatagtttttctgaaatattttactgcagtgactttaaaacttttgaccatgacctgcagtaaaaatacatttataaacacattgaacatcagtgcgcacacacacactcagactcacttacaacgaaatacaacttacccttactacctgcaatgcactcagatctttttactctttcttatctctctttctctcaatctcacactttctctttttcttttaatgctttctaagacccactaaattaatttcctagcacactaaggtgtcatgacctacagtctgaaaacaccaactttctatatgaatatttctgaattcaaaaacagaacagaacaatgatcatctctagatccttggatgcaccaccaattgaactcctaaggaggaaattcacaatgcttccaatggattcgagtttacctaagattatttttggtactaaccaagaatgattttttcactgcttttttttcttaagtggttgggcaccagtctgtccctactaagcaatgaaatctgatgcacttacagttttcatacagtggaaatctgaagacaggcaaaaggcaaattaagaacactgaatgtgattcagttactattttaaaaaatagacatttatcatcacttcccaatattatttcattgtgataattgagctaatgttgtttgctatataaagtattggaggaaaataagttagagattataaatgtatttaaaatatattcttgtaaatttgtattttatttttgcatcagttttggattggggttaaaggagaaaatagtggttttcttttataaagaagaaaaattttaaaaactgcttaccaggaatttaaattattagttttattaataacattagtttcataaaaactagataaaatgttgctattttgtatttcttaatttaccaaacataaatgtctttgattcctaggaaattaaaattttaagggctaattccccttcattcaagaaatatttactgtgatgaagacatgttccatgcagaggaaatggccaatgcaaagagcccctgactggagggcatttggcacattctaggagagtgaggaggtaagtgcagtgggagcagagtgaggaaggggagaataggaagaagcacgcttagtgaaataacagtggacacaatcataagggatcatgtaagcctttgtaaggactttggttttcgctctgggaggggaaaccactggatggtatataatacagcagtgacgtaatctgacatattttaaagacactctgggctgggcgctgtgactcaggcctgtaatcccagcactttgggaggccgaggcgggcatggtggcaggcacctgtagtcccagctactccagggggctgagtaagtagaagcacatgaaccaggcaggtagaaattgcagtgagccgacgtcacgccactgcactctagcctgggtaacagagcgagactctgtctcaaaaaaaaaaagagacactctggaagctctgttggaatagactgttggggggaggacaggggtagtggcagaagcagacctcataaaaggctactgcagaaatatgatcaagagatgatggtcattcgtaaagatggtgagaagtagtaaagttctgaatatattttgagggcagcatcagcagaatttgcaggtggtatggatgtgacatggaagaaaaagaatgtaggatgactccaaggttttttttacttgtacaactgaaaagataaaatcaccatcaactgagacaatgtatcagttttctatggctgggttaagaaactactctaaaggaataattatgaaacatcaactcttttattatgctctaggattctatgggccaggaattcagacagggcacagtgttgatggcttgtctgtgtcctggctgggatggctcaaatggttgtgggactatttgacttgaaaggctggagcctggaatcatttgaaacattgttcactcatgtgtctggcacctgcgttagaatgactgaaggctacatcaactagagtacttacatccggtctctccatgtgacttggacttttcacagcgtggaggctggatttcaaaggtgagtgtctgaagagagaccatctcgagagttaacatgccaagagggagcttctagagaggaggtgttccaagagaatcagacagaaattgtgtagccttttatgaccttacctcagaagtcagagcttcatttctactgtatgtatcctattgatcaaagtagacatgagcccacccagataaaagggcagggaacctagaccacagttcttgatggaagtagtgtcaaaaaaaaaaaaacttgtagtcattgttttaaactaccacagattgaaatactgtggctgaacaggaatggggaagatgggggaagatcaggagtttggttctagacatgctgagtttcaggtgcttattgatcctccgagtggagatatcaagtaggcatttgtgtatataaaccagagttgaaaagatgagtctgggcttaggtataaatgtaaaggttgtcagcctatgagtaggatttaaagcccatgatactggataaaatcatcaagaaagagaaagtagatagacaaaagaagaggacaaagatgccagcaagggagacagaagaacaaccagtaaagttgctctcttttaggcaggaagacaccatatcaggaaaaagagagtgaacaactgagtcaattgctgctgatggtcaagtcagaagaagacttggaattaacataagatctagcatcatgtttgtgttatgtataagatattaacattgattgcagatgcccacaatgtttatgatctgactgaattctttagtggaatcacaaaagttcaacatactcagatgtgtacagtaggttagtagagtttgtagggataattatggcaacatattttatatttcctaaataactttaacttgaaaaattcctatgaggacagagatactaaagtacagtggatgctatgtttagtctcactatgcaatttagtcttgtctctaagattagacttctaaacattcttaagattttgagaaagagagggagagagagagacactcatattaataggaaaaattgccaagatatgtcctaatttttaaaccaaatattttaaaatattttagacaaaagtttatatctaggaatctacttctagatttattagtctttactgatttaaaactttacaaaataacaaataatagctttcacctttttaaaaactattttaaaagactaatgtaaggtaatttactgcaaaagacaaatatcaataccaacacctagttttaagttggaaaatgtgaaataaaatcttatgtaaaatacatcaatacccaacaatataataataatgtaacataaaattaccatgtcattggtgggacacacaatttactaaagtgtaaaaaccataacataactcttggaatctctatagaactacaaaatatagttgatgcttgaacaatgcaggcattaggagtggcaactccacaaagttgaaaatctgcatataactttagactctccaaaaacttaacttctaatagcctaccattgaccagaaactttactgataatgcagtagattatcacatattttgtatctgcattatatactgtatttttaaaataaaataatctagagaaaagtgagtattgacggggcatggtggctcatgcctgtaatcctagcattttggaaggctgaggtgggtggaacacctaaggtcaggaattcgagatcagcctggccaacatgacaaaatcccgtctctactaaaaatataaaaattagctgggtgtggtgtcaggcacctataatctcagctacttgtgaggctgaggcaggagaatcgcttgaacccagggaggtggaagtttcagtgagccgagatcacaccacttcactccagcctgagcaaaagagcaagactccgtctcaaaaaaaaaaaaaaaaaaaaaaaaagtgaatgttaagagaatcataaggaaaagaaaatatatttactactcattaagtgaaagtggagcatcctaaagatcttcatcctcatcatttccagattgagtaggctaaggagggggaagaagaagagggcttggtcttgctgtctcagtggaggcagaggcataagaaaaacgtggataaatggatccatgcagttcaaacccctgttgttcaagggccagctgtatgcttaaacacatccctgggggttgtaaaactaatgttactgttgttttcattttgcaatttttccatcttgatataaaagcaaaagtaaagctaatctatgtacaatttattataggtcaactgagaatggcagaggactcatcccacctttgccacatggtgacttgccccactcccccaggtgaccttgctcgtgcatgtggatatttgctcagattaagaatgtttcccacaaaattgcttactctctttcattctgtccgtggttgcttgtggtttatttgttgataactgagactatttaaagattgccaaaacaaaagccatttcttttctccccgaatagcctcattttttctattccctttttcccctcctattaacatttctggggactctaaagcagagctcaagatggttcaggaccacggagagcgcaaggaaggggaactaccaaagcactttagtcatgcaggtggggaaagagatgatcctaaaattgtttttatttttctgtttttttgagagggagtctcgctctgtcacccaggctggagtgcagtagcacgatcttggctcacttcaacctccgcgtcccgggtccaagcgattctagcgcctcagcctcctgagtagctgggattacaggtgtgcaccaccatgcccagctaattttttgtatttttagtagagactgggttttgccatgttggccaggctggtctccaattcctgacctccagtgatccacccccctcagtctcccaaagtgctgggattacaggcgtgagccaccacgcccagccaatagtggaattgttgccggacaatatttatttaaaagacattattgtaaagagtaacagtgtaattctggctccttgaaatttgaggggaatgatttttctggacattcgaccagtgctttctaaatttctccactgaattctatctaatgacagatgagaggacactgaaagtaggagtagccataagtcaccagtgcaaaatgtcttttgaagtttgcatttattgattgctaccatttatgtaaagttttacagttttgacagtcatagggttcaccaatccaccatagaagagaattaagtcatgcggacacagcagggtttagaatggatgagtagaggagtgtgtgcaggctccagtccccaaagtctctaggactgtcctagaacctgcagctcatctgtcaattctgtcaactactcaggatcctctcaagaattatccccccatacccaccttttaaatttcctcaagctagtttcatttgagttttgtcacttgcaactgaatgagccctgctaatgcagatagattcaattgagaaggggaattctaggctaggagtacaaggttacaggcaaggagacaggaacatagcttgggatttcctggggcagtgagaaaactgactttaaaaaaatggaatggtttctaaaatgtttgtacaacttctctgtatggcaatggggtaggagtataaattctttcagcttcttctgagggcagctgaacaagaagtataaaaattttgaatgctgataacatttgacctagcaattccatctctagaaataaattctacagtagtaatcttaaaaacgtattcactgaaatgttattttctcatagaaaatgtcgaaacaacatatgtgtccatcaatagagaacttgctaaatgatttatactacctttacatattgaaatacgcatagccgtggaagataatttagtagatctatatgtcccattatggaacaatccccatggtggggggaaaagtaaggtgcagaactgtatcatagatgttctctctctctctctttttttttggaaagcacatgtatgcttttatatacacagaaaaattctagaatggcaaacaagatatctttgcaatagtttttttctgggaggggactcatttaaaaaaattctcccatattgcttgttttgttttgttaaagacatccatgtattcctacttgggttaagccatgataactaaatatgattaaagttcagaacaataaaaaccttagagatgtatacataaatatcacttgcttaggaatttctaggtaggtactattttaagccctctacatatattatttcattcaatccttggagcaactctaggagggaggtgttatcctctaattgcagatgaggttgatgaagcttaaagagtaatgatgccttgagtccatcctctggctccaaagcccttgtatttaactgttctcccttttgcatccctgtgctaaagtgactttgctataatatccacaaggaagaatttctgtgtaaaaattagacttccttgcaggcagtctatcagtgatatccaataaagactcaataatggctaacaatacaaaccacacacacaagaaaaacttctccttttgtgccaggtacttagattaggtgtagtggttttcttaaactgattatcaaggtaaacaccacctcatacatttcagcagagagcagtggtttctctctccagcagtgggagccattgaatcaggacaatgccacacagttgggctttcatgttagatagatcactcttgtggttttgggggatggcattataagagaggagactggagacaggggggctattgtcatgcagatttgttggatgtccacccagcattcactttttccatcttttgccaggggtacactacacaacatcaccagtcatttcatagaatggcaattagattaggcttaggtctgcactgccttccttcactccgctctgtcacttgccatcattgtaaatgctgacaacttagtgcctttcatgcttcaagtatcaataagataggaatagtaatagtatcacattgaattattgtggagttttgaacagatgatacttgtgttatcagtgctcaataaatattagctgtcctcttccttattgttgttgtcctcaactatgtattttaaatgggattagtcacacaactcctcatgtcccccacccattaatacctgactcctttgcaaaacaaagcatagcatatggtggtggggattacaaaatcgttacagaaatttcatatgtaaaaaaggggcaagagttggccagtttgacacttccttaacctattttatttttcttaaatattacagtatcaccagatatactttctatttatttcttctctgagagtatgcaatttgtctgatgtgttgcctgctgtttttgggtgagtgataaatatgagttctatatagggggtgaagaaagcattccatgagtgggactgtatgaacaatggagaaaagtcatgaaggaaagatggcattccatgtggactcgagtaaagtgaacatgatatcttgtctataagggggatcatacatttaaagcattcagcaacctgtaaccaacacaacagtctttccaagaagaagagagtatgagcttttagaggggaagaaaagtatcctcttcccttgagaagcattcagagcatctagtatcacacttgggatatagcaggcatttggtactcaattaaagaatagaatgtgattaaataactttgagggcccacatggatgactttgaatacggatcaaaagtttggacttagcttgtcagtaatgaggagcctttggtatgatcaacaggagaagtaacatagcacatctgagatatagagtaaaatggaaaccttgagcaaaggtaggctagttaggagtctgtttcaatagaccaaaggagatggagagcatgaggggctcagttagtcttgtggtggtggaaataaagaggaaaaagcaggtgcagaaaacattcagaggaggaaacaatgggctgttgaaacaaattggatatttgggacaatagcaagagaaaagtcaaagataactgggattttaatcctgagcaacgggtaggctagtgagacatctaatcactctccccgtctccttccctgaaagttaattactcacagaaaaagcattagccagaagtcagcatgtttacatcagttccttaaccctgcaagtccacattggtgatgcaggtggccaagacaggtgctgcacacactggattacagcatggaagaggagcccagggtcatggaggcacccagcaagtggcaaaatatgggcaccttgacctactgggttgcctatgtgaccagctacagaagctgctcagtatcaggagctggagctgcctgcaatctggccactcagcaagaattttcagagactgtttctattccatagtggatgctccatccaacaccattcttttaaagtgcgcacatctgatcactttccaagtataaatggcctgaatttattttcctttctttaccaaaatccaacctaagtaatttttttctttccatactccttattcatgaactctaattgttggtaactttgagagcattggtcatcttaatttcttaccactaatgacatgacaagttaatttctgcaataagaacagctaaaattatttttatatcttctaacataatattttgtcatgaatgctttcctagaatcttccttctggaatcctactttttatgtagtttggagattctcttttctaaaataaagattagcatgtaagataataaagttattatatatttcatccaaactgtaaaaatacattgaatattttacttcttaattcctctaggtaatataaaagtattttagacagttttatattgtattaattgaagcatatcaaagttgattgatttctaaagactgtgaactcaacccacataagaggaggcaaaagtaaagattagaacttgccatttctattccagtccattaattctagcttaagctatttctgataagtgtgtactctggagaaaaaaaaaatgttatttgaagagtggccactatatttgtttctggcaaaactaaagttttaaaattccagttcctcaacaaatggaagatggaattttccagttcttcaaagtatgatttttaggacttgctactaaaggttaaattttctctctctattataacatattcatggatcctttagacattaaagtaaagttggagtggaagagtagaaaataacagaatctatttattgctttaggttttcttatgaattgccccctgctctgtctctagtttgtgacatgatgctgatagcatgtctgttagtgtgtaggtgacgctgccttcagctagaagctggattcaacaacattaggctgacttgcaggctacaaagcctctgactaaggtcatcacatctggcaccagatttgatgtcaggagctgatgttcttttcaccttcttcccccatgaacttcttaacttagtatttctaaggatattatacagtggcatcgtgctgacttaggctaggcagtgacaaatttaatgttacttcacctctgccagggtgaattcaagacccatcaccgtgcccagaaacccaatagcacatttgaatattctgaactgcaaacctggttgcattaacaagaatagtatgggaatggtggcaaaaaaaaaaaaaaaaaaaaagaaaaaaaacaagttgtgcaataaattatcagtttattttctggagaaggttactttgaaggtcacaaatttcttctgtctaaggatccttggaatggtttaagaaacagcctacttatggtcaaagttaagaaatgaataatctcttaaactatgccccatatccaagactctgttgtttacagattataccaagaaaatataaaacataggtctaggccaggcacagtggctcacgcctgtaatcccagcactttggcgggccaaggtgggtggatcacctgaggttaggagtttgagaccggcctgaccaacatggtaaaaccctgtctctactaaaaatacaaaaattagctgggcatggtggcaggcacctgtaattccagctactcgggaggctgaggcaggagaatcattcgagtccaggaggcaaaggttgcagtgggcccagatagcaccactgcgccagccttggtgacagcgcaagacgccatctcaaaaaaaccacacacacacgtctaatacctttttctgagggacaacttgcattttagttcatttctcactgaagcaaaataacaatttacatttaaattgtggttttccttaaacataagaaaatgtatagttcttgaacacaccagtctattggcattttctacagctaatgcttccagtgtctaaagtggtgtgacatcatctataccaccttcattatactatttttgtcctgtgtaggtgtgcatagtgagctatatacgcctagtaatatgtttattccttgtgtttaagagcaggcaaggtcagaagttatactaattctttggggatgagttcattggtcagtgtcatcaaataacttttctgagagctaaaagttagtccagttattggcttaaccaaaatgcctagggtgttacggtaaatgattgttcagttcagtcacagacagttgatctggtaggcctagttgctggtgttctaattaatgccttatagtagtcaatcaaaaataactgggcaccgatcaggtacattacactgatactcagcagggaaccaagaggaaataacccactaaggcattagctaaatgaaaagcaaccataaactggaagctaatgaggtagacatttgtcattatgaagtatcaacctgaaactatgtaattgaacaacccaaatacacagatgagttctgaatcacccaaccaagcagggatccaaaggatcccaaattcgccctgtttaaacggagctgtctctgcctggaagaatagggaagataatagaagttaaggctggcagttaaatgacattgaagccagtatattctcaaagagagaaactccactcatgtttatgtgtgaatcatttggggattggggtgctcacgcaaagttagattcctaggatccgcatgagacctaataaataaaaaatccagcatgcacctttttaacaagctcttcagtgaattccgcagtcagtggtttacagttcacatgttgacagataccctttatggtttcacatagatccctaggtctttcctgtttgtattggtaaagtctaacttaactgcattgttaaggttatacaaaggctagtttaaaggtataggaattcagaatgatatgataatttggagggcattatttctcctattacttgtttgaatcaggagttgcaaacttctggcctgctggccagatgtggttggtccatctatagtcttttaagtggtccaaacagtatttttttttttttttttttttttttgagatggagtctcactctgtcgcccaggctggagtgcagtggcgcggtctcagctcactgcaacctccgcctcccatgttcacaccattctcctgcctcagcctcctgagtagctgggactacaggcgcccgccaccacacctggctaattttttttttggtatttttttagtagagatggggtttcactgtgttagccaggatggtcttcatctcctgacctcgtgatctgctcacctcggcctcccaaagtgctgggattacaggtgtgagccactgcacccagctcagtattttttaaattatttgccaacgttaaacattagaagatgatacagcaaaatctgaaattctagtttctctttaaaaatcagatgacctggccgggtgtggtggctcacacctgtaatcccagcactttgggaggccgaggtgggtggatcagaaggtcaggcgtttgaaaccagcctggccaacatggtgaaaccccgtctctcctaaaaatacaaaagttagccaggcgtggtggcgggcacctgtaatcctagctacttgggaggctgaggcaggagaatcgcttgaacccgggaggtggaggttgcagtgagacgagattgcgccattgcactccagcctgggcaacaagagtgagaatccatctcaaaacaaaaacaaaaacaaaaacaaaaaaacaaaaaacagatgacctgagagcactgagccatgatttctacaagacctcagtcagctagaattgaaaagcagctgcccctttcaatgtgtagttttccatagtcccatgactccagatcatttccctgacaccatggccaaatgtcaggtgccatttgtcaccacgatgcttcagatgctctcttccacccggcccacttgactcgtttatatcacctgcctatatcctctaggcacttgaatttatgacccctgtcttaagggtacttcaaaaccaattgcttttgaacagtatttgatgatgaagacagatattccacattcagacttattctgatgcattcccctgggatccacatactatgctcctgggcagaatctgggctaattcatttaaagaatgctcattaatcaaaagaaagtccaatctaactcaagtctttctaggagactacacaatttgccatgtctaattgatgtacatattttattttctattttctacagcgaaaggaaagatactgcttaagaggctgttgttttacagaaaacacagctgtttacagtcatttacaaaaatttaaccattttaaaaaccactctaaaatactcatccttgtgtaattctgatgtgtcaatgtaggttcatcaattgtaacaaatataccctctgatgggaaggctgataatgtaggaggctatgcagggggtgtatggggaatctctgtactttctgtttaattttgctgtgaacctaaaactgctcttttaaaaaaagtctcaaaaaaatttcatctgaaataaatctgaggtgcttaacagcccaagaatattcaatggtcaatattccctatgttttttctacttcataaaaaatatagtttaaaatatttcacattattgctcagtagaaccttgaaaattgaacatgctatcttttttcctaggtcaaatatgacatggcattgcaaaataagcctttcccctcattactttcactcccttgattatgtgcactaaaaacaagtctcaagaaaatccaaggtaaaaacctgttggtaaaatattaagttcaggtttaaatgtgaaaactacatattgtgtgtgttttttttttttttttttttctgaaaaaaattcaagtctctcttttagctagggcagctgaagatctgtgggtgcattcacagtaatttaggtttaggtttcaagtctctcccattttggcactgtgaatttgaactagttactttgtttctgtaaaatgagataataatccgacctcatagactcattaaaaggataaaagtagtttgatgaataaagtacacagcacacactcaataaattatagcccttattttaattagtgacagtgaatttctttctgtactgaccaaacagtatctccacaggacctaagaaaagtgctttaaaaaggaagtcataaaccctttttttggcttttcttttaagcagctttattcacccaacaaaaggaaagtgaatttcttttccatgacaacattgtttaggctaatagccagttatcacttctacctaagactccatcttgctcagtcttatatttctcaggtaaacactccaaagaattccatagagaagtaactttcttttaaaaattaacttttacaggccaggtgcagtggctcatgcctgtaatcccaaaactttgggaggctatggcggaaggatcacttgaggccaggagttcaagaccagcttgggcaacacagtgagactccatctccacaaaaaaaaaaaaaaaaaaaaaaaaagaaaaaaaaaattagccggccatggtggcatgcacctgtagtcccagctactcaggtggtaggattgcatgagccctggagtttacgccactgcactccagcctgagagacagaacaagaccctgtcactaaaaaaatttaaaaattgacttttacttttgaaagtcataccaggaaagctattaacacagatcaaaaaggggttgccagaaagttagctggtgtgtcaaagaataatgatgaagaaatggggcctgtaactgggccaggaagatgagcaaacagcatccgtggcatcagtcaaaccttccctctgttcctccaggcttctggtacccccatcctctcctgtgtctgccactcagcctcttccttttttccacccaaagcagaaaattgaatatgaatgatggcaaggttgatattatagttaacattttttgagccccctactatgttccagtcacagagctatatgctttattcaccttaactaagcttaacaaaaagccacaaagagaagaactgttgccccatttcagaagttggtcataccacccagtccttaggctagagctgggactgaagcttgggtttatctgatttcaagctacttctaaatgcaatagtgactagtactggctttttttgtttgtttgtttgttttttaagcagtgaatgaacttttaatgtttttcatattaaattaaaaaaactaatttgttctttgcttgagttagtgtccacagtcattgactttgttgtatttttttcacccctgccccctgccccatgacttactggctctcaatagctggaaatgtgtttaagttttgctctaatttttttattttaataattatttattattctataatttaggagttttatttgttcagagctgtcattacctcttatagacatcataacacaaaatatatttattaagtaattgtgagttgtatttagcttctgactacttcttggtcctgcttcttcattccaaaatatagcaaaggtgtatatttcattcttctcattttctacactataaaagttttaataaaatctatatgaattttttaaatatgaaaaattatggtgattcttatttgtatcttgaaattttacctttcctttggctcagcaactcttagttctagtcatattttaatctttttgtcatctttgatttttttctaatatgctatttacgttttactctagatcttagaatcttaaaataatctggaagagatcctcttagaaaaaatttcgtgttattatgtcatcttatagttgagaaaattaagtttcagggggtttgaatgacttactcaaggccacatagctagtggtagagctgaaaatcatatcctgtgaacttcccaattttctatgctttcttgctcattgtaagtcaaaggcattagggaaaaaaagaaaaaaacttctgttaggcccacaaatagctttatagctttatgtaacaatttttaccatagcctgttagacctatacctcccctgactcttctagtcccactctgtaatagcttgtttgttttggcttatattatattcatttgagaaattaattttacagctctgggctattatttagtcaaatgaatttaattttttggggatgcttgctcttttgcgtacattaagaaagaaatgtggccaggcacggtggctcacgcctgtaatcccagcactttgggaggccagagcgggtggatcacctaaggtcaggagtttgagatcagcctggccaacatggtgaaaccctgtctctactaaaaatacaaaaattagctgggtgtggtggtgggcacctgtaatcctagctatacaggaggctgaggcaagagaatcgcttgaactggtgggctgaggtcgcaatgagccgagatcgtgccactgcactccagcttaggcggcatagtaatattttgtctcaaaaaaaaaaaaaaaaaaagaaaataaatgtttgggtcatattggcagttcaactcaaagagtgacaatgtttgtgtccctccaaaattcatatgttgaaatttaatcctcaatgtgttgtttctaagagatgaggccttagggaagtgactaagacatgaggatggagccttgtgaatgagtttagtgcccttctaaagaggcctgaggggccaggcgcggaggcttacaactataattccagcattttgggaggttggggcgggtagatcacttgaggtcaggagtttgagatcagcctcgtcaacatggcaaaaccccttatctactaaaaatacaaaaattagctgggcatggtggtgtgtgcctgtcatcccagctacctggaaggctgaggcaggagaatcacttgaacccgggaggcagaggttgcagtgagccaagaagactgcaccactgcactccagcctgggtgacaatgagattacgtctcaaaataaaagaaccctgagggggcttgtttgcctctttttgtcctgctgctatgtgaggatgcaggaaggagtcaccatctgtaatgcagagagcccttgccagataccaaatctgtcagtctcttgatcttggacttctcagcttccagaaccatgagcaatcaatttctgttgtttataaaccacctagtctaatgcattttgttataaaagtccaaatggattaagacacagtcaatttgcactgtttcttaaaattctagattgtattctgcttaatatttggatgtatagtctagattagctgtcagcatttcctaataactaagtcccatggcacttgaatactgccaacttaaaatggataaaatggtgcactagacttaccctggaaatttatgaataatatatttttcttaaaagaaatccttgtttttataaggaaatgcatactgcagcaaaggggcatcttatctgcaatgtacatgaaaacaattcagaaaaaaatgtggatagatagatacacctatcttagtccaatttatgctgctataatagaataacacatactgggtaatttatgatcaacagatatttgggcaatttataatgaactgacatttatttgactcatggttctggaggctgggaagtccaagttcaagggactaaatcttctgatggccttcgtgctggatcataaatcatggaagacatcacatgggcaagagacggcaagatggggctgagctcgattctataacaaacccattcccacaataaccacactaatgtattcatgaaggcagacagcccctcatgattgaatcacaccccagtaggccccacctcccaacgctgttgcattggggattaaggttctaacacaagacctttggggaaaacatacaaaccacagtaatacttatcagaattataattgatatacctacatacacgttttttctctctctatatatatatccatatacacacattatatacatataaactacataaacattttatatatactatatatacacacatatgagagagaatatgataaagcaaatgttaacatttaagacatttgaagaatacacaagaattctctgtactatttttgcaacttttctatacatctgcatttatttctaagtaaatttgaagaaacaattggcagcattaaaacttgtaggattggacatccacttaaagactagcatcctcaaaacttaagaaaaaaaaattaaattgtaaaaaaatcttttccacttatatatatctaacattctcaggtaagagacagcctttacttaattagctctcaaagaacaaattccctgggaaagaaaggattgagttaagtcagttgtgttacattaaaacagaaaaggaagaaatctaaattatgtaaagtggagctatctgtgattgtatgggatgtcaaaaattgcccccactccttgcttcaacccacagcttctattttccaagccctatggtagtaatttggctagaatcttagcaatacttctacaaatttttcaactgtgtcttttgtcccaggctcccttcacccaagatcttctgcctctggcccccttcagtcaccatcagggctgaacagattgacctttaattgaaattcatcctgccttgtatacatggtatgtctaattgtggatgtaaaggcctttttgaagcaaattttaatcattagtaagcagtggcagagatacagctgtgtttatgaggttatggatgtgcatacatgtgcgcaaaggaggtcctaaaaccactttcagactacaggcacactggaaagctaagccaaaatgcctaagaatcatctgctactgttattatcacagactgatttcccacattttgatgcaagttcatttttggacatttatttcctagcagaacattcatagcttctccttttctaaaagttcattatctacattagtttttcatcaagcacatacacagcactcatgaaatattttgccagaatttaggaggggtggtttagaaagtctcctacgaggtctccaatggcacacagagaatgtgatttgacagctgtggtgaaatttttcattataatcatggaagcatcagaattttagttggttaaaaaaaagcagaagtggcggttgcagatgtaaaaaaaaattaaaaggaatgtttattaaaataaactccttatttaagatttactatttgaaggaaacaagaactctcaaacaatattctactattatcctgtgaccataagaacaattggacagctgtaaaccaaatttaatttttagaaaatactcataatgagttaaaataagattaagaaagatctatctaaaacactcaatagataaatacttcctaaaatagaaaaatgtagaaaactggaaaggaatacatcattcaaaataattctgaaatagacagtaaatggctattttcattttgatagtttagatagttaataaaacaatggaaacaatgcaaacatgcacgagtaaaaacaaaattagcttttatgtggaccaatgatgcatccaaggtcacccactactagacatttaatgttcagaagcagaaataatgtattagaaagaaaggtgaaatcatgaatccctttgcccactagctacatgagctttggcaaattacttagactttctgacgctctgtctcctcatttgtaaaatggagacgaagtgcctcacatgcagcagtcactcgaaaaatggtcactattattattaagaaaataacagttatcgggtatcgagagtttattgtgtgccaggcactttgataaaagctctaaatggattatcgtttttagctagtaggggttacactgctggttaacagtgagctcttacaggatgttagatagaggagtgataaaattttaaaatctaaaataataatgagttgtaacaaaatcaaggagatctggcttatttatctacttcttaggaaaacatgtagacgatgcatgagtagagaatgaggtttcattggtttaacaccccaaaataggaaatagaatgatctatttatgtgagattagaaatcagggaatggctgatctagaggcaggagtttaagcattaaaattttaagtattaaaacacttgcagtgtaacacaaattattttattgttatttcagctcttctcagttccgttagattaattgagagttgattagtgaaaattgatatgcaattataataatgaccataaatatgtcaggataattaaccttggcatgtctacttgcaaatgcattgctcctatttgtagttttggtaacaacttattactgacaggattctcctggctgtagaacaatcatgatagatttttttttttttttttttttgagacagagtctcgctctgttgcccaggctggagtgcagtggcacaatctcggctcactgcaacctccacctcctgggttcaagcaattctcctgcctcagcctcctaagtagctaggactacaggcaggagccaccacacccagctaattttttgtacttttagtagagacggggtttcaccacgttagccaggatgatctcaatctcctgacctcatgatctgcctgcctcggcctcccacagtgctgggattacaggcatgagccaccacacccagcctgatagattcttaattgtacattcttcttttacaccagtgaaaaaccacttgagttctaaagcacacatttctgtataaagagtcaaagaaaagatcattataagaatttctaagacatgttaatagattacatttaaaaaattttttattattatttcttaagacagtgtcactattgcccaggatggagtgcagtggagtgatcatggctcactgtggcctcggcctcctgggctcaagcaattctcccacctcagcctcttagtagctgggaccacaggtgcataccaccatgtcaggctactttttgtatatatatatttttgtagagacagggttttgccatattttccgggctggtctcaaactcctgagcttaaacgatccacctgccttggcctcccaaagtgctgagatgacaggcatgagccactgtgctcagcctaatggtgtttttaaaagtaagatttaatattctccatattttacacccataatctacagataacctttccattatcccaaataaattatctactccatgtagtccagtgtccacattgtaatgctcacacaccaagaatattgcacatgatggcatacttatgcctcttattccttactgttgatcaaaatgataccctgctaaaatactacataaaacatacattaccataatgattcctcaaaatattgttctcacttcgcctttttgttttgtttttgtttggcctggaatgctgttccatttaactcagtaagtccagtcccacccatttacacattaagtattgaaatgccagctctacaaagtattctcccatctctccagctctagtcaatgtcttcatcccataaactcccaagttaatttcaacttcacttaaagcagatagctgtttctatctggtttcattgatagtaatgtagattcccttggtttctttacaaggctagaagctcttagagtgtgagatccacatgtgatggttatccttcatcaaaagaataatttcttgagcatagcatgtggatgggtagggcctgggtagaacttccatggtcagtctttactaggccttggacataagtgaccatacgtgtacagactggttatcttctttaaatagctttgttaatgtggaatttacatagcaaaaaattcgtgcattatttatgtatagtttgtgatttttaataaatttatagtgttaataaatttataggcaaccatcatcactatccagttttagcacatttccatcattccaaaaagttttctcatgctaatttagagctaacctgctcccactcctggccctaagcaactatgggtctgttttctgtttctgtagatttgccttttccagacatttcatgtaaatggaatcacactatatgtagacttttgggtttgatttctctcaactaacataatgtttttgaggctcatccgtgttataggatgaatcagtagttttttttcgttgcttaatcattaacagttgagcatttggattgtttacagttttgcctattatgaataatgctgtcataaaattagcatgcaactcttttgtggacatatgtttcatttctcttgggtagattcctaagagtgaaattgctgggttgtatagtaagtgtatgtttaactttctaaaaaactgcataactattttccaaagtggccacaccactttataatcccatcaacaatgtatgagcatcacagtttctccacattcttgccctaattccatcttttttattatagtaacttaagggaatgtgcagtcgtttctcattgtggtgttaatttgcattttccaaatgactaatgatgctgagaatattttcatatgtttattactcatatatcttctttgatgaagaatatattcaaatcttttgcccactttttaactgaattgttttctacttgactggtaagagtaatctaaatattccagaggaaaatcctctattagatacaatatttgcaaatattttcttccaatctctatcatgattttcattttcttaatgatgtcttttaagtatattttttaaattttgaggtccaatttatcaattttttcttttgtggattgtacttttcctgtcatatgtagaagtctttgcctaatctaagatgacaaagattttcttttgtgattttttctagaaattttatagttttagctgttacatttaagcctatgatccctttggagttaattgttgtgcattgtgtgggcccaagttcatagtttttttcagacatccaactctgccagcattctttgttgaaagactatcctttccccattaaattgccttagcaattttgttgaaaatcaactgaccacatagggggttatttcagttctattctgttgatctttatgcctattcttacaccaatagcacactgtcacgattactataactttataacacattttgaaattaagtagtataattcctccaactttattcttctttttcaaaactgttttggccattctagttcttttattctagattatagggaccagcttgtgaagtgtgtaccccaaaaaagcctgctgaaattttgagggattgtgtattgaatgtataggttaatttaagaaggagtgtcatttgaacaatattgaggcttccattctatgaatgtgaaatgtcaatttatctcagccccattaagtatttttcagtgtacaagccttacacttcttttattaatttgattctaatattcctaagtattttattctttcgatgctacctggaatgaaattgttttctcaattttattttcagactgctaatttgtggtgtagagaaatatgtttttcaaaaaattttgtatcctgagactgtgctaaacttattaattttagtagttttatctgtgtgcgtgtgtatgtatgtgtgtattttccttaagattttctacatatcaggtgatctgtgaatagagtttcactttttcctattcaatttgatgccttttatttcgtttcctttattacactagctgaaacctccagtacaacataagtgatgacagcagacgttcttttcttgtttctaatctcaggggaaaagcttttggtggtttatgttaactatgatattgactgtaggtttttttttttatagatgccctttattattactagattgagggagttcccttccattcctacttcccggagagcttttatcataaatatgtgttggatttagaacagtgcttttctacatctatggagatgatggtctgaatgtttgtgttgctccaaaattcttatgttcaaattctaatctccaaggtgatgttattaggatgtggagcctttgggaaggaattaggtcatgaggacaaaactctcatgaatgagatcgtgcccttataagagaccccagagagctagttctcctttccaccatgtaaggacacagcaagagggtgctgtctatgaggaagcaggcactcatcaatctgcccatgatgctttgtcaactttccagcctccagaactgagacataaatttctgttgcttacaagccactcgatttatggaacttttgttatagcagctcaaacagactaagacagatgaccatgtggtttttgtcctctagcttattaatatggtgttttatattaattttttgctaagagggtcttgctatgtggcctagtctggagtgcagtggctattcaaagatgcaatcatagcccactagaccctcagactcttgggctcacgtgatcctcctgcttcagcgtcctgagtagctggacctacaggtgcataccacagtgccagatataaacttttttttatttttcaagagatggggtctccctttgtgacttaggctggactgcagtggcacaatcacagctcgctattccttgaactactgagctcaagtgatccccccgcctcagcctcctgagtagctgggactacaggtgtgtgccactgtgcctgccttatttaatttgttgtatagataggatctcaccatcttgcccaagctggtctcaaatttctgggctcaagcactttcttaccttggcctcccaaagtgctgggattacgggtgtgagccactgcacctggccttttttgatggaaagccaaacttgcattcatggtatatgatctatccttcatacatattgccatatttggtttgctaatacttcattgggaatttttgtacattcacaagggatgctgatcttgtaatgtctttgtctgaatttgttatcagggtaataacatcctcacagagtaagtggagaactgttctattttcagaaagtttgtgtatgatggtataatttcttccttaaatatttgatggattgacatcagtgaatccatctagacctgggcttctctttgtgggaagattttctttgtggaaagtattaaatttccgtacttgttacatgtctgttatgggttgaactgtgtcatccaaaaagatgtgttgaagccctaacccccagtaccttagaatacgttatttcaaaagagggtcattgcagatgtaattcattaagatgaggtcacactggagtaggctgggcacttcagcctctaggagacaggcacgtgagggaacagcacatgtggagatgcaggcagagactgaagtgctgcagttgtaaaaccaaggagcaccaagaaaggccaaggattgctgaaaacaccagcagtgggaaagagacaagaattctctcttccaggtttcagagggagcagagccctgccaacactttgatcgagcttcatgtctctagaacatgagataataaatttctgttgtcttaagccacctagtttataatacttttttttttttttacaaccaccatagaaaataaagtctttttggattttctattgagccagttttggcaatttgtgtctgtctaggaatttgtccaattcatctgcattgtctaatttattggcacaacgttatttacagtctcttacaatccttttaatttgggttggtagtgatgtacctgttttgattcctaattttggtctttttaattttttggccagtttaatgttggctcattaattttactggtttttttttttttctaaaaaacaaacttttgattttcattttctctatttttgttacttattttattgatttgcaatatgatcattatttcctccctttgctaaaggtttacgttcctcctctttttctagttttcaaggtggaagtgtagatttgagactctttttcttggtgtttaaaggactaaatacccttttgatcactgttttagctgcagtgcatgacttcaatatgttttcactttcattcatttcaaaatactttctaatttcctttagtacttcttccttggcccatgagtaatctaatttccaaacatctggggattttccaaatttctttctattgtcaatccctaatttaattccactgtaactggagaatgtactttgtatgatcccaattcttttaaatttactgagacttatttatggtctaacataaggctatcctggagagtatactttttaaaaagaacataaattcagctgtcattaagtacagtggtctgtacatgttggttaggttgagagtcttgttcaagccttctatatacttagtgattttctgcctggttgttctacacattattgtgagtaggatactgaaatatcaaactactgttgtttgtatatttctctgttcaattcaatcatttttgcttcatgaatttagggctctgttactgggtgcatatacatttataactgttatatcttctcaatgtattgaccctcttatcagtatggaatttctgtctctaaaaatatttcttgtcagccagacgcgctggcctgtaatcccatttgggaggccgagacaggtggatcacatcaggtcaggagtttgagatcagcctggctgacatggtgaaaccccatctctactaaaaaaatacaaaaaattagccaggcatggtggcgggcacctgtaatcccagctacttgggaagctgaggcaggagaattgcttgaacccgggaggcagaggttgcagtgagccaagattgtgccattgcacttcaaaaaaaagaaaaaagaaaaagaaatttctttcttaaagtctgtttcatctgatattagtatagccactacaaatctcttatggttagtgtctgcatagtctactgttaagtattgttggtattattatcactatggtacatgaaccaatttctcatttttacagttcttaaattgagatttgaattatttaatttgcaagcttttccataactagaaagctataaattatcttatcagttttacacatattttggtacagttttgggtaaaacagtaatcaatacttggttcattaaaagcaattagaaacccaaacaagcttctcccttaaaaagataatccagttgtgtatttgttgcacgctgtcgttgcatggtattgttgcctgacgtcctctcactttcaggctgggttctgaaatctgagaatgacacttgtctaccttcctgccagtcctggatttgtgaactgtacaagggttgttaccaccactcctccgcttatgtgcaagcaccacatcttaaaaacactcatttaagtcgggtggcttaatcataggtattgctgcttttcctgtaaaccttagataaaagttaaaatttattttataccattcaatgtctcacatattatgcacaatgtgcatagtgctgcctcgtctcatgattaagatatatactttccagcatttagaaatcattgttttatatggtaatgtagtgattacgtatattttaagttaaagaatttcttctggcactgattctttggtatttttaagccttgctcagtgaaaggatgctgctgctgattgcttcatatgttcatatttaagatatacaattattatccaagtgatatttgtcaattgaaatgggatatgagcatgttacaacatgctcatttcaacagaaacttttaaaaaacccagtctgctcaacaaatcacgtaggacaaaagagaaggtcattttttaaaaggtagatatttttttctatctgttaaatgtcttttaccccttaaatgtctatgaaaattttcactgatatttgaaacagaacataattacctaagaatattcttaatccgtatatatttcttacattttaacgaaattattgaattgagacttcttgatttgtggctcccttaaaatcacctctgcatttgatgtattatacggacaagaaaatgatgcaattatagaaagatgtagagagtgatggagaatagaagataagattaatattaattgaatggattcatatgattgtggttcagaaggataaatgaggacttcttccttttgagaaattacacatttccccctctagggaaatacagaaaatacctctataggcaatttacttttccccgcattcatttgacttttcatgtccagaaatgcagtttctcattgtcagttgagcttttggaggagtatattgtttttctaggaaagaggtaacttatgagtcttaatgaacacgtacaatttgctaagaatcttctttgtcacttgaaagtcatatgtacacccacacctatgcatgagccacattttcacttaaatttcaaactccaaaataaatatttctatgaagagttttaatacacaatggcaaaagataaactcttctggtttaggcagtttttgttttagcagactatctaaacacagctgctacaacttccaataaacaaagagtaacactaaaccacctgtattcggatactcggattccttcttggaaaaagagcatctttaccctagctatcagaaaattccataccaaatagtaagattttttttttttgagatagagtcatgctctgtcgcccaggctggagtgcatggacgcgatctcactgcaacctctgcctcccgggttcaaggattcccctgcctcagcctcccgagtagccgggattacaggcgcccgcaaccatgcctggctaatttttgtatttttagtagagacagggtttcgccatgttggccaggctggttttgaattcctgacctccggtgatccgcccgccttagcctcccaaagtgctgggattacaggcgtgggccaccgcgccaggcctgttgttgttttttaaatagagacaaggtctcactatgttgtccaggctggtctcaaactcctgagctcaagcgatcctcctgcctcgacctcccaaagtgcggggattacaggcgtgagttaccgcgcccggctgtaagatagttttttcatatcctattaaatatatatagcattgcaacatttaacttagcctaactcctacagctaaacataaaacttgctcccgagtagcaaacaattaaaatggtatcaaattatgtattaatcgaaattctattaactgaaatatgaaacacctaaagccctcaaaatgggcaaacgttgcgtggtgcagtcccagacccaagcttctgggagtgaaaggtgcacccgcgaccttgccttgctggctggctctgggactctgcgataagccgccctccggttgtctgcgatagctcctgaagcaggagagtgtctttcccaccctccgcctaacaggcggtatctgacccttccaggcagcagctccccagcctccggctgcgctggggcccggaaggacgaagcttcccggcagagaacctgggcagaggcgtccgttgggtaggcggccgcgacccgctcgctgcttctcccctagtcttcgggtcccttgaacgcaggtcgcttgtttgccttacgcgtagtcagcggccagtggctatttatggcagtaaggaatattatccacatttcacatggagcttagaggacagggcgagggtccacactctccttactgcgctctgccgcggtcctgccccgctgtgccctcgcggcccccttagagccactgccggcgcacgcggtctgcagacagcagagcgcgggcgcgcacaactaagcatgcgccgcggccgagccgtccgctttaaggccctcccctcccgcacccggccccaggaacccggggcgccccggatcgggaacgtgcgtgatgacgcacgtgcgcgcgaagacgtggggacgcaggcgggtcgtagagagcgtgagtttccgcgtctgtttggtccggctgctgtcgttggttgtgagcggcatctctcgccgtttccccgggctgcgggagctggcggccgggctggggctgctgggcggaggtcggcgcctcccggggggctagggcgagggaggcatggcggggctggaggcacagcctccccgtccggggcaagtccgagagcggggagggcgtttcctggggtaactccacctggggtcttgtcgaagttgccgcatctccgccggaccgcacgggaacgacgtgcccacactcggaggaaggggttggcgctgagcgagtttaaagggttccttttgaaagcaggaagtttgaagtgacgttgcatcagcaacagagcatgcagtttcaggtgctctcgggacagctttcagtttctcagaacaagtctaagcctcaccgcagtaataacttttattagaggacaaaaaatccgccaaagtaaaccctttctgtccaacccctaaaaacctttggataaacgtttacaagaaacggatcacagccttatttgtttttctaaactgagcataaactcttttgaagactcagcgttactgtcaaaatgaatgagtgcctgcctagttatgattcaattatcgaggtgtttgggtctctgcagtacactcagtgactcccaggcttttcttttttctctttgaaattgcttattagaaggctttatctaatttctcacagttgtgtgtctttttgaggtagttctaataaactttaaaggcttctggtttgctgcaggcctgccgtcgctgtggaaagcaagtattctttcaaagaagaatagaagtgcattggtttctaaataatcccaggacgctaggatcagcatcacttgggaacttcttggaaatgcacattttggggtcttatcccaaacttactgaatcagaaatatattttaacaagccttccagttgataccaatgcacctggacgctaaagtttgagaattaatggcgtagtgataacacccattgtggaatcacatataatggaatttgaattgaagtaattcctagatggaaaaacttggacatgttacctcacagggctggaatatgaagatgcaagaaaaatgtttaacacaaaacacatagaaaaccctcaaagatgttattaagtaacttattagaactgcataaaataagtacatagtttgtgctggaaggattcttcagcggggtagatatgagctgtagcgcatggatattgggactgctgcttagagggtattttgtttacctcgggattctcaattctgtgtagtcaaggttgttggatgcaggatattcagttaaaagttaaagcagtgcatactaatgctattgtggttgtaggatttttaagaatagcattagtatttatgttgaagagtagtttttaattctttggccttctgatctcttcagctttgtttggagacagtctctttctgccacccaggctggagtgcaatggtgcaatcttggatcactgtaaccgctgcctccagggttcaaacgattctcctgcctcagcttcccaggtagctgggattacaggcgtctgccaccacgcccagctaatttttgtatttttagtagagacggtttcaccacgtttgccaagctggtcccgaactcctgacctcaggtaatccacctgcctcgtcttcagtttagttataccttctttgacccagaatttggtaaagaccagaggtaagcactagttttagagttgagaattattgtaacatagtgacttgcaagcgaaagccaaggctgaatatgtttctgtccttatctttgtttcccatatgtcgtacaactccacggtagcaaagatctcatgtctactctagatacctccattttcaggaaggatcacaggagtgccctcaacctgctgtgttttttagatgcagtattttcttacaactttatctctttcaggggtccattgtagggggagaaagaaatattcaggatttaaagcagctgctctaaaggctacattcactgcaatgttgagaaggtcagtgccaaaccgtggcctacacatgtcgttttgatgagagcacgctgctcccaaggctataccatggctcctggatattgagagagttttcagataaacataagtcactttgaatggattattctggaaataatttcgttagctctgccaccaaattggcactgccccatcatgaaatgtttatttttcgaaggcattaaatatttttttttgttctcctcatcggagaggcagatcgctatctgtggttttaggtcagacaagccctgctctgaatcttgcctctgctacttagtgattgtgtacattagacaaattaacatcctccccacttgaatttctgtaaagtaggagtcataggatgtgctacttcaggccattgaattaaatgaaataacgcataaaacacgtccaccttgttttaggcacagaggctcagtaaatgttgtgtgtcggacaaagggaaaaaaggtatttgttgtctcaaacctaactttatgccattcattttataatatttttataaatgaggtaattttattacctaactgcactgcttttctttttaaccataaaatgctgaaatggagtcaaagctttcatattattgtgaatgagaaaaaacaaacacttgaaaaaagttgaaactttaacgtgaaaaaacaccatcttcagttttatcactgtaacagagcaacttgtagaaattgttttggatgtttacagcaaggtaaacatccaaaggtcaggggatgagtaataaagtatcttctgttagttaatggggacagtcagctagagaaggggacactgttacaggaaatgagacctcgttgaaggtatgcatcaaaggatgagaaaatgctgttagccctgaaattgctaatatttttttaaaacacgaattcttaatagcaaagtgaaaagttttacattacattttttaataagggataacaaaatctcttacatgtatttctgtgtgtttatattgtatatgaatgtatgagtgcagaaaatacttgactcacactaggtcataattttatttgtcagtatattggaatatgggggtggggaccaagtataaaaggaaattttctatatatgtaaaattagatacgtacatgtatatgtaaatgttctttaaaaaaactattaaaaacggaagcgattctttaaaaggtagatttccttttatgttgcagtcatagccacgtaagcaatggacctcatattttttttcaacagggagcctcttaaacagaatcttacctgtaaaactcaggagccgagaagctttaagaacagtgaggttgaagggcacaggctcttggtccttggcagcgatattaggaggcgtgcctagggaacctcggattccggggagctggacgtgaaactctgtggtggaatagaaatcctcagggcatgagctatacctaaaacgtaatggtattaagaattctggtaagtgggattcacaaacttgttctgaagacaatttccaaggttgtcagccatgtcaccatatggatggcttctcatgcagaggagtgagtgattattgagaaaaaaaaaaacccacctgacccgtattttacaaagtaggattctgtgcacttttttgaggaattagctttttaaaaaatccctccaagttgtgacagctgtatcgctattaaaagctatttggcattttaactgactgttgtttaggattacaaatgactcggggaaaaagaaacaaggagtcaaaggaagtgtattacttgtgtttatagccctatcatttttttgttgtatggaagcaactactctatatttatatagtaaagtgtttttttagagttaatttttagttaataatgagccttcataagaaaaataatttcaaatgctaagtatttgttagattgttactaatagtggtagttagtgatattacattgtctttttcacacattgaagagggtttcctggtgacagctggagcttgggggagggggagttactttcaatcaaccagctgctttgtggcaatatcatgatggtgatatttcaaagcccatagataactttggctgtttcaggaaagaaaatctatcaaatttctgggaagcaacagataatgggcaagagacctttgggatctacgtgatggccaactaacaatgtgtgcattccggtttgcatgttggggttatttaccatctagtttcttggacattgttacatgcacctcataattacacagtaatagaatctagctctaagggcaggaaaatctcattaaggagaggaaaggagagtgaaaaaccttggtgatgcactgcacgctttaacataataccctatttcatttattcttgatggtgattctagaatgtaagtggaattttttgccatctatggataaagaaacagaagctctacagtactggttgtatgatttgcccaaggccacatactagtacatgatggcctccatatttgaccccagatcttctggcattagctctaggaatgttgtcattacaccaacagctgtttctccaggtgttaacttgcttatgcatttttaatgcaaagtcacaatatcaggatagtaatgaatgaaataaatataaatgttacttacaatgacttcagttttataaataatatataggggtgtgtgtgtggacttgtgtgtatgtgtgttttggcaactacatataatttgggttttttttttcttaagtaaaaagtctcttgggcaatactgtgaaaaaaatttcactacgttttttaaaaatatattactgataccagcaatattgcaattatgtgtgttgcaatgaatcagttgtgattctaaatttgaacaaacctaggaatgaattttgtgcatactgcccatgtagtcgccctcatcctaacatattgaaggaaatttcttgtttttttctttcaaggcgtattcatttttcattcatttatttattttttttgagacagagtctcactctgttacctagattggagtgcagtggtgtgatcttgactcactgcagccgggacctcctgggctcagttgatcctcccacctcagcctccctagtagctgggactacagacatgtgccaccacacccagctaatttttttttcttcagcttttaagttcaagggtacgtgtgtaggatgtgcaggtttgttacataggtaaacatgtgccatggtggtttgctgcacagatcatcctgtcacctaggtattaagccccacatccattagctattgttcctccctgcctaccacacctccctgacaggccccagtgtgtggtggctccctgctctgtgtccatgtgttctcatcatttagctcccagttataagtgagaacatgcagtgtttggttttctgttcccatgtcagtttgctgaggataatggcttctagctttatccatgtccctgcaaaggacatgatttcattcctttgtgtggctgcataatatttcatatgtaccacatcttctttatccatctatcattgatgggcatttaggtcaattccatgtttttgctattgtgaatagtgccacatttaacatatgcatgcatgtatctttataatagaatgatttctattcctttgggtatatacccagtaatggcaatgctgggtctaatggtatttctacctctaggtctttgaggaatcgccagtctgtcttacacagtggttgaactaacttatacttccaccaacagtgtagtagcattctgttttccctgcaacctcgccagcatgtgttgttttttgactttttaataatagccattctgactggcatgagatagtatctcattgtggttttgatttgcatttctctaatgatcagtgatgttgagctttttttcatatgtttcatggctgcatgtatgttttcttttgagaagtgtctgttcatgtcctttgcccactttttaatggggttgtttttttctcctaaatttaagttccttgtagactgtggatattaaacctttgtcagatggatagactgtaaaaattttctcccattctgtaggttgtctgttcactctaatgatagtctcttttgctgtgcagaagctctttagtttaatcaggtcccatttgtcaatttttgcttttgttgcaattgcttttggtgttttcatcatgaaatctttgcccatacctatgtcctgaatggtattacctagattttcttctaggatttttatagttttgggtttgacatttaagtctttaattcattgtgagttaatttttgtatgtaatataaggggtctagtttcagttttctgcatatggctacccatttctcccagcaccatttattaaatagggaatcctttctctatttcttgttttggccaggtttgtcaaagatcaagttgttgtagttgtgtggtctcgtttctgagttctctattttgttccatctgtctatgtatctgttcttgtaccagtaccatgctgttttcgttactgtagccttttagtatagtttgaagtctggtagtgtgatgcctccaactttgttctttttgctaagaattgttttggctacttgggctctttttgattccataaaatagttttatctaaatctgcgaacaatgtcaatgaaagtttaatgggaatagcattaaatctataaattactttgggcagtatggccgttttcatgatattgattctctctgttcatgagcatggaatgtttttccatttgtgtcctctctaatttctttgaacagtggtttgtagttctccttgaagaggtctttcacttcccttgttggcggtattcctaggtattttattctttttgtagcagttgtgaatgggagttcatttatgatttggctttctgcttgccggtgttggtgtataggaatgctagcaatttttgcacattgattttgtatcctgagactttgctgaagttgcttatcagcttaagaagcttttgggctgacacaatggggttttctagatataggatcatgtcatctgcaaacagataatttcacttcctctcttcctatttgaatacactttatttctttctcttgcctgattgcactggccagaacttccaatactgtgttgaataggagtggtgggagagggcatccttgtcttgtgctggttttcaaggggaatgcttctagcttttgcccattcaatatgatattggctgtgggtttgtcatatatggctcttattattttgaggtaagtgcctttaatccctagtttattgagagtttttaacatgaagggatgttgaattttatcgaaggccttttctgcatcagttgagatactcatgtggtttttgtctttagttctgcttatgtgatgaatcacatttattaatttgtatatgttgaaccaacctggcaccccgggatgaagccaacttgatcgtggtagataagttttttgatgtgctggtggatgcagtttgccagtattttgttgaggatttttgccttgaggttcatcaaggatattggcctgaatttttctttttgttgttgtatctcttgccaggttttggtatcagcataatgctggcttcatagaaggagttggggaggagtcattccttttcaattgtttggaatagtttcagcaggaatgatacctgctcttctttgtaccctggtagatagaattcagctgtgaatccatctggtcctgggctttttttggttggtaggctatttgttactgtctcaatttcagaactcatttattagtctattcagggattcaatttcttcctggttcagtcttgggagggtgtatgagtccaggaatttagccatttcttctagattttctggtttatgtgcataaaggtcagcagctaagtgagctcttgaggtttggggagacttggtagatctggaaaactcttcaaattaatgctgtgagaaccagcttcaaaagttgttggtcacatagtttctcagcacaacttttaaattccagggaaatagttattattccaactttggtcactatcaccttggatcagtattggaaatggcacccttgattgatagctgccccccgccccccggccccttgccaaagaccgcatccaatgggagtgggagacagattcctgttactgaaagaatgaagtattgatgctatgcaggcaaaaagccctaagctgttccctatcacttaataatttgtggacatcccatgtggtttgtggtaatataacatatatttgaagcatggcatgcttttcccccttttcactagttgttgtgcagggaagacttgagttacataaataattcacaaacacttcttacacagattaatttaaatgagagcagggagtggtggtagctctcattttttcattgactttaggtagacaaagaaatctggtgcagagtaaacctgaatatggaactacttaaatcctgttgaaggagcgatcatgggacgctggcattgctgttccctgtgtgcctcctggtttaaaaacctaggtctgaagggctgtcagttggagaactttaatgagccctcattacactaaaccgtgtggtttatgagagaagaaactggcttatgattgatactggaaatcataaatggtgatgggtcagaattggagttggcactaattcacctagcagtggagcaaaatttaagattatatacaaaatctggtaatttcattttttagccattattttttatgtataaatatagtctaatcattttcatttatactatataacacttttaaaaggtggagaaagaattttgccagctgatgctgacattttttttttcttcctaaaatggaggcttattaaattctcaaatcatcagataatcttgacagagatcctggtttgagattttacataaagtttattttaatgaaaaacataatttctgctttcaggtttcttctctatatttgttatactttttaaaaaatgcatgtgtaatttaatcacactatgcagttttaaaatgtagggtcacagaaagtcatggaaaatgctaattagttactatgttatcacaaaaacattttaaaactattttaagtctgatttgtcacaatttgtgattttgtgtaataaatatatatacatatataatcccatttaatccttgtgaaaccaaatgagcctatgttatcttttacaagtgaaactctgaaggttaactttcctaagagcacgtggctggtgtatcgtagagccaaggaccatgcccttaactgctgtcctatgctgcatatgttaatattgccacccttgtatataattttggcaaaaagcactgggacatttcttttcccaaagcccatctctttactttcagttccctgacaacttctttatattctgaaactgttaaaatgtgttgtattatccatcatcttgtgcttctgtttgttgggaatgtggcaacagctcctgtattgcagcagtgtgccctgtgaagccatttgttctttatgtcttagagcagcctgacagcctttcgtgttaaattcagcaagattgcttttcatttaacaaagctgaatgttgctttctaggtgaaaaataattaaatgcttttaaagatatatttgattaacaggaagctgatctgtgtaaattaattataaccataatgatgtcatagccttgtcttttgttattagccaggtaattgaccagaagtttagaagcttattgtaactgacagttagtagtttgaccttgtgtgctgtctgaaagtgaaacatgcacaatgaatgtaaatgcaatttgttcattgagctgcatgtgctgtcagaacatctgatcttgggttcttgtttttatttttccattatttctttgttgaaattggtggtcaggattatatactcacagtgaatattatatgtatttatcttactaaaagcatctggccaaacgcagtgttgcttgtgtcctggaataactataatcagacttgaaaccttggcacatttaagacatgcagtcaaataaacaaatgccaaaattaaatgaatctcatttttaaagtttgtatgaaggatagtaaaacaacttttggtagagaaatcagaaaaggaaaaataggggcatatttgatagagaatttatcccctctaattctgatttttctgagaaaattaaaagcatttggtattttgaatatttgagtaatgaaaacttccagcttttgtaggtttgattaaagaatggaagtgtaggccgcgtacagtgtctcacgcctgtaatcccagcactttgggaggctgaggcaggtggatcacctcaggtcaggagttaaagaccagcctggccaacatggtgaaaccttgtctctactaaaactgcaaaaattaaccaggcatggtggcgggtgcctgtagtcccagctactcaggaggctgaggcaggagaattgcttgaacccgggagtgattcagctcagcagtgagctgaaatcgtgccattgcactccagcctgggcaacaagattgaaatgccatctcaaaaaaaaaaaaaaaaaaggaaatgtaagagtaaaacatggagaacatggagtagaagtgggataataatgaatgacaatcagccattattaaatggttaaaaaatatgtaagtactatatatgtaagtaaatgtggcattttaccttcaaaagtcctgacctttgcttgtggaagtagttgtcagaattgcagcttatgaatttttgtcaagtagtggaaggagggttttgtcaagtagtgaatggaaagttgttaactgcacatgtggataggtatagctcataatgtactctgtgaactggggtaactgatagatgtttgaaatgtataaaattgttcattttgtgaatttctgtgcagtttgcctcagcagggtgcagttttctgcatgcatcaaaagtgaaatttgcacttctgctcaaattattccctaatatacaagttgcatttgagcaaattttttcatttcaaaacaagcattatagtggagcagaatggagcatactagttacttctacttccctaaacattatcgtattttatgtctctatggtaacagcacatgcatgctattttctttctttaaaatacctttctttcatccactttttatctttcaaagcctggctggggtgaagaaacttccctaaggtcttctctgaattacattgacttaacattttcaatattgacatatatttttattatttgcccatttccaaaaagtatctgctttagatgacataagacacaagcttgtagtaaagaaagaaaacagcaaacccaaatggttgagtggctctcagcagaggaaagcatattcatttattaggcaaacttaagctttttctagctctgatgagattttgcatgagaaacattgtctgaatggtgcttcacaacaatatgaagatgattctttgggtgagacctatgtcaaggcctctaatgttagattatatctgcaaacgtcattctacaaaggcaaaatgacctgaactgaccatgcagctttcagtgatctggcaaaacacagggatagtgatcctttatactagaaattcttaaaaggtagaaaagcagttttcgcctctctgtgaattctctctcagagtaaaccttgctttgcagggtagggcttgggggtgaaggaaagccaagcatggaacgccttgcaactccccaatcccctaaagtcctcccagccagaatcctagccagccagatgcctggccctggtaggagaaagttggagaaggtatgggtgcttttgttcctcagcttctctatttatatagaatacattctaagatgagaaaaatataaatttgaattcttgttacttttttaaaatcttgatttttaaaacggatttttttttaagctgtgactgtgataacaattaccaaaagaagttcggtatttgcacattacttggtaatattctctatagtattctatgctatgtagatctacaaattgacttgtcctcaagaaaacagttacaattgatgtagaatataagttttacatagtgagattttctatatttgaaatgttttaaaaatgcatgaatatcttaacatgtgtaatggaagtcaccaggtacctttcttgggaaagactattcctatgccaagatgatgtcctccctaattttttgatagtcaaagtgtcatatcttactagtagacagttgggggtgacttctggtctcagctctgacacataaagatactggaagtcattgtcacaataagaaaaaagctggacaaactgaaaatcaaatacttttcttaggtccctcagataattgaggtcacaagtcaaatcaccactctgaaatctgaaaggctcatgtaaagaatcagccaagatcagcttaccagaagccactaaagacagtaaccagtagggactcttaaatggtaattttggtgagttggtaaatttggtgggactctgagtgtagactagcttgagaattaagaactcttttctgcagacaaaccagaccagaatttcattttaaggacagagccttgggagccgattattttgattaaaatccctgctcatctataaaatggttaataataatacctaatttataaagtttagaggattgaatagggtaatcatgtaaagtttgagagcagttctactacagattaactagtaatgtggttgtatgtcactttggctcgtggtttggctttttgtgttttagaataactatcaatcagtagcaaaatgggatttctttttcagtcattaaaaaatagctgtgatttattgagtgattactgtatgcctggcattattctaagaatctcaatgttttagatcatttagtttgtataagaactttaggatcagatttagctattattatgactccatcttacatggtgggaaactgagacttagattaagtgacgtgggcagggccacatagctcttaatgctaaagccagtcagtaggaccaatttaggttccagattgtatgctcttaaactccaaggtataaggaaaacacaccatttggaagagatgatgaagattccctggtgacatcctactggcaccggtggagcgagcatatgtgcaggaagcatttgggaggttagtgagcactggcatgggcagggagcttgtcaggagggagtcaggttgggagctggctttgaggattgggaaggaattgaatgggttggtggaggcaggtgtgtgtctcaggctaaggtgtgatggtagcattgccctcaggctccacctacatccccttgcccttagggggcattccagcaggcttctagcctccagaccctgcatttctttgatgaagtgctttctctggccccggatgtcctctttgccttctatgacaacacagcaacgacagagagtcaaggcagactcccttgccctgtgggcataacactgaatcatatctatgcctatatctatatctatataatctgtatctatatctatatatctatatcatctgtatctatatctatatatctatatctatatctattccagctttcagagttccccagtgagattaagctccagtcattcacagtgatagctcttttgagaatatatatattttctgtctctctctctctacatatatatgtgtagatatttatttattttttacatcttgccattcctgtcttgcttccctattccccagtcagtgtgttggtcacctcccaaataagtgacttccacagggacccttgtcttagattctgctttttggggaagcccagactaaaacagtaatgcacaataataatatcaacaacgaagggctgcatttgttaaggacgtgctaactgaatgtctactgacctgttttacagattgggaaacagacgggggttgatgagataatttgctcaaggtaactaacacaatgaatagactggccaagtggtcttgagtcaagagtggcttgatgctagtcagccatcttaaccacctcttggcacttgagcaaacacctaaagacaaacatgatctgattgggaaaccagtcgtaggagagtaatagaaaataaggttaaatactcagtgtcttaaatttaatttctgcggtttcagagaggtcttttagcaagggtcctctatcctgccattacaacaatgcacaaagggtttcattttatttttttttattcttttaaaactgttcgggttggatttatggcatcagaatgaccccagttaatctggagttttgaacttgtttttcccagttaggaaagtacagagaggagcaaaacctagctgcccttctgagatggtgccatcctggtctcaaatgtggacatgcaggattctaggtggtgtctataggcaagatgacattacactatccccctttccagaagttctaatccataggaaatctaagacagagtgatttttaagaggctctgtgcacatgtatgattttctgaggtcccttgtagattccactaagattgtgtgaaatccacccagcaaatcccagcaaatgggcaacagtaaatgaataaaagtgtttgtatgcataaaaggactcctatttgctacagaatcttccatgagacttctttggtgaccatgagaaaaggaaagctggggtagttccatacaactctattacgtgtgtttttctaaatctacatccttagtcaccctagggggttgaagcattgtctcctctctgattatgttcaggaaataaaacaacttaactcctttgaaacaaggaacaagaagtgtgccctatgcctttctttctgtttttctctgagcctaataactctgcctcacctgtggaagatggtcagtatgttatttgttttgggtcccattgatgaccttgttaacattcagcctcttccagtaaggaagacgctaaacttttttccatcaaggagagttgataaattcctctccatttctctctgtgtgtttccatgtctctttctccatctatgtctctgcatttggggtatgtgtgggttctaaacacatacccccccaatgcagagacaacagatggagaaagattttcagtcttaagactagaattagagttcctgagctccgtgtgcagcagagcaacttgatgatccaactgagcctaaagaaaccagttgttcaggaggttgatgaccttgaatatccaggaccacaaatctaggagccgaattaggatgggcagaatcaggacaactagcaaaagtagaggtggaagcgtcacctctctgggaaatagtccctccagttattttttatcatctttgcttttttttaacctcaagtttccaaattgcctggggatcccctgcacctcgctcaccactaccaaggcctcatcttttcctctcactttggcaaaagtctctagtcccttggaatgaattaattgtgaatcttataccttcactctgtgtaatttagttaaactgacacatgagcctttttgttgttgttgctattgttgttgaaagtagtttagagcatttcctaaatctgcagttcccttcctcagccttttgcctttacctgaaaccaatgctcatgtagttcctttggatcttttaccctcaacagccagtcgtcagtgtagtaaagcttggcgtttgttgcggtggtgttggtggctttttgttggcttgttttaccttttagttcttcagccattctatcctcctcctcagtggcaaggccagcacggttgctgaagtcctcagtttagccatgtgtactttctaccctgccatatttcctcttcagtgaaattgatctcgcctttctgtaaacactctgaatcaatctgactgcttcttgaattttgttgaatccgtaggatagaactgatgatcaagtcctaacttgacagtttcttttggtgattgtatttattgccttggacctgcatttctgaggcttagaatagatgatagtatcatttgaaatcactttcccatagttaatttaaagttccgtttttatagctgccacctttgtttcgccgcagtaatttttgtgtttacaaaaataaattttataaaaatgtctgtgtgcaatggctccagaaattctggtgactctagaatacctaaagtgatggtacaaggatatggcacctttggcaggttattaggtcatgagagtggacccctcatgaattggattagtgtccttatgaaatggaccccagagagctctcttgctctctttctaccatgtgagtatataacagaaaagcagctcacaacccataagagggccctcaccagaacccaaccattcttgtaccctgatgtcacacttccagcctgcagaactgtgagaaataaatttctgttgtttgtaatcatcctgtctatggtacttagttatagcagcctgaactaagacaattgccagaaacaatatctaactcaaaatttattgctctaccttgtctcttttagtaagatcttattttttaaatttaattaatcttattttatttttagctatccactatcatagctcaccacagcctcaaagtcctaggctcaagtgatcctcctgcctcagcctcctaagtacctaggattataggtgtgtgccactgcacctggctaatttattattattattattattattattattattattattattattatttgtagagatgaggtcttgctatgttttccaggctggtcttgaattcctggcctcaagcagtcctcctacattggccttacaaaatgctgggattataggcgagagccactgagccaagcctgcagattttcttttcttattattaaattctaattaaattttacactgcatattacagatggatgttgagctaaaatgaagcattgttttggtcccttttactacttttaaaacattcaaacttcagcttatcctccaggaagcatttatgtgaaagaaaagtcactgacatctcttctaaatgttcctggtctagtgacttaagttaaaaaatattggccacgaagcagaacattgaactatttcctggcatgcctctagatcacagcctagaattttagaagatttttatttaactacttatagccatttgaggcatctggtacatgctgtggaagtgcagaatgtggaactcggctttcttgaggcaggccaggctgctggggcggctcacaggcataggggtctcgcaagggtcacagctgggaggcaggaaactgcagggcttcacggcggaacagcactgtctggtgggaagagctgagtttgagtccttatactccagcttctgggcatcatcaccttggtttctttatctgtgtaataaagtggaatttctgtctgtctttcatggtttcacaccaaaactactggaaggacttttactaaattgggcacaagatgtaatgtgtgggatgcatgtgaaatttactttcgtcccctcttgtggtgagagagtccatgtgactgcccatctgtgggaatggccttgcttattaagcacgttggacagagaaagtgaaggactgaaatttcagcatccccagaaagtctgaagggccgaagctccatggatgtacatctcacgtgggcaactctacggagtgtgctttagaatgggcagctggacagttaagtgattttcttggccggtggtgggtagacccgctaatcgataaggtggaactaatttcttctacaggattgtgagaattaagtgaaatgaagcaaattgtatgtaattacttttaaactataattgcataaaagttattattgggaggtatgtaaatattataagaccttgattcctgggatgaatagcttgaagttgatcagatgatgttgataaatatttaatatctgctaatacttatatggtacttatgtttcaggcattattctaagtgttttacctatattactcatcaacaactctatgaggtggtccttattattatttagtatctgttttataaatgaggagactgaggtagagattgattaacaacttaacctaagggccgggcgtggtggctcacacctgtaatcccagcactttaggaggctgaggcaggcggatcacccaaggttaggggttcaaaaccagactggccaacatggtgaaaccctgtctctactaaaaaatacaaaaattagctgggtatgctggcgcgcgcctgtaatcctagctactcaggaggttgaggcagaataattgcttaaacctgggaggcggaggttgcagtgagccaagatcgcagatcgcaccactgcacaccagcctgggtgacagagccagactctgtttcgaaaaaaaaaaaaaaaaaaggcgcttacctaatgtcatatagctcccaagcaattaagcaggatttgaacctaagtcatttgactccagagtccattccattaattatgacactattcatcgtttttttaaatctacttaaagatattttttccataaagagtatcactacctgagatactatgcagtgttttaaccatgaatatagaaagtcattgagtggattgaggtggggggcacaacatagtgaaattggattttaagcaaattgagtcaggtgctgtgtaagtagactaggggaagagtgtaaggtgataaaggcctgatttctgttgagatctttcagtgtataatacatgttcttattaatggcttatctgtctagaacattcttcatatgtccaatttagtggtcttaaatcccaactcctcagaggttacatattttgcctatacatgccttccacatgggtggcactgatactaaaggcaggctattataaaggacatctggacattatcccactaagggatcagaaattttgtatttgtattcatctggggagatggtgtatgaaggaaaaaaggaaggaggagcttttatgtcttaagaactctaggtttgagcttgggtatggtggctcacacctgtaatctcaatactttgggaggccaaagtgggaggattgcttgaagcaaggcgctcaagagcagcctggacaacacagcaagaccccatctctacaaaaaataaaaaactagctgggtgtggtgacacttgcatgtagtcccagcttgggaggctgcagtgggaggaccacttgagcctaggaattcaaggctgctgtgagctatgattgtaccactgcactccagcctggcagcagaatgagaccctgtctctaaaaaacaaaaaaccctctaggtttgataaattaaagtcagaaagatacagccagttgtcattagagagatagtctaatggttgtgtcaagctgggtgagaaagtttcttaatatggttataacaataaagtgtatgaagttggagaaccattgtattaaaggtctcagtaggcttcaaaaggagaaaatgctctcagttcccaatttcttctggaatacagtctaagttgtagatatttctgtgaatagatactggaatataattattgagagagtgtcacagtagtcataaagacgagattcccattaccatcctaatataatttgattccagtttttattttatatgcatgaagtcagttttcattcattttgattgtcttcatttctttgtatctctgccattaatgtgaaggaaggaaacagagatccctactctaattccctctgattttatcattaatgtagctctggaagacatttaatggattagatagccggaaaaaaatgtcatttatgtgcaactagtcatcaaataattatgctgtctaactaagattccacactatacccccaggactccctgtttactaatcaactcaggtagaatatgcattctggtaaattgaacatggtgtaatgatgtgaagccatactatctgctattatgttaaatatttaaatattaaattttaaaagcacaatttacatgttattcaaacaactatgttttgcatatagcaaagctttttgaaatgtattcatgtatttgaaaagagaaaacagattgcgagtattcagttaataaattcgtgtttttcactaaatgcaaatatatattataccattttcttattttcaaaactatcttgaaaatctacattttgtaactggattctcttggaacctaaggaaactaaggcttttaagaaaaataaaattatgctaagaagttttattggaagaacaaagaattttattattattatcttggactaaaatgttctcatccattggctctatagtaacagtaacaagtggagcaaacagtttcataagtttgggctagaaaagccatgaatgaataagattcctgagagagttacaggggttggaagaaaagctccagttcagtttattcctagagaaagatgactataatgaaacaaaataagagagaaaaaaatgcatgtagcgtttgtgtatattttgaccacgttaatgcgctatttgtgatgcactaatttgctgtctagctcttgtaattaaaaaagcagaggaagtttttatgtttaatataaataatttgctattttcatagcatttttgctttgtttgcagtaataaaacacactaacccttctttttctaaataattgcacagaatttgcagtcaaatgtgttggcctaagcaatattttgccattgaagtacattctctttcccttccaacatgttatatcacaggggaatggtagagctgcagtctttgcagtttaaccaggacagtttctgtgtggtttcacctttttttctgaagatttctcttgacctgagcttgttgaataattttctgtagaaagtgtaagagagtgtgtgtgtgtgtgtgtgtttgggtacacgtgtgcttgtgtgtgtgcctgtgaacatgtgtgtgtttatattgtattttaagcaatgaaaatctaagcattttcatagtatcatgagtcgttagaggaatgaaaatcagtattacttcacatccaccaggatggctacagtaaaaaaagatggataaatacaagcattgttgaggatgtggtgaaactggaacccctgtacagtgctgaagggaatgtaaagggtgtagaaatttggaaaaaatttcacagttactcagaaagttaaacataaagtcaaccatatgagccagcaatttcactcttatgtatataccccagagaactgaaaacatgttcataaaaattgtacatgaatgtttatagcagcattattcattagagtcaaaaagtggaaacaaatgtccatcagctgatgaatggatgaataaaatgtggtatattcatacaataaaatactatttgaccataaaaagaaacaaagtatcgataattgctacaacatggatgaactatgaaatcattatgctaagggaaataagccaaatacaaaaggccatgtattgtgtgacttcatgtagatgaaatgtccagaatgggcaaattcatggggacagaaagtattaatagattaattgttgccaggcactaggtgggaagtgactgactgactgctaatgggtatggggtctctctttgaagtcatggaaattctagaattagatatgcacaaccttgtgaatatactaaaaaaaaacactgaattgtgctccttaagattgaattttatggtatgtgagttatatttcggcttttaaagatgaatgctaaatcccatttatacctagtgttccattattggaatgctaagcttgtgggagttatttatatcctgctgttcaaggtcatcgccaaggtctgatttttcacacacaaaaaattacaacctccagcataaataggttaagcatctggaaggtcaggttttagcaaagtactgagtttgagtgataagaagcctcttgccaaatgacttgaacaaacctaaattttcccctatttcttagaacatacacttcaaatattcaaaactgttaaatgaaacttaccaaaggcatgaaagtagtgctaatgatatagcattaatatatctcaattatatagtgacagacttttcttgaatcttaaagaggaaaaaacatacaatttaagaatatttcagtgaataattttggaatttgttatacttttagtaatatggaagtctcaatcttcagaacagcatttgattactcccattaagactctgtagttcctgtctttcttgtgaaattaatttggttggtagcagacaccaaattgggaatagaatttataactggtatatattcttgcaatttaatggtctcaattcttattgaacatttaaatctggaaattgagatatatactgccttagtaaatgataatgatgaaatattttctgctttgtaagtagaattgaaaatcactgaaattagtttcttttccctttttactcctttctctcccccttgagacacattggtttcccaagttatgaattcagtttcttttgtttgttctagctgcttagtctttcttattacatacctgtttaatttttaatttctcattaaaagtaaatatggctaattttcctgtcaatatttcaagaaaccttccatttctctctgccacaaccttgatatagtactgtctagtctgtattattacataattaaaatgctattttttgtcaaatagttctggcaaagcaacttatcaatacattttaaatggatcagagatttatttctataatgttgagattaacgttataaatactgttgtggacctaaaaatgctaagtggaataatatgtatagtgctatgggaaaagttgttacaatttcaggaaaaatacttaaagatgaatatgccataggtattcagaccttcttaatcagtttcatttatcatataatgtagacacatttaaaaatacactaatcttgagtcatttgagaaatacaattggccctccacatacatggattctgtatccatggattcagccaactacagattgaaaatttttggcgggagtggggtgggaaatggatgattgtgtcagcactgaacatgtacagacttttttttcttgtcattattccctaacaatacaataaaacaactatttgcatagcatttacattgtattagatattataagttacctagaggtgatttgaagtatatgggagggtgttcataggttgtatgcaaatactacactgttttatgtaagggacttgagcatccatcgattttggtatctgttggaggtcctggaaccaatcttccatggatacccagggatgagtgcatttactaagcatggaccatatgccagtcactgtgtatttgtggtgatcctgtggtagctctgggtgttgttggtgatcaaaacggagaaggttattcttgcccttggccatttatactataatcctggagctactgatttgggagcacctgtgtgactggagcatagtgactgatgcagagacgagcttgagatgagaccatagtggcgggcagggaactggtgatataagcatacagttatggggaagagtttggacttattcttgctgtgatgacaagccatcaaaggcttactactggggagtccagcttcagttttatacaagattactctaagcagtggtggaaaatagttagtggctatcagaggagaagcagagaattcagttggttggattttatggtaatcaggcaagctgtgatggtgacccagactagagtagtagccctagagctagaaagaagtagattgataaaaaaaaactgtttggaagaattaataaaacttgatggataggatttgggggtagcagggtgataaggttaaggtcaaaagacatgtcaaggatctttctatgtctttggcttgaacaactggatagatggaaatcccatgtcttgaggtggggtgcatgagaggaggagctgatttggaagggacagtccagtgttcagcttggggcatgttgagtctggtggggagggtgtgtttgtaaggtaagggagcacagggactggcctttcttgaactctggtaactggcttgtggtctggatacaagttagaataatacataaaccatttccaaaacccaacagattttacaggttttcagttcacagataagttgctataattgatgttgcctctgtggtctttcagatagcacagcactctaaaaatttctatgtatttgatgggcatgacattaacaatattcattttatagtcagtgctcacttattgtgatctgtcttccttggtgttcctagagccgtgcctccctggcccacagcgtcaggttacagatttgatctttacatggatcagttggattttctaagttgtcttgtgacaggttgcatccctcaccttggatggctgacttggtaactgattaggaaggaaactgccctagagttgttatgaactaggactgattggtctttgctactacttaagactcaaaacgtatgttctacctacactgggactctaatggcctttgtttacaaaggtggagcccaaaagacgggcacttctcacattggctatggttatatctcctttcgcattaagtatacatttactgagaagccaagccacacaattttacttctcttttgatttcctgtggacaatatttttatttccttcaacaaatagaagtaggccatttagaggctgggaatataagtgttttgttatttgctgtacctccagtgcctggcacagggactggcatgcatatggcacttgatacatgtttattaaatacatgagtgaaagaaggaatggctgaatcatcattctgtgagaaaggataattcagttttcagaaaccaagacatcaggcaaactatatcttcttctaagattacgtccctgaaacctgagaaatcaaagctgaaaaatagaaatttgggcatcatcctgataaaaagaattacaaaaatcattaaagtggaagcccttgagtgtgtgcaggagagagtagggatagaggagaagtgaacagcagagaaacgggttggaaggaggagtgaagcctcaggagagcaaggtgtcccacagaagcaggagcagtcaacagtggagagctgggaggtgcgaagggatgcagacagaaagacaccttttcatccagccagaagtaactcaggaaagtgcaatcagagcctgggacacagtgtgaagtaagactgggaattctgtccttttatctatattcttcattactaatgattgtaattgaggggcaagtttttcttgagcaaagatgtagttagttttgattttctgctacataaagcccagcatcataagacactgttggcaatgatattgaagggtttattttgtgatttcttgtaagctgattatttactgatcaatgatcaaggccagtttttccattgttcctgttaaaggtaataatgtttgatatatgtaacataaatatttctgtgtgtgtgtgtgggcacacgtgtgcacacatattgataaatttaggagaattacaaaaaagttacggtaggtaaagagttgaaagttgacttgagttctaatgtgaaaaatataggccatttatccaaagttatgtgggagcatttcagtttaaatttcattaaattctctagttcataagaatgctacagagctacaataataacaatatagaaacgggttgtgctaatacatggggttttgccaataatgtgtgtgtgcatgcacgtgtatgtatatggctaattttgtgtgtgtatgcatacacatatatatatacacatgcataatttttttctgaacattgttttggtgtgatgttgataataagaatccatatgggggcataggagtacatttgagtctttttaggatgttaccatttgcaaaggaattaattctcacataagtaagtttactttatagaaatgaaagtagtagctactgtttattctgcatctcttttgttccaagcatgtcacagtaatcctgggaaggaggttttatgtttcttaaagggaggaaattgaagttcagaaagtttaaatgatttgccccaggtcacagagctagaagataggagaatcctgccttttttttttttttttttaactctaaaactcatgcattgtccagtgtgcagtccaagttagaatccttagggtattagagtgagttacctgtttggttgggggccaattaatctccacagagaaagcagaaaccattagatgagaactttttcaacattttgcccctaatagctacacctgatttttcttttctttctgttaagaggaaaagactcttccctccaagcacttgatcctttttatttatctcttgcatctttagtctgtgtctctgcctgcatctcttcccttactagcttcttctcatgagcatgaaacagtccctccctggcttagtccgtttagggttgctataaatacctgagtctgagtaatttataaagaaaagaggtctatttagctcacagttctactggctgtaaagttcaagattgagcatctggtgggggcctcaggccatttccatttgcggtgaaaggtgaaggggagctagcatgtgcagagatcatgtgatgagagaggaagcaagggagtggggaggtgccagtctcttttaacaaccagcactggcaggaactaataagagtgagaactcactcatcccctgaccccagggagggcattcatcttttcatgagggatattcccccatgacccaaacacctcccattaggctctacttccaatactggggatcggatttcaacatgaggccgggcctagtggctcatgcctgtaatcccagcactttgggaggctgaggcagacggatcacctgaggtcaggagtttgagaccagcctgaccaacacggtgacacctagtctctactaaaaatagccaggcatggtgacacatgcctgtaatcccagctactcaggaggctgaggcataagaatcatttgcacccaggaggtggaggtggcagtgagccaagatcatgccattgcactccagcctgggctacagagtgagattctggctctaaataaataaatacattcattcattcattcaacatgaggttttggagggacaaacacctaaaccacagcactcgcgaaaggcaataccttctgtattagttagtagttgttgcataacaaaccactccaaagctcagtgaagtaaaccaagtaccatttatttagctcactgttttgtgggtcagcaaattaggctgggctcagcgagactcacttgtatacctgtggtcagctagacagcttcacctctggagtagtagctgaccagtggcaaggaccttcagggtgactggagtgtgtgcctctctttcattacccagcaggctggcctaaagttttcacatgttgtttgagagggtttcaagagagagaagcctataaatcatcttgaggtataggctgggagcttatgtagtatcccttcctccacattctgttagccaaagcatgtcacagtgccagcccaggtccagcggggtggagaagcgggctagtaagccatggaacttctcattgtcaaccccaaatcacccttgaagaccatagtcagatcaccacctcaggctgtgttgtgtgcctgtgctctgggttccctctctcactgcatttagaacattatgtggccactgttggtttatttcttggtggaaagtgagcctcttaaaaacaaggactgtgtttcaacccaggatttggcttgtagagtaggtaacgaaaagctgaagttgttatgaaagtagagttcagaccactgatatctggcagtgtggaaattgggattaaagataatgtatgctcgtgtcttaaaacttgcttgttgatgtttaaaaactttggagcaaactcattctaacatatcaaaatcaaatatttctttgaaaaaaatggaggggataaagaatcctggccaggattctgagtagaaatcatttaatacttgcacactatctttgtaggtttttcatgaggttacatgtttgtttgggaagtgaagttaatttcgtggtgtgtttgtcagagaaaaacatacctgtccattaactgattcattgggatttgggataacatttctattctagaatgtaaaatgaaggaagggtgtcagtcagcatcctcgatattactcttgaagatgtcgaacataaatatttctgttagaatgagaagtagcatttgcctcatgggagtttgtcttgaagcgagtatgtcttatatatgtactaattcttaattgatggtttttcacatgcattttgtgttttaggttcagccgtctgtatatctccccagatacctgaaactgaccacctgagtacgttttcccattgctgagctgtttccctgatatctggccatgcaacggagatcaagagggataaatactggacttattctactcctttctcaaatcttccatgttgggatcaacaatattccacctgtcaccctagcaactttggccctcaacatctggttcttcttgaaccctcagaagccactgtatagctcctgccttagtgtggagaagtgttaccagcaaaaagactggcagcgtttactgctctctccccttcaccatgctgatgattggcatttgtatttcaatatggcatccatgctctggaaaggaataaatctagaaagaagactgggaagtagatggtttgcctatgttatcaccgcattttctgtacttactggagtggtatacctgctcttgcaatttgctgttgccgaatttatggatgaacctgacttcaaaaggagctgtgctgtaggtttctcaggtaagggagacaaaattttgaggttgcatgcataaaggaagcaagggaggtgtggctgctgtcattttatgaagtgtgggtccctatcaaattctgagtggttaagggctgctgaggctttgcgtcttgaagaggaggctggagcatgcagggactagtttttgccattctacattatgctgcattattcactcttagtctgcactaggacctgctggaaggtggttttgtagaagacatagtattggaaatatgcaccagctccttatggtagggtcacagaaagacccacagatgtatttgtaatagggagttctcaaaaaagatgactgtgcttgtgaagtaggctcagtgtgctgtctctgattaccaacttgtctgcacctggtgagacagagcacactcatctgcaacaagttacatgaggcagatttagtatttacagttaggcagcaagggaaaacaggagcctaggattcatcgtgagcccatcttcaaggctcaaaaagctgcctagggctgttggagtcttcactgtgtgtgttccttgcatgcaaataaggaaccccaaagaggcagccaggtacaaacctaggaatcacatgaatcactgggcaaagctttgaaagacatcctattcgggagaggattaggctgtttcagccagcccccttttatctcagggtgttggatttccagcacatttccatagttattcttgagaactacaagcgagaaaggagggggagaactacataggtccaaggccacctggagaactgtcctgcgatgcctctggatgacttcgttaataaatggaccacaccctgctatggcatgctggccatgttttaggagccatgataatcactctgcataacctaaccaatttaatttatgcagcagatccacatggagatgggattatctttattttattttattatttatttattttttttgagacggagtctcgctctggcaccaggcctgaagggcagtggcgtgatctcggctcactgcaacctccgcctcccaggttcaagcgattctcctgccacagcctcccgagtagctgggactacaaggcacgcaccaccatgcccagctaatttttgtatttttagtacagatggggtttcaccatgctggccaggatggtctctatctcttgaccttgtgattcacccaccttggcctcccaaagtgctgggattacaggcgtgagccactgtgcccggccttgattttattttactttttttatttgtagttttttttctgaccacctgctgactgttgagggattgtcttgattttatagatgaggaagccaagacccagagaagtgaggttactagcacaaggttacccagctcggaagcgatggagctgggacttgagcccagtctacagattagctgtgtgatgcattgtctctcactttcttcctcactagttcctttttacagatatttcatgggaccaaaattgccagcaggatttaaattaggcgttctaaatattagaatgtgaaggggaggagagaggtagtcctgaaacaaggaaatctaatccttccttctgcttttcctgacatccttcccctttccttccaagatgtatccttatgcatctaattgtgggagaagaaagaatatatgccctgtcttcaacatgtttttccatagaggttagaaaaatacatattactggtatttttattgagttaaaatttatatagcataactattttgtagtgcacagttcactggcgtttaatactaataatagtattttattcacatggtaggtattatgtatttagtagcatactgaacaccaatatgaacttctatatttagaaacatcaaaggagtgactgcctttaacgttgtctttttaccaaatgcaaggttgtaaggaatagggtatgttttaaagcacaaagttggatgtaatcgaataatcattttcacttttaattaactttctttgtaaatgttgatactcctacttttggattgttgatatttgcatgttcttcattctcttttaggagttttgtttgctttgaaagttcttaacaaccattattgccctggaggctttgtcaacattttgggctttcctgtaccgaacagatttgcttgttgggtcgaacttgtggctattcatttattctcaccagggtaagtgttttcttttggggaatacagttgaaggacctgatgttctgtggagaaaaaaattgcaataataatgaggtaaccaattgtttttcacagtgaggtttattctttatctattaggacagaatcaagcttaatagttttaatgtcagatatttctgggtttgaatcttttcaactattaagctgtataattttgggtcacttgtcttaactgagttgcagattcctcattttttttaagtaggagaacctgctatactgatctgaggatcaatattaaccagccaatcagctggttaattctgaaagcaagattccaaagaagcacatagaaaccacgtaactataaagattaaaaagctataaggtatgttgatctaatgctttttattattattattattcttttttttttgagatggagtctcgctctgttacccaggttggagtgcagtggcgtgatctcagctcactgcaacctccaccccctgggttcaagcaattctcctgcctcagcctcccaagtagctgggattacaggcgtgtgccaccacacctggctaatttttatatttttagtagagttggggtttcaccatgttggccaggatggtctcgatctcttgaccttgtgatctgccggccttggcctcccaaagtgctgggattacaggcatgagccaccgcacccggccgatctaatgcttttaagccattttagctgtcaattgtcttggtagtagaactttttaaacaaaaggctttacttaacactcaaaatgtgaaatggatcagctctgaagtcttttgggttgagaagtggaatggggcccctttcaccttactcccatgttgctgtggcttcctcagaggaggcacctccacaaaaccctagagctccaggaagtacagtttcagaactgctgatttagatgaattttttcccttacagagaaggacttggaaattcggaaggttaagagacttatcaacaaacagtttgtggtagacaccagccttgtgaggattcaggccccctgactcctgtctggggctcctgcccattcatgctgcactttcttcctttggttcttttctctgctttttgtttagaaaaaggaagataagttgtgttattttttccacctcttccaccagcttcactttccttaatctgtcttgtgcaactggaaatgcataatgtttgtttttactgtgggactggacgttggcaaagggtgagattcaggaaggttcagaaagaaggaagatttctatttgctactgttctttacagacagtttttattttggttttgatttgtgtgactgtgctgggtgtcttaccttatttgagagtattctcatggggctgtgtgtcagcccggtaactccaggtccttctttaatgctaatttcccatcacgggcagccactggcagctggcccataaatgacagtgacgtggcccctgagtaccactcatttacaattgtattgctacttttgacagttccacgaagaaagcctaacaaaatcttcaaagttttctttgagaaagcatccggtaatgtctgtcccttatctgaacagccctctctataccttgtcactcactgctcccctgacttgcttgatgtgacttggttctctgtgtcaatgataggctcttgtatgtgactggcaacacccacattcatatgaaaatcactccctctgctatttgaactttcatcctgtgatgaatccattgaataacagtgcgtttaatattcttatgcaactatttctgaagtgctttttatgcatttcattttttagggttccccccaacttacatggaaaagggatggttgcatttctgtgtcatatgcatattctttgtggaggcaccggtaattctgagcttgggaagtaaatgaaatttcctgtctttgaacttaaagtcttttgatttttaagatttgactgctttgaatgataaacttctaatatacaagcatctacttacacatgtatccaaataaagactacgctaaacactggcccaggaaacctaagcagtgaatgcttctttgagatggatctcggaagaatggctgaaactagagctctctttgcaatgcattgttatttgcttgatggttgtcaattagaattttcattgggaaaacactgtaaatctttagaacaaagcttgctttattgcaggactgtatgggctgcccttcgggaggaaaaaaaatctgccaaagcaaacatttggtggacctctgtgttttatgaaagccacggaattagtaatttcccccagttacagagttttatgaaggaaagccaccccaaataggcatcgtgaggagtatgaggcatgtggacttgatgccagagtgaagcaatctccctcattcacgtggtgcttttgcttctcacagtgtctgtgtgtacttacttcagaggttgctctgcttcacatccggctttccattttccttcgtgtcctgagaccctgataggtgatagtgtctgaaggggtgtcccaggagggagatgtgcaggccacctctggtgcctccttcctagaccaggcttctgtcccttcccacctcctacccccaccaagattctgttgatgggaggaagggggatatgttgcctggttttaccttctagcgagattatgaacctctgtgtgttctcgtctgagccttaggctatctagacagaaaaccaaagtggagaatcatgaacatcacccagagtaagacagccactcagcgactatactagaggagagcggttgaatgtgacagggccgggctcacatactggccgtgggacctcgggcaaggtacacagcctctctgagcctcattttcctcacctgtgtaatgggctattacttaccttctctgtttgataagtcagttttaaggtgtcatatgcgaatgagctctttgtaaacaataggaagtactcaacccttttattatgaaataaatcactggatgtgtacactgttcctaaatagaatcatacctaatttcttttgctttctaaaattaataaatcagctgttatttaattttgtttgtttgacttccactccctacttccctttgctcctacttgacttttttcgtcctgaatgacagcagtctaaaaatgcccataagccactcttaaacactaaataagcaagccttggctgcatttggaccctggggtattacagttgacccctgaacaacttgggggttagggatgctgcgcccccatgtagttgaaaattcatatataatttttgacaccccaaagacttaactatcaatagcctactattgactgaaagccttactaataacatacacagtcaggtaacacacattgtgcatgttatatgtatcatatactgtattgttacagtaagctagagaaaataaaatgttattaagatcatcataaagaagagaaaatgtatgcactatttgttaagtggaagtggatcattataaaggtctttatcctcatcatcttcacattgaggaggaggaggaggagaatagggggaggagttggtcttattgtctcatgggtagcagaggtggaagaagatcctcatgtaagtggacctgcatagttcaaacccatgttgttcaaggatccactgtatttggtaaaatatgacagctgaaagcattaccccctaggctttggatactgcttcattgctaatatttgacaagaataaaattactttgacccaactaaaaattatttggctagattgatcaaatgagagaaaaaatatattttttacttgtttcaattttttattatacagattttcaattatttttcaatttaaattttattttcaatttatttttccacttgtttcaattttctgttttcaaaaatatttataaatttataaattttcaaacataaagaaatgttgatgcaccatttgacagtaagttgtaaacataataacttcacccctaaaaacttcagcaggcatctgttaaacagaaaaatataattttacaaaaccacattactgttgtcatgcaaaagaaaattaacagtaattccttaatgttgtttagtaattggttcatgttcagattctcctagtgttcaaaatgtctttaataactgttgtggccaaaggagaaccaggatccaaaattcatatattgcctttgattattgtatttatttattcttgtattctaagacggtcttcccacctttttacttttccatgaagttgacattttaaagatatcagatctctcgttttatagaatatcccacactctagacttgtctgcttgtttcctttggggcttgtttaacttgtccctctatccgttgcatttctggaaactgaaagttgggtctaaaggcttaattagattcagattaaactggctcttttttggcgataatactccatagggatgatacatgttgcattacgtcaggaaggacatacatgccaggtggctcctatgttaggaattacaagtttaattacttggttaaggtagtctccattataagggcacctttatccctttggaattagcaagtactatatgaggtgacacttggacatcatgcggataacttgtttccagtaactttttgtctagatcagtggttatccttgtctggattgtttattttagggggaattataaaggatgacttcttcattggttatgccttttatatttgtttgatgagattaatccagagttgggggttaagaccccaaggcaaggaattgaggaagatgaatgtttgtcaaaggctggtcttagttttatggacttcaagcttatttggttttatgggttctccttaggaaaaaagtacaaaattgcagaaaaaagtaaaaattttaaatgagaaagggaaagacagttcataaaattttaagacctgacaaatattataaacattattaaatccatacaaataatataatattaattccctgacacacctctgtaatattttccccgacaggttttgctgcatgctttctgatctctttttcatatgaaaataacctggcaatagtatttccgtagagagaacatcatggtggctcaaaattagttttctattattaagagtttagaagagctttcttcacagctcatcatgtaaatttttagaatcactgtccaactttggaaagcctctatcaatgttttttttacaggcaagctgtaaaatttcagtacttttcaagtttttgtgaagtgatcaatatcaaatgttttttgaattgaatcaaatgttgtcattgacctttagtggcaaagtgcaggttttagttttcttcattgatctactttgttcttaaatcagcaagtaatttaagtacttaattaatgttcttatgatgcagtcctctttattcattgccagaaagccaaagtcctactgattatttgtttacactttctgatgtgatttgcatataattttgtttgagaattataaacacaggaattctgataaagttagtttgcaggattctccaaaaaggaaaggaacatggtacatttataattgcatatactgcattatcatatatgttcctgatgtgggagagcctctaatttcagttttgactatatgaatgagaagtgagtcctcttcttacagttttacatgcttggtgtttggaagatttttccagacactggtcctgattccagcatgatgactttactgcaagtgctagctgccacaggacacttgagagtgctgtgggaccgctgctcttgcatatcctgttatcatcctggttacaaatgcacagtgggcattaagagtatttctggaagccatttttgcactgtaaagactggcagtgactcagctatgcacagaaatgaccacaaaccacataaatataccatgctgaacccaaaccaaatgtatcctcaactcaacgtccctttagctgaatcccaaaaatgcctggggctactccagtgacaactgatatgggaggaagtgtgacagagggggagttagagtggaaagagacagcagttttagtaggttgtggttaagatatctcactttcacaagtataaaagaaatatgaccatgtgaacatgttgctgggacccctcccagagctctgaatgagcccaggcaagtgagggacctgatgcctcataagcttcttggcaaagctgcatgtttctgttgagagggggttggtgcagtgatgactctggggaagggaaagtaatggagctgaagagccttgtagactgcaggataatggaggaattaagagataggaggttttgtcaagtttgaaaacggagaaagctgtgagaatagaaattggtagtcagaggagaggatgctggagttggttttgctggtgacatggccctgagaatgtctatgatggtatgaaattgagacatggaggaagaaaaggtcctggtagtcaaggagttgttcaaggggttgtgagtttaaggtgtgggtgggtctgttttcacactgctataaagaatatctgagactgggtgatttataaaccaaagaagtttaattgactcacagttccccatggctgaggaggcctcaggaaacttacagtcatggcagaaggtggaggtgattcaaggtcgtcctacatggtggcaggtgtaagagagagcacaggggaagtaccagacacttatcaaacaaccagatctcatgagaactcactatcatgagaccagcatgggagaaactgcacccatgttccactcacctcctaccaggaccccccttgacacatgaggagtatattcagattatgattcaagatgagatttgggtggggacacagagccaaatcatatcaggaagattatctgcatggacagtgccattacctaggaggactgtaggaggtagggttgggggacaaagaatgtgaggctactctggtgttctctatggatgtcaggaaatggtattggaggcagatagtagacagcatctttattagtttcttattgttgctgtaacaaagtaccacaaacctgggggcttacaataacacaaattccttctacagttggtgttgtcagggtggagttccctctagactctagagcagtttgtaggggagaaactattaccttactccttccagctcctggtggctgctgccattccttagcttggggctgcatcactccatctctgtgtccagggtcatgtggccttctcctttttctatctgtgttaaatatccctcgtctctttcttatcaggacacttgtgattgcatttaggagtcaccctggtaatcctggatgatctctgtacctcaagatccttaatcacacttgctaaatccttgccatatatggttacattcatcagttccagggatttggatgtagatgtcttttggggaaccattattcagcctactacagcataaacaaaaaatagaaagtgatggaaattcaaactcagaatgccaatcccatgtgtctcagcctgtgcgtgtgcgcctctcttccctctccctggcatgccttttattgtctccttgtgaattcctggttattcaaaacccaaatcacatagtatctattgtatgctacttcccctgattcctccaggcagtgttaattacttctttgtctttgcttctgtagtgtttgtagatttatctaccgtaagcccttcctccatcataattaatctgtgtttttcactttctttctaggctatgagcttctttaggggctgtttcttgtttacctttgtatcttaaccatctgcctgacacaaagtaggcaattagtaaatatttgttgttggatggacataagataaggagcatcagttgttttcatggttgctgtttggcttgaaatggcttgctagattgctttatgaactgtctcaggtatttttactttattctttccattgtaaggtggactgatatctcattgttttagaacttggtatctcactcaaatgtaaggaggtagtaatcttgaacaattctgaattaaatctttagtaaaagagaatgtttattccctcatgtgcctgtgcttttgagatccttgttaaatgttgacctaaatcaatacactatttccgtacccatcgagacttcacagtttagcaaaagaaacactaactaccccccaaaccagaacagaaggtgggaatgttagttcaataaaaatagaggaacagaaaaggaaagtaactctgatttgagaaattaggaggcgctgcagaggacagggctatgtatgttgagtgtttggaaataatagggcagatgatgagatagactgctctttgttttgaaaggggaagagaaagaacaaatataggaagcttggcaaatttatgaaatcacaatctatccataaatgctgggagataaagctagtggtgttccttcaaatgtgttcttttgaccactagttccttgagatgtatcctgaaacagggcttcctggtcagtagacttcagctcatgtggtgttctgtgttcctgcaagggcacagtgcacatgaacatgtgaaggattctgaaaacattgcaggatggaaatcggatttgccaattagtttcctaagtttacttgacaatagcacccttttgttttagcactggcatgcagcaatgtacagaacaaatgttcttcatggtgcattttataaactccaagttgggaagaggccaaaccatagagaagaggccaaatcatagagggctttggatggcaggttaataaatttaggccatgcttgtagtcagaatggacacacggctttggtttctgagaaggaaaagccatgaatgaatatgtggtttaggacaggaggccaggaatagtataaagatttgcagaattggtggcaggtgtccatttacactgttgacatagacaagagaagaaactgaaggctagaactagtgcagtgactgagagaatcgaaaagagcagcctcacgggagagcagtttccaaggcccagtgacagttcatgggccgtataggaatgactggtgtattgggaacttcctacatgccaaaaaccatttaagctctttacgtatattatcacatatcatccttatacctactttgtgaagaagtaattattacttctaccacttaagagatgaagaaactgaagcacagaaagttaacttattgtagctacttaaatatcagctagtccattggatagccagtgtttaagtttctgcaatcaggcccctaaattcatactctgaactagtggttctcaaacttttgatcataaaacccatttagactcttgaaaattattgaggacctcaaagagttttggtttatgtgggttatagctatcaatatttaccatattggaaattaaaactaagaattaaaaaaaattaatataattcattaacattcataacataatttatcaataattcattttaaatatcagtaagcacaatatgtgttcacatagataagtttatgaaaaattaatgtagttttcaaacaaaatgagatgaatggcaatttttttgcaaaacttttaatgtttggcttaattaaaaaaatctgattcccatatttgcttctgtgttaactcctagagctatatcattttgattgaaggtcagtttggcctcatacaggtatgtacttgggaagggtaagagggattgttttagtagctttttcaggtaatcgtggatatccctctttgcactactaatttggcatgtggtggttgcttaagattagttccaaggtggaacctgaaaccatatcagtgaacctgaccacgttctgtaacattaaaatctgttgatctgtcttgaagtttgaatagatcttttccctatatatgattttctaatattatgcattgattatttggaaatattggtttactgattatgtagactttgtaaatattgacttaattatacagtatcaaagtatcacatttatttatgtcaccaccaatctcatcagaaaactctttaagtattgggaagctgtcaagctcacagtgccacatagaagttttccaaaattctaattttcactccaatgctcagatcttatcattgacaacaaattcattagttgttttccttaaaggcttgctttatttttttagaaaatgtgagccattttccttttttttttttttttttttaaccatagttcattagtttttcttttaagtaaacatggcaggggaaagtggggagggcccatgaaaacaacggctcattcatctcacagctcaaacccataagtgcttttctttttccacaagcatctttctttgctatacagctgaagtgctttgtgtgtatttcacatttcatcacacggtgtattaaaaagatgtggactaatcttggtgtttaataaaattaggaattttaccgctttgtcaaagatattcctaaacaccatgaatatgtgtctgtgaagagtgcagtgactattggtattgtttggggccactgccttgattcacttgactcatgctaaggcatcagcagttgtcttcttgcttttgtgccattagtgtaaatgtcaacatggtttttcttaaaaaaaagggcagatcatgtcttaatgttgctgtgaaaatagttttgactttgtgaacctctggaagggtcttaggggcttctagtgattcatagagcacattttgagaattgctgctttaaactctgatgctacctctctagtcacgggaagactgcttagcttgtatgaaaggaaagatggttatttgcaacctgggagcttccaagggagcttcatgtagttagggatgggagggagagggaagcagtagaatatgtacaattatatacaatcactgaaattgctggttaagaactgtggacttgaactgttaactctttgtagaaaggagaatggctaatagcaatttagaagataactgtaacaatagcttcagtcccacgtgttcttttcaaagtttcccactcagccattaagaggtggagtccagttcacctctctgctagctgggtggatttgtgacttgctgtaaccaatagaatccagtgttaagtatcacattgcttctgaaacaagcagtttcttgccttgtgagttgaaatgcttgtctctggagcccatgtcaaaagcatacagctttcccgatgtcaccaggctgtgaggaagaggcccaaccatcagtggcatcagagccagacatgtgagtgtgtggcctttgatagagccacaaagttacctccagttttctctgctgaggctgctgacattatggagcagagaccgaccaccccgtgtgctccttctgaattcctgacccacagaatctgtgactccaagaaaacgtttctttggtcccactagatttggggagacttgttctgtagaagtggtaatggcaaccatgagttgaatgaatataggaaaagtagaatgaaaagtgtgcaaaggacagtgttgagtcggggagagtagagtgaaaagaagggagtgaaagagtcttggggacagatccatactgagttgctgtgctactgtgagtcctaacaacagcacccatcaagtaagagagttttaaatcagtggttttcaactgtgggttctaactcattaaaaggacgtgaaatcaatttagtgtgtcacaactggcattccaaaaaaaaaaaaaaaaaacagacatagaaatattagtgttacatatagaaagggtaagtattatttcaaggacctttgatttcagctatgtttgtatatgtgctgggtgaagtctaaaataagtttttatgtgggacacagtacaaaaattttgagagatgctgctttaaactggctactagttgcttaagctagacttaaatatgtgtgtgggatcagtatcatttattgccttcagtggaagagagaattagattgccaggactctggtggcaatgagaagaacaggccatgatcatagatttctgctaatttattgtcttttgttagaacaagtactgtttgttcacgaggcttactaatgagtgtgccagctctcaagatagttgtctgtatatggaaatgtgtgctcacagatttagacttcacctgagccagaaatgctaataacagttgttcagttataaacaaagttattagtaaaaccctttaaaaatgcaaaaaaagggttatctagagcaaaggagaaaatgaggtataaaatttaatacattttcccaaatgaaagtataacattcctttctaaattgtttgaaatgtaaaagtatttctgacagcttggtagaaaataaaaaccaatggatatagggtcaaaagatacattgggagtccatataaataagcaagtgacatataaattcagcaatacccaaattagtcattcttagaagagaaacctccttcaacaaaaataacctgatggataaggactgcagaaggaattttggtcttctcagagttgggttggtgtctgtggcagctctttgagaggggagaagagtggctgtctcagatttaggtttctaaaggaaggtttaagttatttttcaagaagttatgtcaatttattgtgttattttggtcaagttgagcacaggttggcctgtgtgtgcatgtccatgtgtgtataaacacacatttgtttattgtcaaggatgagcattttctgaagcatggttttctgtttatattgtaagattacatcttctgtctttgtatctacttggactgttgcatttttctaataagcttggatgacaagtgtatatagaatgataccctgtttcatttcatagaaacatgttttcctggcttgctagagttcagtttaaatcaacattccaggactgtcccaagcagattggtgaagtaggggacatttttcttctgcatttcttagatgttcatttatatatttcctccctttcctctttacagactaccttaaaggaaagttatttgagtcataagaaagagttaatttgtcctgcctcccagcaggggttacaattgagcagaactcaaggtgagagcaatatttaacccaaaacaatgattcccttgagtcagattttatgagatgagaaggagaaattttgagccaagggactttccctcccactacaattggaactctttgagggaacggaggtgtattaatcaactctccctttgaagtccaattctgtggagagagacagaagccccagccctgtcctgaacagctggacaatgatcttcccattccctgacccaccgtgggaagaacttagagcacaactggggacacattgagaacagaaaagacagtttcatctgactactgagttttctttaggtattcttttcaaagagatttagtacaacaacttcttttaaaaactggttgaattacataaataagccgaaaagaaagtagtggctaagtgaaaaggtaaccttatttctgaacctctgattgaaagaacaacatactccgtgtagaaaagttgcagatatacaaatatatgatgaagaacccaaactgcctgtattaattcattttcatactgctataaagaactgctcaagactgggtagtttataaaggaaagagttttgatcggctcaccattccacatggctggggaggcctcaggaaacttataatcatggtggaaggtgaaggggaagcaaggcaacaggaaggagaagtgccaagagaagggggaagagccccttatgaaaccaccagatctcctgagaactcactcactaacaggagaacagcatggggggaaacagccccatgattcagttacctccacctggtctctcccttgacacttggggattatgaggcttacagttcaagatgagatttgggtggggacacaaagcctaaccacatcactgcccaatctctcacccagagaaaattattagcattattctcttacatacccctacccttgtatgcaactgtattttcaatttttttgtttaacatgctataagctcagatagagaagcctcctttttaatgactgcataatgatttcttctgtagttccttagcttatttgctgattcactaattttacacactaattttactacctcatcattcagattataagtgaggttatctgtcagagcattattggtaggtcttggctcccaggtccgagtatgtcattggagtatattcccagaacaaggtgaagtgctggaactattttcatgtgtctttatacacactgtcgctgactttctgtatgtttattctagttgataggtcatcagcaccatatgaaagtgctggctttcccatcctggccaacttgaatattttctataagttttttgggagtttgatatgtattaataacaaaaattattccactgctgttgcttaccgttctttatttgtgaaatgggacatttctaacatttcctttttagccagttctattttcttgtctgtgatttttctgtttgtgtcctttacatattttcaggaagctgtgattgttcagtgttaatgagtggtgatcacaaataccaagtagttcttattagattttatatagtaatagaccttaactacacagtacaatgttaggttctataagtaatagcatagatgatgcttatggataatttcttttttgttggcattaatggatacagatttatcatacatcatagctaagaacagaaagtgttttatactgaaaataaagaaatgatatgggccgggcacagtggctcacgcctgtaatcccagcactttgggaggccgaggcgggtggatcacctgaggtcaggagttcgagaccagcctggccaacatggtgaaaccccatctctactaaaaatacaaaaactagctgggcttggtggcaggcacctgtaatcccagctactcgggaggctgaggcaggagaattgcttgaacccggtaggtggaggttgtagtgagccaagatcatgccattgcactccagcctgggcaacaagagtgagactttgcctcaaaaaaaaaaaaaaaaaaaaaaaagaagaagaagaagaagaaaaagaaatgataagatgggttgttttttgtgggagatagaagacataggctttattatttacttatgttttttaagtaaattctttttttttaaactggacttagattggcagaaaaattgccaagatgtatggaaaccgccccccgccccgaacctcacacctaattttacctcttattaatgtctttcctaatttttacctaatgtcttttatctatcccagaacgccatctggcatatcatgtagtagttagtcctttggtcttagattcctgtcttactcagccataaataaataccatagactgtgtggcttacacaacaggaatttatttctcacacttctggaggctggaagtctgagatcaggttgccatcatggttggttcttgttgaggcctctcttctaggctacattctcactgtgtcctcatgtggcaaggagagagagagaaagcaagttctcttacatcccttcttataaaggcactaatcccttcacaaaggccccaccctcctaacttcatctaaatctaaatatctcccaaagaccccatctctaaatagcatcacattgggaattaaagcttcaacatattaattttgagaggacacagtttggtccataagagttcctcatggctgtgacacttatttttatttatttctaatgagttataaaatcattcctgaacatctgcgtgtattaacattaactctcattgaccctcatgtgtttcagaaacagtgttcaattagccacatggcgtgatttctaagcaagttttaatttaggtgcatgaacatatattgtgttctgtaattagacaggcctgctgtggttccatttaaaaatgtacacgtcatacacagaggtggaattaaaccacatcgatatgagacatttctataccaaccagagggggccagccatggaggactcctgctgtctatacattagtcagaccttgtttagggtctgttttacccaattggcctgctcagaataacagagaagagcggtaggtagaaacaaggaagcagctgtttttctagttgaacagtgttatctggaataaggttcactacccaggttgaaactaattggccatcatgctgggatataattgtgggtgtgtggatgataacacctacctaatctgtacttaactaactaggcttgttaataatcaattttggtgacttggtgacaggtgcgagacttgagtactatgttggatgtcccagataatgatgagtggaggttattttaaaatggtaaaatttttaaaaattaaagaaaaggcctatgtcatgggtcagtaggtgataatcaataaatggatctaattcaattgaggagctctgttaactgtattttacaggaaaagggtgtttttaatattagaagttaattacaaatgtagcaattattttgactcgattttttttctggctaatattttttcattacaaaagtcatgaagccgctaaagcaatgtatttccctttggagtgtttagaatgtgcactttggcctgtttggaatttttttaggagacactattggagataaacattatacaattaaatattctcaactaataagatgataaatcacatctctggagatttctaatgtgtttacttaattcttcccatttcagtataagcaggaatgttttaaaatagagagttctttttatttgctaatttccctttcctcttctgcttgtgcagtattaagtgatttttagttaaaagtcatgggagttaaataggcatgaggactgttttccatttacattcaggtttggttcaaattatgtaaaatgaagacagttggggctatgagttgaaatcattagtacatcaattattctgtgataaccagctgagaacaggctgcagcctgcaataaatgttccctccatttaaagttggcttctcattagcttatatgagagataaaataatttgattctaatttatctctccttaaatggacattgttcccccctgaattcaagaggagagcattttaattttgtagtcatttataacacatgggtcaaataaataacaagttttatttctagcaatatatgtcacttcagtaatttatattgccatagtttctggattctaagacacacatctttttatgacataattggccataaacgtgttaaagataacataaaaatcagtagagaaaataagagtttttaaacaatgttgcttaaataattttttaaccatttggaagaaactaaagttagagctttgcctcactagactctaaaacaaattgctgatgtttagaatgtgtaataagccagatctgaaaaataactaacaatgtgtgaggaaaattttaatttctaagcataaaaacagtgaacgtaatttcaaatgaacacaaaaatagtaggctgcttttgataaagggcaaaaatcagaaataaatgagaaaaaaatgaattacatctttaggatgaacaatactaagtacaagaaaaacactgacaggcagattggcaaaggctatcaataaacaatttatagaaaaaaatctatcagtggctaataaatgtctaacataaaagctttagttttgtttgtgttttcttttctgtataacactaggtaaccaaaaagctcattattagttaaataatggaaaattaaattattctaaaattgttactcttgaggttttgattaaatgggaatttacataaacttttgatggggctgtacattggtataaacattctgaaaagtaatttgggcatgtgtatcaagatttgtaaaaaggtttataccctttgattcaataattagctttctaagaatctaaagtataaatggctagaaatacaaaagattgatatcagcatatgtattgtaatgatgtatcagaaaatggagaaccccctaaacatccaatagtacatgactcaataaatcatgttgtacatcatgatagaatattgtacagccattaaaatggtattgtcagagattatattagtaggcttagaaaacacaataaaataagggtagaaagaagaatacaaagtattacatatgaagtggtttcagtttttttcaaagtaaaaatagtcatacaaaaaggactagagagaaacccatcaaatattaatagtagttaactcaaggttgtggaattattggtattatttatggctttttcttcaaacatttccccccaaattttctacagggatgcatcatttatagtggaaaaatttagttcttaaaacataaatatatacagtagttcccctgttatctgcaggagatactgttgaagactcccagtggatgccagaaactaccatggatagtgcagaacaatatatatgctgggttttttcaatccgataaccgagatggctgttaagtgacgaatgggcaggtagtgtatgcagcatggatccactggacaaagggatggtttgtgtcccacgtgggatggagcaagacagcgtgagatttcatcacagtactcagaacagtgtgtgatataaaacttgtttatttatagaattttccatttaatattttcagaccaagattgattgtgggtaactgaaaccgtggaaagtgaaacagcacataagcggggactaccatagcaccctatttttacaacccttaacttatttgtctcttccaagttccagagggcagggatattctctattagtcttgttctctgcttatcctcagtgactcaaacagtgcttggtacattgtagttactcaataaatatttgttgaatgaagccagcgtttggggtgtctggcccagctaaagataaatagcaaaatgtaaaaatagctgagttagggacccaagtccctaagtttggagtgggcagcaaggaaagatgtgagatccaaaatctgagcacagagctagaaggcaaagtgtgggattcaaacaagaaaagggaaaacggagcatgtagaagacctgaaaacgcggctgagcaactggagtaggacagtggaagctcctcctgcaagtgttgtgcaggacacggtcctgcctcgtctcacacaaagatgacaagattaggctacaaaggcaacttcaatcttctctaaaaatacagaattttatagggcatattctcatcacaaggtaataatgactttaaaaactgaacgtgaagaaaaggcaaaacaatagtcataatcacttgagaactaactccctaattaaggggaatttttttaaaaaaagattttagacataaacattgagaatactacatatcaaacctgtgggctttggcaaacttttaaatgctttctattatataccaaaaaattttaaagagtaagtaagcttagtctttaatttaaagaactagaaaaggaacaaataaatagaggaacatggaactgatcatgataaaggcaaattttaataaactaaaaaggaaaaaatgatagaattaataaatgaagagctatatctttgaaaaaacaagtagacaagcctgtggcaggtttaattaagaaaattagaaaaaatacttaaaacagtagatttgaaaagatgtagccacagatacggaggaggctaggtccactttgaggatgatgtatattttgggagagaataactttttctgttctaagactgttttaaaagagtcgctgttggtttggagtttttaaaagttgttgactaatattataaaaacttttctttttaaaagaaagcatcactgagatatgatccagtcagtatttataatataattattaaaatgtctttgagtttctctgatgtgttctaattgcatctgtagttgtagatttcattcaatgagttcttacccagagaacattcaattatagtgtcagtttgttgagggcttatgatcctgtaatttttgagggagaattcctcagtgtaactgacattgaacagattttgatggaccagttaattttagttaaagggtggtataaattcactgcgtgatatataccaagtaatttgaactctcaacagagggtcacatttcctcctctttcaggcagttttgtgaagtgtgatgcaccagtaggtaaaaatactttaggacttgctaatgaaagacagtgtgtacagaatctgcttttctagcacatatttttatagatgttgaaaatgctcttgtcaaacagtattttaaaaactgtcaggtgtatgtgtgtttttcaaatgagttttaaataattcagtactatgcaggcagcagaaaaatgactttataaacttgcaatgctcttttgtattgaatgtgcaagtagagtctatgaattaaaaatgaatactatctgatccatctttttactaataaccaatgtagtgttgatggaaatttattgtttactaatgtttggtatttttccattaaagaataaccttaaagtcatttaaacagatacaacacgtatgcagatggtgaagtagttttctaatagaagtcctgtctggtttatacagcttgatggccgactcagggtggcctccttcccttttcttccctactatgagctgctgaatcggaagtgaggacatgttagacatggaagatagtttacttctagtgagtaagtgttagattccttagtgcttgcccatacagccacgtagttggtgagcagcattggtggaatatttaaacttccctccctaattacactgaggaattttccctcaaaagttacaggatcataagccctcgacaaacggatgctataattgagtgttctctgggtaagaacttactgaataaaatctacaacttcagatgtgatagtgttacagaaattagaatagatcaaaaattcagactttaaaaaattgtgtattaaatactgtttggatcatgaaatctcagtgaggtttttttttttcaaaaattcagttttaataatattagttataaacttaaaaatccaaaccaccagtgactcctgtaaaaaaggtctagagtgtctaattgggagtgaaaacctaaggatcagactattatgagtcttaccacatttttcattgactcatttgtcctaattctcatctttatcctgacctttgtgtcttgttttttttttctttttaaggtgtggcaagggaaaaacttatgtttgtgaaaaggctatgtgtaaagcatagtactgtgtacatttctttctttgccaaagggcagtgaagaactctggtttttctaaagggagacacattttcttttttatcattattgttatgtctacaatttggttttgttttcctcaatcaggtattttacatgaataacaattgtgttagtcacgatcaggagttatcaaatctctggtctgagaatctgcacgttaggaattaaacaacttccatggcaagtgatttaaggtgtatttgcaggaattgccacagagagggttgtagttggatacagaaagggtgaaaacgtgtctgggaacattaagttcaaagctttttaccttgcagcagtaattttaaagatttgccccaagaaactgtaaacgttcatttaaaattcataaattccacttcagcatctctgagtgcactgcctgtgattgctatccagggtcttgagcatgctgactgtgtactgtttaacacacatggtttgtcgtggtatttcccatgctgctggactgacttgttctgcttattcagtctgaagggactcatcagagctgttgtcacccattcggctagaggtggactgcccaagtaatgagagaggtgttctttatgtgctctgcattatttcagggtcctcttcagagatctttatttttaacaatggcttgaggtccccctttgatcagggttttatacattttcacgttagttgcgattgagttttcttaaagttcagctaagaaccaacagtaaaataagggttgaaggggaaaaggataacaaaagatctcagaaaataataaaggagattaaaactatctggtgaaacaaaacctcgtagcagacttgaaggcatgtagtgtttttggaaaagttttgttgaggaatacaaattagaaatcagtagatttcattttctcaaagtgttttgtgggtcaaaacatattgttagacttgtgtttccataaacagttatatggcttctagtcagacttttgcttgttctcatgttctgcattacagattataaaccctaattatacttttccagacatatagatgccgagcaaaggccagccgaaggtatatccatcagggatgaagtactgggaatggtttccttattgaattctccttctttcagcacacttttttgagtgccactccctcttcctcctagctctgtacttcatagtcctaggcccttgattcaattacttttctaagtatcagtctctcatctgtaaaatgagaccaataatagtacccatgtcatggacttgttgggaaaattaaaagattgcacaagacaaatgctgaagtctgtgtctggctgatgggcagggtgctaccatttccgtgtccctgacccatcacctgcaggtacaaggtgagggttgctaaagctcaagccagtcagagcacgtccaagtcttccagaactgtgtaaatcatggaatccccttgaaagtgtttgctgacaatttactgaataaaataactacagattttagagagccctttaaaagacctaataagtgagtacttaaaaatagtgtgtctgtttttaaaacagtgagatgtttgagttttgactcacattttgtttacctgcaacgtgtcagccattctacaggattctttagtatgtattttctcttttaattcttacaatatttttattatctcctgcacatgaggaatggagctatatctgttagaaggttctgggaattcattcagtgatgaacatctgcattagtatttcttcagtgtagtaacattcttcttgactcttattagaatcatcaggtcctccattccacctgtggtctgcctaccctggagctgaaatagagtgtttagccaaatgctctttgagagattgaggcctgctggattctataatgcctctgtcatcttttgtcaccttggctaggagtcctttggttacaatttaaagaaacccagttctttgtgttacatacattccaattatgctcttttagttattttaaaatgcttggatgaatgataccccatttaccctgatgtgattattaagcattgtatacccatatccaaatatttcatatattccataaatatatattcctattatgtacccataaaaatttaaaataaaatttttttaaaaagtaaaaaacccagctcaagcaaacctgatcaaagaaaaggacactattaaaatttctaatggtgtactttaaggttccaggagcttcagatatgatgaaactcagattcttactgtcattaggattctgtttctccctcctggctctatctcactaaccacccacccccaacgcctgttttggcttttgtattagttatctattgctatgtaacaaatgatctcaaatccagtagcttaaaacaaccacatttactatcccacagtgtttaataggtcaggagtctaggtatggcttatctgggtccttggtttcgggctctctcaagactgcaacaaaggtgtcagtacagaaatctcatatgaaggcttgactggggaaggctccaatgccagctcctgtggttgtgggaggaattcaattccttctgtgttgttggactaagagcctcactgttggctggaggctgccctcagttcgttgccacttgactctctccctaaggcagctcacaatgtggtaccttccttcagcaaagaagagtctgctagtgaggcagaaattacagtcttatgtaatattaatagcataatcatagaagtgacttgtattctgttgattagaaacaattcacaggttccacctatgctcattggcagaggggttatccaaggagtgaatacccaggaatcagggatcaccaggggtcatctgaaagtctgtctgcccagtttcattctcagaagagttctctccacatggtgacagagctgacatcagcagctcctacatcctaatgctagcaatcctagagaaaatgcagctactgtctccctggcatttgtataagtatctgtacccaaccaatagaattcttggttggaaaccctagaaataaactctggcaaactgaaccataaaaagacttatcggaaggatatcagatagcttctaatatttttgagaatactgaagacctgggctggaagaacctgtaagaactggcaggatgcttgttgccattggtcagtgcttcactggactgtcatcactagactttgtattagatacaaagggtatctgattggccagtgcaggtcgcatgcctgtgctctggctgccaggaagctgagggactatctgcacctcttgagcctccactggaggtggggctgtgtttctttgactgtgacactgtgctgagatgagcccataggggtcacctggcttcactagggtgacttttgttcacaaatgttcagcctagcagcttgtattgcataagcagattcagctcaaatgggcagattttagaactttctagctagcatttctatgctgtttgtttaacattaactgtgccttacagacataccagtaaagctgctacagagtagtatgtgatgttgatggcatgttaaggtctctgagtcatgtagtagatggggcatgtctgtttttcatagtcagaatttttattcataccagatttaaccacaagcagaatttactttttctgaaattatgggctaactttgcaatgcagtttttgtcctaatcttgatgttggctctaggaattcagggattatcttaactttttactttcatcatctttggccatgtgcatatgactttttgtacatgcgatacactgacttgaggtatcaggtttttataagtacaaagaacttgtgaatcttttgaaataagttcatgtttccttgcatgcattttcaaagctatacttaattcttatgcagcattgcagtagaatagaataagtaagaccaacttaccaagaagggaaacagatgccacttctatggggtaatttgtgaggtgtagtcttgcctactctcgaaatgtttttcttattggcccaatatggcaactgaaatctcaccattagaactcaaattttgggtgaagatcaatgcatctcaacctgaacacgttggaatttcctggggaattaaaaacaacatttcaaaaaaatcactaaacagaaaaaaaaaccaatgtcaggaccttaccccagagcaacgttgcgtaatttctgggagtagggcccaaggagcagtaaattgtaaaacttctttaagggattctaaagtgcagccaggattgagaaccagcagatcaagagtagaacctgggaagggcagtgcattcattcatgttatgatgtgtacaaggaaatacagtagacagcatttccacagttccagttgagactatttcctgccatcttttcttcttcatgtgtctgtatgatgaacttcctttaacaaagatcaataagtcagagagtccatctaccatagggccatggaatttctagctatggcattgcttgtgaaaatacctccaaaagactgaactcatgggaatatctatttgcttcataccagtagcacatgttaaaatcaggctataaacagtcgaacttctctttcattttatatttactttctggagatattgtgcaaatgatcattgatgtggtatccagaaatatttttgtctatagtaatagcagatggcagagcatttttcatgtgccaagtcgcatttattctgctacagtacaatgtggaagtgatcatggcctctttcaaatattcaactccccatgtgcatttcagttgtggtgggaacttttattgcgtatcagttcaatatgttatagattgacttggaatccttggaatttttgcatagtatagtcacatgagaagtactttgaaaagaaatagtttcgaagcctcatgattaaaagtcatcaattcagcaaacatttaataagcatattttgtgtgctaagccagtggttttccactgggatgggtggctttgtccccaggagggattttggaaatttgcagggttgttcttagtaatcctaatgattagcaggggtgctactggcatttggggtgcaggggccaaaggtactagctgtctcacagcttacaggacagacctccacgataaaaatagtcctctacacacagcactactgacccccagtctgtcgaaaggacattcttgtaaatgaaaaacctgtttgtggttatctgagcctaaaacctaagtgtgcttttcaaataaagagcagtttttggggggacatggatttaacatacagtgacttttccaggaaaattatattaataaattaaattgtaaatgtaaagtgagggaaagttgtactttgctttatttggaattaagagttttttaacctcacgtaaactcacattacccacggaaccttgaatgtggtacttgagtcacaaaaagcctgcatctgtaaccacctgcattcgttattcccatatttatgaggattccacacagaggtgcaagctaagggctactttatatgtctcctgctggtggtgtgcctgagcatttgtaattcatattatttttatttttattttttgagacagagtctcactgtgttgccagggttggagtacattgagatcatcttagctcacagcaacttctgcctcttgggctcaagtgattctcctgcctcagcttcccaagtagctgagatttacaggcgtgcaccaccacacatggcaaatttttgtatttttagtagagatggggtttcaccatgttggccaggctggtctcgatctcctgatgtcaagtgatctgcctgcctcggcctcccaaagtgcttggattgcaggcgtgagccactgcacccagcctataattcataatattttattttattactttttattcttattttttagctaggatattatgttgacttgtgattgtgtgtttgtatatgtgtctgtgtacacaaagtgtacaagatgtgttattcacaaattttatttcaagaaggaacattacaaaatatttaggctataaggtggtattgggtgtgattgggttgaaagtcaccggattaagtagcagggtgatgtcagacaaatcaatggacagggaaactttagcatgctagaggagcacagaggccactgcagtatccagaggagcagcctctgccaagtcctgagggagtgtggtcacactggcccgggatgatcaggagctgggggacatggagggcaaaaggaatggcacatacaaagtcctgaagggtggatgcttagcgttggtgagtggctagagcccagggtgtggtagggctgagccctggcagaagggagagagaaggctggagaggcagacagaagtccatgaagagcctaacaaatcttgcttgcattttattgtagagacactggggagctaccaaagggcttctgggctaggatcaggtttgctggttagacagacacgcttgtcacagtggtgaaaatgggctagatgagggcacggttacatgagccagggtgaagcctgagctaggcaaccatggggtagactgctgggctaacacctttgcaggccatgtgaacctttctgagctctcctgctgcctagcagcagtcagccctgcagtctcaccccagtagctgtgctcctgaccacttttctaagaggttggggtgtgggtgggaaggggtgttgcagagaagatggagaggattgtggtcggtgggagctactcagcatggaatatagaagatacagggtagggaactctaggatgtgtctggttacatgaagtgtctgaggaaaagaacactaacctcacagaatctcactgactctttaacctctgtgcccaattaagggagtcgggggagattcttgtccagttattttgtgtgatttcacttacctttgcttttatttaatttaggacaacctgccattttgttctgaagatttgaatagcaacacagatcctaaagaagcttagtaatactgcaaagctaatgattatgactttcatccagagcactatttagaaacacttgcctgtgccaaatggaggaaggtgttcttaacaactcaccccagcaacagcaaaactatttaggcttatccaccacattgatgagagaagtactgttcttaaaatgagagccttgctcggtgtcttttccctttgcatttaaaaataaatgaaattactgaaacactattataagaagtttggaaaataagagggatgttaccttccccacatattatctattaatattttttatgtatttcctttaaatcttgtttttagatatgtttatgtatatttgtgtgtctgcataatatgttatatgtataaatatgtaacattataactgtatacaattattctaggaatcaacacatgaaatatgggagcaacattttgaatcattcttccctctcagcttccaacttgcgacctagttaccttctgattagatgtctctattttgttgtctcataggcctctcaaagcaaagaaaacaactgagttcttgcattgtctctcaccctagcctttccttttcccaatcttctgcatctcagtaaatgcttccactatccatttagttgcacaagccagaagcctagatttcttcctttccctcaccctctacactgagtccatcagcaagtccttttatctctgcctccaaaatacatcccagatctatctattacccttccctggaatagaagcagtcctatcaagatctgttgtagtagtattaatatttctgtaatccactgccaccacctccttccaagctgccatcatcttttaccgggactacattattctccttacctgtcttctgcttaatttggccattcttacttctctagggtctgttctctcagcaggtggaatagatcactcctaaaaatgctcctgtttggaatcctccagtggccttccattgtacttagaaaacaactcaagttctttactatggcacataaggcacatggcacacaggccttatgtaccgtgagtttctaaatccgtgcagcaccctgtgcccatatttcttgcttactattagttatctcaaaaattttttttttgaggcagagtccccactatcacccaggctggagtatagtggcaccatctcggctcactacaacctctgtccccggggttcaagtgattctcctgcctcagcttcccaagtagctgggacaacaggcacgtgccaccatgcctggctaatctttgtattttcagtagagatggggtttcaccatgttgaccaggctggtctcgaactcctgacctcaggtaatccacctgcctcggcctcccaaatgctaggtttacaggtgtgagccatcgtgcctggccatctgaatgttttaaaataccaaattcttcctgcctcaagctgctacatatgtgcttgtagctgcctgaatcttccattcccacttctgagcatgctagctccagatcctgcagtgccacttaaatgacacctccttgagaagccatcccagacagttctgggtaaagtagacttgctttcttacacttaacagtttgaggtgtgtgtgtctgtctgtctgtctgtctgtctgtctgtccatctgtctcctccactctagattttaagctccaggaggtaaggaccttgtttgtcttgttagtgtaatagtcactaaatatttgatgagtgaatgaatgaatatgtcttagtccatttagtgttgctataaaaaaatacctgaatctgggtaatttataaagagaagaggtttatttagctcacagttctaccagctggaaagttcaaaactgagcctctgctgaaggcctcaggctacttccactcatggtggaaggtgaaggggaaccagtttgtgcaaagaccacatggcgagagaggaagaagtaagacaggcagtgccatgctttctttaagaaccagctctgggccgggtgtggtggctcatgcctttaatcccagcgctttgggaggccgaggcgggtggatcactgaggtcaggagttcgagaccagcctgaccaacatggcgaaaccctgtctctactaaaaaaacaaacaaacaaaaattagctgggtgtgttggcatgcacctgcaatctcagttactcgggaggctgaggcaggagaatcacttgaacccaggaggtagaggttgcaatgagccgagattgcgccattgtactccagcctaggcaacaagagcaaaactccgtctcaaaaaacaaaacaacaacaacaacaacaaaacaaacaaaaaccagccctggcgggaactattaaaagtgagatctcattcacccgcaagggaggacattaatctattcatgagagatctgccctcatgacccagtcacctcccattaggccctacctccctatactcctacaaggaggattaaatttcatcatgagttttggaggggacaaacctcaaagccatggcagaatgcgacctacttgaaccagctcagggaattgtcttattagcaggcgtagggacatggaattgagagccaaggaattgctaaacattgtctgttatcttggaagctcttttgtaaaagaggcttctgctattgcaatacccttgtttttgtccagattctttttgtctggacctcaagtaaatgtcagtggtcagcttctatccccgtgtctgcagttggtgccatgtttaataaatcatcatggattgtagagggtgcgttgtcagtatagctgcctttggggcacataatattggaagatggctaggttttacttctgaggacaaaggtgcagggagcaagggatgcatggtagagagcatgtagaccaggtcattcaatcatgctggtatcatggttgaaggaggcatcaaggacagaaaacaagaagtttaaaaacagtttctgttaagaagaagcaatcctgtcagaatctttcctagtggccttagtgttcaaaaacctgaaaaatttgtattacatctcattgctagtactgcgaatctgggaccatttattaagatccccaaaccccagagcttctgatcagtgcagcccctacctgctattaactgcttttacaggaagaaatcgtggagagtacaataggccacttctagctgactgcctcttaccttaccttgttcctttaccttgtccaacactgtgtctccaagttgcgtccttaatgaggtcatttgctctgcatacattgtgagattatgtcttagagtattacattttctgctttctgagctatgcttgagaggacaacctcttcaactgtggaaagaatttgccatttaatagaggagggcctttatagcttgtcacagctttcagtcacagatccagtttttgattctgtcacagtggcacatgagagcaggaacattttgcataaccacttaactcagcgttacaatagcctcttaaatggatgaggagcagcttaagctggcttgatgggaaagaacactgtctgttggtgttaataatattcgtatttagtttgcataacttagatccacaataatatcttaatcttagttttgctccaaaattgcctttctactatcactatcccatataaataatgtatagcaacattgatttgattgtaaccctttcatattttattaaaatttttttctgtaaacatatattgagcaccccctctgtgtcaggaaatacacaagtgctgcatatctagaggtccactggacaaaaaataatgggtgaggattttcagaattgtaaaagcacatgagacctcatgttgaaaaacacagcacatcttagcaggttaaataaatctgcaactagctacagtgattgtggtataaagacagtatgtccaaaataaagagaaaatctttgaaaactgaagaaaaagacagattgcctacagaggaatgactttccaactgacagtacatttattatcagcagcagtagatcctatacctgtcatcaaaataggatgctgaaataaaaaccttttaggacatacagagactaggataattttttactctcaaatattaactgaaagaactatgaaacattgtattttggcaaggaggaaactgaacccagaaataggttgcaccattacagaagcaatgacacaacaaggaatttggacaataagttaatgaacttgagtaatcagaataaatggcttcctctgtgccgccatgatttgagtactagcaagatgttttccagttaaatacagaattactttggtttggtgctgatgtctgaaattcttgtttgtgatgaattattcacctcaatcaagggtttttaagaaggggtccatggatggagttcaaggtatctatgaacatcctaaaattacaggtaacgcactttgtgtatacacagtttttctgaagacaggcttgttggctctcatcaggcgcttaaaggtacttggaatttgaattagtttaagaactactggattaagttattgttccttattaaagtgaaattacatcaatacttaccttgctctcaagttgagatacatgatctgaatttgaatcgtgacgttattggttaccttgcagaatcactgtgaccctggaaaaattatttttcttctcattgtagtctgagtgtgcattgtatgatctgtgtagctaaaggcagcagtggtgtgcctggcccctgtgactgtatgtcagtatcacagtcagtatttgattatagttacgatttttctaaagagagtcactattaagctaacagaagaaataaagcttttaagttaccaattttaggatataataatatatttattgttttgttaattgaacatatattttgtgtaatacactgtccaagcgtatgtagtggggtggacagggggaggctgtgttcagtcattatctataccagtgagatttcctgctaaaacaagtattaactggtgaccatgtgcaacttgtattttccccccagctttattgaggcatcactgacaaataaatgttgtatatgtttaaggtgtataatgtgatcttttgttgtacatacacattgtggagtgagtaccatgaccaagctaattaatatatctgttacttcaagtagttagcatttttgtgtgtatggtgagaacactcaagatgtactctcctagtaaatttcaagtgtacaatgtaatgtattattattaactctactcaccatgctgtatattagctctcttacttattcatcgtataactgaaagtttgtagcctttgatcaacatccccctatttctcccatccctagttcctggcaaccactgttctactgtttctatgagtttgacttctttagagtccacatatgagtgagatcatacagtatttgtctttttgtatctggcttatttcatttaggaaaatgccatctagatttgtccgtgttgtcttaaatggcaggatttccttattttttaaggctgaataataaaaattccattgtgtgtgtatgcgtgtgtgtgtatacataccacattttctttatcggttgatgtacacttaggttgttttcttatcttggctattgtgaataatgatgtaatgaatatgggagtgcagatatctctttgaaatactaatttcagttcctttgggtatatatgcagaagtagaattgctggatcatatggtatttctatttttagattttgtaaggaacctctgtattgttttctataatagctgaaccaatttacattcccaccaacaatgtatcagtgttgcctttacatccttgcccacacttgttgtatcatttgattttttatagtagtcatcctcacacatgtgaggtgatatctcattgtggttttgatttgcatttccctgatgattagtgatgttgagcagcttttcatgtacctgttgcccattcatatcaaaggaaatagcaaaatgaaaaggcatccagcagaacggagactatatttgcaaaccatatatctaataggggactaatatccaaaatatgtaaagaactatagctcattggcaataaatgacccaattgaaaaatgagtaaagcacttgactagacatttttctaaaagagacatacaaatgtaacttgtgatttttttaatacagtgtattttagatacatgtattttatgtgtaattgaaattccactcttcctctcatctgatagttacgtactgagtgctagtgtcaggccgtttactgtagttgctgtggtcatggatgtagagttggtggtggtcctgtcccagaaggaattactctgaataggatagagggtggtaggtcataaccaaatccccagtcctagcctaagacctagtaaggtcaacaggaagttgttcctagttgcaggattgtccctgaatgctgcttcggatggcatcttccacgtggagctaagaacagaatgaagccacaggcttattcagagaccacaagcttcacaacttctgtttaacacatctaattatgattgtaacaatactgtctggttttgatgctgttacgtttgaaggtagatcccagccactgatcagagcattcagatggatcatcttcccccaaagcccagggcttctttctgtctccacagcacccccagctcaggggtaaagtgccctaaccctaggactggtgagaaccaccttcccagttcagttttctccctgtctgcaggtccatctatcttctcgctcaggatgtgggtatctcttagagggtgaagggaagtgatttgtcaaatggttaccaagggcatggagaaagttaatttacctcttaaaatgacttttatattccttttacattggtgaaattcattctcctgtttttttatgtgtgtgatgttgagagattctcagttttgattgaataagatcataatctcatttttattttaaaattgaacacttttataaagcttaaatgaaacaagaccagttaaatttttgagatggaacttttgtggaaaatgctgaatgttggaggatgacgcaatgagttctccggactgccagcctcccttccctagatatttgaaattatattagggcaattagattataactcaaacttctgaaaaccatttagagatagataagaaattcatttcactgtattgtactctaaattgtaaatgagattcaagattaattgtttaataggttgaagttttaaattgaaacttccttctatgttattttatatcatatatgcttcaccatgaaggttgatttgaaaccagagtttcagaaataccaatattattatattcttttcatctaaattgaagttattattatttttttaactggtcctggccacttctttgtatctctcaaactgccactttctttgtcatttttacaactattaataggtggccgattgtactgagcctgagcatagaataaaataagtacagtggtcccccttatctgtgattttgccttctgcatttttagttagccccagtcaaccttgatccaaaaacattaaatggaaaattccagaaataagccatttataagttttaaatttcacactgctctgcatagcatggtgaaatctcaccccgtctcacccaggacgtgaatcatctctttgccccgtgtgtccatgctgtctctgctacccacccgtgagtcacttagtagctgttatgattatgagatgagaaaagcatagtatatataaggttcagtactatctgtggtttcagccatccagttgggggtctgcagataatggggggtgactatagaatttcttagcttggctggggagctaaaagcatagttcctactattcttgccagaaaatgggaaaaaatgttcaatcccataattttattatatgaagtagtgacacggacaggaggcagaaacagtgggtagaagagggcggttcccagcaaaggccccaccctcaagcctggaaacccacagccctaaatgggaacaggcattcctgtttttgcatccaaaagctgcctattggcccaccacacccccctctcctgtatccatataaacctgagaccccaggctccagaaggagacaaggagatgaacagaagagcagaagaatagcagaacggcgcaacagagagaaggagcatctgaatgctaagagggagtttacctggacatgatcggagaggagatatgtcactggacagccaaactccaggggaagaccatcttcccactccatccttcttccacctccccatccatcccactgggagccacctccatcacccaataaaagccccacattcatccttcaagtccacgtgtgatctgatttttcctggatgccagagaagaaacagggaaacagaaaactttcacactggccctctgcctttgtggaaaggcagagggttcactgagctgtctaacccttaagctgcctgtggaccgcaaggttaaaagagcgcactgtaacacacacccacttgggtttcaggagtcgcagatacacacccctggacgttgccgtgaggctgaagcctaggggcactcatcccagctcctgcacctgcccatctgtgtgctccccttcccgtaaggggtttaagcatgcacggtcaccaaacagacaagttacaccactgtggcacatcctgcaagcggggggggaggggggtcagggaactcctgtttcagtagatatatctgatgaaaataatgctctcctgaggggatgatcgtgtatgtggtgtgtgtgcgtgtctgtgtgtgtgtgcacgcgcatgcatgtgccatgacttttagcacgtgtgcatgtatgtgagggcttgtctgggcaatagtgtcatttagtcagctaatgggaacaagcatcaatgctgttctctttacaaggctcctgtttgtctctttctttcaagtgttcctcattgcatgttcttttcctgagagccagcgagtcttttcatagcttggagacaaagaaaattactcagaaccatcttgcttgtggtgtttcagggaatctcccctaggctgctgccatagtaggcgaaatgtattggttttgactctgagtctcgtgtaggttaccaaatggcggattcttagctctgtgattgccgtggctcagcaagcaccctgagctgaacatctagtggttttaacttacctcctgttggtcttggtgaaacggtcctggcacacttgagccatttactcaacatatccttgagtgcctctcatgtgcctggccctgtcctgggtgtttggaatacatatgtaaaagccacataaaggctatgttcttggagtctccatcaggctctttcataactttcagtttcccaccttctggaatgagaggtcactattccaggctgtgggaatgcgttcatttgcttggcttttttttttttttaagcttctaattttgtataatgtatgaatgagacaccattgctgccctcagggagtttgtgtgtgacagagagagacggacaggcaggcagacgtgtaagtactgtgccaccagcagactggcttcgtgccagaataaggtaggagcctcagctctgaggggaggcaggagaaggaaagaacggctcttcaactggggtggcattttttgacagaggtgctgtttggcttagcctatggtcagagagtgcttgggggatgtgacagtggggcatgtgggaatggaggtagtagacgatgaggtctccaccctctgactttgcagagatgggcaaggccaagtgttggaagggcttaaacacacaccggagtattctgtgagaaccagtggatttcagaggatggcaatgacaccacttgccttctgcctcaggaggataactgatggccgtgtgtgggatgcactggagagcaagagctggcttgcagggagaccagctggatgattttctttcatttattttattcattcaacacacattcatctggggttcactctgtgcccaacactgggcatttccaaatagtccagatggcagtaagcatggttgtggcagtaggaatgggaaggctgggaggggtatgagaggcattacaaacgggaagtgggagtggcaccccagaaaagtctagtttaaggtgctagtggatgtgtgcatgtgtgcgcgggggtgtctagagggtggcgggcagctggaaattgaggtcaagtgcttaaagaacaactcgttgtgtaggacccccccctttgtggtaacagcagaggtttttgagaatcgccagtaatttcttaaactcaggctggttgggaggtcattcagccagggaactccacaaagagtgttgccacttgggtcaaagtagacctctgaaaataaatcttacaagtaattgctggttttagatgccagtttaagaagagttaaaccactgtcatgccctaacgcaaacactttcatgccctaactcatctttcaagtttgaaatttaaatgtatgtttctttgttctgagtgactgaaacatacacatgaagacaactttggtggatgcaggtgggcatctcagttccttttgctgagtttcacttgctctctgcttcactcatccatggtgtagaaaactgcagcagtctgccctgccataacacagatagacatcatccctcacaatggctggataattccagatttaatgccaaacagagaaaactgattttatttatgttttgtgataagaggtacagaaaaaaaacggaaagcgatgtaatgacttgtcttgaccaaatgcttccactgctctggaggagacaacccacttcccctggttaaggaggggtgttgcgttttaaacatgtggtggttgttattcattgtacttttttttaaggtaggagatgttgttctttggactgagttaaatgctgcttagcataaaagacttgatgtggaacaaagcctgcagactgtgactatttgacatgcactgggctaatgagaagacagaatgtctctaatcagcagcagaacaaacactcacaaagggtctccttccctcctaggacttccttcgctgggcatctggctgggattcttgttggactaatgtacactcaagggcctctgaagaaaatcatggaagcatgtgcaggtacagaataaaacacctttggcatgacaacagcttggaagttcatgttaattttaatgtgaacagaagcaaccccaagtttccctgtggttcagctcaagaattccctaatatgcctgtttttctttttaaaccgaaaggtaaaacaaccagtgcagttccttacattgctccacaaaagaggctgcaaacttaaatttcgaatctgatactttcttaggggacaaatatcagtatatatttataccctcaaccttaatgctacccgcagaaaaccacgatttcctaaagaatgcagagaactaaagtgcctttaaaataatgcattcttctataatagtccatgaattaatatacgtgcaaggcaaaggtgaaaaagaaaacaaagcctggactgaagtgcatggccagtattttaaagaattcagactgatgaccgggtccttggtggatgagccatatattcatgcatggcgaaaccaagtctgttattgcttgaagcttagctcctgctttttttaattttgtttttcccttcaaattgatactcaatgaaaatatttcatttagaaatacttgtattttttagacctcttaattttcaatgcgattctcattttgacttgtaagaaaactggtttgcaaacacttgttttatagactgagttccactatttcatcttttattcatgggaagtcttctgagactattttaccttttcttgaaccataaataatttgtttcacagtttgtgctgatgactggtattcttgagaaccatataatattcatgatagtagaaagctttccaggcactgcactggcacctttattagcaggtcgtgttcacttttggttgatttttacaggctgtgttgcatttaagcagatcctcattttcccacgtttgcttattaatgtgtttccactgtacgtacttagaggaggcagtgggagcttcatttattgaaaatgtccagttttattgtattttcaatacaatttaatactcattagtactgataaaagagatgattctcgggagtttaatgtcttgtttcttttttctgtgtctcatgatgaagcggttagtaaagctttttgcagacatgttatgaaatttaagcaagtgctttgtttaatttttaaagaggattttcccctaattataatatttaaactcttagttttaaaagccttaaaaaataagtggtgacttatttctacaccactccattttcaaagtaataaatacaatagcaaattaaataggaaaattagaacactcagtgcaatttgcaaatagcctgcgaactcggccttttttctgtgagctgagaattgaaggacacaggaaccccatggaaaacgacccagcatgtggaagctgctgtctgatgcctcctggaagaggagggtcaccctgagggtgtggcccttggccctccctctctcatttcattcagccgtgccaaattgactgagtagacagtcctactgccttctgtagggacaagaaagagtgaagtcccctaggaagggtagggaggatggctctcctaacaccttctttgaggaaggttctccatttagccagagtgtctctgcttgtacagagacatcaaagccgaggcttggtactttggcaggcaaagactaaggaacttcagtgagtgtaaattagggtttcattttccactacacacacacacacacacacacacacacacacacacacattcttttccctgtagggacacacacacactcttttccagttagggctggcccccaaacaaaagggagtttattttaataagtgtttagaaatcatttgaaatgaccttgggctttgtccagagaactttctaattactggaacaattagcatttaaagctttatggctgccattaaaatgtttatttcttttacgtttaggcggtttttcctccagtgttggttacccaggacggcaatactactttaatagttcaggtaggcactgtatttcatttaataaattttaacttatttttaaaattatagtgttcagctctacagagtactttaggatactactagtttctgctgtggtagggtcattcacatgttgtgtaactgtgcctctaacacacctggaagctagatggagggtagcctagggagcatatttgtgggggttggtagggaaggccagggaaggaggtaactcaggcatgaaaacatggtatgattggtatgaggtctctcatgtgtgataagattcatattagaccttggttctttaagtctcagtctgagactctactgctgggaaagtgttaaaagttggttttaggtgtatagttctccatggcccatcctgtgtatattcaggaacccttgcataccgtcagatgctaaaataggcatgcctctaacaaatgccatgtgacttaatgaggaagaatgtatttttctaagtatctgtgtaaatagatagaaaagacttcctgttaaaagcgtaagacctattttaggctaaagcctttgcattccagtctggggtggctacacggtagtattttagatcaggcccagcagccaggtgttagccatggccattggaacactcatgtcttaatgcagtgaactgaatgtgcccgtccccaaattcatacgttgaaaccctaacccctaatgtgatgattttagtagggtaggagtttggggaaaaaattaggtcatgagggtagggccctcatgaatgggattaatgtccctataaaagcgacctcagagagctctctagcttcctcactgccacatgaggatacaagaagtcagcagtctgcaacctggaagagggtcgtcaccagaactgaccacactggcatcgcaagcttccagcctccagattgtgacaaatttctattgcttaagccagccagtctatggctgtttgttatagcatcccaaatggactaagatgtgtttctgtttatattaattgaggaccactatagcttaaagctgagactagcagccttttctttaaaggaccggacagataatatttcaggcatcaagggctttattggccatataatctctgctggaactaacctgtccttgtagcatgaaagctgccagagacaatatgtaaacaagtgggtataggtgtgttccaatagaatcttattcctagctcctgccttttctactgtgtaaggatatgagattgacactctgccaatttaaccttacaaaatagggcagttctacttactgtcttctctctcttttgcactcgatttattttctattttttaaaaaagaggactgaagagaacagcttctttccttcttatgtggaagaagcacagtcacacagaccagagaattaagggcaaaaataataaaaagccctttttacctcttttaacctctgtaaaattactatagttatatgcctttctctgaagtgattggatttcttcaaaggcagagctacttaaggccaggtggctatgctaatggtcatctagggaacttttatgagagcatatgtatatcttacaagtaatgatttattcttaatatggctgtccttagctggaaaagtctttataggtcaaagaaccgcatgaatatttaaaaagctgttaccaatttttctaatcttggtggtgtttcttgatctcctttgccatgaaatcctggtatgtgtataaggaacagatggagtagttaatagaataatgacaaccagattttcttttactacagagcctaagtatataactaaaaaaaaaaaattaaactagtattcctctcaggacataatttaaatttatttatcttaattgtttgattgctaggtttttccaggaatgtttattatgaagattttaaaacatctgattgggccagtgaaacatccatagaaaatttttggtcctacgggaggagatctgttctcattataatagatactgatgagattttgggtcctgttgatgatctatgattgacgatatagaacgtttagccacactggtctttctgatttaaggcaccaaaactttcccattttctttccccatattttgtctgacaagtaccaaatttgtttttataatattcagatgtttagagttgttgactttatttcattgaagaactgccagattattttaaaataagaaatagcatgaataaaaatgtttttctacatcaagaaaatgttgcctcaaatcatcgcatgtgtatctggcaattaaaactctaggtagatatacagtttctatgtggtgagcaaatattcagagaccttgggttattttggcttttgaattaactgagcatttttgggggtggataggtagaaatgctgcgtagatcttacataacagaatggctttccacatgggtttgaaagtgataatgagccatgtgggaaattacccaatatactttttgtattccagtaaaataattggcattcatagggaattgggcagtttctctaagcagggattgctgaagcatcccatgctattcagtgacgtctctataaatattctattagtgttgcagaatggttgccactttctttgattctttgtggaaaagatgtattaattatgtttttaccatttgtcctcatgtgaaagttcttttttttttttttttttttttaataaggaatgaaaagtaagatgtgtaaaaacactaccacagtctcctttactctcaaggtctgaaactggctggttgggtgttccccagtgcagcaatgggggctaaatttttctgattctattggatagagaccagtttaagaataaatgttcatatttaaaatggtaagatccaagttcagttttaagccattgtgaggatttggaaaatgtacttgtctccttctcctgttctaaatatcaataatgttaatattttgacatgggaaacaggtgagagaaaatatgaaagttgggttattggaggtatttagtaaatcctcattaatatttactgcactggggcaaagcttttcagaattagtctccaaaatcctaaaccattttatttaatgtttatttaaatcattcctttttcttttactttcaaggacgttcagtaaaatagaatcaagttagaagagttttttcacaatcactgagaatggacaaaagatctggctagacatttctctaagaagatacacacatggccaataagcacataaaaagacactcagcattattagtcatcaaaaccacagtgagataccacttcatatgccctaggatgtttgtgaataaaaaggcaaataatagcaagtgttagtgaggatgtggagaaattggaacccacatacactgcttgtaggaatagaaaatggtacagctactttggaaaacattctggcgattcctcagatagttaaacagaatcgccatgtgacgcagcagttccacttttaggtatatactcaaaagaaatgaaaccatatgtccacctaaaaacttgctcacaaatgtttatagcagcattattcataacagtcaaaaggtagaaataatacaaatgtctatcagttgacacatggataaacaaaatgtggtataagccatacagtggaatattatttgcccataaaaaagaatgaagtaccgataaatgtaacaaaattgatgaacctggaaaatatactaagtgaaataagctagacacaaaatgccacatattacatgattttgtttatatgagctatccagaataggcatattctgtagagacagaaagtagattagtgcttacttagagctggagaagggatgggagggtgaggattgttagctaaagagtacagatttctttttggggatgatgaaaatgtccaaaattgattgtggtaatgatggtgcaactctaaaatatactaaaaaccactgagttgtacactttaagttgataaattgtatggatgtcaattatatatcaataaagctgttctaaaaatatcaatagacacaactacttttcatgaccaatatttatataaaaaactagtgtgttttgtcattcgttgtttatatgaaaatgaagtctactagagtgctgatttacagtttcccttttaatcctgcatattaggaaaatattcataaagaatacaacagtaaattttaaaatagcctcaggaccaactatcaaaaattctgagcatgaaatctcaattaatgcaattctgccattcagtgttcctcttttggctggattgtgttttttttctgtagccttattaaagctccaactcaggcctgtactgctgtactctgtgggataatatggagatctgtcacaaagactcatagcaaaggttaggaatcttcatcaacaacccaaaccacattatttaaatatttgaaacatcaacttcaaagaatataataatggcaggaaagaagagaaaaaatcaaacagactattttacttctctctctttatgccagaatgagattggtaaccttctgtggggaacaaaaatctcttccaaacaaattctctaactattggcagttaaaggaaatgtaaggaataaactcaaactgaaaagatcaatggaaatatcttccaaaaatgaacttttccctgttattgacctttattaatggtgtacctaagtttggtacctaaagcattatttaatgactaggttatctcttctctcttgttttatctagcaaccatttttttttgaagtcgtctcttctttcttgttttatctagaaacctttttttgggggggagctataatctctgacatagaattacaattacagagaaattggctgcatcttaatgttggtattgtctgaagtattctgtgggatctgtatgaaacattggtctgccccttattgtacagagcaacaagacaataaggctttattagctattgtttccaccattctcttgactcaagccaggacttcactgaaaactctccaagtattgaatagctctaagctgaaagaatccactccatatgtcaatagctcattccagtctcttccccaggacttctgactaccctctgaattaatatctcctttcctcattagcacataaggactcattcatgttcagccccatggtgggcactgaggatacagtaacaagacaatcaccatttggcatcttttcttattttgaggataattattatacctaaaataatgttatgccttactcgcttgtctttgcttatacaaaacaggaagtataaaacaacagtccatagctgtgttctagaaccttttccttgtgcctttaggcagctctggatatcaggattattatccgcatggcaggccagatcactatgaagaagcacccaggaactatgacacgtacacagcaggactgagtgaagaagaacagctcgagagagcattacaagccagcctctgggaccgaggtaggagtcttgcgcccttcagttattttaaagcatacctcatgtggtaaggtagtctgaaaaagagctatttgtagcaaattaaattttaaacagttcagaaaaaggatatgtagatgaaaactgtgtgcagattgtgattacaaagaatggggtgtgatgccatattcccagcaacctaagctaataaggtgccagactgtgtatgtattgttaaagtggttctttttatagtcctgctgtacttgatgctttggcattaaagtcaagaaacttaaaattcttagatgcatgataaaaaaaagagagattttctttggaattcatatttgtaaagaaggctcagtgtcactaagtatcaaaatattgcccataaacctccgacaaatctccctcagcatcacataggctaagaattcaagctcagatttgacttctgctgaaccaatctgtctgggggtagagcctagaaatttgtgttttgaacaggctttccaggagattcttttataaaccgatatctgaaaaaacactgtatatattttgccatgtttgttctaggtttggattatgagtttgggtattactgtttttattgtttgagtagcgactaaaaatcaactgttcatttaaagggcatttgttaaagttttatgtttcatgtacaatggtaggtacaatagggaacactgagtggtaaaagttggaaactaccctcaaaaagttaacaatctgtgtttgggcatatgcctactagatgtgataccacacaggtaaccctagcatcaggtgactaagagaggctcaagctaagtgttagacgtagggagaagatggtgagctttttcatacctagaactatcagattttcacagaggagatagcatttgagttggaccttcaagaatgtgtagaacttgaagagctgtggacgggcattctctgcagaagtctgaatatcagcatagaagttagggtcatgttctgccagccctcacttttgaatggacaataagagaagaaagggaagaagagtgggaagctaggctgggtccggatcgcaggggtcctagaattaaatagaccaagtggaaagtggatttagtgtgtggtataaatgccagtagagctctgcatgggacactgatgtggtcagagctctgttaaaagaatctggtagtagcagtcattctgcgaagaagattgagcaccaatcaggtaccaagcattatgctaggtgatgagagtacataaattatgacaatataatttctgactttaaggaatatagtcttagtagcaacagtgtgcatggaggtggggaatgacaacaagcgggagacaagttggaagactatattgcagtaacctgaacaagaaaggaaagcctaaattatgaaggtggagaagaaggcataaatctgtatttctcaggtgaagagtttcagaactgtgatgatgtatcagtaatctatcactgtgttaagaatcaccctgaaactcgtggattaaaacagtaaacatttgttcttgctcatgagtatgtgaagcagctgggctgggcttagctgattttggctagcgagctaaggtgtctgcgctggtctgctggggtctggctgctctaagatggcttcttctacatgcctgcctgactaatggtggtgttacgccatgcctcattcctcagccagcaggctagcctgggcttattcaccaggccacagcataaggtttacaggagagtgcagaaataaacaagtcttatgctggcacaatgtcagttccactgtattctgtatactgttactgaagcaggtaacaagaccagctcagattcatgggatagggagatagtctccacctcttggaggaaccgcaaagtcacatgcaatggttatggatagagggagaggtggagaattgtagccatttttgtaatcgctgtatcacatatagtcagtggactgccagtatcacagtcattcaaaagcatgccttagctatggaatcctgaaatctggggaaagggccccagagcctatatttttaacaaattctcatggttattcctgtacacacaggtttaatcaccactgggctatccatgaaatattacaggacaagtagggcagggcaaaacttctcagcgtggacttcatacagcctatctctatccccttcaaggctgacttcaaataaagtcaaaagagccaaagaacacagcatgataggaaagatttggacttatatttgggagacatcttctgattattatcttctgttaagaaaatgtgtattctaaagtagcaagccttcataaagagtgatggaaaatcagggaaaaattaggcagcccgagtgagaatatttgaatgtgagacatagaaaacctcccatgttaaatgtagtaagagaaaggaaatgcaagaagacaagcttaccttttgtagttttgtttctaaagggttgctatatgcccccatcagtaattatacaggaagttagtactagtagtacaggtgtcttttttgaaagagaaagaaaataatgacttccctcagtaatttgggctcagagacatgagcatggaagatctgcagatgaaagcaccctctgatggccctggtgattttggagcaattttatagacttgaatctaggtacaaaggaagggcttacattttgggaatcagaagaaagttggagtagatttttgagatgtttccttaatgaagaatatatttattattaagttaatataagtcattaatattaatttttcctgtttaacagtaaatggtattgaaatatatactaacaggcaaaaagaaaaaaagacacaggctaccttcagagatttcagaaagtcatctgatagtagtgttgatttttcataaatttaaatcttattcttaaaaaaacttcttgtaaaaataactcgagagtatactgaacagaaatagaaacaacttaaaatgttttactacccctattttaaattattttatattttttcttcttacccttaaaacatttcagttaagaaatgaataatttttactttaaaaaaaagatttttacacatcagatgctataagactcgcttggtgagaagagtatttctgggattattttgaagccaagggttttgtttctacctctgtctaactagttgcttggtttgaaaaaatctagcttctactttgtgagtatggagttacgttctaaaactcctcacagtagaagattgctaagactaaatgatccagagtttgtgctgaattacttttgctatctgaccttttattttaacaaaatcataggtttttttcttccctttttttccttcctcctacacatgtattttcagaatttaaaacagtctcttctttccattcatgaaaaatcacaaaagtatgtagaacttgtttgtctctcaaatggccacttggtacatcttaaacagagtggccttggttaggattttgaattacggtgaatgaaatataaaaataaataattttaaaaagaaaagaaatcataaaagttaatagttaattgatgatttttgaatataggactttctaaacagaaaagtaatgaaaaaattgtggaagatagaccattgaaaactttgacaaagaattaatataatcagcatgtaaactcatgcaatgaagtaattaatactaactcctattaggaaaatagaaaataattttaacatataatccaaagacttataagtgaccagtgtgcatctaaaaataatttgctgtatattagcaaagagttagtttgttcatctcactacatttattttttttaatttttaatttttgtggatacatagcaggtgtatatatttatggggtacatgagaattttaatacaggcatgcagtgtataatacatcagggtaaatggagtatccatcacctcaagcatttgtcctttctttgtgttacaaacaatccagttctactcttttagttatttttaaatgtacaaaaaaaaattgttgactctcatcacgctgttgtgctattaaatactagatcttactcattctaattattttttgtacccattaaccatcttcatttctgctcatcctccaccccagcatctggtaaccgtcttttcactctctatctccatgagtttgttttaatttatagctcccacaaataaataagaacatgcaaaatttgtctttctgtgcctggcttattttacttaacacagtaacctccagttccatctacgttgttgcaaatgacaagatctcattttgtttaatggatgaatagtattctattgtgtataagtactacattttctttatccattcatctgttgatggatacttaggttgctcccaaatcttggctactatgaatagtgctacagtaaacatgggaatatagatatctctttgatataattatttcctttcttttgggcatatacctagcagtagaattgctggatcatatggtagctctacatttagttttctgtggaacttccaaactgttctccatagtggttgtactaatttacattcacaccaaaagtgtacaagggttcccttttctccatatcctcgcaagcatttgttattgcctgtctcttgcataaaagccattttaactggagtgaaatgatgtttcattgtagttttgatttgccatttctctgaggatcagtgatattgagaaccttttcatatgcctttttgccatttgtatgccttcttttgggaaatgtctattcagatcttttgcacagtttaaaaattagattattaggttttatccaatatgtaagcagctatttgaactccttatatattcttgttattagcctcttgtcagatggatagtttgcacatattttctcccattctgtgagttgtctcttcactttgttgattgtttcctttcctgtaaagaaggcttttaacatggtgtgatcccatttgctgatttttgctttttgacctgtgcttgtggagtattactcaataaatctttgccaatccaatgtcctggagagattccccaacattttcttttagtagactcatagtttgaggtcttagatgtaagtctttaatccatttcaaattgatttttgtatatggtgagagataggggtctagtttcattcttctgcatatggatatccagttccctcaggagtatttattgaagagactgtcctttcccccagtgtattctcttggcaccttttttgaaaatgagatcaacataaatgtatggatttgtttctgggttctctgttctcttccactgatctatgtgtctggttttatgccagtaccatggtcttttggttattatagctttgtagtataattcaaagtggggttatgtgatccttccagtttgcttctttctgctcgggatagctttggctattcttggtcttctgtggtcccatgtaaatattacaattactttttctatttctgtgaagaatgtcattggtattttgataggggttgcattgaatctgtagtttgctttgggtagtatggacattttaacaatattgagtcttccaatccatgaacacggaatatgtttccactttttgtgtctgcttcaatgttttcatcaatattttatagttttcattgtagatatctttgacttctttgattaagttaattcctaggcattttattttacttgtagctattttaaatatttgtatttaaataaataaataaataaataaaaacttgtaaataaatacttgtatttacttgtagctattttaaatgggattactttcttggcttttcagattgtttgctgttagcatattgaaatgctgctgacttttgtatgttgattttatatcctgcaactttcctgaatttatatatcacttttaatagttttttggtgggtttttccaaatataagatccataccacctgcaaacaaagataatttggcttcttcctttccaatttgtatgccctttatttatttgtcttggctgattgctctagctaggactttcagtactatgttgaataacagtggtgaaagtgtgcatctttgttatattccacatcttagaggaaaggctttctgtttttcccctttcaacatgatactagctgtgggtctgtcatatgtgacttttattgtgttgaggtgtattccttctatgctcattttttagggttttttgtcatgaaggaatgttgaattttatcaagtgctttttcagcatcagttgaaatgaccatatggttttgtatctgttgatatagtgtaccacattgattgatctgcttatgttaaaccatccttgcatcactgggataaatcccaaatggtcataatgaatgatctttttaatatgttgaattcaatttgctattatctttgcatcaatgttcatcagggatattggcctgtggttttctttgatatctttgtctggttttggtatcaggataatactggcctcatagaattagtgtggaagtattccctctgcctctgtttttcaaaatagtttgtgttggattggtattcattcctttttaaatgtttggtaaaatttagcagtgaagccattgggtccagggtttttctttgctgggaaattttttattatggcaccaatctcattactttttattggtttgtttaggttttgggtttcttcatggtttaatcttggtaaattgtgtgtgtctaggaatttattcatttcttctaggttttccaatttattggcatacagttgctcatagtagcctttaacagtcctttgaatttctgtagaataggttttaatgtctacttttaatctcatttttatttgggtcttctctcttttttcttagcctgactaaaggtgtgttgattttgtttatgttttccaaagaacaactttttgtcatgaatcttttgtattgtttttttcgtttcatttagttctactctttattacttcttttcttctactattttttcgttttgttagctcttgcttttccagtggtttaagatgaatcattatgttatttgaagtttttctaccttttagatacaggcgcctattgctataaacttccctcttagtcctgctttcactgtatcccataggtttcagaatgttgtgtttgtattatcatttgcttcaagaaatttttgaatttccttcttaatttcctcattaacccactggtcatttaggaacatattgttcaatttccatgtatttgtctagtttccaaaattcctctttttagtgatttctaatcttattccattgtggtcagagatgatacttgatataatttcagtttttttcaactttttaatatacttttttgtggcctaacatatagtctatccttgagaatgattcatgtactgaggaaaagaatgtgtgttctgcagctgttggatgaaatgttctgtaaatatctattaggtccatttagtctatagtgcagattaagtgttatgtttctttgttgagcatctttctggaacacttttccattgctaaaactggggtgttgaagtctgcagctattattgtattgggatcgatcgatctcttaagctctaataatatttgctttatatatctgggtgctcccgtgttagatgcatatataattataattaatatatcctcttactgaattgactgacccctttatcataatataattaccttctttgtctctttttatagtttttatcttcaaatctgttttgtctgatataagcatagctactcctgttctttactggtttccactggaattaagtatctttttcctttttttttttttttttttttttgagacggagtctcactctgtcgcccaggctggagtgcagtggtgtgatctcggctcactgtaagttccacctcccgggttcacgccattctcctgcctcagcctcccgagtagctgggactacaggtgcctgctgccacgcccggctaattttttgtatttttagtagagacggggtttcactgtgttagccaggatggtctcgatctcctgaccttgtgatccgcccacctcggcctcccaaagggctgggattacaggtgagagccactgtgcccagcctctatatgtattttcattctctataggtgaaatgtgtttcttgtaggcaacagatcattggaccttatattcattctattctgtgtcatttagtcttttttcatttaatgctattattgtttagtaaagatttactcctaccattttgttatttgttttctggttgttttgtggtcttccctttcctcttcccttccttcctgccttccttttagtgagtgatgttctctggaggtatgttttaatttcttgctttttattttttgtgtatctgttgtatattttttgatttctgattaccatgaggcttgaaattaatatgacctttttttaaactgataacttaacactgattgcataaacaaacaagcaagcaagcaagcaaagagaaaatgaataaaaactctacactttaactttgtccccctggtttttagcttttgtttctacttatattttattatactgtttacgtttgaaaaattgttgtagttattatttttgattggttcatcttatagtctttctactcaagatatgaatagtttacacaccacaattacagtgtgtccttttattctgtttttctgtggcttactattaccagtgaatttgtaccttcagatgattttttattgctcattaacatccttttctttcagattgaagaactccctttagcatttcttgtaggacatgtctggcattgatgaaatctctcagcttttcttgggaaattttttattttgccttcatgtttgaaggatattttcgctggatatactattataggataaatttttttttccccttcagcactttaaatatatcatgccattctctccttgcctgtaaggtttccactgaagtccgctgtcagaactactggaactccattgtatgttatttgtttcttttctcttgctgtttttagtatcctttctttttccttgacttttgggagtttgattattaaatgtcttgaggtagtcttatttgggtcaaatctgtttgatgttctgtaactgtcttgtacttgaatattgacatctttctctaggtttggaaagttctgttattatccttttgaataaactttctacttctatccctctctctctccatcctctttcaggccagtaacagtttgatttgcacttttagggctattttctagatattgaaggtgtgcttcattccttttgtctcctctcactgtgtgttttcaaatagcctgtcttcagggtcattaattctttcttctgcttggtcaattgtgatgcattcttcagtatgtcaattacatttttcaactccagaatttcttcttgatttgttttaattatttcaatctctttgccaaatttgtttaatgggaatctctcccttcagggaagtggggtcccctctggcccagctcaggtccagaaatgctttccaagagccaaggcctggaatcaggtaccccaagagcctgcctgatgctctaccctgctgtggccaagctggtacctaagctgcaagacaaagttccctttactttcctcacttctttccttaagcagaaggagtctctccccaaagccaccatattgggaatgtgcttgggtcaaacctgaagccagcatgtctctgagtctcacccagataccatggggtaagtactgcctgtttaccacagtggcctattcaggtccctagagccctttagtcagcaggtgatgaatcctgctaggattgagtctttctcttcaaggcagaaggttttcttctggccagggtgcgtctagaaatgatgtctggtaactagagcctggaataggggcctcaggactctgctcggtaccctatcctactgtggctgagctggtatccaagtcgcaaaacaaatttgtctttactcttccgttttctctcctcaagcactgggaaatagtctcttccagagctgcgagttgcagtgcctgaggttgggagaggggtaacacaagcactgacttggctgtcccggctgatgtctcactggaaggcatgtcccccaggtccactggctctgagcccagcacagcaccagagcttacccaagaattgcagttcttgtgactcagactacctttcaagtttatttaggaccccagagcacttttgcccatggtgtcagggcctgatggaactcaggttctgaccactgggatgggcaattcccctctggcctaggcgggtctaaatgctcactccctgggtgctggctaagttctgcccagttttgctttctggcagtgctgagttccaatgggatgtccacaatcactgtgctctccctcccccaagtacacagattctctgtctatgctaccaggggatggatgaggagtggcattggcaattcaagactatctttccttctcccttcagtgcctctttcagtgttgtgaagttaaaaccaggtactgtgatcactcacatgatctttggttcttatgaaggtgattttttctgcagatagttcttcagtttggtgttcctctgggaaggatgatctgtaaagctttctatttggccgttttgctccacctccctccatctcaccacatttaatgttggtagtgataacagacatttctatatgctgctgatatgaatgcaaattggtataacctttctggaaaacacattggaaatgtataatcaagaggcttaccttcagtgattccttgactaggaatctagcctgaggaaataatagagagatggtccaatatttgtttttaagttactgattccctaattaaatttagtaacaaaaacttaaatacattgaaatttgcacaacaatgtgtgcaagggttaaatcagttgtggtttcattgtaaaatggaaatattaggcatctattaaaaataacatttttgaaaaatttagtggcatgaaaatatgattacaacataattgctgaatgaaaaaacgtaaggcacaaaatagtatgtaccatatggccagaaatttataaaataagccaactcaaaccaaatatttttccttaggaaaaaaaaatgaaaacggcctttgacaaatgtcttcttgattcttacacttagacaattacaatggtttcaaaggaaaataaaattcaaattaatataaatttttataaagctgcttcctttgccattgttagttactgtataaggcacttcaagagtctttttagacctgtttccttgaaactagtttcgtgtgctgttcaaaacattcattcaaaataaaattctgtggtcaaataagcttgggaaatatgtaattaattggtttcttaattgcagagctaattagaatcataagtagcataccagtgtcattgtggatattcaaggaggtatggtttgcagtatttcccaaatttatttgaatgtagagtttgtgtgtttgtgtgtgtgtgtttcagaggggaaagggaagaggaggagagggagggaggatagaagagagaaactagaattgtttgggctgaaccctctgacaggttggagacatcctgttactttgcctctaaatccttcaatgtgtatcttttgaaaaataagggccattggccaggtgcaatggctcacgcctgtaatcccagcactttgggaggccgaggcgggtggatcatgatgtcaggagatcgagaccatcctggctaacacagtgaaaccccgtgtctactaagtaaataaaaaaaaaaaaaaaataagggccattgtgctacttatctacaacatcatggccacatcaaagaaaattagcaggaattccctagtaacacctaccatttagtccaaatatgaaattttctaattttctcaaagagtatgttttatagtcaggttttcaaggttctgatgttgcatttgattatttctttttaatataaaaaccataccgtgccctttttatgatttaatttttcaggacaccagtctcattgaatggtaggtgtcttattatttctttgtggtgtatttaaatagttagttctgtgtatttctgtatatattggcacttacatttgaggacttgattaattggatttgggttacacatttttagcaagaaaatgtcataggtaacactgtgttcttcagattgcatcaggtcaggagatacactgtgtcaagccataccactaatacctggttactagtttcagaaagtgactgacaagtctctctgttgcaaaggtacatttttccctttgctgtttgcaagttccacatgaagtgatactatgtcaccatatgaatatcctgtttcctaaaaattacttgaaaacctttcaagtaatggtttttgtagtctttggtgatctttttttacaaggctaaatattagtcttgtattatgcacttctgtataaaaactgatcacctatcagttatttctttgggttccttgttaatatttttatttctttaaaatttatagtgaaatttactccgtgtggtgtacacttatgtgagctttgacagaagtatagagtggtttatcataacaatctagatacagcacagttgtatcactccagaaaattacccatcactctccctttgtagtcaacctactctgacccttaatcctcaacaagcactgttctcttctccatctccttaactttgctttttccagcatgtcatataaatgaaatcacacagtatttagctttgagaggtcgtacttctttccctgagcaaagtttatttgttattcatctctttctattaactatattgataattttttttcttttatggttgaattatactctagtgtatagatataccagaagtttttttttgtttttttgtttttttgttttaatcctttcaccagttgaaggatatttgggttgattccaggtttgacatttatgaataaagctgctataaaaatttacgtaccggaatttgtgtaaatataagttttcatgtcacctaggtaagcacataggagtagggtttctggattatatatggtaaatttatgtttaactttataagaatctgcctgttttcctaagtgtttgtaccagttttcgttcctgccggcagtatatgagagttccagttgctctcggttctcccagcatttggtattttcagttgtttttatcttagccattcaaataggcgtgaggttgcagttttcatttatatttctctaatgactaatgatgtttctgtttatcgactacctatatatcttctttgctgaagtttctgttccattattttgtctacttttaattggattgtttgttttcttatctttgagtttagggaattctttatatattctgaataaaagcgcttcataagataggtgatttgcaaatattttccctgagtctgtggctttttcccccattctcttaaaagtatcttttgtggcacaaaagtttataattttgatgaagcacaatttatcaatgtgtcaagcatttagtgttgtatctaagaatcttttgatgtaacccaagaccatgattttctgctacattttcttttaggagttccatggtcttaaaatttacatttagatatatagcccattttgagttagtttttatataagatgtgaggtatgaaccaaagtttgttttttgcttgtggacttccaaatatttcagcaccatttgtaaaaatgactatcagttctccaatgaattgcctttgtacttttttcaaataacaattgaatatgtttacatcagtctatttctgaaaatgtaaaaaacttgaagtcatatcagatatcttctcagaccattgcagagtaaaactagaaatcagttctaaaaggaatccacaaaaccatataaatacatggaaattaagcaaatctgctcctttatgatttttgggttaacaatgatatcaagatggaaattaaataattcttcaagataaatgataatagtgacacaagatatcaaaacctctgggatacagcaaaagcagtgctaagaggaaactttatagggctaaatgcctacatcagaaagtctgaaagatcacaaattgacaatctaatgtcacacgtcaaggaagtagagaaatgagaaccaactaaacctaaagctagaagaagaaaaaaaataacaaagatcagagcagaattaacagaaattgcaacaacaacaacaacaaaaaagatcatgaaacagaaagttggctctttgaaaagataaacaaaatcatagaccgttagctatcttaaccatgaaaagaagagagaagattcaaataagctgaattagaaatgaaaatggagacactacaaccatcaccacagaaatacaaaagaccatttgagattactgtgaacacctctatgcatacaaactagaaaatctagaggaaatggataaatccctggaaatatacaaccctcctagctttaatcagcaagaaatagaaatcctgaacagaccaataacaaccagtgagattgaatccataattttttaaattgccaacaaaaaaaacccagtgccagacagattcacagccaaattctaccagacattcaaagaattggtaccagtcctactgaaactattccaaaagactgagaaagagggaatcgtccctaattcattctatgaagccggtatcaccatgacaccaaagccacaaaaggacataacaaaagaataaaaatacagacaaatatctctgatgaacgtagatgcaaaaactctcaacaaaatgctagcaaactgaatccaacagcacatccaaacaataatttaccatgaacaaatgagtgtcatcccagggtagcaggaatggttcaacattcacaagtcaataaatgtgattcatcacacaaacagaattaaaaacaaaaaccatatgatcatctcaattgatgcataaaaagcatttgctaaagtccagcatccatttatgataaaaaatgtcaacaaactaggaatcgaaggaatatacctcaacaaaataaaagctatctgtgacagacttacagccaatatcatactgaatgggagaaaaggtgaaaagaattccctctaagaactggaacaagataaggatgcccgctttcaccactctattcaacacattactggaagtcctagctagagcagtcaggcaagaaaaagaaaggacgttcaaattagagagagtcaaaatgtctctgtttgctgatgatatgattgtatgcttggaaaacccaaaagacgactccaaaagacttcctagattttataaatgaattcagtaaagtcttaggttataaaactaatgtatacaaatcagtagcactgctacacaccaacagccactaagctgagaatcaaatccaaaactcaaccccttttatgatagctgcaaacaaacaaaacaaaaaacaaaacaaaacaaaacaaactggggataaacttaacaaaggaggtctctacaaggaaaactataaaatactactcaaataaatcatagatgatacaaacaaacaaatgtatgtcccatgttcaggtattggaagaatcaatatcatgaaaatgaccataatgcctaaagcaatctgcatattcaatgcaattcctatcaagatactaacactgtttttcacagaaatgtaaaaaataacccaaaaattcatatggaaccaaaaaagagcctgaatgccaaagcagtccgaagcaaaaagaacaatccagaggcatcacattacctgacttcaaattacactacaaggatgtagtaactaaaacagcatggtactgctgtaaaagtcgatacaaagaccaatggaacagaatagagaacccagaaataaagccaaatacttaaaaccagctgatcttcaacaaaacttaaacattaattgaggaatggacaccctattcaataaatggtgctgggaaaacagccacatgcagaatatgaaactatccctatctctcaccatataaaaaattaaaatcaattagagacttaaatcttaagacctgaaaccataagaattctagaagaaaacctaggaaaaacttccctggacattggcctaggcaaagaatttatgactaagaccccaaaagcaaatgcaacaaaaacaaaaataaataaatgggagccagttaaattaagtttctgcatggcaaaagaaataattatcagagtaaaatacaacccacagaatgggaggaaatatttgcaaattatgtatctgacaaaggactaatatccagaatctacaatgaattcgaacaaatcaacaagaaaaaaaaataaacctgtcaaaaactgggcaaatgacatgaatagacattcctcaaaataatacatacaaatgaccaagaaacgtatgaaaaaaatgcttaacatcactaatcatcagggaaatgcaaattcaaaccacaatatgagatactaccttaccccaactggagtggccattactaaaaagtcaaaaagcaatagatgttagtgtgaatgtggggaaaagggaatgcttatacactgatggtaggaatgtaaattagttacctctatggaaaacagtacagagattcttcaaagaactaaatgtagatcttccatttgattcagcattcccaccactgattatctactcaaaggaaaagtcattatatcaaaagaagtcattatgcacacctgcatgcatatgtttattgcagcatagttaacagttgcaaagatacggaaacaagtgtccatcaaccaatgagtaaagaaaatgtgatatatatacaccatggaatgctactcagccataaaaaagaatgaaataatgtcttttgcagcaacttagatggggctgctggaggccaatattctaagtattaataactcaggaatagaaaaccaaataccatatgttctcacttataagtgggagctaaactatgagtatgcaaagacatacagagtggtttaacagacttttgagactcagaaggggaaagggtgagaaaggggtgagagattaaaaagcctacatattggatacaatgtacactacttgggtgatgagtgcactaaaatctcagacttcaccactatacaattcatccatgtaactaaaaattacttgtacccctaaagctactgaaataaaaaaaattgaaaatctatttctggactttctgtatttttttcattgatctatgtggaaatctgtccttcaccaatactaaatgatttgatttcttttgctgtataatcaatcctggaatcagatagcatggatcctcttagttcttttttaaaattactttgggtattctagatcttttgcctttctgcatgaatttcagaagaagcttgttgatatctactgaaaaaaaaaatcccaagattttgactttatagatcagtttgggaaaaattaacatcttaacaacaatgagtttttcaatccatgaatatggtatatttctccatgtacttaggtcttctttgatttctttgaccagtgttttatagtttcgaacatgcagatcctccatatgttttcttagatttatacctaagtattttatgtttttttgtaggatgaggtttgctattttaaaaatattttctctatctgttgagacgattatatagtttttcttttttattagcatactatattactttgattttcaaagccaaagcagttttgcattcccaggataaatctcacctggttgtgctgtattacacttcatcctggtaaaaatgccacgtgcacctgaaaagaatgtgtattctgctgttgttggatagaatgttctatttaaatgttatttagatgaacttagctgatagttttttctaggacttctgtatccctactgattgtctcctcgatttaatgaattctgttagtattttgaattacctgtgataattatgagtaatactgaatacctattgttgcaatagttactctggacacatcaaagacttcaaattcctttaccatcaccttattttaaggatgggcatgatttaccagagggtttttctcggtatctgcttgaacttcagtttcaggtcctcgttttgtgctgtgactcggataggttctccttccactcccttgtccctctcccggtagtatagtgcaattacttgttgctctatgctttgtagtctggtggtgagaggcaagttatgggtatgtcctgattaagccttagtcttaagcagttactgtgcccctgggtttggcagtatggccttctcagtgttcttgcccctcccccggatttagagggtatgttttatttttcttccttttcccttcttaaagttgccatatgttttcactagctccccaagggaaatggtggttctgctagtccgttctcacactgctatgaagaaatacctgagacagagtaatttataaagaaaagaggtttaattgactcacagttccacattgctggggaggcctcaagaagcttacaatcatggtggaaggcaaaggagaagcaggcacgttcttcgcagggtggcaggacagagtaagtgcaagcaggggaaatgccagaggcttataaaaccatcagatctcatgagacctcactcactatcacgagaacagcatggaagaaaccgcccctgtgatctaattaccaccgtgtggggattatgaggattacaattcaagatgagatttgggtgggggcacatccaaaccctctcagtggtttttgctcttctttcaggcatgtaaggcattattccataggctatctaggggagaaggatctgggcagcctttcatacatttcctggagtgggtgctgttcttttcccacaggactgtaccatagtgataaaggatgctttctctggactctccctagtctctcttgtgagaccagatgaggttctgagaaaacctgaaagtgggtgtgaatttctttatatcatagccctccggggattctgggttcccttgctggcttacagtcagcctttaccaatcttcttacaatttggccgaaattttttcactggtgtccagcagagactgtcctaggtgaggaagtgctcatgtgtcattttagatttatatttgtttagttggctgatctgctacctcaggtctttgatgggttcaagaaaagttattaggtagtctctctgagcctactctggcttgggaggctgcccaattaaaaaaaacaagttaatttaaggattatgtagcatttatgttttttataaggatgaaagtgatgccctttccagctttctacatcccaagaggaagctaggagcattccttattcttcactggggtttgaattatcatttcttgcatactatttatcaattttgttttcttacataaagaggatttttccatcatgaaatagatagaaactatagtttctttttaaaagtctgggtaaatctctcttggattccaaggttttagactaaggagttaatgtaatagttaccaataatactgagttttgaaaagacccactaacaagctcatttggtagaaagaatgccagtaccccagagaaacatccagtactatttatagtcatgcattacataatgtttcgctcagcaacagaccacatatgtgacagtggtcccataacattataaaactatatttttattataccttttctatgtttagatacacaaatacttaccattgcattacacttgcttatggtattcaccacagaaacatgctatagaggtttgtagcctaggagcaataggctataccatatagcctatatgtgtagtaggctatgccatgtaggtttgtgtaactacactttataatgactgcacaatgacaaaattgcctaatgacacattttttcagaacatatccctgtggttaagtgatgcatgactgtcctctcaaacttttctttagttaaataaattgtaagggtacattgaaaaatcaaggtagctagcaacttttaacctcagaatttgctattatcgtatttcataatagtacctggccataattacaagtcctaaagatcatgccaggaataataatgcctaagttgcctttgtagaagaaatattgaaatttatattatttcaaggggcttgaacatttactactactaacaaaaatcttgtcttgttctgttggcagtctcagcttttataaatgaatccaagaggcagctgataccacagtaatagaaaaattttggaaaggagccatgtttttctttgagtcaaaaggcagatgccaactaggaacattagctccttgcattttttttctcccccaaccccacatccctctgtgcataatttatgcctttttcttttctttttttttttaaatagcctgccaccaggttaagttggtgctgggtacaaagctctgtccttttcaatttctatctgccagcgtgcagcatgggtactggttgaagccggaaatccttactgacatgtggagtaacttgtgcttcttttcttagattcttctgaaaggcaaatggccacaatcacactttggctgtcttgtgaaaaaatcaagcagaattgtcacccccagctctgcactacacagttgaggttgctaggtagcatatatgaaactatggtggaatatactacaaaagtcttggcttgagaatgaaactgattgctgctttgtttcttagtctctagatgtaaaaaccgggaaagccatattagaaaaaatatttagatttcaaattaatatgtagtgctttgttaacagagcatttaatgatccctttgaatcctgtttatgagcaatcatatattcatagggaccaattgagatacgctttaagttaaaaaggggagataatttatttaattaagttgtacatttttcttttttctgatgcaacatcaaggtatgtaaaagtaacatttatttgtcttactgtgtggcaatttttgtaaagaattggataaattatgttgatgttcttttcatctttgatggtgtgttacaaagaaaaaacgatgggaatttcagtgacctgagtttcattcctagcataaccattaactaactttatttgtgctgtgagtcactgaatctgatcagatctcagttttattttttttttttataatgaaggaatcgaattggttatgcttcagagtctcttccagttccatgattctgaggagaacatagctaaaaagagatgggagttttgggagatgtcaggaatgtgagtttttgacatacaggtctcagggcttacagatgaaagatctctgaaagataaattcaaacagctatataaagcagatctaacttgataaacacatgtattagatggtagtaccttattcagttgcgtgattatacaagcctttattggcccagtgcaggcataatgcaattggcaatttttaatgtatgcaaattttcactgctgccttgcttggcatagcagaaacattatagccaggacagagatgtacgactaattctgtgtgaccacttaacttcttttttttaaaaagtaatttggtatgttctcccccaggaaaactttctatgtaataaaaaagtaccatctgccagattgtctaaaagcaatttcaatgcaaaacaacacttgctttagattactgattcttacttgctgctgtgtgtattgaaggttttcatttcagtgaataaaagtttgatatttgagaatgtatctagatgtgaaattttacaacagattgtgcttatatctagattgtggttatatctacatttacagtgctataaaattgtacttatatcttagattgtacttatatctacctatactttttcaaatctatgaaattaggttcaataatttaaaatattaactgaagcccagccattgctttaaaaaagagagagagagatacatggaatttaaatgtttgggaaactgaccttactagttatctgtgaattaatttatatgtaatcttttctctaccacctacccccataataatcatttattgaaaggcattatttggatgctgatgagaagatttaacaataaaagcgtaaagaaaaatgtaatgaattaattctacccatatcccccacaactgatggagactacgttttgggctaccaaatcttaatgatttcagaaatatttctttgcacactcatgatgttgctcagtaccgtcattcattctgctactcaacagaaccttatttgagcccttcatatgtgtcagcattttaggcggttaagtactgtaggctatagaaatgaataaatcttgttcattactatcaaggtaaaaatattcttctttctgccaaatgacaagcgatttaaatgacctatttcagttaagctaagcaatatattagatttaggaaagagatatagtaacttttgacttcaagtgaggtcattgctttacttatcaatatgtgacattctctacttcagcaaccatgattccctaagttatgaaagaatttacagaaaacgaagttgattataatacagtgatttagatactcaagttattcatataatttttagcctcagaagtttttgatgtgtatattctgtatttaatgagatcacatataattgaagaaaacttactttctaggcctgattcacaaactcttgtgatttttataaaaatgtattaatttggaaaagatacatcagacagtactttacaatagcaatcaatcttatgttctcattcaacaaaacttgagggtgtgaacaagtttttatactatgtatctgtactaaaaaataaaatagtacccgctttttgagctgcagacactagactttgttttataaactcaatagttgatattttcagtgaataaaattttgttcttttttaatttgagcctttctaattcctttctttttttaacttttattttaagttcaggggtacatgtgcaggaaatgcaggtttgttaaatatgtaaacgtgtgtcatggaggtttgttgtacagattattttaccacccaggtattaagcctataatccactagctatttttcctggtcctcttcttcctcttgccctccaccctccaataggcaccattgtgcattattcatctccgtgtgtccatgcgttctcatcatttatctctcacttataagtgagaacatgcggtattaagttttctgttcctgcgttagtttgctaaggataatggcctccagcttcactcatgtccttgcacaagacatcatttcggttttgttgtggctgcatagtattacatggtgtatacgtaccacattttctttatccagtctatcattgatgggcatttgggttgataccatgtctttcctattgtgaatagtgctgcagtgaacatacacgtgcatgtgtttttataataggacaatttatattcctatgggtgtatacccagtaatgggattgctgggttgaatggtatttctgtttctaggtctttgaggaatcacctcagtgtcttccacaatggctgaactaatttacattcccaccaacagtgtaaaagcattcctttttctccacaatctcgccggcagctgttatttttttactttttagtaatagccattctgactgatgtgagatggtatctcgtggttttgatttgcatttatctaatgatcagtgatgttgaggtttttttcatagatttttcaccacatgtatgtcttctttcgaaaagtgtcttttcatgtcctttgcccactttttaatggggttgtttttttcttgtaaatttgtttaagttccttatagatgctggatattagacctttatcagatgcatagtttgtaaaaattttcttcccttctgtagttggttcactttgttgatagtttcttttgctgtgcagaatcagaaatgataagggggatattgccactgaccccacagaagtacaaacaataatcagagaatattataaatacctctatgcaagtaaattggaaaatctaggagaaatggataaattcatgtacatacacccttccaagactgaagcaggaagaaattgaatccctgaagagaccaataacaagttctgaaattgaagcagtaataaatagcctaccaaccacaaaaagcccaggaccagacggattcacagctgaattctatcagagatacaaagaagagctggtaccattcctgttgaaactattacaaaaaaatgaaagaaaaaaaaaacggactccttgctaactcattctatgagtccagcatcatcctgataccaaaacctggcagagatacaacaaaaaaggaaaattttaggccaatatctttgatgaacatcaatgcaaaaatcctcaacaaaatactggcaaaccaaatccagcagcacatcaaaaagcttatccatcaggatcaagtaggcttcatctctggatgcaaggctggtccaacatttgcaaatcaataaacataattcatcacacaaacagaactaaagacaaaaatcacttgattatctcaatagatgcagaaaaggctttcaataaaattcaacatcgcttcatgttaaaaactgtcaataaactaggtattgaagaaacatacctccaaataataagagccatatattacagacccacagccaatatcatactgaatgggcaaaagctggaagcattcactttgaaaactggcacaagacaaggaagccctctctcaccactcctattcaacatagtattggaagttccggccagggcaatcgaacaagagaaagaaataaaaggtatttaggaagagaggaagtcaaactatctttgtttgtagatgacatgatcctatatccagaaaactccgtcgtctcagcccaaaagcttcttaagctgataagcaacttcagcaaagtctcaggatacaaaatcaatgtgcacaaattgctagcattcctatacaccaacaacagacaagctgagagccaaatcacgaatgaactcccattcacagttgctacagatgccgaggagtacagctaacaagggaagtgaaggacctccagagggagaaccagaaaccattgctcaaataaatcagagaggacacaaacaaatggaaaagcattccatgctcatggataggaagaatcaatatcatgaaaatggtcacacttcccaaagcagtttatagattcaatgctagtcccattaaactaccattgacatttctcacagaactagaaaaaaattactttaaaattcatatggagccaaaaaggagcccaaatagccaaggcaatcctaagcaaaaagaacaaggctggtggcatcacactacccaacttcaaactatgctacagggccacagtaaccaaaacagtatggtagtggcacaagaatagacacatagaccaatggaacagaatagagaacccagaaataagactgtgtacacctacaactatctgatctttgacaaaactgacaaaagcaatagggaaaggattccctatttaataaatggtgctgggagaactggttagccatatgtggaagactaaagctggaccccttccctacaccttataaaaaaatcagctcaagatggatcaaagacttaaatgtaaaaccaaaaactgtaaaaaccctagaggaaaacctaggcaattgttgggattcgatcaggctggtgcaatacctcaggcagtaccattcaggacgtagttatgggcaaagatttcatgatgaagatgccaaaagcagttgcaacaaaagtgacgcttgaaaaaaggatctaaaagagcttctgcacaccaaaagaaactatctaattgtacgcatcaaacatgtctgtaacattttaaaaggctttgtcttaatatttatatcttcaattatgaattgtctcttttggtatttataaagagccacgttgttaaaaatattaggtgtataactgccatttaagtcttgggaagggatatattactaagatcatttgcttaatttatttgcttgtgtgtgtgtgtgtatctcatgacatgattatatgcccacaattatatatgattattataattcattaaaaattttaattaaaaagtaattcaaattgtttctaaagtagatagatgatggagagtgagataggcagtactgttttcaaatagaactgtaatatgctagcactgaaagcaaacttagaggtcatcatatctgacacgttggtttcagatcaggaaacagagaaaacaagaggcttaattctctgtcacagtatactggcccattaactgtgaccaggattactattgacagtgtcctgccctaggaatacagatgtgaagtaggttggttccctaggttggtctgtgggcagcctgggagtcagaacctctctggaaagtgctagattagactcacattttctttttccttttttttttttttgagatggaatctcgctctattgcccaggctggagtgcagtggcatgatctcggctcactgcaacctccacctctcaggttcaagcaatcctcctgcctcagcccgcctagtagctgggattacaggcatgcaccaccatgcccagcaaagcttttttgttgttgtttgtttgtttgtttgtttttagtagagatggggtttctgttggccaggctggtctcaaactcccgatctcaggtgatccacccgcctcagcctcccaaagtgctgggattacaggcgtgagccaccccgaccggcctggactcacattttctagggctcccatgagtctccctagagctgaacctcaagtgcacttctccatcggccttcagccttctgggcttgactgcaaatggactctcagcccttttcctgctggcaggggcaagtccacctggcctttggaggtgtaggagacaagtaggtgatgaagtgtgagaaacagttctgatatatgtgtgttaacacttgttatatgcgtgctgtgatgagcgtgcagttcgggttttgttttgctatgggaattgacttttctagaaatcccacctgaattccaagtagtcccaaggtggaccatgctgagagcctgagagagatgaaaatggtacttgagctcatctattctggtcttttagatgttgtctagcatttgttttgattttgaaagtaatatttatacactatggaaaatacaaaccagcaagaagtcaaaaaagtaatctataatttcaccaaacatagaaaagccacttcgcatttgggttatatccatgcacatacccataacacaggcacctagaggaaagcactgtaaatattttggtgaaattccttccaggttaatgagtattaggtggtaatgactatgctgagaagattcacttacccacgcagaaccctataaaataaatattttaaattattttcattgttttagattgtgaggcagaggcacagagaaatcaaatgactttttcagggtcacattctaagtggtaaatatcagattagagggccagatgtctctattcctagttgggacactttttacgttatacaatattatagcctcctcagaaaaagtatatctaggctgctactgaattgtcagttaactaagtagagattaacatggttttcttgtaagtctgtagcctgtcatataattggcccatgtaacttagctggaggatgtttgtattcttggagttagattggctgtcgtgatcatctttttttttttttttgagacagagtctcgttctgtcacccaggctggagtgcagtggcatgatctcggctcactgcaagctctgtttcccgggttcatgccattctccctgcctcagcgtcctgagtagctgggactacaggtgcccgccaccacacccggctaattttttgtatttttagtagagacagggtttcaccgtgttaactaggatggtcttgatctcctgacctcatgatccacccgccttggcctcccagagtgctgggattacaggcgtgagccaccgtgcccagccgttgtgatcatcttgaattcagaaaactgaaaactcagaggtatgtgtggccactattgataattctttgctaaattaaaaagactgcattatttacagagatagcaatgacaattatcttacttttgtctttatctattcatatatgtttagctaagttttttttgtttgtttggtttggattttttttaatttttaaatattagtgacatttgaattaaggatatttgcattgttaatttaaatagaacttaatttgtctttaatagttttccttttagaaaagaaatgattcataatagaaaagaataaatgtgcttgcattaagtgtgccttaagacatcacaattttatgttgagctatttcccattactccagttacttattagtgggaattattcacatgagaatttccgctgttgtccgctctgcctctcttaaacaatcttacagttatacccattctcccatccattatattgtgttgtgttgctggtgagaaaaaccaagagtcatatgttggtttccatttattatacagtcacaaacagcctcaaggtggtctagtgtcatctcatggcagttctccagtgattcaaaactataatcgtgttgtacttagttatggagagccagatgtgagagtcacgtatttgtgtatcttcactaatctcaatcagaggaccaaagatctccttaatagatacctggcccaaattgtgcaaaagtataaagattactataaatattaaactgattaaaattacactctaattatttgctttggaaaaattgcagatggcctgagtgtgcagtcataggagacaggtgaaacaaatcatgatatgaggtgactcttgaatcattgcatcgggattctttacagatcaaaccagaacaatccaaagcccagtagtttttgattttcaactcaatgagtctaaaagggaaccacttgcttctggctagcgtgatgctaaaataaaatgtagcccatggacattacaggagatagtgtttaataagtgtactctagaagtgacatctatatagaacacctactctcttcattgtgtctttaaataagctgggtctctgggggttagtaaggcccttcttttgcacactgtgctatgacaaagataaattttaaacctcaagtaatttactattgtctagagcatgctttttggagaggagggaaataagtccctgacttacataacgcaggcctagtaaggcctattttgcatataactttgagattgtgacatttgtcaggttatgctgcatttcatccccctttggtagccttcattatttgctcattgttattttaaagttttatgtattacaaaaccacataaacagtgcttcttggtctgtaggcccacctgtgcagtggacttctggatttctctgtgtgctctgaggaagggatccaagtggccattgttgacaggccattggcctgtgttgacagcttgtttctgttatgcctttgctcagtatagtcttgctggtggtagcgacagggggaagtgaaagaccactgagtgcctcttaaatcagttgtcattttggcagattcaatctaaaccaaggatgacttccatatgcaatggctgtgcaggatgttttggcccaagcaaataatacttaatcagcagtgtggttcatcttattactctaaggagaaaataacctactaccaaattctactctattgtagataggattttttaaaacgaaaataaaaacatctgctgttttgtagctgcttgaacctgaggctctgtgcccctagaggagcagcggttgtacaattgctgtgcgttctgtgtctcttagaccttgccaccaggctagggggacactgtcagagttaataagcaattaggacgttctgtcctgtcaattaactggcagaataatgagaccgcaggagcactctccttaaaaatgccgagacttgtgttctgaaaagcgtgtctttctctgctgtttgcagttacacgaatagacaactacttaacacttaaaaaaatacagtgaaaattatacctacagcaaacagaaaagagaggtatacaaatgggatatcattcactctaaactcagaattcatagattttcctcctgagtggctgtagtgatattataatattttctgtcaccttatttggcttaaagattgacagaatacttaggtagtgaacatcctttgttgtataaatcaatgtttaaagtctaagttttggacaatctgggtattgatgccaaatttgaattagtgagttcctggccatggtctattgatggatttttgtttccccttgaatgtgatgagaccttagtgaaggattttcatagaggagcgaggggagcaaagaaaatagataaaagcccaggaatagggagacagtctgttggaggaactaggttggttgtggttacaatgtatttttcatggggagatttgtggggaggattgcaatttatcagagggcagagataagtaggaatcaagttgtgaagggctcagtatgatgtgtttgaaggttttgtgtttaatcctgaggacagtggaaacaagatcaaatctgattattattattattattattattattattatactttaagttctgggatacatgtgcagaatgtgcaggtttgttacataggtatacatgtgccatggtgctttgctgcacccatcaacctgtcattctcattaggtatttctcctaatggtatccctcccctagcctcccacgccctgacaggcccgggtgtgtgatgttcccctccttatgtccatgtgttctcattgctcaactcccacttatgagtgagaacatatggtgtttggtttcctgttcctgtgttagtttgctgaaaatgatggtttccagcttcatccatgtccctgcaacagacatgaactcatccttttttatggctacatagtattccatggtttatatgtgccacattttctttatccagcctatcgttgatgggcctttgggttggttccaagtctttgctattgtgagtagtgccgcggtaaacatacgtctgcatgtgtctatagtagaatgatttataatcctttgggtatatacccagtactgggattgctgagtccaatggtatttctggttctagatccttgaggaatcaccacactgtcttccacaatggttgaactaatttacactcccaccaacagtgtaaaagtgttcctgtttctccacatcctctccagcatctgttttttactgacattttaatgatcaccattttaactggcatgagacggtatctcatggttttgatttgtatttctctaatgaccggtgataaggtttttttttcctatgtttgttggccacataaatgtcttctttcgagaagtgtctgtcataaccttcgcccactttttgatgtggttgttttttcttgtaaatttgtttaagttcctcatagactctggatattagccctttgtcagatggatagattgcaaaaattttctcccatcatgtaggttgcctgttcactctgatgatagttttttttgctgtgcagaagctctttagtttaattagatcccgtttgtcaattgtggcttttgttgccattgcttttggtgttttagtcatgaagtctttgcccatgcctatgttctgaatggtattgcctagattttcttctagggtttttatggttttaggtcttatgtttaagtctttaatccatcttgagttaattttttttgtcaagtttgtcaaagatcagatggttgtagatgtgtggtgttatttctgaggcctctgttctgttccattggtctatatatctgttttggtatcagtaccatgctgttttggctactgtagccttgtagtgtagtttgaagtcagaagacaagaaattactaagatcagagcagaactgaaggagttagagacatgaaaacccttcaaaaagttaatgaatttaggagctggttttttgaaaagattaacaaaacggaccactagccagactaacaaagaagaaaagagagaagaatcaaatagacacaataaaaaatgataaaggggatatcaccactgatcccacagatatacagactactatcagaaactactataaatacttccaagcaaataaactagagaatctagaagaaatggataaattcctggacacaggaatataccctcccaagactaaatcaggaagaagtcgaatccctgaatagaccaataacaagttctgaaatgtatgtatccagcagcacatcaaaagcttattcatcacgatcaagttggcttcatccctggatgcaaggctggttcaacatacacgaatcagtaaacataattcatcacataaacagaaccaatgacaaaaaccacatgattatctcaatagatgcagaaaaggctttcaataaaattcagcatcccttcatgttaacaactctcaataaactaggtattgttcactctgatggtagtttcttttgctgtgcagaagctctttagtttaattagatcccatttgtcaattttgtcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttatttttctcaggtttgtcaaagatcagatagttgtagatatgcggcgttatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggcgatgcaggctcttttttggttccatatgaactttaaagtagttttttccaattctgtgaagaaaatgggagaaaattttcgcaacctactcatctgacaaagggctaatatccagaatctacaatgaactcaaacaaatttacaagaaaaaaacaaccccatcaaaaagtgggcgaaggacatgaacagacacttctcaaaagaggacatttatgcagccaaaaaacacatgaaaaaatgctcatcatcactggccatcagagaaatgcaaatcaaaaccactatgagataccatctcacaccagttagaatggcaatcattacaaagtcaggaaacaacaggtgctggagaggatgtggagaaataggaacacttttacactgttggtgggattgtaaactagttcagccattgtggaagtcagtgtggcgattcctcagggatctagaactagaaataccatttgacccagccatcccattactgggtatatacccaaatgactataaatcatgctgctataaagacacatgcacacttatgtttattgcggcattattctcaatagcaaagacttggaaccagcgcaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagatcaaaaaaccaaacaccgcatattctcactcataggtgggaattgaacaatgagatcacatggacacaggaaggggaatatcacactctggggactgtggtggggtagggggaggggggagggatagcattgggagacatacctcatgctagatgacgagttagtgggtgcagcgcaccagcatggcacatgtatacatatgtaactaacctgcacaatgtgcacatgtaccctaaaacttaaagtataaaaaaaaaaaaaaaaaaaaacgaaaaaaataaaaataaaaaaaaataaaataaactaggtattgaagaaacatacctccaaataataagagccatatatgacaaacccactgccaatatcatacttaatgggcaaaagctggaagacttccctttgaaaagcaacacaagacaaggttgccctctctcaccactcctgttcaacatagtattgtaagttctggctagggcaatcaggcaagagaaagaaataaagggcattcaaatagagaggaagtcaaattgtctctgtttgcagatggcatgatcctatatccagaaaaccccatcgtctcagctcaaaagcctcttaagctgataagcaactttagccaagtctcaggatacaaaaatcaatgtgcaaaaatcacaagcattcctacacaccaataatagccaaatcatgagtgaactcccattcacaattgctacaaagagaataaaatatctaggaatacaacttacaagggatgtgaaggacctcttcaaggagaactacaaaccactgctcaaggaaataaaggacacaaacaaatggaaaaacattccatgctcatggataggaagaatcaatatcgtgaaaatggccatactgcccaaagtaatttatagatttactgctactcccatcaagctaccattgactttcttcacataattagaaaaaactaaatttcatatggaaccaaaaaagagtctgtatagccaagacaatcctaagcaaaaatctgggttttaagaccactctgttaggttaggggaagttgggggcaaagaatttaagtgagtcatagcatgtataccagcagcattgtaagtgacctgtatatgtgtgtgtacatggatgtggacattgctgggaggctgacataggtcccatagctaataaagggtagggctgagactggatggaacccagtcagtttcatttcacagtctatgtactttattgttacattgttttgcctttcatattgtattggtaggacataataatagtgatatttgtattaataatttgattaataattatattagtttgctaggaccatcataactaaataccacagtctgggtagtttaaacacataaatgtattttctcacatctccagaggcaggaagttcaagatcaaggtgccgacaggtttggcttctcctgaggctgctctccttggcttgcagatggcctttcccccgtgtcctcccatgctctttcctctgtgcacgtgtccttggtgtctctttttgcatccaaatttccctctcttataaggatactagtcagattggtttaaggatcactctaatggccttatttgtaaaaattaattatttagttgatcaaaattgtatctgtttttcacgtactccacaatgttttgaaatgcatatctattgtggaatggctaaacaacctaattaacataagttaccttacatccttagtttttgtgataagagccctaaaaatctactcttcatgattttcaagaatacaatacattgttatcaactgtagtcactgttgtacagtcactgtatcatagatagatctctgtctaactgaaattttgtaccctttgacccagggtctccccagcttgcagctctgtagccacccttctgctctctgcttctgtgagttcagttttttaagattccatatataagtgagatcatacagtatttgtctttctgtgcctggcttattttatttaatgtattgtcctccagtttcctccacgttgttggaaatgacaacatggaggatttctttctgttttaaggctgaatagtattcattgtgtatatgttaccatgttttatttattcattcacctgttgatggacacttaggttgattactggctattgtgaataatgcctcaatgaacatgggagtgcagatatctcttcaacctactgacttcagttcctttagaggaaactccatgctgttttccataatggctgtaccaacttatattcccaccagcagtgtgcaagagttcccctttctccacatcctctccaagacttatctttcatctttttgataatagccattctaacaagtgtgaggtaggtgatacctcactgtggtttcaattagcatttccctgatatttagtgagcatttttcacatacctgttggccattcatatgtcatcctttgagagatgtctgttcaggtcctttgtccattttaaaaattgggttgttttcttgcctttgagttgagtttcttatgttttttatactaatgcattatcagatgtatggtttgcagacatgaaatttttcccattccatcagttgtctcttcactttgtttcctttgtggtgcagaagctttttcattttatgtaatcttgtttgtctattcttgattttgtcgaccatgctttcagggtcatatctaaaaaattattgcccagaccaatgtaatggagctcttcccctccattttcttctagtaggtttacagtttcaggtcttatgtttaagtcttaaatctatttcaagtggatttttgtacatggtgtgagataaaaatctaatattgcccttctgcctatgggtatcctaatggcttccgtttaactacatcacatctttaaaggccctatctccaaatacagtctctttctgtagtactggggtttagggctgccacaggtgaattttgaggatatacaattcagcgaataacaataacataataatactattattaatattagtattctgctaaatgctaccagtacttcaatagtttagttaactcatattttttgttctcatactcattcctgttgaagtgaaattagaaaatttagcaaattagagttttgtttgtaaaatattcatgaaaagttttcaaattaatttttttaagtgttggctattaatgacttcttggtcaaactttaagcttcctatgggaacttcactgtagagttcatgattgaatattttcagggtcttcagtagatatcggggaaaggccagggaatatgaaatcccaaatgttttccaacccacagttaacagctaactgtctatataatcttccaattcaatggaaaggcagaatttaaagatgatgttaagaataaataaaggagagtgaacttttatgtaagatacagctcatgtcaagaactaaatatattcatagttgcaatgtctttaggtgatttctgaacaaaagagaataacctttgttgtccgacatgtttcagtgaattaatggagattgtgcatgtatccaaggactacaattcaagaaagaccaaagatatactttgctaatagttttaaataactagaggagatgtttctctcagaaattttggttgttctcaaccctggctatctattagaatcatttggggagctttgtacagttgccagtgctctggccccagaacaaatcagaatctgtagctagtggagttggggtgagggagtgtgcacagagatggtagcgtgcagcccaagcactggaattgctctataagctccccaggtgatactaacaggtctttatctcctcatctcctcttaggagaagagttccctgagaatcaaagtgagaggcccacatttatttttgtatctcccaaaaagctgtagcagaaggtagtgggtgcttcctgttttttttgttttgttttggtttggttttttttttttttttttttttgagaaagagtctggctgtgtcatccaggctggagtgcaatggcactatctcagcccagtacaacttctgcctcccgggttcaagtgattctcatgcctcagactcccaaatagctggaattacaggcacatgccaccacgcccagctaatttttgaatttttagtagagactcagtttcaccatgttggccaagctggtctcaaactcctggcctcatgtgatctgcccaccttggcctcccaaagtgctggcatgagccaccattcccggcctgacttcttttttctttttaagttgaaggtacacatagtatcatccactggatgtcctccatgctttatacataattttaaaaatatatagaaaacctatattgtgccaggtatgaggaagatagcttcttcccctccccaatgcccacctcatgtaaagaaagataagaaccaaattatctgccctcagggaatgtggtcaaatggaagaaagagagacagggagggagggagagggggtggagggaactagtaaggcatcaacaaaaatagctactacctataaactaatgctaaccaaagagaagggcagcagatggttgggaatgtttagggatggggtgggatgggacaggtggatggatggatgaaaggaaagtggtaatggtttccttatttgtctccatgatgaaaaaagaagccattaagaccaactttcatcacattccagttcttattggaattgatgcaattaagaaaatgtaaaatagcgtgttttttgtgtattctttaggcttgagtctttacttttgaggaatgttaacacaatacggtgaattttaatgattactgcttgtgttcctttcagaaaaatgccttttaacatgtttcttattagagaggaatgaaatttttttttcaggtctttagtggttaggaaagttgcagttcacatgagcaccagttagagacgattataacccaacggtgtggttgtgccatttaaggagagctcagctgacactttttgaaattgtggaaaaatgttagtttgagagccaaatggcagcggtttggccctagaagaattacacagagttctcagtaatatagttattctaaggccttagaaatggcctggcccagactgccttggcactctgcaccctggaaagagaggttgttatgagctcagagccacatggcctctcaatccctgggcttatcctggaatctatatcattacactccccattcaaagctgtttctaccttatcacctaagtttgttttaactataatatacaatcaaaaaagttaagttcttcaggaagcagtaaggcacgtgctgaccatcgtgagctattctccagctaccttaaaggattgtcagtaagatcctctggtacttacattcgctttgagaagcatctgtgaacaactacagagaggtgggaagatcattattttaaaacttattttaagttttaatgggttccagcgatcattttggtgatgcgttcttaagacccaaattatgaaagctgacaacctaacaggtgttggaagactgcagcaggacatctctgccattttacatttaacatgagttacctggttattttggctgctctcacatgtgggaagagggtgggtggcaccatcctcctcctgccatggcttctgaagcacaggatgaggttaaacggaagtcacctgctcttcttcctgggtggtcatagcttgcattcatttaacgactgttgatcgaatacctgccatgtttccggtgctgtgctgagaggatggcaaataaaacagacggcacccaaaccctgagtggagaaactggacaataaagaagacagggacaggggagagagaaacagagatacatagatgagtttttatcatctataatttcccttgcaggaaagaagtgattaattattaatagtgagggtgattgatttttttaaattctgaatattgatatttcttagaccataggttcatttttttcaacaagaatttgtggagtacctactatgatcaagagaatgtgcttatggatttaagaacccatgatttaataatcccttgttttgtttttattattttataacaaagtaatagtttttagctttcccatgatacaaatagactttagtgacaataaaaatattagaagaaactaatgatttctagccgctagcaaacaagttgctttgttctttcaacttttcatctggtattaaatatcattgcccactgctcccccgacccccaccaaccaaaaataaagaaaaagagagaaagagacgggagagaggatgaagagatgcacagagggataaataggcagatggattgataaaggtagttaaatttggaggccatgctatgaagaaaataaatcggtatggttgaaaaagtaatgggaatgggagaggaaactagggaggtgaaggttcaccaaagacctttctaaggagacgataattaacatttaagttgaggcctaaaagaagagaaggagtgaaggggggcagtgcttagggagaaggagagagtatgttcatataatacatgttcatacacgtatggcgggatgtgttaggggtgggggcaggcacagtggggagcgttcacccagagggacttgccttcctacagtatcgaggtgggggagagattggtgtgcttgagggtactgaaagcaggagaagttgccaagcagtgagtcaggcagtagactggggccaagaactcacaggaccttgagggctcagggagggtcacttggctgagggggctgtgagctcttcttttggatgccctgcctggctctgcctaacatcttgatgatatcgtcagggagatgcagttgtagtgtcagaaggtgggagacaggagccctgtttgcacacccttcccaaacctcagtcaagggatccatgtgcttgttttgcaagatcctggaaccacgtaaggtagcaagtcactaattagaaagtttgcggtgttttgcattaaagcttgttaaaagttgtcagagcaggttaagcactctcaccttgccccaggggcatatacagcttttctgaatgttgttttgatgttactctttgttgtacaatatgcagctttttagcatctagggtcactgatctttgagaatgggaccacaaagtcatgtcagcccagctgtgtcctcccatcttggttttgctgttcacagtaatgtatttgcatgctagggaggccataataaaataccaaagactgggtggcttaaacaacagaagcttgtttctcactattctggaggttagaagtccaggatcaaggcaccagcaggcttggtttctcctgaggccttgccccttggcttgcaggtggctgtcttctcactgtgtcctcacttggccttttctctgtgcacacacatccctggagcctctccctctgcttataaggacatcagtcctgttggattagggctccacccctatcacctcatttaaccttaattacctctttagggccgaatctccaaatacagtcacattgggggttagggtttccataaatgaattggtgggggggacatgatttagtccctaacaagtaacgattatctaccgagtgcttagcacacgcagatgccagggtcagtgctttacttggattcatatattgcagtccccatgacagccctatgaagtcccatttcagagatttggaaaccaatacacagaaagatgaaatgagttgcacagattgtatgattagtgagtggaattcaaattgtgtgctatcaaagtaccattgaacctcacactgtttctcaatctcttggtgtcccctctgggagtcccactgtgagtgagtgggacttgctcaacttgctcccacgccccactaagccgtgcccgcctccatcctgaggcgcgcagtcccactctgccttctccctagagtcacatattattagcattgatgtagtcccctctgctagccagtcatctggcctctccagacacgtccccccggcccttgtgtctttagtaatagctgcaggagtaggttccatatttgactgattccccaggagacatgcaagcctggtgttatcaggtgttacctatcatcaccagtccccaagttctcctgctcatgatttcagggtgtaggtcacacattctgctgggaagataaaagttgttgttgttgttgttgtgagtgttcgtctatgtttgggctacatcttttgtactctgacatctttgttagaattccgagtggagaaatgacttggggcccagaatcttctaattattaggtttcctcttgcccagaaatgctaacagaaagatctgtctccctagtgctcagaaacgttaggacaaatgacaaaagctgcagcaagtgataaaggaaaggacactagccagaggcagtgagctgcaggaatcctaagcatgacacagagacagagggatcatggtgtcattgacctgcatggcttctggcagttagaccagctctttggcaatgtgatgtttcaaggccaaatcagcccttattgtgttcctctgtccttctagcttatgtgtgtcctccacacctgcttctgtgctcttgtttacttaccacttcaaggttgaaaaagataagaatatttcttgattggtggtctcaatgaggtatctttgaagtttatggaatttcccatttgtaatagatcttagcaaaaatcgattctatattcattttagtgatactgcccatgggggcagaaaggtaggatgaaattcaccccagattccagtcttgttttaagcacaaataaccaaagggcccgatgtgaaggcacataaagtacttgatatggcttgctactactgacagtgggtaacatgcaggatctggtgtggaaccagctcagtaatctaaatgtaagagctaacactcgaaaactcttagaagaaaatatagatggacatcttcatgaccttggattaggcaccaagagaataacaaccaacaaaaaatagataaattgaacttcatcaaaattaaaaaatgtttgtgctacaaagggtactatcaaaaaagtgaaaagaggctgggcacagtggctcatgacgcctgcaatctcagcactttgggaggctaagacatgagaattgcttgaggccagaagttcaagaccagcctgagtcttgaagtgagacctactctctaccgcccccacccaaaaaaaaaagaagaaggaaaaaaaaagtagtgaaaagatcatcacagattaggagaaaatatttgcaaaccatgtatctgataagggacttctatcaagtctatataaggaactcttacaattcaataaccacaagacagcccactcagaaatgggcaaatgatctgaatagacatttatccaaagaagatgtacagaagtcccataagcacatgaaaagaagctctacaccattagccatcaaggaaattctgatcaaaaccgcaatgagataccacttcacgtccactaggatggctatagtaattatttttaaaggcaatcttaggctagcaaggataaagagaaattagaaccctcacccaaaactgataggattgtaaaattgtatagctgctttggacaatagtctggcagttcctcagaaggttaaacatacagtttaacctgaatatattaatcaccaatttttaagagaaatgaaaacatatacctacacaaaaacttgtatgtgaatatttattttaacattattcataatagccaaaaagtagaaacaacccaaatgctgatcaaattgataaataaaatgtggtatatgcatacgatggaatattatttggccctaaaaagtaataaagtgctaatacaggctacaatgtggatgaacctgaaagtagtatgctaagtgaaaggagccaatgacacatggccacattatatgattcgatcatatgaagtggccataataggcaatccatgaagacagagagtgcattggtggagccaaggcctaaaggtagtggggtgggcagtgagagaagaaataggggttgattgctaataggcattgagtttctgtttgggggtgataaagatgttctaaaattgattgtgggaatgattatacagctctgtgaatatcataaaaagcattgaattgtccactctaagtaggcgaattgtgtagtatagaaatgaaatctcaatgaagctgttgagtaaaatctcaatgaagcaattattttttcttaaagtaggtatatcatcctaataatagaggagaaaaactgaagtttactatatggtattccaaattgagcagtttgagtttaggatgaaggatttttctgtgtgtgtgtgtgtgtgtgtgtgtgtgtgtgtgtgtgtgtgtaaatctggaatattgaaattttaaagacgccaggttcttgggacatatcttctttttcacagactccaggagttggatacccagtccccaatccctctttgagttcattcccttgattcagttagagctagacataagacattttttcttccccttctgctcttttgagatctcttaaaggattttaagattttataaaaccatactctggttagcgcgataaacctcaaggatcataatgtatatgcccggagctgccttatctgactggtaatagttctctttagcatagagcagcctcagaaatctaaatgtcttcaggagccgaacagataaccaataaatctcattaaagcagtgacaaattgtggggcctattgagtctcggtttcataactgaaatctgggttgtagtacacaggttgttctaggaataatgataccttctttttgtaaggatcaagtgagatggtgtttaagaaggcaccgtataacacgtagcaagctatacagttattaatttggatatgaaatgaagtctgttcttttctcaaaaaatttgtaaagattaatttttatcatttgattgatatataacccataatcaagataattaacatagccatcacacccaacagattcatctgcctcttagtaatttattcctactctcctccacccttatcccctaccagccactggtcttctgtctctatggtttagtttgcattttgtacatttttttataaacagaaacgtaccacatatatttttgttgtctgagttaatttactcagcatagctactttggagtttatcatatcactatgtgtgttaatagttcatcccttttcattgccaagtactagtccattgtacagatataccataatctgtttatccattcacctgataaacatttggatttccagtttttggctattgcaaataaagcagctatgaacattcatttacaagtatttgtaaggacatatgctttcattactgttaggtacatacctaggagtggaattgttgggtcatgtggaaagtgtatgtttactttttttttgttgtttgtttattttttgttttgatatggagtctcgctgtgttgcccaggctggagtgcagtggcgcgatctcggctcactgcaacctctgcctcctgggttcaagcgattctcctgcctcagcctcccgagtagctgggactacaggcacctgccaccatgcccggctaatttttgtacttttaaagtagacatggggttttaccgtattagccagaatggtctcaaactcctgaccttgtaatctgcccaccttggcctccctaagtgctgggattacaggcatgagccaccgtgcccggccacatttatgttttagtaaactgtcaagctgttttccaaagtgctggttctattttacattctctccaccagtgtttgagagttcgaggtcctccctatcctccccaacacttgctatggtcagtctttttaacttaagccaatcaagtcgatggtagtgccatctcattgtgattttcatgtatgtttccctaatgaataattatgttgaacatcttttcttgtgttgataagtctgttactttggcatcacttcacatccagcttactctgtgcataagagaatttcactcttttaactgattgcattggaatgctgaccaacatgtcattaggaacaactgtggattttctgttactttatatttaactgggcatgtttgtgaaaggatccagaacatcctccaacttaattttctttgtatgtgttaggttatttcgatgctctaaaattttgaccaaattgatttttaaggtgtggcctgatttcaaggcaaaattaggggttatcaacttattttattagatgtctaattctgtaaatgaatatatatacagaagtggatttccacttgaaataagctgtaatattgacatctcgctatattcagaaataagatgtttgagttgggagggaccttagcagtcactctcttcagccattcccttcatgccccctgcagcactcataagggggttcatctttccactgtcagagattcgagtatctggaaggaccttgtacaataagcatacaacaaaaaaattctccttttgtagatggttgctaactgaccttcatttgaaattgttttatggtagttatttgatgggagttatcaggtgagatttagccatccagagcaagcactgcctattaagaatttcattgctgtgtttttaaatatatgtaaagcgtaaaaaggggtgggggagtaggcagaaagagcctagaatctgtattcccctcagtctgtgatgaaggaagccctttgcaagccttgctttcacaacctcaacatggcatgggctttgctgtcagtcaggtctgagttggaatcccagctctgcctctccttctccatgaacggggtcatgagggattatgggtattttgtgggtagggaggtatattataccctcctcgtggggcagctgggatgcctacctgagataggagatggagggcactggcaccaggaaagcactgggtctgtttccttttcttacctctttctctttctcctcttccacatgttttctctcatcacttaggtcacttatagaaatcgttctttttacttctatttcaatcaattttggaaatttctccaaaaagataataatggtaatgaatacttaagcagtaacatttagcaagtcccttttatgtaccaggaatatcaagtacatttcatgcatttttttttcatttacttttcacaagaactcatgaagtaagctgcaattaaggcagagaggaaacggaatgagtgatggagtcaaggtgtgaaccaagccctaactgaccccagagctcttaatcactctgtatattgcccctatatctaattttaggaatgctcagttgtctgtgtttccacccccatccagatgatgataatatgaaaacagtaacagctggtgcatacctcgcactgagcactggtctgcctgctttccacatattaactcatataaggctcactgtaacctgtcacaggttctattgctgtctccatttttgtgatccccattttttaggtgaggaaatgaaggtgcagagacgctaagtaacttgcccacttactcaggttcacatagagttacaattgatgttcagtctgtcgttcctaatgcctccggtgtctttcccctatcacttcatcatttcttaaaattcattttaagcccatttcagaccaatcagagaagagatgggaactccctcctgcttagcttagacatccgagctactctttccagtaacctgtagaattctttccttatccttgctgcagtctttctaaagtggtgatatattggacacttcatccaaaggctgaactgagactaatgcctaagcaagaaagaaaaaatagcaaattcattaactaggaatctatttacagtcaattcccaaggctcattgtgcagtcagtggttctgcatcatttagagttgctaataaatgaaagtctttgcgtctttccaagtgccttgatatttacaagtctcatattttaccataggaaatggcttcaacaagcatattcatgtgttgacagttctaattaatacaagtaattagccctgacagaactgtgaaaaggagacccattcataaatttgctaattatgttactctgctcagaatttaatcgcagtctagtctttaatcatatctgtatatgggcaaaaggccatcttactaaattcttcaggcttttacatttacttctggcaagaggattttactgaaattaatttgtggctgcaatttaattttccagtatgcaggaactggtaaagaacacagattataatctttctggaaagaaacaagaaaatgagaaaaggcagacaagggaggaggaaggcatcaagtacataccatatgctttcttacatgtaaagcttgtacgtttctacctattttaatgccttttctgaaaataaagatagtcttatttaggccactggtaggtttatggtacagaaaatttgaagatggttggttactttgatccaaagttgagccctcttctcttggatgtaaatagcctactttttcaagtgcttttgttcttgagcaggggttctcaaccttggcactattggaactttgggctggatgattccttgattccttgtcgaggtgagtgtgactgccctgtgtattgtgcagtgttgagtagcatccctggcctctacccactagacgcaagcgcacctctcccctagttctgacccccaaaagtgtccccagatgttgccagttgtctcctggggagcaaaatcacccctggttgagaaccgctatgcttgagagtaacttaagataaaaaaaagaatccagtaaaacttctatatagaacacttatagcagctgtagcaaaatcagtaaagcaccttttcttggaatcatttaccaggcatcatgatacagaactcagatttggaatgatattccttgaattacaatacttccttcctactttttcagcattaagctccctctggtcctcttagatagaaagtagagttgtgcttggtagtaaagtagcttatctaaaacccctttacttttctttttgttagtagatacactgggctcttcatattcatggatttaacatttgaagttttgactactcgcgggtgaccccagtgttctgagtaatcaactcccagtgttctttgtcttcctttccagttcattgattccttactttgtggtcttgctcttctccctccactgcttagatttctggtccatataaataccttccatgcccttgcttctcacccttcttccatttacctggaaaaatcccagacttgagtgagcctggccactaggcttcttggaatgtggatctggcagctaagccttattagagaacatgactcagcagagcagactgagcctatcatacatgcacattaacctctcaactatcctagacctccctaagaaaatggaatccacccctaggcaatgcccccaacctcccatcatgaaaactacaaacgaacctattctgtactcaccaccccctacttaactccttccttcctgacaactgagcagggaagtcttcttcccttatcaaaagctaatccttcacccacctaccccagcttctcagaaaaatattttgtcattgagtatccccttttcccttgtgtcttcagcctctcagtctctactggatccctcccatcaacactgaaagatattcttagtctctctcctctcctatcttgagagagagaggaagagagcaagtgagtatgcagtaacacacagcagcctttcagtaaccatccttccccgttccatttacattcatattgtcctcttcaactttgaatcttgcctctactactacagtcatgttgctactcccattagtccaataaaacagttctagctaagatcccctgcaccctctatgttgctaaggcctggagtcactttccttccccaaatttacttaacatagttaactactccttccttgaaaccataccttttttctttcttgttttcccaatgtcacactttcctggctttcctaatatggtctggtctctttcctgggtcttctttgcaggcccacccacctccactttacctttgaacatcagccttcctaatgacttaattgtagctcttcttttcttctcccaaggctttagttgctatttatatgctggcaacttccaaatttatctcttcagcccagttttctttctgagcctctaaaattacaaataaacatattcaaggacatctcagatgcatcatgtacaaactgaatttataattcttttatacctttgcaactcattccttttggccttttggacgtagtgagtaaccaagccttcttgatggtaactcaagatacatctcaaatcctttcacttctttttacatccattagtgaaagccactgttctttacaaatggatagtagaaggtgaggatgtagaaataagagccaggtcacacagggccttttaggccatctgggactctgatttttctctgaatgagatggaccccattagagggttttgctcagaggagtaacataatctaactcaacttagaaggaccactgtggctgctgtattgagaataatttgtagagcatcatagtgggttgaatgttatcctctgaaagatatgaccacccagaacctccaagtatgacctcatttgaaataaggctctttgcaggtaattaaggtaaggatctcaagatgagatcatcctgggttagggtcaggtgtcctgataagagacagaaatggagaaagcagacacagatgaatgagccatgtgaagacagattggagaacagtcacaagccagggaacaccaaggatggccagcaccacccaagctgggctagaggcatggaatgggttctcctgcagagcctccagaaggaaccaaccctgccaacaaccttgatgtcagacttctggcttcccaaattgcaagagaataaagttctgttgttttaaggaactcagtttgcaataatttgttatagcaaccctaggaaactgatacaagcatcaagggtaaaagcagaaggccagtaggagtccattgcagtaatccaggcaagagaggactgcggctccacttagtagctgtggaggaggtgtgaagaggtcagcttctggacacattttgcagtaaaatgaaaggattttttgacagaatgcctgcaattgtgagagagagaagtgaagaatgactaaggtttttggccaaaaccactggaaagttgaaagtagttcaggtttacaggaattagagttcagtctcagaggtgtatacattgagagaattagtagagctccatgtgccatcatcctggagccctgttgacttttagggatggcaccatgtttgagaggctacagaggagacccagagccagtaagcaagacatagagtttatagagaggacttacagcatagtccagtggcagcgggctagacaggagaaccgcaattgcttgaaaaagcacgaagtttatagcaaagacacaatgaaaaaaaaaacatgggccgatatcactgatgaacatagacagaaaaatcctcaaaaaaatactagcaaactgaatatagcagcacatcaaaaagttaatttaccatgatcaagtaggcatcattcctggggtataaggttggttcaacatacgcaaatcaataaatgtgactcgccacataaaaaccatatgattgtctcaataaattgctagtttttccagcattatttgggtgagtagttaactactctcctaaataaatagatccttgatgctactcatcttggagctatggagagttccccaggtgagaagcaggtcaatcacaagaaatgcctgcaatttggaccatctgtccttgcactcttcaccgtaaggctcatccttggtatcagttttctctgcctatggtacctaactatatagaagggatcctcctaggggcctcctcagtagcccgaaagcaacactgttcagtagaagtatctgcagtaacggacatgcttcgtgttttcattgtccaacatgggagccactagccacaagtgctgagcatgtggaatgtatttacaaatggatagtaggaggtgaggatgtagaaataaatacaacttagtgcaactgaggaattgagttttcagctatgcataattttaattcatataaatttaaatagctatgtgtgcctgatacataattttaattcatataaatttaaatagccatgtgtgcctggtggccattgtatcagtgcagatctagagcattggttctaaaagtgttgcctggaagcttgttagaaatgcatatttttggaccctgacctcaaactcctggactcaagcaatcctcccacttcaaccttctgaatagccagctgagactacaggcataggccaccacattctttttaattttttttttttttggtagaaatgggagtggggtgggttgtggggaggttgggagcatgggagatctactgcaccagaagctttgcgtgtgagacccgggattatgtgttttaataagctctgcagatgattctgttgtacaataaaatttgagaaccattgctgggtcccactctcagagttcatgatttagttgttctgggatgaggtctgagaatttgcttttctaacaaattccctgatgatgctgtgatgcagatctggaaatcatctgagaacctgttatagaagatggaccaactctttgtgaagtggcccccgttcccaagagtaaattgcataaatcccacataacaaatatttcaagtcaggatctcccaagtgtaccctccatacttgatgaaaatcttcctagcttttttcccatgatctggtaacaaactgtgtctggcttataggagggctgttaagtacttgttgaattaataaagagattatataaatcagcctgaataaaatatctgaagttgagaattctttttttctttattttattattattatactttaaattttagggtacatgtgcacaatgtgcaggtttgttacatatgtatacatgtgccatgttggtgtgctgcacccattaactcgtcatttaacattaggtatatctcctaatgctatccctcccccctcccttatcccacctctaactttctgcatgtgatggctttttggccttcatgataacctattagtggaattccacttttctgatccgtaattctacaactcgttgtagaagtcattgttgtagtaatttttctgtctgtagcttgataaattttaattgttatagtggaaagaaggtaattcttaactagagaagagtgtagtatgtccacacccccaagaggcatttgcaaatgtgtgtgtgagagggcttttgggttgttgaaatgataggagtcagggtagaggggttacaattttcattcagtgccaggggcccaggaatgttaaataccctgcaggcacaggactgtcctgtacaatgaagagaaactctgtaacctgttggtaggtgacagtaatatttcttcagtaaaattacttctaaggccatgactctcttttgctagttatatctcttcatgagcattttgtatgagttttacttatctcataggagggtgaaacaccctctgtcctgctcttgcataacataatttaattcttgcagcaaatatttagtgctgtgtagtttacaaagataggagacatgagcctacctacaaagaagttacagtaccaccaataagctggaaatgatataagagttgtataaactggaagaacccagaggggatattacctggtttatcagttaaggttcaaccaggagacaaaaccagtggagacatatattaagagctattattgcaaggaagtgcctatgtgattgtggaggctgaccaggcaagtccaaaatctgtagggcaggccgtcaggaagggtgagcaggaactctcaggcacttggctgaagctgtagtccacaagcagaatttcttcttcttcagggaagtttcagctctgctcttaaggccttttaaccgattgaatcaggctcatccacattatctaaaataatctcccttaaagtcagctgattatggactttaatcacatctaccagatgccttcacagcagcaccctgattagtgtttaattgaataacctgagatggtggcttagcccacttgacacacaaaaaagagcatcgcacttggagattgaatgtttgcgcactctctccgaaacatgtgccatttgttctgacccttgaaaatggggaatttttaagtggggcagttggcattctagagggggtgactattaaaaattagccaaaggaaacaataaaagaagccaaggcatgaaagtataatcggtgtttgcagaatggctagttgttgctatgtggcttttccctgaacctcagctctcaatttcctcatctgaggagtgggttcagtacttgtcataactgtcctccaggatggaagaagatgatatttgagggtgccttttggaaacagttaaacattgtgaatgctaagggattttttttctttctttaaccatccatgtgtccaaggtatggaccagtcatggacacaggccaaaagccaagccgggataaacaaggtgttgctttgtctctggctaatgtgagatgggctccaccaaccagaagctactcttcccatgtcagaacactgaggtgttttatagtcatggtggtggtggcagtagcattggtgagagtgtgaggttggtgtgataaaaaccgaaggctcggccggtaacagagagcctgattgttgcagactttgtctaaaatttgtgtttttaagaaaaaaaaagtgacattctcttgaccttagttcctaatgggctaaaagaatgaaaaacatccctgtatataagtctgtgcccaactgtcacaaagcagcaatagccatttgctctgggctaagacagctcagccttttttttttttttttttttaaggaagtagacctgtttttgatgcttgagatattaggggtgaaggagagtcatttattataaatgtgttgaatactttgcctaaatagggaaagggagttaaactacatccaaggaagctgttccaagtttcttaggtaatggccattaaggccaattgactccgtcaccaaagaaagcaccagaaaacgtgagtcccgtttgacagacttctttccttttcagaactgtgtcctacaaaccaaacaaatctcccccaattgttaaagccatatgcattttgaaggaaatgtaatccatatgttcctgagtcacttatgcctaagtcattaaaaagttattttttaaatgtgatttcatgtttgaagtcattttagagtatttttagtagactctcattcttcataatgctaaatttttcttggtttgttttcttgttttatttaaacacactgtatatcatcttaacacatcctgtggcgaggcacaaagggaatcttgaactcagaaggagggtctggtgtactggaataacacatttgaggcagtttctattttcagaagtttacaactgtccccccccccttaattttttattttatgtcctgggctgcttttaacctggtcacatcgtcatcccagccctctccccccgcattccttaaatggttgtccatgaagaagaaaagggaaaagagaaaaatgacaaagaataaaatcacatggcctcctaggatatacttctgcactgtgctatgtgatcctttcttcccagaattgaatgtattttccccttttacctactattgttgctagctgggagaattaaggtgtttcttaaagtgccaacaaaagagagaaataaaactgaattgaggagctgtctccagcttctcatttttaggacaaacagaagacggtgtctgcttagaactgaaactaattgaaaaatggtttcattttttactaaaataagcttttttcccccctttttaacctttgtctcatgatatgagtctcatgatatggaccaagttttatctgtacatgaagcatcctggtttgtgtgtgaatttgtccatcgtgaacatctgttggctgccagagggcacggaagcagccttatttttaggcactggtagaggtccatttctcttctcaggggctgctcaggcagcaggtgtgtagcatcaaacatagcgagaggcactcaccacctggaggaataaagatgtaaggagttaacaattttacttttcatctctgccagcctgtgaaatattttccaatgtactttttttatttgattctcaaaactgccttgaggaccattgtttttgtttgttttcataaagaaattgaggctcagggatgcgactttcttcagtatttcacaaggcaatcttggcagctggtgtgtgcctcggagaggagggatatcgtgcccatcatgtggggacatttgaggaccttcgtggacttttacttttgaaagccctgccccacatcatttcaagtgtattaaaacatacgcaatctcctatctgtcccacagatcccgtgtataatatatatcatcatatatgtgagttgagttataaatagttgagatggtacatttcgtagacacttaattaaatgtttactacttttaattttatagtttctgtttcattttggaaccaactaattattttgaggtctggaacattttcatgggcctttaaaaaactcaccctccctgagtgctgtccctacagtggctgaagccgcctcttgctctcattcactcctgtttccctcctcacacctgtggcagaaccgaggcaggtgcttactaaatgcttgttggtgaatgcccaagtgagtgagagaaggaatagaagaagtaacaaataagtgaagtacaagtaagtggcaaagtctggtgtcgaaggacgtctgaacccttagcgggctcatttcctttgcactgtcatcacagtgaagcagaacgggcatcttcaagctgtgtatcaaagtgtgttcctccccatttctcattgttttgttccaagccagttttcttctctgttacagctaaggcatgagaaagaatagactaccagcttatttgacttttgataagttcatgaagcagcaatagccactttcaggtcataatccattcttttctctctgtttagttgctatagtttatttttttgccttgcaaatatgggataaatgtggctactaacattcaaatattcagacaagtttcttgacaaaatcagagaggtgttttttgcctgttgtttcttttggtttgttttctttagaatactggacatttgctctaagttatctgtcatgtaatttgtgtgttttgttgagatatgattttttttttaatccaaaggtggatctttgtggcctttcttcaaagctctagaatttggtggcaaggaacttattgaacatgatagaaaactagagagaaagcaaaagcccacttttttttttttttaattttactttcagttcttggatacatgtgcagaacatgtaggtttgttacataggtcacatgtgccacggtggtttgctgcacctgtcagcccgtcatctatgttttaagccccacgtgcattaggtctttgtcctaatgctttccatccccttgccccctaactcccaacaggccttggtgtgtgctgttccactccctgtatccatgtgttctcattgttcaactcccacttacgagtgagaacatgcggtgtttggttttctgttcctgtgttagtttgctgagaatgatggcttccagcttcatccatgtccctgcaaaggacatgatctcattcttttgtatggctgcatagtattccatggtgtatatgtgccacattttctttatccagtcaatcattgatggaaaaagcccacttcttaagaaagaaacacaaaggtgctaaatgagaggagggaagagagagacagggattacctaaagagcagagccatcctcctctttctcagccctgctatgccccctggaaaaaggggtctgcccatatgagtgggcctgggaaggctgctccacccagttcatctggactcccagggtcactagatggcaccagggcagacgtgggccacactcaaaaccctgcagtgctgcttcatggacggagcttctgggtcaaggcaggagctggaaatggtggaacttgccctccatctatgaaattttttgagtcagtcattcagcaaataatgactagacacctatgatagtgacacaacagtgaacggcacagactggtctctcgagtccaggggctctctgctcacactcggccaagctcttgctgtttaagggtgcctttcatgaagtctatttgaaatgttttggtttctgtcagtttttggttgggttataggtaagtacacaagttaccacatgtatttagaaggcccaatccctccatttatcaactaaagttaaagaaaggaaggaagcctgtagcaaaaaaaaaaaaaaaacaaaaaaccatgcaggttcccccactgctatatgattttctatatttatgttttaatttcttggtaggcctggacttcaaagtagagattcagagccctacctgagtttgggttgtgccctgtggctgccatccttcctcacagaagttcctccctggacttcagcctcggggttcttgttcactttcagtatttcctttttgcagtgtgtatgtgtgtgtacggaactatatagtgttgattgtccttaaatgatcttcttccaaactcatccaaaccatttaatttgtagcaggaatcccaaagtatatccttcccagagaaagaatgagatttgcctggcatcaagttaaggaaatcattactcaaaaaaattgtttaagacattttcctgtgctagagatgctggtgaccaagaagtgggtgcctgggggagatgtctgggctcattatctgggaaagttgggaagtgagtgtttgcctgttcctttttccactctgtttcctcattggctttgccatttacccaactgcccccattctaagattggtgtttactgatcaagagcaaagctctactgccttaggagtagttcataaaatgattcctagatgtaatattcactctcttccctgcctagtccccttagcaaggacctctctaacattttatgtttgaattgttttcttccagagacaaaggtaagttagatcaagagtaaacagatggagatgttcattcttggaagcagcaagcattttgttatcattgttattgtctgagcaagtgaaaaccagatgagaagagccttgacctgcctccttcactagcagaagtgaagtaggtcgtatctttcttgcagcattcctgtgagcgttagaacaactccggagcccatgagtaaggctactgtgtgttagaattgtgattctgcctgttcatcctcctggctgcccacccctgagaatctccttttcgttcgcatgggctctttgatagcagagtggctgcctctctgcaatgagcttgagggttttgtgggtaagaggcccagtgcccctcaccgcctttccacatgcttgcctccttacccagtttgtcaggctttgacagatggccggcgtttgtctcacctgcgattcctttttgcacagcactcggtgtaacacttcaaagaaataattagcattctgagtcttctctgccctgtgcatagaatgtgggaaggttccgctgaagagggacttgagcccagagtgttgtatgggtgttgccctttttttattttattttattttattttatttttgagacagagtctcgctctgtcgcccaggctggagtgcagtggtgtgatctcggctcattgcaagctccaccccctgggttcacgccattcttctgcctcagcctcctgagtagctggaattacaggcgcccaccactgggcctggctaattttttgtatttttagtagagacggggtttcaccgtgttagccaggatggtttcgatctcctgacctcatgatccacaggtcttggcctcccaaagtgctgggattacaggcgtgagccaccgtgcccggcctgggtgttgctctttttagtcctgactgtcaaggtattaacttctttagagtcactttttcgttgaacaaggatgtacaaaagagacatctagttattacattcttctggtttggttctaaaataaatgggaaggtacctgtggaagtgatttgtatagatttccaggcaccaggatcctctttagtgtcccgcacccaagagcagggtggatactccctgcaggctgagagtcgtgaactgtacagtgctgagagtcgtgaaccatacagtgctcacggtgtcatcgtataattggagatcactcttttcaggtacctcgccagtgcgtggctcagggacatcctggagatcttggtgctcccattaccattttcaggccatgtatctcttccaggctgtgctcctgtggcacagatgaggcctagttccactgctctgatggccacacgtgaatcagcagcagtgactccttggtacgtggagagaactgggactcttagtgggtagcaaggaaattatgtttttaaaaccaccagctcctccttccatttagttggcagttccatttctaatataaaatctttcagatctgagctctcctagggcctcccaagatttaatatggtgccccagaatgataaatgagaataaagagaaactcttcataacaggaccatgtagaaaaggtggaatcgatgcccctgaggtaattaacttgattgtggtactcatttcactacacacacaaacacacacacacacatctataaatacatatataaaatcatcacgttgtacaccttaaacttatacaattttatttgtcaattagacctcaataaagctggaggtgagggaggcccgaactcaatgacagtttgctttcctcagaatggccatggggtgagggagggccccactcctagagggagcaacttcttgattttcctcattcttatttccccctcgggccacccagaagccaggccagtcctactcagatgatagaaaaccttattagccctcctaatgaaatgggcagtttggtacagaagaggggaatctgcttggatttaaagatggcgtcaaactattgtccaatgcagggaaatacatttatttctacatgcagaaggaactcattaaaatctgttaggcttggaattttcgacaatgatttgtacataaactccttaagtattgccttgtgtactgacatattaaaagttatgatgatgcttaggaactacagattatttagaaaatgtttgaaaagagataatacacaaaagcaagatttcattgtcaccaatagatagcaggcaagattaccttgtccctctgagggttctgattgagtgcatttggctgcaggagtaatgtaagtggccccagggttgttgtgttctgtatctagatctggggaacagtcacactcatggttccagttgaaaataggtctcctgcccccattagcatagcagggcctgtctggtcacaagtcctggctgtttggtttggagactatgtgcagtatggattggagcagaggtacaaagccccaagtttttggtactagggacacttggaaggtgtgagagcacagcctgctcttccctcaaggccagcccaaacttagcagccaagcagggcttctggggcagtccaggtgtggagctcttgtccattgtcacttaagtcctctgtcaccttgtctgtgtcctctggtcatactagatcttggatatgcccacccccctggagacaccactagacaaagagaaatgaggatgtctagtcagtgacttcccaagtccaagtcgagacgtctgcttcagctgctttgacatgcagcaacatcaaaggagcagtaccccaatatagtaacaatttgttgtaaattatcaaaatgtgtgagctttacccacgcctccttacctggaaaccctcccctgccttttcctcttctttgactatcccatcttcactgtgtaggagactcaccaccgtatactgatgaagaatgcacacagttccgtgtggtgctgctgctaccttaagctcatctagaacacttagaggaagagaagagaccccagtccaacttcacacatcaggctattgtctcattttgagaggaggagagaagggagggttaggagtaccttaacggggcctgggtgtggcttctaagtgctgcaggcacaaggtactatgacttgggcctatcgggtaggtgtctggagtgaggcctcttggccctgggtcacaagggcagtgataaatttcagtgaccacaatactgctctgatatttttccccacttggtggcattttatatataaaactgaggcttcatttattttgaccccctcctcccattgaaagagccattatctatttcttagaggccccaaacaaacagggtggatggcagaggcctcttgtctggcacaagactcgggttcctggtttacccttcaggctgggataaggctggcctcacaagtgagactcagaaacaagccactgctctcatgaatgcctgtcttcatggaaaaagggatctttttggtcatttgtttctgtgcctttgttctggaaatgaggaacttgaggcccagagaagtcaaggagcatcattggatgtctcgcgtctctggtttcccagttcagtttgtgtctccccttcggcaagctccccctccctttagttttgcatttaacacagtcttgccttcatgactgccgcctcctttttttctgtaaacacaaatatgaagtgtatttgctttgcttttcagccttgtctgccccactgagtgtccgaaatagccggctggaattcatgagaatgttacgtcttcagatgtttataatccaaaagaatcccttatggtttttaataataaaacaacttagatgtcggtattttgtgttggaaaggcgagcaaagttcacaatgcagcaattacaatgcagtgcattatgtataatttgtagcctgccccaggagcaatggtgaaccgtgaaacaccatcctggccctgtagcataattagcaggatcaaacgctgcacagggagaagcataatagttgtcatccgaggtaaataaaagtaaggaaaagttctgatacaccccaaattatataaagagcagcccctatatcaggctgcaaatatgtcaagagtcttcattgctaattgaagaaatcttttgaggtttagcagctcataaattcacactgggaattggcctattgttctaagtcttgtctttggaatgtaacagttgtacttttatattgagttcctccaatagtaccattgtaaacatgaagagtttgcattttaacgtaaatttgaacaatgtggttttaaaagagttcaccacatcaaaaagaggctgtttgggcatgttttatgcattcttttctctatagtatttaaagctataaatgactcatagaagtatgttccatttagatctgtcatgttggtgtagtgtcctcactggagcttgtactgcccttatttttttctactgtgagataattatctgaaaacaggtctaggccttttgccaagtcacttgcccttaatctgtcttcagatccatagaaacaattctagaacgctgttacacttggactaaacagcaacacattttgtgccttttcatgatcatcttttttttaaaattcaaatattcaatttgtactcttttttctccatgtaccaattacaacccttcctatagcctgctagccccccattaaaaatctctaattttttgccaagccactagttggagtagagaaaggttggatggtaaagggaaacatgtgtgtactggtgtccaaagcaaactggcggaatatgaagagtgctgggcttggatctgacccctggacatatggaccataccgttttctggtgtgagacctcaagaaactgcccacctacgtcgagcctcagtctttacatctgtataatgaaggcaatatttagcactctacacctccttccattcctgcatttgttcatttatttgttcatccccaggcatagaatgtggacataaaccctcactgtccttgcccccatggagctcacaacgcagtgagaatgcacgctgtcaaaatgattagattcacgagtaatcactaaccatggcatcatgtgctgtgaagggaggggatcctgtgagagcttcaggcaaaggaccctcactgggggtgatcagaggacacagtcacttccctggagaagttgtgtttgagccaagagctagaggacatgaagcaaggagagatgtttgtttttgaaaagctctcccagctactgtgtggagaatggctggtaggaagacaggagcgagtgtggggaaatggtttagggttgtgttagagttcttcagagggacagaaaccaataggatgtaggtatgtataaaaaagagtttattatggagaatcagctaagtgattacaagcaaagtcctatgataggccatctgcgggctggggaaagaaagaagctattcgtgtggctcattcccagtccaaaagcctcaaaacaaaggaaacctgcagcgcagccgtcagtctgaggcccaaggcccaagagcccccaagaggccactgctgaaagtcccagtgtccaagagctgaagaaactgcagtctcattgttgtaggactttctcctcagttcagctaaaaactaggttcttgtcacacaaccaggaaagataaggcttatggacacatagaagggtgagaaaagcagaatttattgggtgaaaaaaggaaaaaactcagcaaagcaagatggttcctgttaacaggcccccatctcaccaattgaatcccaggtcaccacccaggaacaggaggggccaggctcctcccccctgcaaatggctggaacttcccgagaccccaccccatcctcccattgcacaggtcagttggagattctctaggagcccgttttacttggctggctcatcatattcaaaggcaggaggagaggaagcaagcatcccgcacaggaggagagaggaagagcaagaagactcagcaggctgggtacccttctaccgtctgccctgttctagccatactggcaatccactggatggtgcccacccacattggggcgcatcttcctctctcagtcgcctgacttgaatgtcggtcagtctctggcaactttcagaaacacccaggagcactgcttcaccagccatctagtcatccctcaagccagtctagttcacacctacattaaccatcacagcggtttaggcactggtctaggcccatgatacaggtgactcaaacatagttggtgacaggacagatagagaacaatggacaaatttgggaatgttcaggttaaaatgacaggttttgatggattgaatttggggacaggacgagtggaagaggaaggtgtcaaggaagactctagggtctgggcttgtgtgactaaccagagggatagtgggggcatttctgagaagggcagcctggaaagggggtcattagtgtaacagtcagcaccacttacctttcattgctttgacccaggtgctcatatcctttaattcatttggtcctcagaacacacccatgagctagattttacagataagaaaattgaggatcagtgaataaagtagcttatcctaggacacaaaataagaggcaaagccagtattcaacctcagctctttctgattcagaacccatgccctactctcgttccccaccagagcgaggtagcagaagggcagctttgtaagacaccggtatccactccagatttggtaagcaaggttctaagcagaatgaaatgcctggaagagaaaacgggagatttggggtgtggttctgtgcctcttagctcttaggaaaaccatttaccttctctgaacttccatttcccatctctgacatgagcaagtcagatctaccatcctgaagacacccctcgtgttctggaaatgcatgatatttatgatgtcatcctggatgcatctcatacacagtctcccatccacacttaattaaatctgtagggttccttatggtcttaaaaccatatagtcctttctctgctagctttttatctggccaaagcacatatttagatacttccaatgaagttcagagagcaacatattcctcttcccttatctaaatcttcagttacccaagatgagcctaattctaggttcctaacttgggattgatgtttaaaaaatttagttctggagttttctttttctgttcataaaatgttttattttactagaatttataaataattaatgtctattaataggcatgtaggaataactcattttttgttgttattgaatatctctccgtagcagagaccattttaaaataatttctgagtttaattctagttcagtttgagactgaggcaggccatttcaagggtgtaaaaccagtctgagacactccttggccttcctgaggctggatgggcttgtttgtaagagatgttaggtttccatcactctgagtaaactatcacaaggacagaaaaccaaacaccgcatgttctcactcataggtggaaattgaacaatgagaacacttggacacagggtggggaacatcatacactggggcctgtcatggggtgagggatgggggagggatagcactgggagaaatacctaatgtaaatgccgagttgatgggtgcagcgggccagcatggcacatgtatacctatgtaacgagaccacacattgtgcacatgtaccctagaacttaaagtataataaaaaataaataaataaaggagctcattgaacttcaaaaaattttttaaaaaaggagctcattgaacttcaaaaaaaaaaaaaagatgttagttttcagtcacaggattgtctcctgcctctgtaggttagcacacacaagcacacactcatgcaaacacatgcaggcacacacatccatgcactcatccacatgcacacacatacacacacacacacacactttctctaatggggaacaagattaggatttgggagagggataatgagttaatcagacctaaaagaacacacaaaaagtggttaattagactcagggttaaatgccatcaaatacagaaacaggcgtggttttaaaatgaccatcatacttctcagacagtttttcacatcacagaaactggcttcccagccaccacaattctaggctaactctgacccacataagaatttctcagctctggggtgcagagagcaagggctcctgcttgtttgtgcatttctccagatggcttctcactgccacgtatctcatggagcttatctactccaaacagataaaggttgcatcgccctcatggtccaagttatctagacctttgtggagaagcccaccctggtttcctaaaccacaagctgctgcctctcaaaattcatggctatcatacttttgataagtatatcattcctctttcacatattttcaacttccccccgccctcttttcttttcttgcccagcaagcacacatctggccacaggcctcacatgtggtagggttgggctgggaggttcccagtgattccctcagccctgcccctaatgatttggttacctttgataccagccataactcactctaattgcaggtttttctcagagcagtttgtcttcctctagttccacctgcaaaagatggatgccaggtggctgtcagctttaataagggctttggaccactgtgttctcctaggccgcagataatctcagggacaatatcctaggtcagggattgtttttgtaattatgcattgatattggtatttctggacctgtagttatatactaatcaggcttatggtagttaaaaagtaaagataagttgaacttttaaaacatttaagacagcattcagcatcaatagatgtaatacatctcatatctcagcctgtttctagctactgaatgttctttaatgtggccagaaccccagagcccaggcaaagcttgtgaatttcatagacaaaacaaatagactgaattgtgttccaaagtatatgagtttgtagcccccactcacctgttcctcactatttgtgtctcgggatttgagagctatttagtggctgaggccagaaattgaaatttgccctaatggtgtgttagcttgttctttcattcattcctcaagcatttatgatgcacccactatgtaccaggcaccagggatccagaggtgaattcccttgttcctaggactgggtgagtgacactgggccagtttcttctactccagtgtcatcacaaatagaattttaactaacgattgtatttgttgtgtttttcaggatagctgggttgcacttttatcttttaaaatctacatcatccaaggttgagcatagcataacctaggaaactaccagtctttgactcatagtaaatgtcaccagaaacctacttgtactaaaccaaatgccatgctagtgcaaatggtcaaaggcaaacataaccacagaacacactatggcattcctgtgatcagagtttctcaaagtggggcatgtgggcatccagctcacttgaggtgcatgttaaaaaatgcacatttctgggtcccccaacagacattgatctggaatcttccattagaaccctagaatctgcctctcaccaagctccccgacgtggatttgagaatcactgttctaaatccagcatctagtatttagcccttcgaagcatgctgtgttttctgcgggaatgtggcacggaagtattgggtagctgtgggacctggggccagttatgtggttcactttatttgctgctagtcagtcaggccacctagcctaggggccagccacctcaatccatttcttttcccaggcccaacagccttgttttacaagacacatggttatctgcagtagttgtccagggtgacctaaacttgaccactcggggatggttgttctcagcagaagttgccaactttttgtcccttttcaaagttcttttcccactggcttgtctttttttttccttattccttgaatgcttgggatgatgtttacttgtactttttttcacgtgcaaaggttaaggagtgttttaagaagattgaggtttctgagggaaatgttggctaatttcaaatggtctttgatttcaaaagtcaatgaaaacattcccttgatccttggtttgaaggactggaaattgggccatctctctggtttgaaactcaagtggaagggagtgagaaaaaaataaaacaggtctaaatattatcaaaaatgcttctttatacctttagctgaacagaagatttgagagcctgggcaaaacgcaatggtgtgggggatcttgttatttgtgaatggaggaactgtccctgctcgtataggagggtgagccatgcagctggcattgtgtcccttggagggagggagctgctgtctccggcaattatgaagccaccacttaggacagagtcccaagaaagatgtgctttcttctccaccagaaagcacatctgttcaccgctctgatcactgggggtctgcccagcagctgtgacagccagcacctgctgaactaccagttgccaagctgccaacttcaaagatgctgtcttagtcagtttaggccaccttaacaaaatactaccatggacccggtggcttaaacaacagaaatttatttctcacggttctggaggctagaagttccaggtactaatatgatcaggttatagtggggtccctcttcctggattatagatggctgccttctcactgtgacctcacattggcagagagtgcaagctctggcctcttcattccctgataagtttaccaatgccatcacgggggctccaccctcatgtcctcatgtaaacctaattacctcccaaaggccccacctccacatgccatcacattgagggtttggacttcaacgtatggattttgagggaacacaaatattgagtccatgacagccttcgtgacctctctgagcctaggcggaccaggcagaacagcaacagctaacgccctggggtcgtaggctaaggaattagaaatattctcctgaaaggaaccactggtgctggagacttttgcagattcctagaactcatggaatactcaatttataagccctggtcttgtacattcactcagtgctaggccagagaaacccccaagtcaaaccaagttctgagtgtccttagacagcagtgtgcactctgaaccaggcatcaggcacagtcagaatgagagctagatgggccttttatctcacttccgcccttctgatgctctcctgggggttggggtgggggagggggaggaggggcagaagcaaagaggaggattgggggcaagtacaagtggggggtttgagtgaaaatgtgagccagtaaccagtaccacctgattaggcctaacatagatcattttgagtattactgcatccaggattgattgtcttattaccatagattatgtctgtttatctcctctgatttggagttagcatatttaggaggctccggatcattcctgcaaagcactcactaacacgaggcagcatgcacaatagcaggaggaaattcaggattagaactggttaaactatctacattcatatccatatctgtatctatatctctcccagtgccttgtcagtctcctctgctctggaagaattctgatatgacatagaaactgctagatgctggcaaataactcctgggtttcgggccatctagacaataaacaactccataatattcaatgcagcagcctctgtagcgcccatctgtttcaaaataaccctaattctgcttacgatgcggaatgctttgttgactggaatttgtcctagttttcttcagcagatttaatgtcataggcctctggttccacctgctggcagatataaataccagaatgaaactcgggtggatatgttcagttgcaagaaaaatccgagctgtagctcaatggttctcaaaggctgatgtacatcggagtcacccgggagctcattaaaactacagcggcctgggctctgtgggaagcccacccaatcagcaactatttcttaaacagccctcctggtgattcacacacccacaccaacgttagcagaccccacttcacctggaatgaggggtgcagaacccagcaaggttagggatgattccagaccactatatcctactcatgcccaagagtgacaaagccaccttgagatgcccactcctacctcttccagtttatccaggtaactcttagtggcaaaggccaaagctttattcccttggaactcattttaaaaagaaaaagttcaaagtggagaaaactgatgaaagcactacttatctaagtggtcaaggttaatgtcaccagtgataagtcatgttgacagcacgttgatatgtgatgagggcatttcacctctatggtattcttcaccaaaacccataaccccagtctaaccatgaggacaaatagcagacaaaccagaccgaatgaaattcttcacgatatctgtctgctaccactcaagactgtcaaggtcatgggggtcaagaaaggactcagaaagagccacagaccaaaagagactaaggagacttggtaacaaaatgtactgtggtctccaggattggaccccgaacagaaaaaggaaattagtgaaaaaaactggtgagatctaaatgtctggaatttagttcagaggaatgtatcaatgttggtttcttagtttcgacaaatgtactgtaagatgttaacatttagggaatagacttgtctgcagtatctttgcaacttttacgtaaatttaaaattattccaaaataaaaagtttattaaaaaaatttacaagaaaaaaataaccccatcaaaaagcaggtaaaggatatgaacagatgcttctcaaaagaagacatttatgtggccaagaagcatatgaaaaaaagctcatcatcactggtcattagagaaatgcaaatcaaaaccacaatgagataccatctcatgccagttagaatagcgatcactaaaaagtcaggaaacaacagatgctggagaggatgtggaaaatgggaatgcttgtacactgttggtgggagtgtaaattagttcaaccattgtggaagatagtgtggcgattcctcaaggatctagaactggaaataccatttgactcagcaatccattactgggtatatacccaaaggactataaatcattctgctataaagacacatgcacgtgtgtgcttattgtagcactattcataatagcagacttggggccaacccaaatgcccatcagtgatcgactggataaagaaaatgtggcacatgtacaccatggaatactatgcagccataaaaaagaatgagttcatgtcctttgcagggacatggatgaagctggaaaccatcattctcagcacagtaacacaggaacagaaaaccaaacaccgcatgttctcgctcataagtgggagttgaacaatgagaacacatggacacagagaggggaacatcacagaccagggcctgttgggggctgggggcaaggggaggcatagcattaggacaaatacccaatgcatctggggcttataacgagatgacaggttgatgggtgcagcaaaccaccatggcacacatatacctatgtaacaaacctgcatgttctgcacacgtatcccagaacttaaagtataaaaaaaaaaaattgggatgggaggacggcactgaagagagacaaaatgtgttggaggacattgccaaggagcatagcatggctgcttctgtgcccagctgccaaaagtcatgagcagctagctggtaggacaggcaacagtctccagagaagctgctcaggcagctggccaatgaggcaggttgctggtgtgacacatttgcactctcccatctctccaccacctgacgcctgtgtctcactgggaacaaaacaatcatggacactcgaacctctgtgtgggagtcagaggtccaggcccccctctgggtacagatgaggggcctgaggcccagggagggaagtgacctgtgccagatcgtggtggaccccagatatgaacccacatctggttgaagtgaattcatttgccacagcatttctcagtgacttgatatattatctgcaacagagtcatctgggtgctcgttaaaatgaagttcctgggctccaaccaccacttactgcatcagaatctgtggtgagggggtggaggggatccaataatctgcattttgaacaggttcttcatttctgtgcacacttcagattaaggaccactgcagcaaactgggcaatggttgctgtttgatggaaacttctgtgcatagggccagggctgctaaaaagctgagaatgggagaatccagctgccaccattctcttaggatgaaagtcatagcaggtggcaagcagcagggccaggacccagtgtgtttcaggaggaggcaatattttattctattttgagctcagtgtattatcatttaaacactcttgccctcactactcttttctttttaaaataatgtaattaaaacttacccaaagacagtctcaagatcaagaagcaagaggttgggagtaggactcatatcagggccctgaggaggccactgtaagtctcttcccctgtccttcccttccactgtgccccacctgaacatctgcaggaaaaccaggtcataaagagacaatggcaagtctcctggaccccaagataaaggtcagaacagacaaaggacccagatgcctgggaagcctgaagcaggccgcagtttggacctaaggaatcctttgaggctgcagggtccctgtagtggagttgagcaaagactcaggccttgcgaggtggatagcagctgcccgcactgtgccaggctggccctctctgcggactggtgtggaatctgcatcagaaacatcagaagaggccgggggctccagctgcccctccgagcagacacattggccctggagcttctgagaggaaggtaggattttaatattccgaagggttttcatactttttctatcattttacagacctcatatacatagatatagatatattaagagatagaacgagcatagagaattattcctgtaagaagttacaaactgttctctattttagaaaatacttgagagttaactaccaaggctgacttttgcagctagacctatctattgccaaaccttactccttgtcaaaggagatcctaattctagatgcatccagttatccaaaataaagccttactatttgcagtgagccttatttaaggcagaagatgcattgtttctgctgtcttttaaacagaccctgtctccaagtcgtaattgaggcaataatacattctggaggtttacacatgctgatgtaggggctgaggaagacaactggaacatctcatgtctgaaggagaataggcggggatctaggtttgagttcctgactcagccactgaccagctatttggctttgccaagttgcttaaaatctttaagcctcaattcctcacctgtaaaatagacaaagaaattctacttggagggataagtaggatagaaaccacttataacaatgtggataaatctcacaagcataatgtaaattgaagccactcacaaggcatacatattgtatggatccacttatggacaaaaataggggaaaaatctatagttagaaatcaggatcatgggtactgttgggtaacggggtatagtaactggaagggggcttgtggtggcttataagtgcaggaaatattgtggtattttcagaaatatcctcatatcttgatctggatattggtctcacatgtccagtttgtgaaaatgaatcaagttatacacttcaaggtgtaggggtaggggagcagtaaacagagtgagcatgtagcaattgtcccacaaatattctttgtctctttgacttttctttctttttttgggaggtgggggaattctagaagtctgaccatatcttgtctatattgcaggaaacactgacctgacatagtggacctgatgttatagcttactcgattgttaactggattatggcctgttgattttaagtcatttttgttcattaagggtctccaaaattaaccaactggaggggagagaaaagtacaacaggtaaagtggtaaactaggggctgagttgatctctatttcacaatgcagggtgctgaccactgtaaatcacagagatctccatttcaaggcttcttgttttgagattccagatattatttcagcattagggaatctccactgttgcagtcttgattgattgaaggatagaaatgcgaatgttttctctctaaagtcacatctaaatattacctttctcgtaaaccaaaactgaaatttccatttgtatgaaagttataccattttaagttaatttcacactatttataaagagagaatattataattagtgactcaaaaagtaaagtgtggttactgtctttaagcatctccccttttcatgtcttgctaaattgttagacctggggtcccttcaggcctttttggtctttgacggtaaatgacttaacaaccatcctttcaggggaggcattttgggagctttgcagttcatggaatgctaataaagtaacattcttgaaagagagaacatgggtcgcatgctgctgccctcatctgacaatagaaatcccagagaacactggtgatttatttagaggtttcctggtttagaaaaaaagtgattgcctctttagctccctaatttaagggagagatactatgctatcctgcgactccagtataacttcactgcatggcatagtgcgttcatcagatcatgggcaggatctatgaatagcagcaaatcaaacatctctatttacatggatggcgaacggtagggaaaatggccatcaactcatggtgttccttttagcaattcttatctggacaaaattgcttctcttcccttagatgtaaaatgcagaggctactgcattttacataagggtagaggactgaacagtttttcatcaagaaccacaaatcaataaattttatgatcttactactggtgctgtaattgaggtaaatcatcttaacacgggaagtattcctgaggttctttgaagcatgctcactgcttctttgagtaaaattgagggctgacctccattgacaaaaacacagaggcaaggctcataaatactcatattctctaccaagttctttggagcagggccgtttcacccaggcctgtaaatgtccaatgtatgatttaagcagagaaaagaagatcttggctggacactccagctctgtcagtcacccagaggctccttcatgtgacaaaagcgtgctgcttaatgaaagtcattaattacctttttatatctatttctcagaagacagatatttagtaactagcaactcaacactttgtacaaaacactgccaaagggtttgcaaacagaattgagctctgtattttaagaagtcactggttttgtcattttatatatctcttttttgagacagagtctcactctgttgccaggctgaagtgcagtggcaagatctgggctcactgcaatctctgcttcctgggttcaagccattcacctgcctcagcctcccaagtagcacgggattacaggcccaagccaccacacccagctaatttttgtatttttagtagagtcggggtttcaccacgttggcccggatggtctcaatctcctgacctcgtgaaccgcccgcctcagcctcccaaagtgctgggattacaggcatgagccaccatgcccagcccattttgtatatctcttatacagagttaattaatgataggaaccaaatagacatttagcacatgattcttgatgatgttagagatgaacaatcataccatccaatgttcagcaggcatttactgtcatgtggcactcagctaatcattttatatgcattatctcttctaatccttcaacaacccaacaaaggagctactcagtattcccattttatagataaggaaactaagaccaagagcaagagggtagcctacttgctcaaggttgtgtagctaaaaagtggaggagttgggatttaatcacaggttgtcaaacttcagaatcatggaaaggaccctggaagtcccctttttcagtagcctcctctcacgtatgagtcaactggacactgctgaaatgaagcatcttgtgaagggtgtctccacgagtcccaggcagagctgggaaactatctcctaattccctactaatactttttcctttacactcatggggacacctcctaccaccccaaggaagcttgtccagattctttcctgtgtgctgaacaaatgtgagtacatatcagaaacacaaagataagacccttcgagaaagcctgcaaaggatgctggaggttaaggagagaggtagtagatcatatgacacaagtggaaactatagaaacaatttgacacatgaatgcaaaggtggggaagtagaagacagagtgtacctgagactgagtggacagccaggaagccttgtgccgagtgtggctccaacgcagagcacacacacagtagtcggtgtaggttaggggctgacatcaactttgtgattctcttcgaaataagtttttatgcttaaaaacattctcctcagatcaactcatattcaaaacagtgtagttttcagagttggaaacaaagcaattcggccattcttcagagagtaagatggcttttgtatcaataacactgagttggaaggatttaaaatacccttaagagctggcatgattacaaatcgggcattattgtggtttgggttgtattgttatacccaaggtcttcttggttctagaaagccgaaccatgctagtagccagtggaatttaaggagacccacgtgggaactttagagttacgtctttgatatcagcagagtcccacagaattgagaacttagactggaacttcttatttttctgttttcagatagcagtgagcttcccacatgtccatatccatgaagaaaagggacactgggtttgggcaggaagggcgggaatggtgagaggtgcaaccctgaacacttgcggtgtgagaaccgatggccacgtggggaagtgggaaaagactcagaaggttcgctgttcttcatgctagctcagtgacctcagatgtgtccctaacaccttctgagcctctgtttcctcttctgcaaaactgagatgattctattgggagtgaaagctaagtggagaagtgtaccttgaaagggctttataaagaagagtgtgatgattattcttctcatgacatgagttttctacttcagcatgtggcatttctttggttggctcagccctggttctcctcgaatgccctgcaaatgggtccaaggccgtgtgtgctggctgctccttttgagagctggacctcgggcatcttcctagtctgccccttctaattcctccaggcagttcccttcatggaaattattaatctgcgggctttttcttttgaagaaacgctaaagaaaacaccagaggactctgtgtttccctctgggagtctcagcagtctttcagcctccatgggtttctgccctgtggcctggagtcagggtgccacgtcgagcttgcttctgactctgccctcagctagttctaacagagttcccaggccatctggaatgaggtgtcaagtcctggcctgcactcacaagtgcaattaagaccagtctttttaaaaacaactgttaaaggcaaaggagaatttggatctcatcatataaaacagttttaagcaatcaactactggtgatttgattcatgaatatgtaatttcaaagcatttaccattttgaacaaagagagattcctttacaaatacatatggcaaaaacgttttttggggtgtttattttggggtgttctagtcaggaagggtaccaggggttggggaggtataattctcccatgctctcaacaggaaaggagaatcagttatggggaagcactgggatcttcatcagtagagaagcaaaaatataaaaaaggggttggctttgactgcttttttgaatttctctttgacaacggaaacttcagctgtggattgaaaagacggactccgtttcccactgctttctctaacatcttttcactatggttttaacagttgccatgtcagcttatgcatagatggacacatctttgaaaaggtgccactcttgggcaatgagcaagagggatccactgtttacttgctttccctcctggcttaactgtgctttgcccaccctcccttcccagccaggctagtgctgccagaacatttgggttctgcaaatgggtccaaggccatgtgtgctggctgctgcttttgagagctggactgcgggcaccttcccagtctgcctcttctaattcctccatgcagttcccttcatgggcaatgagttgtgtcagaacctcactgggcagcattggaagtcataagcaggtgctgttgagtcaagtccatatatttattgaacagctactgtgtgttcagaactgtcccagatgctggggagagggagataggtcagggggtcccctaccattttagagcttatgatcctggtaggagagaacagagtggtgcagaaatgcctacacatctggcaggatgtggtgatgattgaatgaagacaaacaaacggaaggtgccgaaagctgaagagtttgaattgggaagagttcttccattggttctatcggggttgacctagcattacaagagtgagtaagacttctggttgatgtaggtgatgggagagagcctttcagtgcaaattaccaaggttagcagagctatagtagtgaaaaggtacagcctttttggtccccatgcttagaagtaaacctctacttacccgtatctatcagtgatgtgtcttcctggtttcctcatggggaatattgaagctctttcattacctttaggttgctggttccttgagatcaaggactatgtatttttctccctttattactactcatgatgcctgggagaatgctttcttatgtagtgattgaaattcttgtatcattacaaactgtgtttttggtaagtttgcatccctaagaaactcttttcagtaacgatttccacagtccttcatatgatcttgaaatatgatgcctacatctttgtttacctgcccagatattgatcagtatggtaactctgctccagtggttgcttgtgtgtttcaatcacgcatgattcttattggccacattggggcaggaggcggcacattagagggaagaaaaggagcacccaaaggctgatcagaagaagccaaaccagcctagttggtggggaagttagtaaaggtggcaacaagttatatatgggcataaaaaaaaaaagacaataagcccttgagatactgtgtaagcctaaatgatgcaaattatggagcacgatggaaggaaaaatacaagtgggaagattatcaagaagcctcaaaatgagtcaaatcagattcatggctgaaccactctaaaaatatttacttgacgttgaaatttagtactgacagctgaagttgaaaaatctttgttatatttctgttttgtgttaaaatgaagatgacacccaagctatcactttgttcccttggaatcctagggtacacatgccttgtcacgtcagaatgattgatttttcctttggctttctcactacaggaaataccagaaatagcccaccaccctacgggtttcatctctcaccagaagaaatgaggagacagcggcttcacagattcgatagccagtgaggtggcatcttgggaagacatggcctattcgtgtaattattgcccatttggctcattccccaagcccctaattcattttaattcattttaaacaaaagcagagtacaccggtattgctccagatcgctcacatcacctgggacagtcccatggcccctatgagtcaactcacagcttgcggggagtgggccttctcctggccttgttcttgctcataaacaggtcacttcctccatgaagagaccagtttccacgctcccatctctcactgctgactcagcgatgcctctgcctcggtctgcttttgaagactgtgaccttcaccaggaggttttacttacaccagtcgggaagattagtccctcattctgcctggagtgccccgtgtttgacttggcagcgggtgtggagccatccccgcgtcctcctggcgcattgccactgtggctgtccaggaacaggatgtggctgccttggccgaatgttgtcctactctccccaaccccggcgcctcagctcctcagctcctcgggcccctgcgtctggctggtgtttgcagggctttcgctctgctctggtattgctctgcctttatagaaagtcttattgaagaagtgtaagaaagacctaaggtggggaagactcctacacacaccattagtatcagtgacaccagcaatgtaggttcccagccccttcccagtggcagcttgtgtgtccaggagataggacatcatttaacgcatcagcaaagtagcagcagatgccacatacagagtagagcgaaggcatttggtggatcggtcactagagatctatcttgcagaaagtatgtttttcctcataaaagtgcctcttaattggccattgtaccagccacttgtcctagccaaatgtccaaaacacgcccttgggccccgccacgttacaatccacagattgtctgtctgagtcgtttaaggcatttcctggtgcttgtgttccatgaataaaaggacaaagtcagaagatcactgatgtcttactgtcaacagagatattttaaaagagagaagcaggaaaagatcttccttttttgatctacaacttatatagttttctgattatgcacataatagatatgccttccagatgcataaggcaaacatctggaaagaaatatacccaaatcttagcaggggttatctttgggagtggagtacatgggattttgctttcttcatttttataattttatattactgtcttggaagatgtgtttatgtgtgtgtgttacttttacaatcaggaaaacatatttaataacatatagtcaagaaaacagacttaaaaataaatactatgtgtccattgagaaaattcacaatataaacagaaatacaaataaatacatacacaattttaaagtcacctgtagccctacccttagaggtacccagggttaacattttggtggtattgtcttatcaatttttccgttgatacattcagcaaatttggagcacattgaccatggagttttgtgtccaaatccaatctgaatttacctggaagaggccttgacacctgcatggaaatgagctaagaaaaccactggagccttgggagctctttggcctcctggctggcccagtaatatctgagctcctttggttaatttataactgatataaaactacatcttctttataatataaattgtacctgtgagtctagaagctttaaatgtgtttaaattaaaatattcaagctaaatgttactgctctctcccaaattctgtaagtttgactcccgttaccccaattagaagtaacttctttgtttcatgccacttttatagcatttggtaattctgctataacacatcttgcccctattattaactgtgcacagctacacaaaggtgtgccttctacgtgggaacatggattgtgaatgactctgtaatgaggcctgagtcttagttatctttccactcactccccgtctcccctttccaaccccaaaggctcacgataggggctcactaaatgtcagtgtttcaccaaagtattttttccattgtattaagagtccagtcactgtatatggaagtattttattttttatttttttatatcacttgagtccactagtagtacttccttgctctgtttgacttgtcagatacaaagacacgggattagattttgggtggtaaaattgtgatacgcatggctgttgatggagtggaacatcttagtgatgtgagaaaggtcattttagttataaatgtaaaccaattactttagcacaacaataaagatgttctggaaattattataattattttagttaatggacttgcctgtaacaagtgcttatgtttggaatgtccattttattttattttcctctacaataaggaatccctaaagttatgccaacaaactggaattggattgagaaagacaaaagcaagtgagcaagtgtattagactaattatctctagtagggaataagcacttagagctaattttttaatttggtttatttattagtagctccctgattgtctgttaagcccctggttcccacagtttggtgtggtcagtcaacttaagcgaccttttaatgcagaatctttacttggttctgaagaggaggcagtagttaaaattgcttcctcttaatgactctgaatgtattgcctgtgattccaaagttgtacataattgttcagacctcctccatccttttaaattgcctgctgcagtaaataactagtttgagtagaactagatcctgtctatctatttggcacatgttctgctgcctggggagtaagcaagctaaagggatgagaaagaccacctccccctaccctggaaattgcactgcaaggcagggcgagaatggggtagctggcagacctggcctccttgttcccagtcttagtttttcttgagagattcagtattcagtaaagaatagcattcaattagtcaaaaaatatatatataacttcttcctttcccttcccatgaatcattgcagtcattccctaagtttcttctctttttttttcatggctgctagtattttattttagaatcacagactctcagcttagagagtcacagtatctcaattatttgctctgttcaatacttaacaatacctcctcactcaattctacataactccagcttagtcttccaaaattcactttcatgatgccactcagcatctcaaatacctttcattggctctctgctgccaaaggataaaggtcaaagtcattagcctcaacagtgggcttcaaccagcctttggacctcagccccatttatccatcacagaggctggtaactagtctcactgctcaggctgtgagtgttcctgatcttgtgacattctgtgctgtgcttttacatggaacagctctttcctctctcttggcccattcagatcctcctcatccagcccccatctgaatcctgtaacagacacaaccacatctacacagtttccacataccacttggaattgctggttatgctgcaatgagagaatgtctttgtctttaaattgtaagcttcatgagggcagggaccatctgtttctctgtctctcctcacagtgccttgagcagtacgttgtctggaatgtcagaaccaataaatacttgtggattgaaacaaaaagagaagctcatttatactgtcaccagtggcgcacataaacactagtgcctggtgcttattgatatcattgtaggtcttttttttttcccttgaatcaatcacatcaaggaaagaatgatggaaagcatttgctggtagaaatagagacttcagggcctttgtcagcctgaagacatgtcccactgcatcgaatgctgtgacctggtacacaaagctcaagattcccacacgaccaagaagtgtcaccaaggagtccctgtgagtagtaccgaatcttgccatgtgctttttacaggtctgcgttggatgtgtttgtgctaacattttttccttctgtggtatttaggggcagagagagaatgatcttaacatctcgatcagatgatagatgaattggcagatttagatatgtgatttatactttagaaaaactaaaatgttgctaatataatagaaatcattaaatttggtcataataggtattgctgcttgggaagagagtagtgtcataaaatcaatggcatcatgtggcttaaagagactcttggaatctgggacacacacaagcaaaaccctagaaacaacacttctgctgtgtggctctctggatgcgaaactggatcccttctctaagtattttgaaaaacactgctcagccacctccagtgagggtttctgccaggaagttgtgaaattactgtgtctttctctcactatttcccccttagataacttgtttagtgcctggatgaaaattctaaaaacaaaaatcaaacgaaagtttgtaacttaagagattcatgatatttatttgagattctttcaagttattgcctgcctctgaccttgagatactatctctttacaagatcctctccctcaacaatttaaatctatcttgcatatccttagtagcagataattattaatggaattgaacaaggtcttcagactctcgttatagaggagcaccaaggccaacctctctgctcttcagggtgtgcacccagggcccacagcacctggaagcttctacagattcagactcctgctccccagaccaaatgatcagaatctacattttaacaggtcccctgtggtttataggcaccaaagtacttctcaaatttcagtgcgcacaagtgcattttacaccatttattgcatgtaaagcagactgactgcttggggaccagaagaacatcttactcctcattatacaattttccctacttttatcaaacataaaaatgattacaggttgagaatttcatctgtggctgataaaattataaccactaagtatataatcactgaggatgcaagctaccccctagagataatgtatgaaggaattgccttgctggcaaatgggagaacaaaaatgactaagttggctggtgctgcagtgactgagcatcaagtaagggccttcagatcctcctttctccagctcagagcagttgccctaaatgactgaccttgggtttctaggggctccagaggtaatatggtttggctgtgtccccacccaaatctcatcttgaattcccacgtgtcatgggaggggactcggtgggaggtctcatggaatcatgggggaacgtctttcccatgctgttcttgtgatagtgaatatgtctcacgagatctgatggttttgaaaaggggagcttccctgcacaagctctcttctcttgtcagccaccatgtgagacgtgcctttcaccttcgccatgattgtgaggcctccccaggcacgtggaattgtaagtccaataaacctctttcttttgtaaattgcccagtctcaggtatgaaaatttatcagcagcatgaaaatggactaatacaggagacacggctggttttcatttcttttcttttttcttttttttttttgagacagagtctcgctctgttgcccaggctggagtgcagtggtacgatcttagctcactgcaaactccacctcccaggttgatgccattctcctgcctcagcctcccaagtagctgggactacaggtgcccaccacctggcccagctaattttttgtatttttagtagagatggggtttcacatgttagccaggatggtcttgatctcctgacctcatgatccgcccaccttggacatggctggttttcagttgaccctgagataaaggcctgtgggattcccccaaaatagctctgtcctcatgggttcctcaccccctccctccagaacagcttgagacagtctccaagctgagctggatgggctaccttagaacccgtaaaacaaggggctttgcagtgacaggagcaatccaggacacctctatgtgagaccctctattttctaaccaattcacgaatggggaaagccgctgggaggtaatggagtaaaggataaaagtattatctttagaacagacagacgagggtttggattctactagatggtgactgtatgaccttaaagtagttattctctctaaagctcagtttccttgtctgcaaaataggacagctgtagggttgagaggaagcatatatagcagagccaatactgctgctgtgacatagtagacggtcagggaatgtttgttagttgagtacccttatttctctatcaggtaaaaggttggcccaaataccaatgaagttccttcctacttaaaagtaagtccaaggctgggtgcagtggctcatgcctgtaatcccaatgctttggaaggctgaggcaggaggatgatttgaagccaagagtttaagacgagcctgggcagcagagcaggaccctgcttctataaaaattaaaaattaaccaggcacagtagcacatgcttgtagcccacctactggggagggtgaggcaggaggatcattcgagcctgcgagttcaaggctccagtgagccatgattgtaccactgaactccagcctgggcaacaggcaagaccctgtctcaaaaaaaaaaaaaaaaaaaaaaaggccacaaagcagttattgaatatctgcactccacctacccccatgttgtttggctataaagagaaatgtaatcaatacctaactaactcctgacttcaagtcacagtggttaaaagtaacaatatctttggtttcataaatctctttgtagttaactttcacaccttgaatcctcccaacaatgctgtgaagcaaatggtcttattctcactcaactaatgagacagctgaggccaagagggtgtaagccccatgcccactgaccactgcccaagcagctcccgtggggttgatacagaccttccccctgaggcctgctttcatttctcttctgcgcgccatcactgtgcatagaacagtgtttccaagagcctctgaatctcatcctttccagcctacactcttcccttctgcagttcacacttccacaagtgtgagccacattacaatgtaagctagaagaaaaaagtaaacccgcattggcttgaaagaaaataaatgcaccagataaaacacagttgtttttggaagtcatcacagaattttatatataatgaaccatattataaatcgtaatacaacaaatatttaagtgccaatggcagaccaggcatcttgcaaaagttacatgctgaaagtctttaactttacaaccagaggttagagaaagggatgcaatttattagacacatttcacatttttcccatgaatcattaaatatttaagcaccataaaattcaagcatttcacatggatgtggcagccagccttggtggtttaaaatgcattatgcagagtttctagcagatgataacagtgacaattgcagagtactgatttttaatgtcaattgtttgttccctgcagaacttactgataatgtccctgcaggaaattgtgatattttctgtgctacagtaactttgaggattgaaatgaaacagcattcccaatgacattaagaattggccacatataaataattctaatcagtaatttatataccctgtgagaatcataattctgtgtaaaaaaaaagaaatatttttcgtattagtttattttaaatacaaaatgtgaccatagtaagtgtatgatgatgggtatgctagacaggtaatctaacttaattttcaatgcaagagtagctgttatgtcccaccgtattaatgagggaaatgaagctaagaaagttggcaaaactcacccaggataacagctgaaaaatgactaagccagatttcaaacctgggttcgaccaactctcaagtcctcttctttccactattcttgcagccataccaagtaaaagtaacaattatcagattattccagtgagctgatagaaacacagatctaatataatttcctggaacacactgaatggtttgctttactgtaatctacacgaggttcaaaataagatgataaagcccaattgtagtgcaccattccattgactatttttcggagcaccaataacatgtacacaaacgtttagcaaagattttatgctaggaagctcttaaatcctgagggaatacagattacagcataaggtaagtcatgtcacattttactgaagggtcttctcagtcggatctctcaaatctcatttctgaaatttctgtttatagaaaaaacaaaaatctatttttggaggggtgtgataagcccattttgaaagcttatcaattggctttctggcaataattgtaacaagagaatgtgggtatacaaatatgttgaatattaaaatattctgaaataggaaatggtttatacttgtaaccgtcttgctgatgaagaccttatatgcagagctgaacacctaatgcctaatgatgtttatggaattgtcattgaaaaaaatgaattggcagtaatgtgttcaactctgtgctaggcattaggcatacaaaaacgagtcaagcatggtccctgccctcaaggggcttgcattttggcaatggaatgaaggaagtgcactgagacattaaagaagcaatggggaacggagaaaatgaggacagccccgtgcactgcacaagagcagcagaagggagcctaagtttcccccagggaattcacctcccacgcagggtaaactgaccccagggaggacatcactggtgaagcaggagcaaagtcgaagaggtgctgggagtgtctgcagagctgcacacagttcatcatgacaggaaatactcctagagggaaccctcgaacagtccccactggacctttcaccccataggaagtcatttggacttcatgggcagcggagtcacagaaggattctaatccagagggtgacaaaatcaagtttgggtggatcttagatggcaactgggatttgaaactaaggcaccaactgggagatgcctactgcaagggtggaggtggaaaacaaaggctgtgtgagacgggcacggggctaaagaggaggtagccatccaaagcagcgatgactcagctttcaatgtggggagtgtgagagcagaacgaaagggccactcatagcatggaaacctgcctggatgaatgggctccactcactgagaatcagaacccagaaggaagcatcccagatttccagcacgggcacagaacagaacagttcccattagggcaatctaggcacgttccagtctacaaggttggtggggaggcagggagagaagggtttgataaggatcatctccaataatgggttaggagaacaacttaaaagctttgttcatcacctccacagagaaagggtaattgaaggcacattgatatataaccaggtgaagaaaataatggtttaaggtaacaggatcttctattccaagaagttatttttccgcccttttgatcctttaaaatacttttgtaaaattagagggcagtgttaatgctgcatttagagacagctcttgtaatactaacattttgaacagtctgataccttcccaagctcactgtggagtaaactgtctacataatttagcctgtctttgtgtgggttttttttttttacttatttattaacttatgaagataatattctaataccaacattaaagtgtttaaaataattagcaagcaagatacgtttctgatgttccatttgtcacccttacctcttcccagaaaatgttctcaggccaagttcaagatgaacaggttgaacttttaggagggttgacttttggtaatagataaagctttttgggaaggagaaaggtaatcacaaataagattgaaattggcttaagttttaggtgcacaaaaatattcaacatgccagagcatggtttaaaaaatatcaaatgggtcaaatgaactaggaaatattctgctacatcaagaaaatatttcatcttaaaatacacatttttctttttaccagaaaatactcttaaaataaattgccaccctgggggcagcccatagcaaaactcatttgaaatgtgttctgcatataagagctcattacaaatcaaggtttggcaaggaaaacatttcttataaacaaaattttaattgagtttttcttctcaattatttttaagtgcacggaaacaaagcactaaaatgagtgtcacgctcatgagaaatttctttagttttctctaaaatgcctttttcttttagatgaggaaggtgagtttcctaaaaattttttccaacaaatcttttaaatttaggattagatcaccaaattcctagcaaaacagaaaaagggatcttttgctttacagaaaaaaataatcattataaattgacacacattctaaacttttttagaaaatactaatgccaaatgtcaaactgttgccttggtacaagactgatatgaaatataagaatgtctttaaaattggcaaaatgggatgctcctgtaacagccaaccacgggagcataaaattcaaattataaattgtctttgtttcgtttaaagatagtgccatgtcctcctgatggggtaaccctgacttaaatgaatcttcttacctaagtttaattaaatcggcccttaattttctcccaagtgcataatgatagctctgtcacgtccctgtgtgagctgccattatgtgtgtggagcaaagtgtccgttgtgagtgcaagaagctgtgcaggctctcctggggaggggagtgagatgctttgtatgaagcgcgtgcctgcctgagtgagccccatgtagcgtcagtcccattagcacgcacgcacctgtgacacgccggaccccgactggggaaaagcagtctgtctggaagttcactgcaatggggagtcaatttttgtgaataactaccttaatattcactaatagcttttaggctcctaatctcttattgaatattttttttccataattgctacttttcaaaagggttgccaaagtaggcatttctattctctgaaaaatgcagaagagaacataatgttttatattcatctgtgatgtgtttatgctaatgtcgcatctctggaatacggcgactgtgggccttcctgccatcatgattcattctcctttgaaaggaactgttaacgctggcagtgtgaatttttttttttcttctttaaaaaaaaatctctctttgcgtcatggttttaccattatttaaagtatatggaaaaatagattacagaggaaatcattttgaaatgttgaaaatctctgctttctagtttcattcattgacctgtttattttttcctataaaatccatccagaagcccactgtattatagagtaattgacttcaattgtttgagatactgttaacccaagaatgaagttttcagtaatgtaatttgtaatctggcctttatcatctacttgcctttctgagaattagcatatttttaagtaaagccagttcttcgatcatcctcagtaaaataagagtatctaggctccctagattgggaggtccaaacaaatccatctgtgcagcatttgcttaatgtgtaaggaaccagaggactctgggaataaccacgacaaaacagaaggaaccactgaaagggagtccaaaatgagcaccatgacatctcttagcacagtctaggaagtcttagccccctaggaagtttctcttggccacgtgttggtgaatttcgcattctctagctatacttcacgcagacctggcaccggctgattttctggcgttgggcctggctttcttttaaggtgtctggtgctggagcagaggaaaactgcaagtctgctttcaccgttgtgagccagaagctatacttatttgcgaaaaagtggcaagttccctgccggccctggcattcaaggaatggtgctgctctgaaatcttccaggcagctgccaggtgacataagggcctgccctcctccttggtccccagctcctgtgtgctacccagaaaacaagagagaattagggctcagacacacacagacaaccccagacccaatcagggacacacccaggtttgggtctgatcttaacatttttccttagattattccataaagaacaaaatacaagcgctgaaaaggagtcgtactcagcatggtaagtatgcacacaaattggctccagtttcaccgatggctgaagcaaactcatcttctaaattctaccaatgtgatcaaaatcaatcacaagtgtttttaaaagataatggccctgcatcccaacaggctatggtttgcaacagtccccgtaaccttatgtcctaagcgcagagtgctcagaattactgtccaatccagagagaaatggcgggagaaggtgttaggaaatggtgaatgagccagggttttcaagggcacgggactcaccatcaggaatgaatacccgatccagaggctcctccaggtctgcggacatggggggatggactggtcctggctgtgcaccgccaccgcctgggccggggcctcgcataccgcacagcggctgacataggggcggatcgcctcttcagagagtggcatcatggggaggggcgcagcgctggccagccagtaggatctgtcgtttctctgggcatagtggcacacctggtggatgttgcagtaggcaaagggcagcgtgctaaatacgggaaggcaagaccctgccagaccttgggaagggaagaagagacagctggtgtccaagcaccccatgtaggtgttcccagacccttccttcctccatctggcctttgcagatacgtgttctgaaatctggaggccctcgccaaagcctgcttctgtggtgaggaagccatttctgacacctccctggtcctgtgggccagccctcatcccctcatccctcactcgagccaagcagggggccaggtgctggaggtgggcaccaagcacatctctgtgttcaggaagctcatggcctagcagggaactggatgagcaaacaagcaatgaaaatacagcacaacaagccctaagaatgagaagtgtggggatccgggacctcaaggaaggataactggaatatgtgattttaagttaggacttgaaatatgaagaggatttagccaggcttggagatggtggtagtgactactcaaaagagatataccgtcagagggggttggagataagggatcgtggagctcagagaactcagacatgttcagtgcagggactatgaggagagggtgtctgcactgtctgtctcaggagtgtccagtgataaatcagaccattggatgtggcctttgtcaatctcgttaaggagtttggactttatcccaagagttctgcagagttttaagatgtgtgctctggttagaccaaggtgggagaagcaagacggatgatggtacaaagaccaggcaggaaagaaattgatggcagagggagagaaggagagaaggaaacagattcaggatattaaacatcacttcctcctttctcctgtgctcaaagaaactagccccttgtgatgggaaaggccatggccaaacccaagggagaaatgcaggggatgtacaagtagttgccagcccaggcttgcactctttgactaccctttttaacagctggggtcactgcctagtgagagcaatggcaagcacctcaccgtcaactgtccccgtcagcatatccttcctgcaccttccattctaaccatgattttcttggaaagacagtgtttcccggcagccaggtacttaagcctttgacttgaaatcagtcccgcagcttgcaaatctactattgaaaattggcaagggctgggcacggtggctcacacctgtaatcccagcactatgggaggccaaggcgggaagatcacctgaggtcagatattcgagacctacctggccgcaagaccccagctctactaaaaatacaaaaattatccaggcatggtggcacaagtctgtagtctcagctactcaggaggctgaggcaggagaatcgctcgaaccctggaggtggaggttgcagtgagccaaggttgtgccactgcactccagcctgggcaacagagcaagactccatctcaaaaaaaaaaaaagaggaaaagagaagagaagagaaaagagaagagaagagagaagagaagaggggaggggaggggaaggtaggggaggggaagagcggagagcggagaagtgacaaggagcaccaaaagatgaccctcaaaataaagttctgtaatttaaattggagtagggtagggagttgatgctggcaagtgccgtaacacaaccatcagcgtgctgtggctgcaccattttacatgtaagtacaggaactgaccacattctggttaatttacatttggaagcaaaaagtacatttcataacagagttacatttaacttactgaggaagaatcatttttataaaactaataatatacttattattagccagataataataatatacttattatagccagataataattatagccagaatgagcttctttgacacttcataggatcataagtttaaaggattagctgagaatgaccatgctagtgtttttgttttaaaagtaagaataatcccatataaggttagtgatcatttaaggtgctgatgaatcagtaaaattaaccccaaattttactcttcaggcaatggagatgggcgatcctgtatccataccaaggtcttgattgtgagctttctcttgcccttccaggtataacagactatacccagtccagagcctgggcatgcccagggggcaggtgggctcctggtccgtctgactgtggagaaccaggaggaagccaccgaggtatccagggccaaaccctttgggcccaggatccccaatgggaccaggaggccctggaggaacaaaggaaaaaaattgaaggcaggttagggggtttggtttaacaaatatgttaagcacctctgttctggcactgtgctaagcactcagggagcagaggggagcatgactcagcccctcctcgccttctggaacgtacacagctacacagctgcagtacatagaacaactcattcatcaagtatttgttccaagcaactcctagatgcctgggctacattagcataaagacaaaaaacagaggaaaatccctgccctcatagagcttgcattacacttgaggaagagagagaaataagaaacaataagcataacaaaaagttaagttatgaaatacgctgggaagaaaagaacaaggacagtgtaatgacacaccccaagtgtggactccccagactgaactgctgagcaagtgctccccaaagtcggtctttcttacacctcccagacctcttccctggttccagcatattatcagttccattctgagaaagccaaaggcttgggatccacatctacaagtttggctctcctcttcgagaagagagggaaatggaaggaaggccttgttctagcattcttgttggcagatgggaaatcaacagttctagagaacgtgagcagggtctgtatccttcggcacctctaaggggctgaactattgcagaaggccaggagctgtttctaattgccaagagcaaaaggtgaagttagacattgaaaccaaaaggtattttttgtgttctacccttggttctgcaagactggcaggctctccccatctacactgtcaaccagagacgacaaagtggtagcctgtggactgaatcaggcctgctcgtgtgttttgacctgtaaggattttacaagttgatattttgaacgaagagagtgtagagtgtaggcccacatttctgtagactataattggctggagctgcgctgcagcttttagccaaagctccattttgctacagacctcacccagccctcctcattcgtttctactcactactaacctggtacaggagtttgcatccctggccagggactctctggagatgggattgtgtctcaggctctttggatccatgcgcctaacgagctacatggtgcattgtttcacacttctattctgaagagtcctatgtcccctttcccaacaccacttcccattttttttcttttaagaaagagccctgttttctacatcagtgtactaatggctatatgataagatgaagtgaactcaggaaaccaggcgatttggccacttggagagggtgagaacacacacaccgtccctgaggtcttcatcacagcctcttaagggtgatcccacagccaccaggctgaccgtcccttcatgaccttgaaaagtgaactgcagaaatggccaagactttgatgatgatgtatagcagtttgggaaaatactgaataggatgcagggccttgtctaggttttatgatggtttaacatcagttagaacataagagatgcatcccactctgttctcattgtttctgtctctgatacctggtgagtcagcatctaaggcaaatgatctgaataggatccagtttggaaagccacttgagagatcagagattttgtatacaactctaaggtttacagtgtcagagaaaagaggagtgactgaaactctacctggtcctccagggtagccgtcttctcctgtgtcacctttacgtccgggaggcccaggagacccagggacgccatccacacccctcctgccatccagcccaggctctcctttgcaccctgcacaaaagtttatgatgctggtggtgaaagcaaccatgacacctgctagcatttaccgtgcttataccgtatgccagccgtgtgccagccccaggcttccttcccactttgactgaatgcatcagctcatttagtctttgcaatgacatgaagttgggattttactatctccacttgcagttggcgtaactggggccccgagaggtcaaataatttgcttaattaaagtcagtgatcccataaagggctaggccaggatttgaagccagaccagggaggtgttgagagacaggttttcacattttcttcatagtcttcatatatttgacttcaaaaaaaaaaaaaaaaactactgaacatgtatggcatttataataaatattttccttaataatgattgtttcaaagcctagatggagaaatgaatgaaacttaatcggtttcatttggggtcacgttaaatctggagcatgataggtgcagcaattttttaaaatagctttttactgagtgtttacaatgtgctaggtaccatgctaatccctttacgtggattgtccaattcagtcttctcagcagccatatgactaggtactcatacatgccagttataccagtgaagagactggggctcataaaagtcacagagcagtcacatgtggagaggaaacttaggcccaagggagccaagtgcagaggccatcaaccaccagaccctgcgcctgacaagctgcagagctctggatataacctgggggacttggcagcaattgcgttaatccttaaggggttctttaagtatgcagttacttttttgtcaaggcctcaaataattagccaccatctcccttcggtcaggggagcagacacaatcattgtctttgagggagtttattgctattatacctaatttcctgaattactagccttctccaggtttccagtctctacttgttttctattctctttctctctttctctctctgtctctctctctctgccacagagtagcctggtatgggctgatttgtgtacccccaaatttcatatgttgaagtcctagtccccgtatctcagaatgtgactgtatttggagataagacctttaaggaggtgattctgttaaaatgagcctcttaggctgggccctaatccaggctgactggcctccttatgcaaggagaaaatttggacacagaaacggaccccagggatgcatgtccctggaatggcacagaggagaggccacgtgaggacacaggaagatggtggcatccgcaagccacggagggaggccttgggagaaaccagccctgttgtggctccttgatcttggacttctgcatcccgaactgtgaaaaattgtctgttgtttaagccactgtgtcagtgatactttgttgtggcggcccgagcagaccaacacgtagcctaaaatcaaacattaaatcaaaggggcttgcttaagtggctttcactgttgcttcttgccttcaccctccagtgactgggggatgatgataaagctgaggatgccagtcaacccaggaattcatggagcctccctcccccaccctactgagggaccagccttgcctgataaccattaaatgagtgtgttaacacagacgctgaccgaaaccctctacccttaaagcagcaaccctgtcatgaaaaggatgcatggaggtttaaggaggtttgacttgatgttgcaagctagcaagaatcgaagatttcccacgcaggcccctccctgcccctctgcggccccaggtgaggccccgactgtgcgtccacaagtagtagagtagctaacttgcctagagcaaccctggactcaatcttcctcctccaacccacctgagcaacatcaataggaaacacagggctaaacagtgcaatgacacggtcctactgctcctgagaacagaaccccaatgacattctggaacactggctcacactttggtagaaatcagcatctgccttggtagggcggggtggggcatgagaatctgcatttctagaagtccccaggtgatgctgatgctgccagtcccaggaaccacacgttgagaaccagtgctctagatgatttaactttaaaactctttccggtgatgaccttggcggcatattttgaaaatcctatatttctgcctattcttaaaaccagaaattctactcagggaatttagtttaaagaaacaacaataatagcaaacacaagtactgtttattctgtgtcaggctgtgttctaagtgctttttatgttagtgaatccacataatcctcacaatcagcccttcttacagatcaggaaactgagtcatggcttatgtggtagagccagagttatgaacatatgtcatctacttccagaatctctgctcttttatttcttttgtgttttgtttgtttttccagatggagtctcgctgtatcaccctggctggagtggagtggcacaatctcggctcactgcagcctccacctcccagttcaagagattctcctgcctcctgcaagggctaaaggtactgcctcccgagtagctgggactacaggcacgggccaccatgcctggcttttttttttttttttttttttctgagatggagtctttctctgttggccatgctggagtgcaatggcatgacctcagctcactgcaacctccgcctctcaggttcaagtgattctcctgcctcagcctcctgagtagctgggactacaggtgcacgccaccaagcccagctaatttttttgtatttttagtagagacagggtttcaccatgttggccaggctggtctcaaactgctgacctcaggttatctgcctacctcagcctcccatagtgctgggattacaggtgtgagccaccacacccagcccttatttccagaacctctgttcttatccattacactatttcttcatgataatcagggatgcgtataagtaagatatcattaccagttgcttatcgtagtgagaaagtggaaactccttaaatcagagtagttactggaccagcagcagcagcggcagcacctgggaatatgttagaaataaagactctcagagccctctccttacctaacaaatcaggtctgggggggacctcagcgagctgtgttttaacaagctcctcagggattctgatggttcatgaagctcgagaaccaaagccttaaatgttccttgtgacgccccctccctacccccaggttcagctcccctgttagaaattcccacattaccccttattaacactcaacatgtccaaactgacttgctcaatgtcttcattttctgctagcctgtggctccaaaaagcagggccttgttggattaacttctttctagcagagcagctggcagcaaaccaatcaataattggtgaaggtagtggttaaataaattatggcacaatcagataaggcaatattcctcagctactacagataatattgtaggaaaatacgcaatgacatagaagtaaggttatgttaagaacagtttgccaacaagtatgcctaggatgatcgtgcagaaataaaactggaaaaatatacaggcaattgtgtcttttaaaagtgtgtttagttttaagttacctttttttttcttttgtaataaagtttttttcttccccttcaccaaatgcctcccccataggctaaaggtacatctcccatctcctaccacatccttccctacataaatggtcttcaacattaggtggttctgcaccgccccaccccacccctcaccccagcagacacttggcaatgtctggaggcattttgggtcctcacatggaggaagaggtcattactggcatctagcaggataggggcaagagatgctgcttaacatcctagaatccaccaaacagccctccaggataaagaacgatcgggccccaaatgtcagcagcactgaggttgagaaaccgctccacacagtaggctacatccaggagtcacgtgttcattcaccaaatgtttaccaaacaccctccatgacccaggcctgtgtatggatatcacactgaataagacaatatcctgccctcaagcttcttacggtctctataacagtggttggcaaattacagcctgtgggccatttactgcccattttagtaaccccagttacagtggaacacaggcattcatttacgtgttatctacagctatgctgcagcaacagggttgagtggtcgcagcaaagatcatctggctccaaagctgaagcaggggattgaagtgttcaggtaatgaggtagatgtctcacttgcctgccctcggttccacacgccccactgattgtaaagtcacgtcctcatattgcctgcctgagagtgtccccttcttcttacatccctacgaccagccagtctctcccctccatgccctgtgctggttgagctacactcagtgcagacatcccagtgtccgatatgctcctgttatgcttttgtgctcccaggattagaaacgaattatttcagagtgtcctggactgcatgctgtatgtggttaccattcagtaggtgagaaaggaaacatccccgcctccccatctgggtgagaggagccctgcccttcctggtgactgggcagaaacctctccccggggtggcactcctggtggaatctggaactccaccaccttccaagagagtatcagttatcttggaaggaacatggggccccaacagtgagctcagagcattcctttctctgtctcacccaacaagatgattccaacatgcaatatattctagaaagggctgccttagtgcttatgggttaggagtttctcccttccactgaacaggcagcagcagggattcctcctgatgtatagactcatggtgagatcactatagatctgggaaaaagagtcctcacaccagacgttatcacgtgggctttactccctttagggtgaggcaaagagaaattgtcaggcggaagacatttcctgagaaacaggaaggaaggctcttcttattaacctgagctctatgttcagagctttccaccttacggacttgttccctacttggaattagttttaaggaataaaactaaacatcaaaacaaaccctccagtgttagatggatgacctcctgagagggcaagtgttgccttgaagagaaacacaaccctaacagggtgtgggtacatccattaggcaggaacagttcaaaacaaaatggaaaacacttttgagttcactgtaggaagcttcagcctttgagggccgccctggaaggaaaagttgtagatcaaagagatctgtgtgtagaagagcattaggcctcctgtggtggactaatcgacccacttcgtgtggctgtcatccacccatattgggcaggaaagagccagaagtttgttcatttttaggtaagtctcagctgtagcacatggttacaaaatcagcttagcaatgaaagaaaagattttttaattttttttttaccttttattttaggttcaggggtacgtgtgaagtttgttacataggtaaactcatgtcatggaggtttgttgtactgatgattatttcatcacccaggaattaagcccagtactcagtagttatcttttttgtctacttgaggctggaggggaggaggaggtagaggagcagaaaagagaagattctgaagggaaaacaggaagataccaacaacatcattttaagtgaacattgttctttctagtggcagccatttcttttcagcacccaatcttgagggtggtatatgtggtggtggtatataagcccaacctttccttaaggctctgctcaaataccacctcttgctggggtcctagctgtcctgcagttctccacactggaattaacctctcccagtacccttgacttgcaactcttttgttttgttttgttttgttttagatggagtttcgctcttcttgcccaggctggagtggtgtatatggcccctcacaccctgctgaaaaaataccttcaggaaatgctagagaatgagcaacatggcctacagatggcccaggtcagccagggtttggcattaggcccttagaatatacctgtcactctttagtaactggacgggatgagcaatacagccagtgtgcccagcaggcatagacaaggccgaggaatacatggcggagaagagaggtcctttgtaacaggaacccagaggctcctatcagagaagaggggccccagaagaaagcaagggcttgggagtgggtgcacaggacaaaaaggagccccagggaagctgggccacatggtgagaacataggaagagaaggcgatgcttcaccagaacgacggggcactttttaaaaaacatcataatcatgtaggtgttagagaggtggccttggagtgtccccacttccagcaggcagggtcagtggctccaataaagagagggcacaggaacccagggaaggccctcctgtggccacgtgcagcagatgagcccatgaaaccctaagtcaggggaattagagattacaggcaagcacacctgggccacataagcactagaccatctttcagaagctcatagtctatggagagagaatcttgttcttgttcatgtcaaagataactatcatgttcaagtgtaaagaattgacccattcacatatttttctcttcctagttactttctttggttatttttttaaagccaccacagtgggtgaccccaaccatccctctggcctcaattttgatgttgaggtggagcagtgcatttcaaccttggctgcctgctacagtcacctggggggcattgaaaaatgttaacattcaggctctgccaccttccacattctattggtctgagattaggccgaggtaccaatattctttcaagatcctccaggtgattttaacctgcagctaggactgccttgctaagaaacgttctactcttagctgaatctttaaggagtgcattcatataacagggcgtctcaaatttgaatatgtatgcaactattttggggaccttgttaaaatgcagattctgattctgtaggtctggggcgggaccaaagttgctgctagttcctggaccaggaccacagttacagtagcaaggatgttgctaactcctagatgcctggttattaggccaaccagcccagtctgtgctcccgccatctccctgttgaacaattctggctcctcaaagcccaacctttcgttaaggctctagtcaaataccagctcttactggggtcctagcagtcctgtagttctccacactggaattaacctctcaccatcccattctcccaatacccttgacttgcaactctttgttttgtttcgttttgttttagacggagtttcactcttgttgcccaggctagagtgcagtggtgcgatctcagctcactgcaacctctgcctcctgggttcaagcgattctcctgcctcagcctcctaagtagctgggattacaggcatctgccaccacgctcagctaattttgtattttaagtagagacggggttttaccatgttggccaggctagtctcaaactcctgacctcaggtgatctgcccaccttggcctcccagagtgctgggattacaggcgtgagccacaacacccaacttgcaactcctttttaacatgaattgtgtaataatctaccattactttaagttatttatattctgctggctatttctttcatgggattatgagaccctggagggggaaaacacatcttactcatcttactcacccataccacctagtagcatactttacaaagagtagagggagtctggaagtacttactgaattgaatttgcagaacccagttataggtcacgtcttcaagttggaagttatttttttaagttggagggacccagctctggatattgcaaatatatacacaaggcagcttggttttaaaatgaggttgatgactagtaataccgactgacagaactttatgcatgcaaggagtatcaagaaagatgagttaaataaagactggcccaattcccagttctcacgggccgttaaaaaaagttgctacaaccaacacccaattaacctggtgcacaaacacagatgcaatgcaataaacacacacaacgaaaacccaaattaatttgaggaaggctccagggctgttttggtcaccacctaagaacgagtctgactcctgttgagaggaacatctcttgggcacttaacttcttggttttggggaaccacaagaaaaacaagtggtacaaaattcagttctgcttccaattcctgtgtccctgaaccaaaaaaagtccaaatcatagtggggcagtgagggggggtgaaaggagagagaacatcctggttcctccttttcaaagaatttgcccatgagttttctagactcatagctactatcaatggatctaaagagaacagtgacttctagatgcccagccctgggctccctaatatctttgtaaattacccaatgcagtggggatatgtggaaagaaaacaaaccattcggagaacacttttttcttttttttttttttttgagatggagtttcgctcttgttgcccagactggagtgcagctcactgcaacctctgcctccaccgttcaagcgattctcctgtctcagcctcccaggtggctgggattacaggtgcccgccaccaagccctgctaatttttgtacttttagtaagagacaaggtctcaccatgttggccaggttggtctcaaactcctgacctcaggtgatccacccacctcggcctcccacagtgctgggattacaggcgtgagccactgcgcctggctggagaacactttttaaatggagaacactttttaaaagaatggtttcgcttaaatacttgaataaggatcctgccaccccggcagttactgaacaatgctccagtgattaaccatgtagtaactgccaaaacgtacagcaagaccctatttttccccatccctcctctaacagctcctacttccttcttgcaggctctgtttccgctccaccaagccccaattcaattgtttttaactcaaaatcaagtaggcagctattaatgactgttcatggagcatctaccatgttgtgctaagaggtttgaaaactctacatccaaaagctggccaagaatgaaagatttaagtaggagttccacataaaaatagaaaggatgggccaggtgcagtggctcatgcctgtaatcccagcactttgggaggctgaggcaggcggatcacgaggtcaggagatggagaccatcctggctaactcggtgaaaccccatctccactaaaaatacaaaaaattagctgagcgtggtggtgggcgcctgtagtcccagctactcgggaggctgaggcaggagaatggcgtgaacctgggaggcggagcttgcagtgagccaagatggtgccactgcactccagcctgggcaacagagcaagactccatctcaaaaataaaataaaataaaataaaataatagaagggatgtgtggatccagttagcccatgattgatgtactttggatcaaggtagaaacaaattgcaaagggaaagacatgctttctcctcagtagtttaggctccatataaaaagctacaaaataaaagatctagaatttcatttcagcaatatatcatgaaaataatgaacaatcagcatgcggctcatacctggtcctgaggggcctctcattccagggagccccatggctccttctggtcctctcatgcctggcgccccaggaaggcctgggattcggggacagtcatccacatctgcaggtggccccggttcacctgaaattggaatcaccgcttgtgtaatggatgcacgtgcttatgaacaagctccttctacagtctctggttaaagttggacttctgacactatactgaaatttagtacaaattcagtataaaattcagtataaatgtttgtaaagattcaacaatccaatgtaagttccatgaaggcagaaatttgtcttatgccctggagggtacatgaaaaaattccagaatgtcgggctgaccgaatgagtgaatggagtatcagaggatgcagaagtatgaaacagtgaaggtcggatgatgcagcaacgtgatgaccctcacaggattgcccaatctctgggccattttttactggagtagcagccacaggtagcattgcaagagggactggtgggttcctaaagctcagcttcatgtgtccctgagtccttactctacactgcagccacgtgggtttccatagtgtcagtcactaacatagaatttcaggattgctagaggctcagaagcagtgactttcaaccttgagtgaacattggacttatccaggggagtcatggaaatatactgatgcctgggtcccactcccagaaatactgatttacttgataataggatgtggcctgagcagtgtcctcatcattggctgcataataaactcagctggtgagcttttcaaaagtactcatgaatactggggccccatctagactaattaaataggaatttctgggggtgggacccgggtgtcagtagtttttggtttgtttgtttgtttaactcccacgatgattccagtgtccattagggctgaaagcacagttggaaagctataattctgactgtagcacatcagaattgtgtcgctagtttgttagaaaccagagttcctgagtcagaaggtctgaagagggggccatgtacatctctaacatgttcccagggaggctgatggcgttgatctgggaatctcactttgaaaaacacaggctgggcacggtggctcacacctgtaatcccagcactttgggaagccgaggcgggtggatcacttgagatcaggagtttgagaccagcctggccaacatggtgaaaccccatctctacttaaaaaaaaaaaaaaatagctgggtgtagtggcaagtgcctgtagttccagctactcaggaggctgaggcaggagaatccctggaacccaggagacagaggttgcatgagctgagatcgtgccactgcactccagcctgggtgacagagcaagattccatctcaaaaaaaaaaaaaagaaaaaagaaaaccactatactaaagatgtgagatttttttcttttactttcacatcattaagacatcttttctaaagcttcattcagtcatcctgcaaacatcacagagggataagaaataataacactgaacaataatgacaacagctaaggctcactgaatgctttatcatgtatcaggccctgtgctgaatgcttttactattaaatcctcccgagaagactgtgtatgtgctactgttatgagaagggtatgaacaagaacactcaggcttcgccaggcgcggtggctcatgcctgtaattccagcactttgggaggccaagatggacagatcacgaggtcaagagattgagaccatcctagccaacatggtgaaaccctgtctctactaaaaatacaaaaattagccgggtgtggtggtgcacagtcccagctactcaggaggctgagggaggagaatcgcttgaacccgggaggcggagattgcagtgagccaagatcacaccattaaactccagcctggtgacagagcaagactctgtctcaaaaaaaaaaaacaaaaaacaaacaaaaaaaaccactcaggctcaggcaaataagtgacacttctgtggtgacacagcttacacacagcagagtctggattgcaatccagggcattctggctccaaacccatgttcttaaccacctcatcagactgcatcaggaactctcaatatctgggtaacaaattctaagaaatgaaacatattttaaaaggtatcatctggccgggcatggtgtttcacgcctgtaatcccagcactttgggaggccgaggcgggtggactgcctgagtttgggagttcaagaccagcctgggcaacagggcgaagccccatctctactaaaattacaagaaattagccaggtgtggtggcacatgcctgtaatcccagctacctgggaggctgaggtaggaaaactgcttgaacctgggagtgcagtggtggaatcgccagcctgggcagcagagcaagactctgtctccaaaaaaattaaataaaaataaaagatatcatctgattagctatggtgttcttcaaatgtatgcaaaagtgtgaaataatttcaggaacatcaatcataaagcactaagaaaatccttaacaaaatgtggcataacaacaaagttttagtctcctaatacttactgggcctgtgtaaaatgacctggaattcttatgagctatttggaatttaactctgtgtaaaatatggtataaaaccacaagccacacagggccaaatgtatttttataataagtacagtttaatgtaaaacttggcttttctactatgggtgacttgagagagatgcatagaggcatcttctattttccatgagtaatgtctggcccttcccagtgggaacggagttcagaaagtgggagcatgtgtttggtgcttcctatttagaattttgatgctctcttgaaatgactttatacatacaatcacagagagacaggattgaaatgaaaacatcaaatacagtttaatttttaaatataaacattgaaaataccaggactttttacatttttgattttgcttttctttactttttaataagtcagaaactgaaaaataaaaagggggagctgaggcctgtcttctaaagaccttaaaaataatacatggtgtctatattcacagcaattttcattaggactaataacagaggcctggaaagaacaaatgcaggcattcacaatttttctttttctcttctgagaaatgcttttgattttctttgaaaatgccaggcacaaaataacacattgtttttgcactgcagagcattaagtgaacattttccttttaacacacaaagaaatgtgctccttgaaaatggacttgagggtgtgataggaaaggcttgtcacagccccttactgggaggtgaggccccattttttaatgttgtatataccatttattttagggatgctctaggtatttatattgtagaatttaaaaaaggaacttacattggttatgtactatatagcctttgacagagaaagcccacatacttcatgcccaaattgaaactatataagcaaaggctctacactgccttgacaacctataatgaggctgaatgttaggatgctctaatatgaggttactatatctgtaacgaggaagcaaaacactgcagcttaatatccttacagcaccccatctataaaaatgtaacaaagtttagctcacacatacagaggaaaaaggacaagtacagaaatgactagaaaccagagtgaggggaaattaccaattttatagcaaagcttacctctgggacctagagggatccaaagacaacaaacgaggccagtccatgattttcacagggtggaaagagattttaaatttgtggattaggacaaaaatgaaatagattaagaacatacataataatttgaggcagcatcaatgacaagcagaatggcagcaccttatttacataaaatgtccacatcaatgtgactgacaggagcagctatgatttagtaacggagttttcatctctagaatgacttgaaactctcttgagcaatataaaattctagttgatttcttctggcaaatatcctctaatttaatgcatgtaggaattctatccatttaaaagcttctgaaaatttcatattaatttgccaagtatagggtatgcatagaaaggaaatatgaaaagaaacaacatataggccaggctcagtggctcacacctgtaatcccagcactttgggaggccaaggcgggtggatcacgaggtcaggagatcgagaccatcctggctaacacggtgaaaccccgtctctactaaaaatacaaaaaaattagctgcgtgaggtggcgggcgcctgtagtcccagctactccggaggctgaggcaggagaacgggcgtgaacccgggaggtggagcttgcagtgagccgagatcgcaccactgcactccagcctgggtgacaaagcgagactccgtctcaaaaaaaaaaaaaaaaagaatcaacatataagcccttgttcctcctgtcctatgatacatcataaagcagtgctatttatttattctttggactagagtgctaatttaggatactgcgaaatattctgaactgacgccacattaccgtaatattgatttaggatcttgaaagatattacttctgcccatctcaaatacacatgtctgtttgccccttctctccccaactcttccttgtcgtaatttgaccctatggttaaaaagtgttgcctatagagttaaactgaatagctttctcccttcctaggaacgaatggaatttacagaaaaaaaattaaataaaacatctaggaaaatcaatgaaaattcagggatcggaattgaatatacgatcctaacaaataataatcaaatcagtctttgcctcttgcatgaaggaacacatatttatttcccttagaaacagtctatgtgggccaagcacagtggctcatgcctgtaatcccagcactttgggaggctgaggtgggctgatcacctgaggtcaggagtttgagaccagccttgccaacatggtgaaactctgtctctattaaaatacaaaaattagctaggcgcagtggcacacgcctataatcctagatacttgagtttgagtcaggtggatcacttgaacccaggaggcggaggctgcagtgagctgagatcacaccactgcactccagcctggatgacagagcaagactgtctcaaaaaaaaaaaaaatagaaaaaaaaatgtgtatataaaatgaactccttttttttttttgagttcatgtcctttgtagggacatggatgaagctggaaaccatcattctcagcaaactatcacaaggacaaaaaaccaaacaccgcatgttctcactcataggtgggaactgaacaatgagaacacttggacacaagaaggggaacatcacacactggggcctgttgtggagtgggaggaggggggaggggggagggatagcattaggagatatacctaatgtaaatgacgagttaatgggtgcagcacaccaacatggcacatgtatacatatgtaacaaacctgcacgttgtgcacatgtacactagaacttaaagtataataaaaaatatatatatatagaaaaaaattaaaaaataaagtaaaaaaaaatcaactcctaattttcaaactttttcattttgacaataaattattactttaccaaacatgagactttgtagtgcggcctgaaagaaatatactcttaatataagaaaagggcttaaataataagaatgtgctagtaattcagaatattaactactttctgaacgatgatcattttagtaaatgtttaaacaaaatgctgtatgtaggttggaagctcacccggaagaccagtgggcccttttctccctggaggtccaggtaaacccttctctccaggtggcccaggaaatccatgtggtccctgcggtcccgggaatcccactggtccttaaaaaaaaacaaaacataaaaatgagggcactggaatgagacaagataaaaacaatgacagtttgatagactgaattcagagattcactccaacaaaatgcagggcatagctagcctgagagtcaagattagcctcgccttcttctgtgaggcttagacgggttgcctctgaaggaaacacatgatcggccgaaagaactaaggaaatggctccatgatcaagacaagaccaaattacaatgaaaagaagtcctataaccctaaacttcctctggagacaaaggactggaactgaaggaaaaatcaggaaagagctttcaatatccgggaacaacgtgcctccccaggcgagttcaaccactctcctcctcactctcttagttttaggcacaacagttcagttcctcatacgtgatgttcctttacttcttccacatccatgatgtcttcctcattttttagagataagacccagtttcattttctcagggaagccttccctggaatcccaactgaagtttagttgctttttgataagctcttcattcaggacacttaactggatttaaactgacatatcctttcatgtgcatgtctgtcttccatgaaactatgctctttataaaagaaatttattattattattattattattattattattattattatttgctccattacccaggctggagtgtagtggcacaatcattgctcactgcagcctccaactcttgggttccagcgatcctctcacctcagcctcccgagtagctgggactacaggcacacaccaccatgcccagataattttttaatttttttgtagagatgggggtctcactgtgttgcccaggctggtcttgaactatactggcctccagggatcctcacgccttggcctcccaaagtgttgggattataggcatgaaccactgagtcaagcggaaactctgtccttatgagattagaaactctacttaaatttgttcactgctatattcctgcaggtgcctaagagatatttgtcactgtgtaagtcataaaaggtaactgaggaaactcactctctttatagtgaagcactgtttggcctttatattctctggactgggagtcaagaagcatgattagcggttccaccaatatttctaactccctgtgtatccttatgtagatcactggtattcatatggtgttttatttcctcagtcctgaacttcatgtccaggtagagatttattccctagagtaactaaggaggaggagtgttagccagccccttcctccttcctcttggtgactagagtgttagcacgtcagtccaattctgaagttcaatcattggaagcctacttacccatagatttgagccacattctctaaaattgatttcattgctaatacagatgaacaggcttgctccatactgttctacaggctgtgcactgcacaattccacagatgccatttgcactatagtcatggcggcctcacagtgatttttatctgtgacctaatcttttgccttatttcacacttggttcagaactcaggcaaggtgctcgttactgggctctttttgcaaatttcaactgttgcttttctgatatccagcttccttatttatgaaatagggaagttaaaatggatactcattagtcatcttttttcaacaaaaagcttctttgaacctaaaaattctctgaaattctggtgaccaaaaactgatctccccaaatattagcagttggataaaaattgattaaaataaatattttaacctcaaatactggggaaattcagtgattcgggatctttgcaggaatataaaaaagcaaagtcagcagtctaaaactaagctgtccaatacagaagctactaaccatacatggctagttagcacttgaaatgtggccagtccaacctgagctgtgctgtcagtgtggaacacacaagggatttcaaaagcaggaagaaggagtggcttatttgcaaaaggaattaggtttgcacaatcagctcaattatctcattgataaatgtatattaactatatgttaaaataaaaatatttaaatatattatgttaaatcacataaagtatgaaagttcacttgtttttacttgctaaaatgtgtctactatatttttaaattgcacatgtggcttgcattacatttctactgttcaattctggcctggaagattatcaagagtattattaggggctaaagatgaacttgtgtttcttccttttacttgtccaactttgacccaaacttcaggactctttggggaaataaggacattttggaaggtagtcactttgtttgcataggaaatagaaatggcggcacagtaccccagaccctcaagggtaagataaccaagttattcacatattacttaacggaacaacattcatacctttctggccatcttttccatcacatcctggaaagcctttgtatcctggagggcctggtgggccagggggacctggtggccctggtagaccacagtcacctggctcccctctcagaaggtcaacactcccagggaggcctggaggcccaggtgctcctgaccacagagaagagacaaaaatattcttttagtcaaagacgaatgtgtatactggctgcttgacagcttccgaagaaaaacaattcaatgacttgcaagcaaggaataaagagaattagaagaataagaaagtcaatgataacagaaatgaaatagaatgaatcataataccaagttgagaaatggtgtagataatgggttggtaactgttagacaaaatgaacccaagcaaaaccttccttcccttcaaagtcattcctgttgaaaatatcattttgggtttttgtttgcattgccatcttactgctttaataagatggatggatggatggatggatggatggatggatggatggatggatggataggtggatagacggttggatggatagataagatggatggatggatggatatgtggatagatggttggatggacagatggatggatggatggatggatggatggatagactgatggacagatagacaggcatttgaggaaatatgtctggtgggaaaggaatgttcactcgattaaatttataatcctaatggaaaacaagttcccacaaataggaataaattgaccccaattatattcctacttagcttctgtacttcttagcgcacttttgagagctttattattttcagtgtatgatccctaaaatcctaaagattcaaagatgatgggcatgtgtctttatggaagagttctaagagcttgtatgaatgcaattgcctgcatttagcaagatatcacacggagccacactcttctcccaactcccaacccagctctagcctaaacctacttggtcagcttagtaatgacttccaacatctttccttaccaaagtttgtccctgtgaagtgatgaaagaaacaacatgtactgtcagcagcacatgaagagactgtttcttgtgtgccacaagcctgcatcctgtcactctgggctagtgccagtggtttatgtgacagttgctagagaccaacaaggagggtgcgattcccacttgccacccacttctgaagacatttggtcagcatcaagctggtgataagaaacgcttgcttatcagtttctagcctgaagagacgagggtctaacagagctgaaattgaagagagggccaagtcctggtcctggatatggtcctgagagcccaccactacccaaagtcccaccctaactgtgtcccacttatcgacctgccaagctgatggggggctgcttcagtgcttctattctgccactctctggtcccacattcctccagagctggcagcatctaacaaagggagcactgccatcctttgtcatgattctctcatacctcttgggccatcaggaccaggaggtccctgatctccaggtggacccgggtcaggaatgtccttaggagctcttcctgtggcacctgcaggaccaggtggtcctgaactccctaagaagagacatgttcacatgttatcctcattgcatttggaaggttttggtttagttattgaaagaagggcaaagcatgctacagcttacctgggggtcctgggggacctttctttccacgaggacctggaggagagattcctgggctcccagggtctcctctctccccttttagcccaggtattcccactggaccaggtggccccacatcatgcaaaccttaatggggaaaacagaattaatactatatcttctcttttcttgtccctgttatagtgcctgaaaaggaaccacttcccaatagcggcagaggagtggctggttctgcagacaccaacaactggttgcagtggtgatccaaatgtctgcaccatttctctcttaggacctatcacactggtcagccataagttttatttcttttatagttattttccagattttaaaaaacaacaacttagaggcaataccaacctcccacctctacaatggagagagtaaaaacaaatgagatacaataagtaattatgcataagttgctttgaaatttgaggtggaaactggcatgattagaactattgtggaatttcacactgggaaggaaggacatcagtgttttcttggaaggcacacacatttaatctatttggaggatctactaaatgaatcttaagtgactatattactggatcttccaaactagaaagatttcacctctctccaacaataaattcaaacctagcagcacaattcctcttccccagggtcactcaaatttgcatgttaggtttcagctactttgtctgatcataagcggtttttctgagaaagtaacgcaacaaatgtgcattatactaacagaacaagatacacttgtcaaagattaacctgtttgcggtatgaaaataacagcaaattgtgtaggtaatttgttttagcagtggccataaaaggatgctattagtactaatttgacccatgtggtcaaacatagcattactatacttaatacaaaaattctaaaatccccagctatttacttgttaggataacattttgaaatctggctcaattgttcagagtacttttagtggacagaaaattccaagcaataccaacaaaagacactgttaaccaaccattccttcttaaatagggttttctcaaatgtccttttcatatgtcattttcagcactaaaaatagctccaatagtgtgtctctaacctaagccagtttttttcagttttgcctccaaatctcatgaagtgcagaaataccagggagggtaccactttctctcatgaaccatggactgaagctcagtctgttacgaatcgattaggtgcttacctgaagcacctttagttcctttctgacctttcaatccatgcaagccgttcaggccaggtgatccggagggacctgaaaaacaccacaggcctgtgacccaaaggaagaccagccaccggtactcactctagccacaaacgcaggcactgcccagcagagggcgcgttgctggggccagcaaacagctctgagcgtctggacttcatcatcagggtggaaacccaggcccaggactatttaacacattcatccggtaaagattttctgccaagacagcttaacacaaacatttctttggttttaaagtactgctgttggtttctgatcctatcgtgaccagatatggtctagaattactgaatcttggcataggaagtgacctttgattttatgacaataaaatcaccctacatgaggaaagagatcggatgggagcaaatccaggcctcacacctcccaggcttggggtcactgcaccctcctaggggctgcaggctcctggtttcttcaggatctactcatggagatgcagtcagacgagaggacgcatggcgcctgtggcatgctggcaaatgcttgccctgcgatgctcaggcctgcatggcgagtgtggctccagctattgctttgcagtcacttctttcacaaccattctgatgcctttctgcagaacctaagtttattttgcgatgatcactgaaaactcccgtctgtgtaaacagacattaccccactgatgcctgtgccttctctcagaaccttctgtttagttctccaaagagccgtccaccagcctggcttgactgaagttgtcactaaacacttccagtggaaaattttttttaaggttttttatcaacgtatgttgagttgtgttgaagttgtctgaacgagagccttttcaaatgacacttcttgatggcccttggtaaagttggaggaggagaggcaaggaagaaagcaggtaaggaatatttatcgagcatctccagggcactgagccatctgctgggtgccttctcacaagtcctgtcccactgatggctacgagcactgaagcttcttcccagcctctggtcaagcctggaaaacttcctatctcatcagtagatcttccacccagtagctgttcttttttttttttaattaattaattaattaatttatttattatactttaagttttagggtacatgtgcacaatgtgcaggttagttacatatgtatacatgtgccatgctggtgtgctgcacccactaactcgtcatctagcattaggtatatctcccaatgctatccctcctccctccccccaccccacaacagtccccagagtgtgatgttccccttcctgtgtccatgtgttctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtgtatagagcctctcggtgcacagccagcctgtttacttagtgtagggtcacatctctcaaatttgggataaaaataccatcagcttataaggttgaacacagaaggtgcccctcacctacccccatgatataggacccccttgattgttgatgtccaccccacactgtgaaacaatcatgtctttgggtgactgtctcccctgctcaagggtaaataggagttcaagactaggtcctatggatgtgttcaataaatgtttgttgagtgactgaatgaaaaaatatggaacaaggtggatgagggagaaagctacaaaaaggagcagggtagaatttttatttgtatgccatatctttctttaatagatttataggacaaatataatttacagaagttagaggtatcagtttgcatataaataattcaagtgctaattattgtctattcattttaagcaagtcctctgtgtattcttattagaagctggcacagttagttgcttccattctatttatcatcagtacttgaaacagacagtcattattcttttaagatctaggatttagattggttcaaatgagccatattctcgtgcaccaaaaaaaaaaaaaaaatgggaatgcatctttattttccccaaatctcttattcctaaccactttttacagttctggcttagtttattctccaatcctctttcctattttatgagccaacgtttcaagtttgcaccaaaagaacacacagaccttctttatctgccaaatctgggtatttattgcaatctatctgaaatgataaattttcggggggaccacttcactatttccacatgttttgatctccagctttagtcaccaagattgatggcttggggacttggctggggtggaatgtctctgcttctgccagctctccattgtcacatcaacacatccagatcctaggttgtcacggtcccagcctctcgccattgttgaactggccgacccttatctgacccaatgttatcgttctaaattgaatgcagctacatctgagtagggttgtaagggtaatttttcctttttactgaaagctttttatcaatcccatctctaaatcagaaagttgttcatgcataaaatatatacagtgcagatgagaggcaattaggctaacaaagcacatttctgggtaatgaggaatttttattcacctctctggtcatcctcctgctaaacaaccatcatttaaggctgcagcacactgcactttcaggctgggtgctctttctctagtcagtgaatgtaacctccaatccagctggaattgtggctcccatctttgttagccagcgaactctttatgactgcattcccactctcaggctgtattttgttctaaagcctgaaaacattactcgacacacccaagagcttttatatgggctcatacttttaacacatagggtgaccaacgtgtccctgtttgcctgcgacttcttcctggttttagcactgaaatttctacatcctgaaatacccactcaggcccaggcaaaacgggacagctgctcaccctaacttcaaagctgatgggaagagagatctttgtgactataagtaatggttgaaaaacctggaagattcttattaacaaagattctgaaataagatttaaatattttttgtatcagcaaatatgtgagtgcccactaagggtgtaagatatggtttcctaatgcacagagtctgccccaaatgtacctcctggcaggtgctgtcaagacgatgcgggacaagtctgtccctgacttgacagaacaaacaggcaattacatccagtgtggtaagtgctgtgggggaagggcaggaggagagtaatctagtaaaaaaagcggggggagaatatttccatgatgttcatagctctaagggacatggcatctcttttctgaggaaagccatttccagattcttttttcttatgaaacattttacttgctaccagtaaatatggatacaaaatccatattctttccagttcttgtcatgctacaggtaatattctttaggttttcattatttcaatcttatattactttccaactaggaactgggtgttctccttttaaagggcatttgtacttaaagtctaggaatcaagccattttatgatgatgatgatgacactttaagttctgggatacatgtacagaatgtgcaggttttttacataggtatacatgtgccatggtggtttgctgcacccatcaacccgacatctgtattaggtatttctcctaatgctatccctcccctagcctctcacccactgacaggccccagtgtgtgatattcctctccctatgtccatgtgttctcattgtttagctcccacttatgagtgagaacatgtggtgtttggttttctgttcctgtgttagtttgctgagaatgatggttttcagcttcatccatgtccctgcaaaggacatgcactcatcctttttttatggctgcatagtattccatggtgtacatgtgccacattttctttatccagtctatcattgatgggcatttgggttggttccaagtctttgctattgtgaatagtgctgcaataaacatacatttgcataggtctttatagcagaatgatttacaatcatttgggtataaacccagtaatgggatcactgggtcaaatggaatttctggttctagatccttgaggaatcgccacactgtcttccacaacagttgaactaatttacactcccaccaacagtgtaaaagcattcctatttctccacatcctctccagcaactgttgtttcctgactttttaatgatctccattctaactggcaatgagatggtatctcattgtggttttgatttgcatttctctaatgaccactgatgatgagcttttattttcatatgtttgttggccgcataaatgtctttttgagaagtgtctgtttatatccttcgcccactttttgatggggttgtttctttcttgtaaatttgtttgaattccttgtagattgtcagatggatagattgcaaaaattttctcccattctgtaggttgcctgttcactctgatgatagtttctttgctgtgcagaagctctttagtttaattagatcccatttgtcaattttgccttttgttgccactgctttaggtgttttaggcatgaagtctttgcccatgcctatgtcctgaatggtactgtctaggttttcttctagggtttttacagttttaggtcttatgtttaagtgtttaatccgtcttgagttaatttttgtataaggtgtaaggaaggggtccggtttcagtattctgaatatggctagccagtttttccaacaccatttattaaatagggaaccctttccccattgcttgtttttgtcaggtttgtggaagatcagatgtttgtagatgtgtggagttatttctgaggtctctgttttgttccattggtcaagatatctgttttggtaccagtaccatgctgttatggttactgtagccttgtactatagtttgaaatcaggtagcctgatgcctctggctttattctttttgtttaggattgtcttggctatacaggctcttttttggttccatttgaaatttaaagtagttttttgtaattatgtgaagaaagtcaatggtagctggaatcaagccatttttagcatatgtttaagttaaagtttaaatctgattgaacacaagcaggatgcaaaatccatatggcctgttctagcagagcaaacagctttgagttcagcagctggtttgttcaaacaagataatcagtccccttgacttagttagaacatactgcaaatatttagtttctcagttcaaagtgtttctgctggagtgtggttcatttttatatcagcatgataagctgcaacaatgaatttatactgcagatgttttaacttttcagaatgtatttcactgttttgttttgtgttgtggtttttaaagaccagttgttctctgagctgtttgaagtgaaacagtgtcactatatggtgatggagcaccactgcaacatctgtctgtaggtggtatgaacatgccaagtaatatgttcatttcctcaccttctctttttaacacactatttcatagcacggaattatgatgtgattggagattaattttggggtgattttgttatggatcaaatttattagctattagttttgttttgttttgttttgcttgagacagagtcttgctctgtcacccaggctggagttcagtggtgcaatctcagttcactgcaacctccacctcctgggttctagcaattcttctgcctcagcttcccaagtagctgggactacaggcacccgccatcacgctcacctaatttttgtatttttttagtacagatggggtttcgctatatgttggccaggctggtctcgaactcctgacctcagctgatccgcctgcctcagcctcccacagtgctgtgattacaggcattagccaccacgtcggccagctattagttttgtaatagcatgccatactgaagttatgtgataaatgcaaacaaattcaagggaaagaaagatcaacaacagtggcatgagccctgccattttgaccaaattgggtgtatgtttttaagccaccaagacacttaaaaatccttgctgtgttactaaactgggagggtaggaagaagtggagggtaggaaaaagtgggagtggttaatgatgacaaatgttttcttttggttctttaccaactgtcttccggacacaaaaaagtgtcaaagaatacgccatgaaggctgtagagatggtcagagacaggaaatggccacaatcaccacagaaactttcaaaataacagaatgatcatttgcctgaaatcctaaatttatcatgaattgctggaattcatattactaaaagtgtcaatgaagacggagaacagtacaaagatgtcttgtgaagggaacttttcctatcaagttatgtgattgtgtgaaaatacatgagtataccaactcttcaacataaatggctcctgtctccacagacttgcaccaagtaatacctaccacactaccacttctggaaaattagaattatttcaaagctatccaatgagtgaagagggcaaagtgtgggaaaatcgtatttgaattttcaaaacagtaaaaggattaatcccagaagaaggggtttccaactcagtaccttctgaaaggagggactttttattttaccaggatttcgtatacgtatgagtcaatgagcaaaggcaggtggaaggagaaaggaagaagaaatagaggaaacctggttacaagactctaccaagtaagctggaaccatcagctgttggttcagataaggactgcaacctcatatctactagctcagatattcattctcctatttgtccattcattcataccaccaaccaatatacttgttattgactgggtctcaagggtatatgaaatgtccttgctttttaaaaaatcatactctgtttgatgagaaaaacctccaaacaaatgtgatacaacgtaagtgttatgctaaagatatgttcaaaaatacccatagaaaaaatactttttctttttttttttttttgagatggagtcttactctgttgcctaggctggagcgcagtggcacgatattggctcactgcaacctccaccttccaggttcaagcaattctcctgcctcagcctccagagtagatgggattacaggcatgcaccaccacagagctaacttttatatttttagtagagatggcgtttcaccatgttggccaggctggtctcgaactactgacctcaagtgatccgcccacgtcagcctcccaaaactctgggattacaggtgtgagccacccggccaaaaaagtactttttctaaagtggaagaaatggactgaagaggggttgataccatggatgaatgtgagggcataaagatttattaatgacaagtattttatattatattgtattgtattatattatattataaccagacttttataaccagtccactattgcctttacagaccaagaaattcaacccagaaaaaattattcttgatcgaaaaaagatgatgaacactaattattctatatctgtagcaccttattgttttctcttccacttatcatgatcagtaaatatatattcatttccacatatattattaatgtctttctctcctgccatactgtcagctccatgagggcaggaagcaggtctattttcttcaaaactgtacacccagcatctagcacagaatctaggatagtaggagcttaaccataggtgaagggaatacatgaataatgggcctgaacatcataaaaatcatttggctaaatgccttcagaaataagatggtagcaaccgggcgctcacatcctagcacttcaggaggccgaggcgggtggatcatttgaggtcaggagtttgagaccagcctggccaacatggtgaaaccccgtctccactaaaaaatacaaaaattagccaggcatggtgatgtgcacctgtaatcccagctacttaggaggctgaggcaggagaattgcttgaacctgggaggtggaggttgcagtgagctgagaacgcgtcactgtactccagcctgggtgacagagcaagacaccatcaaaaaaaaagaaaaaagaaaaggaaagaaaaggaaaaaagaaagaaagacagagagagagagagagaaggaaggaagggaggaggaaggaaggaaggaaggaaggaaggaaggaaggaaggaaggaaggaaggaaggaaggaaggaagggaaagaaagaaagaaaggaagaaagaaagaaagaaagaaagaaagaaagaaagaaagaaagagaaagaaagaaagaaagaaagaaagaaagaaagaaagaaagaaagaaagaaagaaagaaagaaagaaagaaagaaaatggtagcactaccattctccctggtagaaggcaggtcagctgactggatgggcactacctgcagccctggctaaggaagagtaggaagatgctaatggcacctacggaaaagagtggtataaccaagagcagggtcactcactggtacaggaaaaaaacaccatcaatttgccctcattgggctgcatctttcttgtgggatgggcttcattttgacttaccttttattcccggaggacctggtatccctggatccccctggaggcctcttggcccagggtctcccatttctcctggctgtcccctcagcccaggcatcccgtgatcacctgaggatgacagggaagttttgcagatggccagataataaatgaattacattcactgcaaaagtcatctatgttcttaatatatgggtaacggagaacactgtctaattactttttcttcctatacatcttaactctagggagaaaaatacatttaaattcaggaggagaaaatacatttccaaataaatgaagttgccaactatagtttgaaactttctctttttttctgaattggcaggaatagtatccattaaaacactgtgctgtaagtgtgacatctgccttaggtctaaaggaggggaaaacaaacaaacaaacaaacaaaacagcatcctgaatggcaggagaaatgcaaagggctagaaaggagctgctatctgggccagacacagtggctcatgcctgtaatcccggcactttgggaggctgagacagcctccctgaggtcgggagtttgaggctacagtgagctatgattgtgccaccacactccagccttgttaatagagtgaggccctctctctctaaaagaataaaaactaaaaagaaaggagttgctatctgtctgaccattcctttgtgtctggtgccatgctaggcactttacaggtgctgtcttaatctactccaagtcactcagtgaaacccactagcttataggtgaggcataggtgagcttaagtgacctatccaaagtcacaggtctgggaaatggcagagccatatctgaatttaggtctaattaaagactggtggtttctgaaacactctgagacacaagagtgctcaggaagtctccagatttcctttcaaggtacctgggcaccctggtggtccagaggagccaggtggccctggccttccaggtgatcctctgggcccttgaataccaggcaagccctgctctccggatgctccaaaatgccctaaagaaggaaagatcaaacatcagagttgccgtttgagacagtgaatctttaaaatcaccaagttcagcccaccctattcttttctatccttacttttttagttttaaatagtttctattggaaaggaaaataacgttaaggaaaaactgataacaaaatgcccataatcccaccagcttaacacaattcttcatatgtacatacatgtacagataatacccacaattttatattctggtttttaaaattagtgttgtatcataagtaattttccaagtttatattggttttcctaattatcatttttaaatgaatggccagtagctttttgagtcaatcttaattaaattaactaattcaatttattttactattggccatttaagttatctctaactctgccgttatccataatgctctttatatctcttgtcaattttgtttctcctattaaattgtttccttaggaaaaattcctaggagtagaatttctggataaatagcatgatattttggtattttcaaatgcattttaaatgctgaagtattttaaagtacatcacaccgtagtgtaattccatccctaaatacttcaggaggtaagaagtctgaaaaataagaacgtttttctacattgccaaaataacatttcgcagccaagaaaattaatagcaattcttaataccctcaaacactcatcccatacttgaatccccccaattatccccttaatgtccttcacagttggtttctccacaccacgttccatcccagaatcacccataacatctaatggataggtctcttcaatttctaaaaatttaaagcagtccttttcttatgacagtgacttgctgcagagcacaattcagttcttctctagttttctagaacagaccattcaacatttggttcttgatacaggttgccagtagtttggagtaagtgctgcactgactcacaccaccatatggaacccacccacagctccaagagcatgccgtgttcttactgaggacattttagttttttggcctcttttcttgctaatttattaaagataaaatgatatttcagacacttgaaattacatttctttgattactaaagaggatgactatttccccgtgtgtttatttacaatgtatgagtttaatgcacgtttatgggataaaccaatagtgtgtgctgaaaatcactggttgaatctgcacataaaatatatgtctctgtatttacaaaccatgctgggggggctatagtcatcatttattatagcacacaggaaacaagcttttgttagtctgtacctgttccctgattgaatttaacatctattagtctcactatgtattatcttatttatcctgaaaacattcctacagtaaagtagcattattctcatctacaaatgaaaacactgaaatattaaaaataaaaacttgtctcctgaattttgtggggttgtgttaagaacagaacttctgagttaatttgcactatattttctctctgaatagagtgcagagtaggtaggactgaacccaggataatcacatataatcccaagaccagctgcagattcatgccttctcatgatgctcattcaagttcaatgaagccttctccagtcaatggaaatagtgtattaagtaaactctgtgctagtgaataacatataatacaatttaaaatttctaagctgaggccatggcatatgggaaaggggccaatttaaatggtggtaaccacaggagaacaggcaaatttggccaaggcaaactttctgaaaaagtcagcctaagtgtaaaatcactcaggtttatgatttttaagttaaaatactaggtaacatcacaggcccccattttggactaccctgagcttatgaaatcttcctatctttggggtttacataaaaataccagtaagtatgggaaaatgtcttcatgttttgctgactgatgatggtgatgatgacaatgatgatcattgcattttattttgtatagttattttcagtttcagtttctttcatttgatcctcaggacaatcctgcagtatgcatagggccagtttacaggtgaggcaactacgctcagagaagatactctcagcttacccaagaccacaggtgaagtaataatggaggttgactttgagccaccgatttttcccttctgaggcttctcactttgatatttgtcatgaactcccataatgctgacctcaaaactattttccctatcaaatgtatacttcagttatacagttcagttaaaatattatactatgtctaggccgggcacagtgcctcacacctgtaatccaagcagtttgggaagccaaggcaggcagatcacttgaggccaggagtttgagaccagcctagccaacatgacaaaactctgtctctaccaaaaatacaaaaatcagctggtgtggtggtgcacacctgtagtcccagctacttgggaggctaaggtgggagaattgcttgaacccagaaggtggaggttgcagtgagccaagattgtgccactccactccagcctgggtgaaacagcaagactccatctcaaaaaaaaaaaatacatatatatatatatacacatatatatatatatacacatatatatatatacacacatatatatatacacatatatatatacacatatatatacatatatatgtatatatatttagatagtatatatatgtatgtatatgtatatgtatatatgtatatatgtatatatgtatatatgtatatatttatatgtgtatatgtatatatttagatatttagatatatttagatagtatatatgtatatatgtatacatatatacatatatactatctaaacatatatacatatatatatttagatatatatgtacatatatatatatctaaatatatttgttcatgtcagaggtgaaagacccatagcaaagaaggtgggaaaggtagtttgtgccactgtattaacttgtttttgttagacttccattttagcaatcttacagtataaaaacaaagaaaataaaatttctcatatagttctgctcagaaaatatctaatattctttctgttgtatgaaatgaaacacagctattgccagatggaattttaagataatgcacaaaattattgatatgaggtgttttaatttacaaggtacccatctaaacacaaacctggtttctaacctgaccactattggctgagtgccctgggatataacttatttaaccaggcatctgtgaatggacatttgttccattcaaacaacgcatattcctgggcatgcatctttgtacacttgtctgattactgactccagataaattcctaagagaattcctaagtcaagcgatatgcatattttaaatattggtgcatttctatagggtccagaaagggagtaccaattaatatctgcaacattttctgaaatgtaaacatatatgagttaaaccaatagaacattctgtcctaaggctgctttcccctctaggggtcctgttctgtcggcttgaactcaaatggtttccctttccctgtaaagcatggagctgtgcataacactggcaccccccttctgctgtgggtcatctaatgtagccagttgtggcctcaactgtcacaagaactcaatggtgcatcacaatccattctgaaggattccatgttaaattattattgagaagcaaaatactgtttaaaatgacttagatttcttgttggtgatgaggtttatgtttgcttgatttggtttgatttttagtaaattaaaatagattcaatgatggctcaacaatggcgcaccacttacactggcatgtgcttttctcagtagaaagaaagagctggaatgacaacctgcagctgtagtcattgtgagtggttattgcgaatgcatcattttaaatgatagagggtgcaaaatggtccagattttaattgtttgcaatattcatttttgagtttgccaaaatatgggcatgcctggggagtttattattgtgtcaacatcatcggtcacatgagccatgatggaaaaatgattgtgaatccctagtatgtaaccctggtgttcttctaggccaggcaagaaatgctatggaagtgtttatatataacccgttttatctataccttaatgcacaaaggggtaagaaaatattgatacgatcattgccagctagaagtaattgttctgcttttcaaactaaactactttttttgttttagtaagaaaaatatgcagctatacctggacatccagggctacctggctcaccctttggaccaggtggaccaaagtgactggcagggtcacctttgtttcctgaaagggataaaatgcatgtgacattactttagacaatttaatttggtctcatacaggtgacagtaacgtttatggtatttgtatagcttatcttcagatattttaggagagtgtttttaaatacttttattctaaataagaacaaatagaaatatagatgcaagatgcaatttacataccacacacacacacacacacacacacacacacggttttagaatacatcacaatcataaggatctccaggtattgataagtttgagtttttaagtcctgaaaaaattttcaactttaggtttctatttaagaaattatttggcattgagtggctatatccttatgttttagaaaccaaaatcaaaaattgtaactgttttcactgctgcaatcatatttcaagctcttttataaggcagctcaactcagtgtccttgcaaaaagaaaatcacaaaggcatactgcattgatgacaagagatggcacattcaaaagccactgtaggccatgactcccacagtcccacaaagctactggtcactccataatgcttccagacacaaggacctacattatggttgggagccagtttgaagtggaggactcaaaatggagtgggaggaaaggcaagaaaatagatggggtttcaagagaattacagaggtaagttagatgtatcttatagtaactgcccatttacactcctttctaaaggagttccaccagcaccttgtggaagtctttctcctatctgattttactcataataatggccaattgcttgaggggtgggattctggcccattccaggtcaaacaagtctttccttgagaagatggaataagaaagtgagaatttgaagtccttggctactggggcagaaaccaaaagcattatcatgagctgtcctgatgtagaacatattggagtacaacccaacatatccagaaatatccagaaaagatactgtgtagacagagatgaagccagttggtagacaggtaagtgaaaaaatagaccatgggaaaaagtgagaaaccatggattgactaagggctagggttcctttagctttggcagaactatgtctcctatctgtgggatccatgagacatctttgactccaggtattttgagtgcatttcaattccttttaagcatggcccaatacaagcatgaaggaagtgagaagaggtaggtttttactgtgaaagaatggtaaagagactaataaatgtataggtaagcagaaaaggagtgacttctgaaccccaaagttataaaatatcaaaatcaaatataaaactttttccatttgtaaccatttcccaagaagggatctatattattctttctgaagaaataagcccacacaggtcatgtttgttatagcatttagtatattatttatagagtgtctctcaaagtagtaaggcagaggattgtaggtcattcattaattagtattttatattttaaatttcttttaacttatatcaaaataaaggataactgcatgttaacctgtgaatttacagctagttacgctaaggctaaggttaaaaaggtaaatcattttaaagtagatttaaagaaaaatattaacccaatggtataccaagatagtaaaactattaaaggttttatgcaaacattgcaactaagatatcctgctctttgtttgtttacttgtttgtctgaataaagggttaatgaagcctctctttcactagaatgttaggtgtgttacaatgcagcactgtttttgacacaaggtaaactaaggcccgtggggccaaatctagcctgcagccaattttgcaaataaagttctattggaaaacagccacactcctttgtttacatatagcctatggctgctttcacactataacaacacagttgaatagttgtgactgagaccatatggcccaacaagctgaaaattgttatgatctggccctttaggaaaaaaatattttgctatagtaaaaaaataataataataataaaaaacccaattgtaaattacatctatcttgggacttcttaagtgaactcttagcacctgctggaaagtcatggctttagcctctatgtcctaactgggactctaaaagctgtacttatgaagtccttagaaaagatactggctcctgcgggacatagggtttctaagccaaagtgggcacggcccactgacatggatctgttctccttgcaactgagctgttacttgaggggctgcagtcactccatggactgctgctgggactctcacagaggaggaagacacgaagagcctgcaggcatgctgttttctatctgatacccttggatctgagtgacaactgtagaatatttggatcttgagtgtttgactgtctaacaagagccccttgggtgttgcagtttctttgatacactttgcttatcatgtaaaaggcacttgtttacaatgttataaacattcgggactatgcatttgacagatggcttctgtatctccaaaccatacctttaggtcctcttgctccatcaattcctgaaaatccagggggacctggagaacctggctcaccctgacagtttaatgaaacaaaaggccttaatcagatttcaaatacaaatggcacatgcacaacacgatccagttgtaattttctgtaactaatttggtttttgtaatctgcagtggtaacgaaagtttaaatgcatgcaagcctcccactacatgtatctagtttttcaaagttgatatagcttctccagaattagagttctcagtcgcaactggtagcatcccattctctacacttggttgtgaaacagtaattgtgttactaatttgaattttaaattacaaataaacaagttgatactaaataaaatagtattataaatcacagcatatgaaagactttacaaatccatttcattccaaaagatggatagtgagttacgtgttttccagaagtataatgttggcaactacatgtattgtacctcctggattctgaaagggtattttactcatggttgtgaagacgaaatatattgaaagcaaaatctgtgatatctgaaactggaagactttaaagacaggatttgggtgatttttcaggacgactttcattccagtaaaccagtggtcatgaggcaagtcttcatgggtggtttaaaccaggctgggagatagcgattatatgactctatgttaggggaaccaggcaggagcactggtcagaaatgtcagtttcatcgtggccttctagaaggctctattttctccttgagctacaccttacattctaaaagccagtgaaagggcaatggtatatacgctggcaaattatagctccttacggacatcctaagaacagaaaggttttattgtctcttcccccacaaagcagtagccccttacctggtcacctggaagtcctggaaaaccaatgaaccctcttagaccagttgagcctggagggcctgggggtccaggaggccctggctgacctttctcaccaggttcccctctgtgaaatccaggtggtccgtatcttcccggctctcctcttctcccttgcatcccgggagttcctttatcacctgatgaagttggaagtgttacaggtctctgctgaaattttgagctaggtaatagttaagctgagggacctggtcctacttttaggagataaagccaaaggtattgaggattctgattgctgtcccaagccgcttcctgatcatttctggcttcagtgacctcattgatgaaagaagctgcctgggaatatctaaggactatcagaggtgggaaggagcacacaggattatttgcctccgctgcttattttacaaatgaagaagcacttacccagaaaagttaaaatatttgccctctaacaactagctgagagaagccaagatgagcacctcatgcagactaagtctgaccttggaggagcacacaaatggggttgtcaaaaatcctcgctctgcaatgtttctgtggaccattagcatgggcattggggtgtctgttagaaaggcaggatacctggctgccccagagctgctgaatcagaatctgcattttaacaagctctccaggtgattaatgtgctctgaagtttgagaggcactggtcacaatgacttgaacagtcattgcgctattcactttaaaaccaactaccaaacctgaaaccagtattttatgtatagctcaggttgatcccagtttagaatatccaaatctaggagtacacaggaacttcagctaaattttagcatggagaagcaaaaaatgtaccacaaggtttatttgtgtttatttatatctaaaaaaaatggccttttctcacagtggttcacgcctgtaatccagcattttgggaggccgaggcgggtggatcacctgaggtcaggagtttgagaccagcctggccaacatggtgaaacccccatctttactaaaaatacaaaaattagccaggcgtggtggcatgcgcctgtaattccagctactcgggaggctgaggcaggagaatcgcttgaacccgggaggcagaggttgcagtgagctgagatggtgccactgcactccagcctgggcgacaagagcaaaactccatctcaaaaaaaaaaaagtcttttctaatctcagtgttattggggaaagttgcctaacaaatgtgatctgtaaaaatgtcaacttatttgatatggttaaaaactcttaagtgtttacctctttctcctgggaatccatcatctccaggaggtccaggttccccaggtgttcccttttgtgaaatgatagccatttctccttcatctccgggaggtcctatggctcctatggatattaattatgcaagaacaaaatgaacaggaacatcacacacataatttatccattactacatttcactcccaaatcgcaaattcccacttaacctacgaagctctatttatgtagatcacaaaatgtcaccattgttggctgatttcctaaaggaaggtcagtcatcttttacgttcctgaccccatttgtccagccacagagtctggtgtgccaggagtgctcactgaatgtttgccaaattcaaccaaactggtcggggtcttcactgaggttaagacagatttgaaaagttccagtctaaaaaaatgtcgctttgttctataaaatttggatttgcccatctcatatttccagttccatatctcctcctagccatcctctcttactttccttatattaaaagaacagacacttatctcaatgtggtacccctcacactgacttctgaaaggtaggaagggcataccgtacttctgcctgattttgcaaacactggccagctgtagcaatgtgcaggcgtgggctcctaccagcttgacgagtgccagttaccacaattcaagaaccctgcaagccagttgttaaaccattgctaactttaaatcagccgtggcaggagtatttatgccatgacactcagcaaacactataaaccacggtgctttttttttttaatttcaaagaactagtttactagcccatcactggcgttagtccaaattttaatttttagtgggataattgtatagtagcataatagcacagcaaacatcacttatctaagctagcaaagagtgactctttgattctttgattccacataaataatttacaagctagtaaaacaaaaaattgtggtagaatcaatcaactaagaagaaaaggtaattttaattcaatatgaggctacttgcccaaaaggccttaagggcaaaaatccttgggtctgaaaattgtcaagcattttttctcaacactggaaaggaaatactaccttcacccattagagccacaggactaaggagtaggagtaaatatttaacagggatggggacataatatttaaaccattggtctcaaaacttatttttcatagtaaagaaaacatttttttctttttctttttttttttttttttttttggagacagaatctcactctgtcacccaggctggagtgcagtggcatgatctctgctcactgcaagctccacctcccaggttcacaccattctcctgcctcagcctcccgagtagctgggactacaggtgcccaccaccacacctggctaattttttgtagttttagtagagacagggtttcgccgtgttaccaggatggtctcgatctcctgacctcatgatctgcccgtctcggcctcccaaagtgctgggattacaggcgtgagccaccacacctggccagaaaactttttttttcaaatgaagcttggggaaactctactcgtggcccagatgaaagtggactcatggtagttgagaagttggcaaactgcagcccatgggccaaatccttcctgctgccagtttctgtacagcacatgagatgcgaatgatttttacactgtgaaatggttgaggggtaaaactcaaaaacaaggtaatatttcatggtgtgaaaattatatgaaattcaaaccttagtatccataaataccatcttactgaaaattgtattttatgtttgtttctgtgttgtctatgtctgctttcatgctacaaaagcagacttgagtcgttgtgacagagaccagatggtctgcaaagcctgaaattgttattatcaggctttttacaggaagagcttaccaacttctgttctaactgaaacagaggttggagaacaagagccccctttcccaaaaggtgagaaagttctttgaaacctagaagctataaatcagtgcattaagaaccacttgttaattctttttcaattaatagagcaattcatttgccatctatatgtaataagattaagaggtaaagaaaatgaattttgtttaaaattctaaaacaaataccatagaactaaaaggaggaggaatccaagcttcagacaagtcctattttatttttcagagatcacatttctaggtttggatcaaataccagaaacaaatgcatgttgcatggctgtattttatttacctttggcccctctcagtccccggtctccaggaaggccagacatgcccttctctccaggttctccctttgcgccaggacatccctctgcaccaggctttcctctttctccgggaaaacctgggaaaccaggcagcccccggggtcctggtgaaatgagagcataaagttttaggaaaatattttatttgttatttattttttcaggggtgggaggtggacagagtctcactctgtcacccaggctgaagtgcagtggcacgatctcggctcattgcaacctctgcctcccaagttcaagcaattctccttcctcagcctcccgagtagctgggattacaggcgggagccaccgcccttggctaatttttgtatttttagtagagacggagtttcaccatgttggccaggctggtctcaaactcctagcctcaagtgatccacccgcctcagcctcccaaagtgctgggattataggtgtgagccactgtgcctggccctaggaaaacattttacaggctagtatgattcttatatattgtgttcctcgtagttcatctacagatgcaaactcctgcctaacgctgagtttgtattcaaagtaaacaattgccaacctcactgcacttagtagctgggctcagttgggcacggtgactcagacctgcaatcctggcactagggagaccaaggcaggaggatctttgaggccaggatttcaagatcagcctggctaaaatagcgagatcctgtctcctaaaaaaaaaaaaaattaggcgtggtggcacatgcctctcaggaggctgaggtaggaggatcacttgagcccaggagttcaaggctgcagtgagctatgatcctgccactgccctctagcctgggctacagagcaagcctctgtctcctaaaaaaaataataataataaaataaaaaaataaaataaaaattccatgctctgccgccccatcctcagtttcctacctacagacctgaagtgtgggccctgatgtgtctgagtcctaatcccctaacagggggtagggatgagagtggggaccccctccaaaatgaaaatgcacccttcccgaccctaggagtttaccgtgctacccagtcttcatgaattctgtggccctaacacctacaaaccccttttcccattgaccggtacagaaacatttcgccactggaaataacgatacagaggacaagagcaagggaggcatcattaagggaaggacaaagccagactaacagttaactctttttgtgtggtcatctgtccagtcttcacttggcagtggatttcatgtttctaagatgggaggacatcatggaaaaagcactacctaccctttggacctggaggaccaggtagcccatcatctccaaagggacctgggattcctgggaggcctgggggaccatgtgccccaggccgtcctgggagtccggggaggcctttcattccagctggcccgggaggccccacatctcccggctgtcctttcccacctggagcacctaagacaaaccacagtgaccacagtgtgtgaaggctgaacactggcttcacacacagcaggaaaaatatacagtagcttaaacaatgcgttaaacaacagtaaagcaatatttgttggctaaaataacagtagcaactttccatcaatctaagaatatatttttctagatgccataaatagaagggcagatcatttgagtaaatgtttcccagtagggatgaatgtagattataaaaaatatttttaacagaaaacaaaaagaaaaaacaaacatgtatttgtatttcctcttggtggagggaaactaatagaagaaaactttccaggtttttcctgaagctctacagccgagaagaagtcagagccggtgtctaacattattggtgctagaaatatggctgtagcggaaagttttgcctcaatctggttttaatttttcaagtgcgtatattactgcatttggataaaagcaatgggatttaaatgacagagtaaacaatgtgaatagtgaaatgaagatcatattgaaaatagcccctgctatgttctgaatgtgtccctccaaaattcatatgttgaaagttaatcaccaatgtgatagtattaaaaggtgaacacttggggaggtgattaagtcataagggcagagccctcatgaataagattggtgaccttattaaagaggtgcaaaagagctgtttgccccatctgcctgtgaggacacaaggaaggcacaccaaatctgctggcagcttgatcttggacttcccagcctcctgagccataagaaataaatttctgttgtttataaattgcctagtttaaggtatttggtagagcagtgcgaatggactaaggcagcctccctgcaccttgtattaggagacactccaggggtctcttgtgttcctacgtcttcctgggtatgccaagaatgcaagatcctaatgctctttacctgggaaacttctcaagcttgtgtttgcagcaagcacccttgataaatgatatagcactttcctcaataggaaaagcaggctttctcacaggttgctataaagcagtggttccttggctcagggctcctctcatgtaatgcaacccactgtgtgtgtggccaactagcccactacattgccccataagacttgggtgacatgggggaagtgatgcaaaccaacatgaaactcatgagtaacgaagtcctttgtctctgactcaggactcttgcttctggcagcatccataaaagagtaaaaggggagcttatttaattgtaagtagggtaagccccagacccttcacagttcttgacacttacctgggctacctggatacccagggagtcccggttgccctggtatccctggagcacctctttcacaggaatggccaggtggacctgggacacctggaaacccagcatgtccctctctgcctttgggacctttgagacctaggaatccaggaatgccagctggccctgaaatgatacaatacatccatgacattcatgacaaaaaactatacagatggcccatgatgaattgttcacgcatatcaatactggaggtgaacattttcatcctgaatcagtgttcaaatgggttaagtctttgagtggattttcttatcatagatgtaatgagttccttatgaacagagaaacaacgcattgctaagtgagttacttgataaggttatgtggactgcagttgcctatgcaaataagaaaccacttggttcttcctaattttaattaacctctaactttgcatcaggctttacatcaaatctctacaatatttacaaacccagtttgcactgtatgaatttgcattttatgagagatttcatcacttgtattctcaaatttctactcactagaaagacagggtcataatcttcaggaaagaacatcccccataattccacaccctaacccaaaaatctactttgttttcctatgttttctttacattttggttcatatgtttacatttaaaaatagtaatcagtgcaaattcagttgttggagcgcttcagattgcatattaatctgcaaatgttttccagtttgttgcagtctttacaaatatgatttaaattgctaatggctggatggtattcctttgagagatagagtgtgtgtgtatgtgtgtgtgtgtgtctgtctttgttctttccaattattcctctgctgtggataatactacaagggcattttcatatctataaccttcttccattgaacacttcccttagatatattttcacaagtgagatagtcggattactgggtcattatttttattgacttacattatgtttcacctgttactttccaattaattgtttctttcaatatgaatctttttatttacaaacttccatgcaagctccttgagggtgctaattctcctcctctcctccacgtgtcctgtgctaatgtactctagtggatgcctaataaacactggcccaccgacttttagaaaagaaccagaatgttctttgtaaacatctgatctgtggttcacatcttgatcaccatcacccaagaggcccactgaagttcagaatgtggggccccaccccagaaataatgaatcagaattcctcagactggggtcctgaagacaataattttaatgagctgccccacccccacttggttatttttaagtacattaaaacctgaaaaactccactggggatcctgaaggatccttactgatttcagaaaaggatatgaatcagtgtccaggccatcttcctctcttgcgtttgatgccctcctgccaccccaaatggaatgaaggtccctctaccctgtctcttgtgcgaagacagcttgtcctctaggctcagctcatacccggctctcccatagagtgttcccagatgccagctcacagctccagcctctaagccactcttcctctcacaatcaggcctgcctaccttccacctggcaacagccccagacaggttacacagtccctgctcttggcctttgcagcaccaacatactagctgcggaatcaaattgagttgaatgaaccacagtgagctgccctgcatttgaaaacaatcaataaagtgcaaaggcaaggctagagattcaggttatttgaaatgtaaccagcaccccaaatgagggaaaacacttgggtaaactgtttatattctacatgcctaaagcaaaataatctaaacgttcttcagtgacctgttccaaaactgagccagctctatgcaccaaaaggacagcaaagccctcataccttcagcccctggacatcccggatcacctctgggtccttttatccctggcactcctgaaagacccctctttcccgggggtcccaggtgaccaaatgcagggtctcccgggattcctttctgaccattcactcctggtgagccgggagggcctgggggcccaacaggggaggaccccttttcacctccaaaacccggatctcccatgtcaccacgaaaacctatttaacaacaaaaaaaaatttttaatgataacatgtgcaagtatagaaccaatacatataagacttactttgataaaaatacttttcttaaaaacacaggggtacttactaaaattaagagcagtttaacagtaatgttgttttgccaccttttgtagagagagaaactgcaactttgtgtttcctataagccaatgatgtttccctaattgctttccttctctggcaaacattctggctggactgagtagtttcaacaacataatagacaaataatagcccacaacttatgcttcaaggtgtaaggagccttggcaacttataaaattataatctgaaagttatcacaatatagctaagggtctatcaagaaacaccatttccctattatctagggatccctggaccatttcctcaatgaaattatccatcggtagaaatgttaaaaagttcctgatagatattcccaaagcagaaaaaaaaaaaaaaaaaaaaaaaacctcactgaccaggtggacctggtatttccgctgttcctggtgtgccaggtctgcctttatgcccatctgaaccactcagcccaggggcaccttggggacctggaaatcccttcggacctaaacaataataaaaacaaaacacagactcaataaaacaaaatctaatgtgaacaaaatgagatgattttctttaagtctatgttaagtccttttagaatatttctactttatggaagtaaggatgttgcctatcccgatttacaaaaatatattgtaagtcatatgctccaaataaatgttttctaggagtgattttgttaaggcactttctcagaagccatcctgtgaaggattcttcctgaaagcctttggaacttgtaccaccattcaggtgactttttttggtatcttcccatgctaggtctgaaacacgactatgcaaccattgtctgcccttgtaggggtaaagaggtggtggccagtgtctaccttgacaagaaaggatcagattaaagaccaaaatctatttccctgcatcttactgaatttgcccttaaatgaagtataggcaaaaagcacttgcaaaaagtaatagagaattttttttttttttttttttgagacagagtcttgctttgtcaccaaggctggagtgcagtgacgcagtctcggctcactgcaagctctgcctcctgggttcacgccattctcctgcctcagcctcccaagtggctgggattgcaggcgcccgccaccacgcctggctaattttttatgtttttagtagagacagggtttcaccgtgttagccaggatggtctcatctcctgacctcgtgatccacccacctcggcctcccaaagtgctgagattacaggcatgagccaccgcacccggcctagagaatctattttaaaccttctgtgattttctacaaggagttatctcagctaaaataacttataaatcataaacttcaatggaggcacaactgtcaaattaaaatgtgagtattcacttctctcgaagttacagctgctgaaagaaatcaaacttttttttatccacccatgaccagtaaaagtaaaaatgaacgttcaatccgtcaacctgcaattctccactctgctgatacggaattatatttccgcactcttgccattgccttgtggtgggcggagtgtaattccctgcccttttacccagggcttggtcatgtgacttgttttgggcaataggaaatgaatgcccatgatccaatcagaggtgtggagggagcctgtgagctgagctggccctcttgcatttctgcaatcacatgagaaaagcctggccttgcaatgagatgcatgttgcaaccccaaacctaacttggagctacactctaagccaacagagaccatcttagatcagctaaacccaaccaacctgcagacccataagatagaaaataagtgtttgctgtagcccactgagattttgagattatttacacattattgtcataaaatttgatggtagagagagtaacagtcagtcattattcatactagtaatgaacgggtagggaactctaaagaaacaaagaagagttaggcaaaatatcttagatagattttggatttaattcatctaaaaataagtgattgattcaaatgaagctgttgcatgaatgtgcaaacaaggacagagatatttgggcatttttttcaaatgtttctgatcaaatgttggttctcttggaaagtaaaacttacaatcaataaacaagtgatcatgattcactcttgaggcacaggaaaggaaagaagatacagttttaaaactttcaggctgggtgcggtggctcacacctgtaatcccagcactttgggaggccgaggtgggcggatcacaaggtcaggagttcaagaccagcctaaccaatatggtgaaaccctgtctctactaaaaacacaaaaattagccgggcacggtggcgggtacctgtagtcccagctacttggaagactgaggcggaagaatcattgaacctgggaagcagaggttgcagtgagctgagatcacaccactacactccagcccgggagacaaagtgagactccgtctcaaaaaaaaaaaaaaaactttcaagggacagacattttaactgatatgtgagcaaatcaaggtaaattttattgtacaaagatttgaaaagcccatctggagtgttctcaaaccagcagactagaggcccaactacaaattactacaaatgctgttttcccctatccatggtccctcaaaacttcagaaatgtcctaactagtctgaggattcactcttggtttatctgtctggctggtttttttttttttactctgggaagtatataagacagtaacttctcattgataatacctggaggtccatcaaaacctggagggccatgcctcccagggtaggttacgttgcaagaaattgtgtcacctgcaatgagaaaagaaaagcggcattcacataactgatagcccagtgcaatgtgagtctgtctcaatgacaacttcctcaagatatttttctgtatagtatatgcagaagtcaaagaaaaagaagactcccaagtatcattagatcacttaagctgctttcatacagaatttttagatttttcctgaaatctgaatttcaactgtcagaagagttataaacgtaagaaaagaaatatattgattataaaaagtataagtttcaataatctataaaagcaatgtagatgataaaaatgtaatggagatgaactacatgggtagtagataataataataatgtaatggagatctattacatgcatatctaacacaatagaatgagaagtctcgataaatcataaaatagcagcaggtgtccaatgctgagttcagaaaatctgactcttactatgaacatggagaaattgtgcaaatgaagaggctgggctaaatgtgaatagctaccacttattgagggttggtgcttcaagtatattgtctcatttttctaatgacttcacaatctagtagcatcatcccccatgttaaagaaatgtttaaagaaagttaataagcagttgagggtctgaatgaaaaattttctagagagatagatatcaccaataaaacacccaagtttgagcctctcagttccctctcagttcctgtatcctaaaatggaatttttctcttttatattaggaataatacctcatagtgcatttctttatatgctctcagatctaagatatatcagatgaataaaaatgacatcagattttgttgggttctagaccatgaatttataccttatcaaataccaagatacttgcttgcctttctgttatcaaaacaagaacaaaggatattactttgttctaaaacttcacaactagcaatgtagttcaagatatatatataatacatgttacaaaagaaaaaaacttaaaccttttttgccaccttcttaagagttttcagctataatcctgaaagtcattttattgtttgaaattcacataactgtaaaatatatttaaaataccttcttttttctcactagaatgccaacaaatggtttttcatggacaatgatagtttaaatgagatactagtttttaaaaattaaaatatatagtattatctcaaaagactataaaaataattctatactttgagtatgtgtatataatatatatacatatatgtaattttaatatagtcagattgtatgagttcatactgagaaatgaaggaaaagcaattttggtatgtcaaataaaacaacaaagatattttagcatcttaaggatttactttaaatattgtgttgtaatgcttttatttgtttaacaaggtacaaggtttgaacagtgcctggatcaaattttatgtagctattatgccatagctataataattttgcccagaagagactcattttagcttccatgattttatgtgacattctgccacagaaatattcaaaattacctttctgggtgaaaacatcataaataaatttaaaaagcaattcaggatatgaacaaaaaaattctctagacagatatcatcaagaaaaactaatccgaactttgacaaatgaaaaacatactgagggaattacaaaatgcagtggaaagttttaacaatagactagaacaaaaagaatttcagagctcaaagacaaggcttttgaattaacccaatcagacaaaaataagaaaaaaatgaacaaagactctaagacatatggtattagtaaaacagccaaacctaagactaattggcattcctgagggaaaagaaaaaagaactaatttgaggcagttattgaggaaaacttccatggcctggctacagatctagatatccaaagccaagaagcttaaagaactcctgggaaattcattgcaaaaagaccttcaccaagccatatagttatcagactatctaaattcaaaatgaaggcaagaattctaagagcagtgagacaaatgcatcaggtaacttataaatgaaaacctatcagacttatagcagacttctcagcagaaaccttacaagccaaaagggattggcatcctatcttcaacctccttaaacagaacaactgtcggccaagaatttcgtattccacaaaactaaatttcataaatgaaggagaaataaagtcattttcagacaagcaaatgctgaggaaatttttcactacaaaacatgcactacaagaaatgctaaaagggaagatggccgaataggaacagctccagtctacagctcccagcgcgcgcgacgcagaagacgggtgatttctgcatttccatctgaggtaccgggttcatctcactagggagtgccagacagtgggtgcaggtcagtgggtgcgcgcaccgtgcacgagccgaagcagggcgaggcattgcctcacttgggaagtgcaaggggtcagggagttccctttcctagtcaaagaaaggggtgacagagggcacctggaaaatcgggccactcccacccgaatactgcgcttttccgacgggcttaaaaaacggcgcaccaggagatcacatcccgcacctggctcggagggtcctacgccaggctgattgctagcacagcagtctgagatcaaactgcaaggcggcagcgaggctgggggaggggcgcccgccattgcccaggcttgattaggtaaacaaagcagcccagaagctcaaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacacagctggagatctgagaacaggcagactgcctcctcaagtgggtccctgacccctgacccccgagcagcctaactgggaggcaccccccagcaggggcagactgacacctcacagggcccagtactccaacagacctgcagctgagggtactgttagaaggaaaactaacaaacagaaaggacatctacaccaaaaacccatctctacatcaccatcatcaaagaccaaaagtagataaaaccacaaagatggggaaaaaacagagcagaaaaactggaaactctaaaaaccagagcacctctcctcttccaaaggaacgaagttcctcgccagcaatggaacaaagctggacggagaatcactttgacgagctgagagaagaaggcttcagacgatcaaattactccgagctacgggggaacattcaaaccaaaggcaaagaagttgaaaactttgaaaagaatttagaagaatgtataactataataaccaatatagagaagtgcttaaaggagctgatggagctgaaaaccaagcctcgagaactacgtgaagaatgcagaagcctcaggagccgatgcgatcaactggaacaaagggtatcagcgatggaagatgaaatgaagcgagaagggaagtttagagaaaaaagaataaaaagaaatgagcaaagcctccaagaaatatgggactatgtgaaaagaccaaatctacatctgattggtgtacctgaaagtgacagggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcaaccagagagaaaggtcgggttaccctcaaagggaagcccatcagactaacagtggatctttcggcagaaactctacaagccagaagagagtgggggccaatattcaacattctcaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaataaccagctaacatcatcatgacaggatcaaattcaaacataacaatattaactttaaatgtaaatggactaaatgctccaattaaaagacacagactggcaaattggataaagagtcaagacccatcagtgtgctgtattcagcaaacccatctcacgtgcagagacacacataggctcaaaataaaaggatggaggaagatctaccaagcaaatggaaaacaaaaaaaggcagggattgcaatcctagtctctgataaaacagactttaaaccaacaaagatcaaaagagacaaagaaggccattacataatgggaaagggctcaattcaacaagaagagctaactatcctaaatatatatgcacccaatacaggagcacccagattcataaagcaagtcctgagtgacctacaaagagacttagactcccacacattaataatgggagactttaacactccactgtcaacattagacagatcaacgagacagaaagtcaacaaggatacacaggaattgaactcagctctgcaccaagcagacctaatagacatctacagaactctccaccccaaatcaacagaatatacatttttttctgcaccacaccacacctattccaaaattgaccacatacttggaagtaaagcattcctcagcaaatgtaaaagaacagaaattataacaaactatctctcagaccacaatgcaatcaaactagaactcaggattaagaatctcactcaaaaccactcaactacatggaaactgaacaacctgctcctgaatgactactgggtacataacgaaatgaaggcagagataaagatgttctttgaaaccaacgagaacaaagacacaacataccagaatctctgggatgcactcaaagcagtgtgtagagggaaatttatagcactaaatgccctcaagagaaagcaggaaagatctaaaattgacaccctaacatcacaattaaaagaactagaaaagcaagagcaaacacattcaaaagctagcagaaggcaagaaataactaaaatcagagcaggactgaaagaaatagagacacaaaaaacccttcaaaaaattaatgaatccaggagctggttttttgaaaggatcaacaaaattgatagaccgctagcaagactaataaagaaaaaaagagagaagaatcaaatagatgcaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaactaaaaagggtccaggaccagatggattcacagctgaattctaccagaggtacaaggaggaactggtaccattccttctgaaactattccaatcaatagaaaaagagggaatcctccctaactcattttatgaggtcagcatcatcctgataccaaagccaggcagagacacaaccaaaaaagagaattttagaccaatatccttgatgaacattgatgcaaaaatcctcaaaaaatactggcaaaccgaatccagcagcacatcaaaaagcttatccaccatgatcaagtgggcttcacccctgggatgcaaggctggttcaatatacgcgaatcaataaatgtaatccagcatataaacagaaccaaagacaaaaaccacatgattatctcaatagatgcagaaaaggcctttgacaaaattcaacaactttcatgctaaaaactctcaataaattaggtattgatgggacatatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattgggaaaagaggaagtcaaattgtccctgtttgcagacgacatgattgtatatctagaaaaccccattgtctcagcccaaaatctccttaagctgataagtaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaatattccatgctcatgggtaggaagaatcaatatcgtgaaaatggccatactgcccaaggcaatttacagattcaatgccatccccatcaagctaccaatgactttcttcacagaattggaaaaaaactactttaaagttcatatggaaccaaaaaagagccggcatcgccaagtcaatcctaagccaaaagaacaaagccggaggcatcacactacctgacttcaaactatactacaaggctacagtaaccaaaacagcatggtactggtaccaaaacagagatatagatcaatggaacagaacagagccctcagaaataacgccgcatatctacaactatctggtctttgacaaacctgagaaaaacaagcaatagggaaaggattccctatttaataaatggtgctgggaaaactggctagccatacgtagaaagctgaaaccagatcccttccttacaccttatacaaaaatcaattcaagacggattaaagacttaaacattagacctaaaaccataaaaaccctagaagaaaacctaggcattaccattcaggacataggcatgggcaaggacttcatgtctaaaacaccaaaagcaatggcaacaaaagacaaaattgacaaatgggatctaattaaactaaagagcttctgcacagaaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacaatgaaaaaatgctcaccatcactggccatcagagaaatgcaaatcaaaaccacaatgagataccatctcacaccagttagaatggcaatcattaaaaagtcaggaaacaacaagtgctggagaggatgtggagaaataggaacacttttacactgttggtgggactgtaaactagttcaaccattgtggaagtcagtgtggcgattcctcagggatctagaactagaaataccatttgaaccagccatcccattactgggtatatacccaaaggattataaatcatgctgctttaaagacacatgcacacgtatgtttattgcggcattattcacaatagcaaagacttggaaccaacccaaatgtccaacaatgatagactggattaagaaaatgtggcacatatacaccatggaatactatgcagccataaaaaacaatgagtgcatgtcctttgtagggacatggatgaaactggaaatcatcattctcagtaaactatcgcaagaacaaaaaaccaaacaccacatattctcactcataggtgggaattgaacaatgagaacacatagacacaggaaggggaacatcacactctggggactgttgtggggtggggggaggggggaggggggaggatagcattaggagttatacctaatgctagatgacgagttagtgggtgcagcacagcagcatgtcacatgtatacatatgtaactaacctgcacattgtgcacatgtaccctaaaacttaaagtataataataaataaataaataaataaataaatgctaaaaggagttctaaaccttgaaacaaaagcctgatatgcaccaaaatagaacctcttgaaactttagaactcacacggcctataatacaataacacaatgaaaagacaactatctgggtaacaattaacatgatgaagagaacaatacctcacatctcaatattcatgttgagtgtaaatgctccacttcaaagatacgggatggcaaaatggacaaaaacaacacaatccaaatatctgctgtctttaagaggctaacacagaaatactcatataaactcaagataaaggggtaggaaaatgtattccatgcagatagaaaccaaaggcagcagggatagctattcttgtatcagaaaaaacaaacttcaaaataacaatagtaataacaaaaagacaaagatggtcactatgtaatgataaaacgatcaacaagaagatactacaatcataaatttatatgcaccaaacactggagcttttagattcaaaaaacaattactactagacctaagaaatgagatagacagcaaaacaataatagtgggagacttcaatacaccactgacagcactagacagatcttcatgacagaacgtcaacagagaaacaatggatgtaagtgacacactagagcaaattaacttaacagacatttacagaacattctacccaagatctgcaggatatacattcttctcagaagcatggaacattctccaagatagaccatatgacaggccacaaaataagtctcaataaattttttaaaactgaaattgtatcaagtatcttctcagaccacagtggaataaaattagaaatcaactccaaaaggaaccctcaaaattatacaaatacatggaaattaaataatctgctcctgaatgatatctgggttaacaatgaaatcaggatggacatttaaaaattatttgaattgaatgataatattgacacaagttttcaaaacatctggaatacagcaaaagcagtgctaagaggaaagcttatagtgctaactgcctacatcaaaaagtctgaaaaagcacacattgacaacctaaagtcacacctcaaggaactagaaaaacaaaagcatactaaacttagagctagaagaagaaataacaaagatcagactgaaccaaatgaaatgcaaaccaaaaaaatatgaaaaattaatgaataaaaagctagttaaaaagccgtttccttgaaaaaataaacaaaatcaatagaccattagctagattaaacaagaaaagaagagagaagatccaaataagctcaattagaaccgaaactggggtcattacaaccaacaccacagaaatacaaaagaccattcaagactactatggatacctttatgtacacaaactaggaaatctagaggaaatggacaaattcctggaaacataaaaccctactagattatatcaggaagaaatagaaacctcaaacaaaccaataacaagcagtgagattgaatcagtaatttttaaattcccaagaaaacaaacccagaatcagatggattcacagctaaattctacttagacactgagagaaaagaattggtacaaatcctactgaaactgttccaaaagattgataaagaaggcatcctccctaaatcattctattaagctagtatcatcctgataccaacacaggaaaagatacacacacacacacacaaactacagaccaatttccttgatgaacatagatgcaaaaatcctcaacaaaatactaaatgaattgaacagcatatcaaaaagagaattcatcatgatcaagtggttttcatcccagggatgtagggatggtttaatatatgcaagtcaataaatgtgatccatcacataaacataattaaaaacaaaaaccacatgatcaatagatgcagaaaaagcattcgacaaaatccagcattcctttatgacaaaaaatctcaacaaacaaggcatagatgggacctacctcaaataataataactatgtatgacaaacccacagataacatcatatggaatggaaaaaagttgaaagcattccccctgagaacaggaacaagagaaggatgcccactttcaccactcctattcaacatagttctggaagtactagccagagcaattaggtaagagaaataaataaacagcatcaaaattagaaaagaggaagtcaaactatcactgtttgccgataatatgattgtacacttacaaaatcctaaggattcttcaaaaatactcttagatatgataaacaaattcagtaaagtctcaggttacaaaatcattgtacataaatcagtagcattgctatacaccaacaacaatcaagttgagaatcaaattaataactcaattccttttacaacagctgtgaaaactaaaataaaataactaaaaatatacttaaccaaggaggtgaaagttctcaaaaaggagaactacaaaacactgttgaaagaaatcatagatgacacaaatggaaatgcatccagtgtttatggattgggataattgataatgtgaaaatgaccacacttcaaaagtaatctacagattcagtggaattcccatcaaaatatgcacatcatttttcatagaattagaaaaaacaatcctgaattttgtattgaaccaaaaaagagcctgaatagacaaagcaatcctaagcaaaaaagaacaaatctggagacatcacattactgaacttcaaattatactacaaggctttagttaccaaaacagcatggtactgttgtaaaagtaggcacatacaccaatggaacagcacagagaatccagaaacaaagccaaatatctacagctaactgatctttaacaaagcatacaaaaacaaaaaattggggggtggacaccctatttaataaatgatgctgggaaaactgccaagctacatgtattagaagaataaaaccggattcctatctctcaccttatacaaaaatcaactgaagatggttcaaagacttaaatataagacctgaaactatcaaaattctataagacaacattggaaaaactcatatagatattggcctcagcaaagaattcatgaataagaccccaaaagcaaatgcaacaaaaactaaatacataaatgggacccagttaaactaaaaggcctctgcacaacaaaaaaaataaataagtagagtaaacagaaacccacagaatgggagaagctatttgcaaactatgcatccgacaaagggccagtatgcggaatctacaaagaactcaaacaaaacaccaagaaaaaaacaaataatcccattaaaaagtgggaaaaggacatgaatagacatttctcaaagtaagataaacaaatggacaacaagcatgtgaaaaaatactcaacatcactaatcattagggaaatgccaattaaaactgcaatgagatattgccttactcctgcaaaaaatggccattatttaaagacaaaaaacaatagatattggcatggatgtggagaaaagggaacacttatacaatgctgatggaaatgtaaattagtacaacctctgtagaaaacaagtgtggagattccctaaagagataaaagtagatccaccatgcgacccagcaatcccactactgggtatctacccaaaggaagagaagtcattatatgaaaaagacacttgcacatgtatgtttatagcagcacaattcacaattgcaaagatgtggcaccaatctaagtgcctgttgactaatgagtggataaagaaaatgtggtatacaaaaaacatggaatactactcagccattaaaaggaacaaaacaatggcttttgcagcaacttagatggagctggaggccataattataaatgaagtaacacaggagtggaaaaccaaaaactgtatgttctcacttacgagtgggaggtaagtgatgagtatgcaaaggcataagagtgatataatggacttcagagattcagaaaagggaggatgccccaagactaaaccaggaagaattcaaatctggtttatttggttattcaaatagaccaataacaagttctgaaattgaggcagtaaccaatgaggtagtgagcctaccaaccaaaaaaagcccacgaccagatggattcacagccgaagtttaccagagctacaaagaggagctggtaccatttcttctgaaactattccaaacaatagaaaaataagaactcctcccttactcattttatgaggccagcatcatcctgataccaaaacctggcagagacacaacaacaaaaattttcaagctaatatccctgatgaaccttaatgcaaaaaccctcaataaaatactggcaaacggaatccagcagcacatcaaaaagcatatccaccacgatcaagtctgggatgcaaggctggttcaacatatgcaaatcaataaacataattcatcacataaacagaaccactgacaaaaaccacatgattattttaacagagacagaaaaggccttcaataaaattcaatatctcttcatgaaaaaactctcaataaactagttattgatggaacatatctcaaaataacaagagctatttatgacaaacccataggcaatatcatactgaatttgcaaaagctggaagcattccctttgaaaaccagcacaagacaaggatgccctctctcaccactcctattcaacatagtattggaagttctggccaaggcaatcaggcaacagaaagaaataaagagcattcaaacaggaagagaggaagtcaaattgtctctgtttgcagatgacatgattgtatatttagaaaatcccatcgtctcagcccaaaaactccttaagctaagcaacttcagcaaagtctcaggatacaaaatcaatgtgcaaaattcacaaccattcctatacatcaacaataggcaagcagagagccaaatcatgagtgaactcccattcacaattgctacaaagagaaaaaaatacctaggaatacaacttacaaggaatatgaaggacctcttcaaggagaactacaaactactgctcaaagaaataagagaggacacaaacaaatggaaaaacattatacactcttggataggaagaatcaatatcatgaaaatggccatactgcccaaagtaatttatagcttcagtactattcccatcaagctatcattgactttcttcacagaattagaaaaaaaaattactttaaatttcacatggaaccaaaaaagagcccatatagccaagaccatcctaagcaaaaagaacaaagctggagggatcaagctacctgacttcaaactatactacaagtctacagtaaccaaaacagcatggtactggtaccaaagcagatatacaggccaatggaacagaacagagacctcagaaataacactacacatctacaaccatctgctttttgacaaacctgataaaaacaagctatggggaaaggagtccctatttaattaatggtgttgggaaaactggctagccatatgcagaaagcagaaactggaccccttccttacatcttatacaaaaattaacccaagatggattaaagacttaaatgtaaaacccaaaaccataaaaaccctagaagaaaacctaggcaatatcattcaggacataggcatgggcaaagacttcatgattaaaataccaaaagcaattgcaaaagaagccaaattgacaaatgggatctaatcaaactaaagagcttctgtgcagcaaaagaaactgtcatcagagtgaacaagcaacctacagaatgggagaaaatttatgcaatctacccatctgacaaaagtctaatatccagaatatacaaggaacttaaacaaatttacaagaaaaaaccaaccccttcaaaaagtgggtgaaggatatgaacagatatccttcttctcaaaagaagatatttatgtggccaacaaacatgaaaaaaagcttttcatcagtggtcattagagaaatgcaaatcaaaaccacaatgagataccatctcacggcagttagagtagagattattaaaaagtcaggaaacaacagatgctggagaggatatggagaaataggaacacttttacactgttggtgggagtgtaaattagttcaaccatgatggaagacagtgtggtgattcctcaaggatctagaatcaaaaataccatttgacccagcaatcccattactaggtatatacccaaaggattataaatcattctactataaagacacatgtaaacatatgtttattgcagtactatttaccatagcaaagacttggaaccaaaccaaatgcccatcaatgatagactggacaaagaaaatgtggcatatatacaccatggtatactatgcagccataaaaaaagaatgagaacattttcttttgtagggatgtggatgaagctggaagctatcaatctcagcacactaacacaggaacagaaaaccaaacaccgcatgttctcgctcataagtgggagttgaacaatgagaacacatggacacagggaggggaacatcacataatatcgagacctgtcagggggtcaggggtaaggggaaggagagcattaggacaaataccttaatgcatgtggggcttaaaacctagatgatgggttgatagatgcagcaaaccaccatggcacatgtatacctatgtaacaaacctgctcattctacatatgtatcccagaacttaaagtaaaattaaagaaaaagaaaaagaaaaacacttgaatactgagaaaaaaaaaaagaaggaggagggaggaaaggggtctagggatacaaaaatctacacgttaggtaaaatgtacactactcgggtgacaggtacactaaaatctcagaattcaccactatataattcttccacataagaaaaataaacacttgtaccccaaagctattgaaataaataaaatttttttaaaattacctttctgacccttcaagccatcagggcccctcacacctgggtggcctggaactcctgggtggcctcgctctcctggtggaccaggaaatcccagtcctgggggccccacaggtcctgctttgcctggggggcccagaggtccaggaaatcctttaccacctggggtcgcatcttcatgatccccctgggaatgttatgtcatgagtcaattaccaaccactgaatgtccatgaactcaaagcagtcattgtaggttacagaaacacacgcaaaagtccataatttcaggagacagttactcttaagcaaatgtaagtttaaaataaataacttagatactttttaatattttaaatatatatatatagaaatggagtctctctctgtcacccaggctggtgtgcagtggtgctatctcggttcactgcagcctccacctcccaggttcaagcgattctcctgcctcagcctcctgagtagctgggattacaggcacccaccagctcacctggctaatttttgtatttttagtagagactgagtttcgccatgttggccaggctggtctcaaacccctgacctccacctgcctcagcctcccaaagtgcagggattacaggcgtcagccaccgcgcctggccaatatacacattttacaatttatatacatacatataatataagcatgtgtgttaagcctcaaatactggaaacaatgtgtgtgatatgccttaaatacagaataagagatttatgtcaaaccattctctaatatcatatgtcatagaatatagaaataagtagatcaagggaggtggtgggattacaaatcaaatacattcttatgtattctcttgacaagatacatagctagactccatcatcctccacccctgtgggtaaaagcctagcaagtcctttctcctcttgcatgacaatttgacttttggttaactgtctggttctgttcctctgataaaaattagattgtcaactaccttcctaggcagtactgcttatagtaaaatcaatccccagttgcaaaatttgcatctggtctggaagaactgtggggagcctgcatcaaggattccctcactggcaatccctggtggggttctcaaaagctgtgcagtggataacagctcccatggggaatgaggctttcaagtcagggctgcctccatgcccaccatatgtgggtctcatcccttcttgcaccccacctgactgaacagctgcaagcactctcaaatgcaaggaatatctgacactgtcctgctggcattttgagtgaccttttatccttctacatggcctggtctcaaatgtggtctacaacagtcttatggatctggattgtttcaacgaatctaggaagacctcagcgaacgttgaaattcgtctcctagtttgatctatatagacgctgctttttcacaattagatgagtacattatgacaatatccactcagtgacagtgatttctaagtagttccttgagaggaagaatgaattaagcagagattaccaagcctaaagcagagatcattcacatacttgtgatcaggagaaaggtcagaaagctataaacaccatctaagccaatttccaggcttctctctcttgttcacttggattctgtctgaagggtttcctgtagaatcaggacatggtctttccctgttgcaacactctcagtggcttcccattatatatggcaggcagcacaggttggtagaaatagcatgcactttgaaataagacagacaagttttcactcctattttgcctatttgacagatgggtagccttgaatatcagatgctaagcctccattttcttactgtaaaattggaaaggtattgcttttcagaagactgttttgaggaaaccatctagtctggtttctgtgatattgtaagcattcagaaatactgcacatatttaagatattttaagttcctaagcatcggatcatctcatcctcttcttttatgaccttaattaccattacctacacatggtatccacccaacgcatgtctgaaaaatgcagcaacatcctttatcagtgagattttccatcagccaacgccttgactctgtgggtttgcacgagttcaccctttcatgctcactacttcccccatgtgcatcttctccaggaaacagaattgatgctaaacatcgggacccgagctccatcctccaccccacagagtcaactgaatacacctaaaatcagtggggcccttctaggatacaagtttctcagaagaaaatgaacaccacgagaatgatataaagaccaaggaccgaaagtcctgctaggactgaactgccaagaggattttagaccatgtccaatgatgctatacctcttaaaacaatcatctttccatgtcagggtgccaaaagtgactctgatttatagtatgttgatattttactgaatttcagcttggcaaatagagaaaggggaaatagttgtttgtatgaccatataagaaagtgaaattctatagcaagagaagaattctacatactggaggtcctggatcccctttttctccagcatgtccatcccgaccatgtgatcctggctgccctggaaatcctgggggcccatcaggacctctttctcctttgtgccctggaaatagaggtcaaaagatattcaagctcttatcagcagagggtaaagtaggatagagaggacaaaaaataaagaaaatgaccttgattctgggttggtagtttcctgtgtatctcaattgctcaagtcacataaaacatgccaaagccagaggggagaatgacaattgctagaaccattgaatctctttacttgggaaaagctccttttcccattccagcaaggagctggtgtgtgaaggtgccaatcacagaatcttcccctacctgtgatgccaagcacagcactctatccctggccatgggaaagggggaatggtctgcggttgggtacttgccctaagctaatcagtcctttctgaaattatttttctatttggagctgacaaagcagggctctcttcatctctggatgtaagaacttggagctgcctgggggtatgaaaatcagtctgatgggagaaaatatagatggtacaatgtgagatgaaagatgcagggagagcctcttgatgccactggaggccgggatctggttgtcccaatgccaacctgtgatggttaatattaagtgtcaacttgattggaatgaaggatgcctacatagctggtaaagggttgttgttgggtgtgtctgtgagggtgttgccagaggagattaacatttgagtcagtggactgcgacaggaagacctactcccaatgtgggtgggcaccatccaattagctgccagcacagctggaacaaagcaggtggaagaaggtgggataagctggcttgctgagtcttctggctttcatctttctcctgtgctgaatgcttcctgcccttggacatcagtctccaggttcttcggcctttggactcttaaacttacatcagtggtttgccagggctcttgtgccttcagccacagactgagggccacactgttggcttccctacttttgaggcttttggactcaaaagtaggaaagccactacttttggggctgagccactactggcttccttgctcctcagcttgcagacagcctgtagtggggtttcaccttgagatcatatgagtcaattctccttaataaactccttttcatatacacatatatcctattagttctgtccctggggaactcttactaataaaaaacactaccttttaatatttcacattttgtttaggtcaataaattacttaaaaaaacgatttcaagctgggcttctttcatttacaatgaaaatattattgactaatatagaatactgtaatgtggtgaataaacaccagccaagccaaaggagggcttgagccaaactcaagttcactataatgaagatgtgaatgtgtggctaaaggaatatttatgttttcaaataagagacaggggatttggctcaacattcatacaaccttatgaagggcaggaagtatttttttaagtaatctcaaccatcctaaattgtatagaattgatctatggtcacaggggaaattactgcaagaggagggtccatacatcattcataaaatggcagggagttaagtgattgattatgctcacctttaactcttgatacaaccatgtcacccttcgcccctttgttgccaggtggtccagaggcaccatgctttcccttggtgaaaaataagagaaacaaattaggttaattgtgatggatcaacagttacatctgtacatattgaatctctctcttcttccctcctaaatctcttgttaaagattctagcttggcattcttggtctcttccacttccctgccttccaaggtagtcctgtcttgcaaagctggggctcttgaactacatgtcaaatgtaaaagctggtgaaatctgaataaggtctgtacctgagttaagaggactgtatcaatgaccatttcctggttttgacagtgtactgtggttatgtaaatatggttatgtgtatgtatcactggggaagctggggaagcatacatgggaactttatgactgtgcaacgtcttgtgagtcaactacctcaaattaaaatttataactaatttttgtaattatcatgggctttgtaatgtgaaatggagaggaaagaagagagtgggataactacaagagctgccaccagagctgaaggtagagatttagggataagtttgtgatgaaaaaggcatggaagtgacgtcctgctaaggaaagttgatgagcaggagaagaggaattaagaaccttttctgaagctaatatatttattctgtataacaggtaaatagctaattttggctgacatgctcatgctctcttaaccacaacattgctcaaatctgaataatttgagtcatactttttaagtgttacatattactgaatatcaaaccatgtcaaaattatgggaacctggctgggtgcagtggctcacatctataatcccagcattttgagaggccaaggaaggcggatcacttgaggccaagagttcgagactagcctggccaacatggtgaaaccccgtccctactaaaaatacaaaaattagctggatgtgatggtgcacacctgtagtcatagctacttgggaggctgaggcataagaatcacttgaacccaggaggtggaggttgcagtgagctgagatcgtgccactgtactccagcctgggtgacagagcaagactctgtgtcaaaaaatatatatatatgaacctattgtcagtatattagggtggccaagcaccatttcaaataccattatagaaacactatacagagcccaaggttacttacctagtgatatcaataatcaaaaaaccacagcaaagaaattggagggaggtaaaaatgactgagcaagccagttgctttgctcacacagatgccactaccttgtcgtattttctttttatttattttctttttttgagacggggtctcacttcatcccccaggctgcagtgcagtggcacaatcataactcactgcagccttaaacctctgggctcaagcaatcctcctacctcagcctctcagttagctagaactgcaggtgcatgccaccatgcctggctaattggattttacttttttgtgtgtagagatggggtcttgctgtattgcccaggctggtctcaaactcctagccttaagggatcctgctgcctctgaaagtgttgaggctacaggagtaagccaccacacctggtcttgtcttattttcacacaatctaacaatgtgttcaagcaagcttaactatctttttttaaccggctgtactaatttataagctgagagctatagaggggaggagggtaccagtggagatgggcacagtggcatcagcaatcatcaggcagtaacagtgaagaggaagccaaaaatgcaaacaacagacataaaaactcaaatggacaacagggttggaagccatttcatgcagagaaaaaaagtatgtccacacataactcaatatctctgatatcactctagtatagcatcctgtttgtagcaatgtctgtgaaccatcaaaaaggtgggtagaacaaatttcttagtataaatcaatatattagaaagaattagaaatcataaagtactaatgtaggttgggttttcttttattcttatttttactatatatgctagtcataagtagcagtggggcctggccaaagtgtatgtcatatggtatcctgcccaagaaatggataaagaaaatgcccttctgaagaataaattatcaggacagaaaactgttcacatagcatttggacaaatttctttccagaaagagaaaaaagtggaatgcttaataaataagactttggtaccttggaagaatgaacccatcccaggagtctgagcagtgtattactcagcacattggagacttcaaatgtatgacgaattgctctaatgctctgtaggtgtcgaattttaagtactagagtagatcatagacttatttgagctagtaaggaaaactattactggacttcattaaagaaacatttactgaaaacattactgaaccattactaaaccattgtttagtaaatgttactaaacattactaaaaccattactgtagttttctttgaaaactacaaagaaccaggcattactctgagtactgagaatacagcagttaactagtgaaataaatgtgtaacctaagcgattcctggggcaaaggttctcagcagcttcagacagagagctactttttacaatcttaagacctgagatcaccaaacacttgtgttactctaacaacggaagcccagcagcaacaaaaactcctctccgggctgggcacggtggctcatgcctgtaatcccagcactttgggaggctgaagtgggaagatcacctgaggtcaggagttcaagaccagcctgaccaaaaaggtgaaaccctgtctctactaaaaatacaaaattagctgggtgtggtggtacatgcctgtagtctcagctactcgagaggctgaggcagcagaatcgcctgaacccgggaggcagatgttgcggtgagctgagattgcaccattgcactccagcctgggcgacaagagtgaaattccaccaaaaaaaaaaacaaaagcaaaacgaaacaaaaaaaacacttcctctctgccaggcatatcctagttgttcagtctagataagggacatcaactgcagatgcctacaggggtggcgcctgtccagtccaaggggaacaggtgggtaggcatggggggaatcaacccgcagccacagcagcagtgggaacgcaataaccttgtgttcataaacttctaatatctcaggagaagccataaacctcacattaataactcaaaaacaaacaccatgaggacacaaccaaacattccagcaggtcagaaatagcccatatattagtccacttttgcttcgctataaagaaatacctgaggccgggtaatttgtaaagaaaaggggctcatggttctgcagactgtacaagcctggcaccagcatctgctcagcttctggtaagccctcaggaagcttccaatcatggcggaaggtgaagtgggaagccagtgtatcacatggtgagagagggagcaagagaggaaagcaggaggtcccagactcctttgaacaaccagatctcctgtgaactaactgagcaagaactaagaactcattcatcaccaaagggatggagctaagccattcgtgagggatccacccccatgaccaaaacacctcccaccaggccccacctcaaacactggggattacatttcaacatgagatttggagggggcacacatccaaacgttatcagcctgtgacagtttgcgacctttggttcgctctgcagcctcctggactttaattcactggtatgtaccttatacagtgtgcaaaacacatgactcaattgaattcttaccaacaagcctctaagatggtgttcttatatccattttataaatgctgcaagtaaaacttagaagactgcagagctcccaaatgtcggagatgggatctgaagctggtccacttgctcctaggccctagtgccttgcactagagcatcctggccggaaatcccatcctagggagcgccgtcaggctaaggcaatgaatgcaaagacttggttcaattatacaaacaattgcaaagaacttaagcctagttttctgttttcttctttcctaccaatctgtggctgctagggccagagacaagcagaccatctccagagagaggagatgtagggaggatggagagcccccaagagcgagagcaccccatagtctgcaccgtctttcatgctcttctgtctgtccttcccttcctcctttcccttcttttcttccctccttcctttcctttctttctttcccttccttttcttctctctcttccccttctcctcccccttccctcccttctctaccctttccttccctagtgccccatggtatgaccctggtccctgactatgaccacaatgtaatgaatttaatgcagagaagccatatggacagaatcatatacacaacagaccagatacacaatcagaaacgtggccagcctacaaaggaaagccccatagagcaactgaattaagtaaaccttagccatgataaccctagataaacaagcagtcctcactcaaagatgttagccctaagtagcaactcaacaggaagccgcaaaaatattttagagccattaaaatcttcactaagaagattaagtaccaacacacacaaaaatgactatggtaaaatgttgaatgcaaactacttaacaattgcaaccatgcttatgcacatacatgcattaaggacctagcttcctattgagcagaggtggccagtgggctttgtacatgtgacaagggtactgctgggacaccttaatcattaacttcacttaaggccctcgggttggaaccttattttcatgagattttctggggaaaatggaaaaaagtcctttggggcttgatggtcaagttccaggccatcccaggattgagccttgttaataaggaggggacagagggctctctccagtctccaggggagtaccccagtgggcagtgcttgcattatgagcaatcagacagctgagaggctttgcctcaacctgcttcatctgtaactttcaccaaatgagaaccaccttgaggtaaatctcatccactctctggcatgatatcacgtaaactctgacaaagccagtatttatatccccagcccaaacctctcatctgaatccttaagttgaatatcatcctactgcctacttgacttcttgacttgactgtataataggcatctcaaacttgaaatgtctcaaacagtactgctttctttcctcacccaatgcccactccttccatcgccttcccatctcagtacatggcaactgccttcttccagtggctcaaacaaaaaaccctggttctgtcccttacttctcttttccttatatcctatgtccaaactaacagccaacatgttggctctgtcttcaaaatatatccagaatctgaccaccttgcaccacacccagcaccaccacattaaggcattggctgtcatatctcaccaggattacacagcagcctcccagctcatctcccagccaatgtcccttatccatatggtctatgctccacagagcaaccagagtgagtgatccatttaaaactattgtctcactcttcttaaaactctcccctggctgtttcatgtagtctagagtaaaggctcagacctcacccatctgtaaagccccatgctctgcagcccttcctaacctcctgccagttccttgacttcatttcctgctctgcccctctctctcttctctccagctacaatcgatggtgatggcgtttatcaccacatgacatactggatatttacttgctgatctgttagatggtctgtgtcctctctgaagctctaggagggcagagactgggctctggtccctgctgtatccccagcacctgaaacaaggcctagaacatagcaggcacttaacaataccaattagttgaataagtaaacgatggatgaatggatgagtaaataaactgtttttgcaggcattagcataatgtttgtaggttcaaaacataaatcatatatcacacaataaattagaaagaggcacctcgatttttatctctacgtgtctgatatggtttggctttgtgaccccacccaaatctcatctcgaattgtaatcgccataatccccatgtgttgagggagggacctggtagaaggtgactggatcatggggagggtttcccccatgctgttctcacaatagtgagtgagttctcatgagatctgatggttttataaggggctcttccctgttcatgctctctgtcacctgctgtcgtgtaagacatgccggcttccccttctgccatgattgtaagtttcctgaggcctccccacccatacagaactgcgagtcaattaaacctctttccttaataaattacctagtcttgggtagtatctttatggtagtgtgaaaacagactaataccatgtctcttttaactggaaagatgactggtaagaggtactcactggtagccctggaggtccttcagcaccaggaggtcctgggtcaccttttgttccaagccagccagggagccccaagtctcccttactcccctgcctcccaggaagtcctggagggccaggggggcccatgggtccaggctcacaggcacagagtccttcatttcctagacagaggatcaatggcagatttgtcatatttcctgaataaaatccccaataagggctttactgtacaaaaccaatagcataaatgaagaacaaagagtccgatatgcacttcttgcagacaattgagagcacgtgctgtgggggctgggtgtggcatggggcactacatggggtgcctaggcatgggatgtagggtgggcataccatttctaaacaaatggagggtttcgttccttaataaatttatcctgacaaattctagggaaaagctgatatccaattctactgaagaaacgttaaaaataattcaacttttttatttttaaaagtttaaaagcccatcctttggttcctcctgaaaaaaaaactgaaaaaattaattggtgagtgcacaaaccctaaacaattaaggagacaaaataatacatgaagaaggattttgattgcattgaatattataattgataattcaccacaatgcattttccaattatcaggactttttgtcttaaacaaatgtcttcagggtagtcagactcctcatctgtgttgatgctgtcacacccacctgactcagttgcccaaaacggctccaaacaatttagagtggagaagcagagagacaggcaattgatgagtctgggaaatataggtcccacaaaaatcaaacatcaatactgtcctatcactgccactctcaaggaatcaagaggaccttgtgagcaaagtcaccatttgcagacaaaattcatggcaggcaaatgttccatatatatatatatatatatacatacatatatataaatatataagacacaaggctttgacttttataatatataagacacaaggctttataaatatataagacacaaggctttgacttttcagtgacttgtaatcacatagcacttaatggagtactctagtgggtgactaaggtgagtaacaaatctgaatgaaatgccacattacacatctcagaaatgcccccgatcatccatgtacagttgtcttctagaaattctacctttggtgcctacttgcctttttctccttttgggcctcttcctcctgggggaccaactttgccttttattccttgtggtccggggttcccaacactacagtatatcactgtcaaggaggtaagggggtgggcagagagaatcacataatttttctgactgtcttctatagaataagtgacttttgcactcacatcctcccccacgtgcttcctttcccaaccccattctttgcgcccttgttttcctaggattctttctgtctgaaataagaatatacacacatatagatgatgcagtggttatggcatgcttctgctaccataaccattgataaagccaaccctaatctcagccctaccttaaattaatgggttgcaaaacaagataatggacaacaaaacaaaacaaataaacaaaaaaatggactcagtgtatggcaaagatattcccccactcagtgatcaattcttagctaatgaagaaaatggaaaagcagagcttatagaaataaaatttcagagatgtcagttaaagacgacagataaaatgcaaacagtttggcatcctccccaaatcccagtagagtaaaagaatattataaaaaaagcataaactggcctggtgcgatggctcacacctgtaatcccagcactttgggagaccaaggtgggtggattgcttgaggtcaggagtttgagaccagcctggccaacatggtaaaaccccccccatctctgcaaaatcacaaaaattagccagccacggtggtgcgtgcctgtaatccccgctacttgagaggccaaggcaggagaatcgcttgaacctgggaggcagaggttgcagtgagctgagatcgcaccactgtactccagcctgggcaacagaatgagactccatctcaaaataaataaataagtaaataaataaaataaataaataaataaaaataagtataaacccacaggacaaggaaaaagggagaggaaccagcaacaaccaagtaaaagaacttggcagatccttaaaaaaaaaaaaaaaagctgaatttgaaacaggaagcttagaaagctgagaaagaacctgatttaccccagaaatgtctcctaaatttcaagaatctgtacctctggaataagaacaacagtgaggtccaaaacaggatgatttgtctaaaaaaacagaccaaaagatccccttcctgaaattggcagcagggaaagaaaatagaccccctactatccccgccaaaaaaacctagaagaaacacgcatcacagcaagctattttaatttattttacaattaaaacagaagatgagggagagtattgcatccctgaaacatgaacagcctgctacaaaaggaaacattaaaagagaacacagcaattgaaaaacagatatagatatagatatagatatagatatagatatagatatagatatagatataaatagatcatgagagcagaaatttaaaaattcaggtgaagggttgtaatgtagagttcaggaaatctcccagaaagtgttacagaaaaataaacagctggagagtaatagagtaaaggttaaaaaaaaaaaaaaaagacatgtaggattgattttctgacagatagatagagtacagaaagagaaaaaagaggggaaaaaatggaggagacaacgttttcaaaggacacttgatctcttctcagccttttggctaagattgaatgcaaagaaacacttgaagaaaaattttcagaaatgaaggatatagggccaggcacggtggctcacatctacaatcccagcactttgggaggccaaagggggcagatcacctggggtcaggagtttgagaccagcctggccaacatggtgaaaccctgtctctactaaaaaatgcaaaaaattagctgggtgtggtggcacgtgcctgtcatcccagctactcaggaggctaaggtagaagaatcgcttgaaccagggaggcagaggttgcagtgaaccaagattgcatcactgcactccagcctgggcaagagtaacactctgtctcaggaagaaaaaagaaagaaagaaagaaagaaagaaaagaaaagaaaagaaaagaaaagacatgacatgaaagctacatgctggattaaaactgcttactgactgtgtgcaagccagtacaaatgtacccacactaaggcaaatcaagtggaatttaagaccccaaaaacaaacaaaaaaaaagagctcctatgagcttccagaaaggaaaatggatttcaaaaccaaaaaataaagtatctaaatgttatgagttctcagtagccaacactggaagctaggaaacaatagaaaatgccatcaaaatcctgagggagaaagatttcctaactaaaattttatactcagccaaactagaaatcaaagtccacagcagaattaaggcattttcagacaagcaagatctcccaactttgcccttttatttacactttttcccaggaaatataatgaggtagtaaagcattaaaaaatatatgggaaatagagggccccagagaaagagagaggatggaggaaagaaagtctcaggatattggtaaaggaagatctcaagacagtattctggcaacaaattaaaaaatgcaacctgacctaatctgaacaactcaaaaagctgcaggagagatttattcaaagagctaatactaatagaatagttaatgagttagagtgtataatgatgaaatttagataattctgggcagtttgaggttaaattataagtatattgaaaaccaagcaaacagacaaaggaaacaagacaattgacaagatgttctggaaaagcaataatttatactttatatggctcagctggtgaatggcccttatataaccaactattcagtgtaaactctgaatatttatggaagcaaaattatgacaataattgtattgtagtttgtgggagtagaaaatgtgcacatgtcgggtgaggggttggtgaaagaaagctaaattcatcttccgtaaaggaaagtcaaaagataatgctgaattggaaaaattgagaaatagcaatacaagtacattgaatgtcagtatagaggcaaataacaaaatatccagccacatgtgttgaaatgattgcccttggagaggaaggattaggagaaggagttgtgggggatttgagttatccataccatgccttgtagaacagtttgactcttaaacctgaaagtgcccttgcaaaaattctcacagtgaaaaaattgtgacagtgaaggagatatgacctaaataacttcaccttgtctttagcctctaaactgcccttggccatttctgagcgtgggccaagctaactttgaaagaatttacttatagtttaaataataatagccctccccaaaactaaactaccttcataatgctaataaaaagccaccaggtaaacaaaacaaaacaaaacaaaacaaaacaagaagggcctgtattctgctaagatgtaggtatacttaaatgattagcagcattattattccagaggtcacaagatttgcaatctccccaattactcctataaatgatatcactattataaaacctaagattggccttttgagatgtcttttcagactttggcgtttctgatgactggatggctccacctagacccaagactcatgactcaagggtcccgtggcacccacccagaagtggattcaacacgttaggaccattttccacacccccatgatctcatccccagccccctgcctgccaaactatctttaaaaaaccctagcctccaaattttcagagaggcttttttatttttatttttatttcatttattattttagtaataataaaactccagtcttccatttagccagctctatgtatgttaaacgctttctctattgcaattcccctgtctcgacaaatcggctctccctgggcagtgggcaaaataaacccaccgggcagtcacaaaccaagcccatatataactctgatgaaaattaaaactacatttaaaaaaaattggtattattttaccaagttctatcatttacactgaaactcctaaccaaatgattgcacatactttaatggatgtgaaagtccaacttcagtttatttgtttgtaaaagacaaccaacttagctcatgaaacatcatataacttttaaaatattttaaaaactatgctttcttagtggcactgcaaatatcaaaagcagcataaatgctaatggatatgaataaggagtactttaccacttgatcctgggaggccctgcaggcctggtgctccaggcaagccaggtgatcctggcttccctggttttcctggagcagaatcaggtctcccaggaataccagcttctcctggaagcccaggaagaccaggaaatccttgtggcccagggggtcctatcatgcctgcaagataaatcaagaatgaaaattacatatactctcagagtaaacgtctctgtagaagaaatcaagattggtacacacttgcttaggttatcgaattttttaaagggaaagagacggagctggaggtcattatgctaagtgaaataagccagacacagaaagaaatactgcatgatctcacttatatgtggaatctgaaatagtcaaactcataaaagcagagagtaggatggtggttcccaggggctgggggaagagaggaatggagtgatgttggtcaaagggtacaaagtcttagtcatgcaagataaataagttccagagatctactgtacagcgtgaaaatgatagttaacaatactatatcttatatttgaattttgctaagaggctagatctaaaataaatcttctcaccaccccccacaaatgataactatgtagacgtgacaaataggttaattagctggaatgtggtgatcattgtacaatgtatacatatatcagaacatcaagctgtgtatcttaaatataaacaatttttatatgtcagtgatatctccacaaagctatttcctaatgctctagatgacagctttcagaagtagaaaaaaaataagtgatgtataaagtttgcttttccacagaacagattactagccgtaaagcaggagttataataatttgaataaactgcattaaaagaaaaaacatagctcaaaaataaagacaatatcccagccattaaaatgtcttgcctcctttgaaataagcacacagtggaaagaaatgggtttagagaatcagattttcttaccttttccccattctttaggattattggggaagaaacatatttgatttaattaaatgattagtttttcaatctttctaccttgataacttggtaaaaataatccaaataaacatattagcatacttagtgggtaaaaatatagactcacgtaatcatctaggtagaacataaaatattgtacctatcacagcagcccaggttgatggggaaggatggaggtaccagatttcaacttggcctttccctctgtagcaggggaccttaagcagtttatttaacttattgagcattctgtatatatacctccagaggcttgttatgaggattaaataaaataatccatgtaagaagcttagtgtaacatccagcaagagcacatgctcagtgaatgttcagtgtgttcagatgaggtcaaaacgaataatgcaacagcaggaaatcctgcttccccttgacatcctgctccccttgctgctgtctttggcttaaagatagctgaaagctggccaggcccggtggctcacacccgtaatcccaatactttgggaggccgaggcaggcagatcacctgaggtcaggagtttgagactagcctggccaaaatggtgaaaccccatctctactaaaaatacaaaaattacctgggcatggtggcaggtgcctgtaatgccagctatttgggaggctgaggcaggagaatcgcttgaacctgagaggcggaggttgcagtgagccaagatcgtgtcattgcactcttgcactctagcctaggcaacaagagcgaagctccatctcaaaaagaaacaaaaaaaaagatagccggaagcctctgtgagagtgaccacctctcacagcttttttcctaagcgtgtctggctccagatcctctctgtggaagactgcatttttgacagatggccatcacgggagctctgtcctacatcctcttgttgaactttgacatttctctatcaaaaggtgggtgtgttgcctccctctgaatgaggccattagaaaagatgattcagcttctgccttgtgagccaaaacacttgagactgaaattctgagctaccatataagcaatgataagaagctaccatattgtaaggaagccttagtacagagcccacccagggaggctcctgaggctacacaagagaaatcagagaggtgtccaggcaggcccagcccttcctgaactcttaaactgcagaaagagtgagaggtactgtactgattgctattgtttcaaaccactaggttttaggaaattttttccgcaagagataactgaaaccctgtcagtaatcagtaatgtagcatgtttattaaattaatggctgtcattattgtgtccatatgtgccgggcttcagtagacatacaaacatattcactcctcgaacaatcctgcaaagtttataccttacagataaggcacacaaagtttaggccaaatatctgtagtaataatagctaatatattgaatctttactatacactagactgcagtctaaaggctgtatacatattatttctttcaaccccaaggtcttgttttacagataagaaaactgatgtacagagaggtttaataaatgtccaagatcacacagcttgcaagtaggagaaattggaacttttctagttcatagtgcaaatgcattaagtatttcactgtaccacattatactatatggctttcactaaatgctaaggtgggatttgattacaagtgtctgactctgaaactgtgcttatctcatggtaaatactgtagataattaccaaattatctacaagatattctatacgttgtatatatagtaaataccatagatattaacaataatatctatcatatctacaaattatatatacaagtatataataggactagatacactcctgtgcttagaacaaaatgaaaatgagctcctgtggatttggctgccatcttgtcttcatgccatttctaagacctgatgtggactcaatacaatcagtcattggatgaacctgggtgctgcctgctgccttgtcccattgccaagaagaatgcttaaccacctgccaacagggagaatgggctacagtgtgtggcatcttgcagtattgtccacccaactgtagagcatgaagtcaatagagtaagttgtgacagcattaaattttttttattataaaagaaatgaatgggatagaagagtgtgtcacataccgaaaatgtatacttctgtgtatttttgtctgaatcacctgtacatatggatacatacatgtttgtgtaatataaatgtatatgtttttcatataaatgtaaaatcaaatgcatttcttactatgggtcatagtcaagatttgaaagctattgggttaatttattttttaaaaccttgtgaattaagaggtttcctgggtttgaatccactagagacacttgttacttactattagatcttcattttaatatgctggagacactattctattacaaacaagcctgattggagaattctaagaccagagtccagtgctttctgaccaacggaatactctatattatttatatactcctgggtcagttaggccaaggctgtgctatctaaaggttaagtgaactagacaaagcttttccacctttgtggttattgaatcctgcaaactgaaagctagattcatggaagattaaacaagagttttgtagttagcagttgaatatctcagaaaatttctcacttcttctcagtaaatataacaagagacacaggctgggtaaaactacgtttactcaagacttttctcctcacaggtttaatcagttctcctgggttcacagactgcaaataccctctaaacttcaattcctaatcttactaggaatattaaccagcgcagcacctgaaggagttcaaagtccttatgccaacaggactctttcccaggctttttaccaaatgccactgtggcccatcattttcttatttttgtttttgacgcgagggaagaagacttttttaaagtaattatgaatgaaagtttttttaatcataatttttacttccacctttcatgcaggagatttaagcaagggattaggtgaatgtactaaattttacaagtagatgtcaacagggagagccttccagcagggtgggaaaacatggggaaacactaatcctagcagtggtttccaagccttatctgcatgcgataactttgtgggaggcctgttgttatacatacatattccttacaacacccctatgatattgattgaatgttctggggtgcagctgagaaacctgtattcctcccaagtaagtgattaattggtttgagttcagtggttcttaaccttggctatatgttacagacacaggagcgcttctacagtatcagatccccaggcccatctcccaagagtctaacattcttggtctggggtgtgcacaggcatcggtattattttacacaatcctaaggtgattccaatatcagctacagttgaaagctactggtgctgatgatgatgcaggaaatctgacctgtaaaagccagggcacatcagggcatccgtacctgcacaggcttcccctggtctgcccaagagacctgggggaccaggtggtccaacatcccctgtttctccatagcggccagggaaccctgggtcccctggtgggcctgccaaagataatggtacatgagaataaacaaatggtatgtgcattttaaaattaagacaacaattactttttgtgagactcagtaaagtataattaggagacatttttgcagtttctcattacatttaaaacgaaatatcttaaatgtgaaccgccttggctgtgcctcttcctcagacacgtgaactttgaatggggttctttgtcactgatttaggctactccttttggtggcagcatcttgataggtgttagtcaaatagttctgtttttgtttttgtttttgttttcagacggagtctccctctgtcgcccaggcaggagtgcatgatctcagctcactgcaacctccacctcccaggttcaagcgattctcgtgcctcagcctcccacgtagctgggattacaagcatgtgccaccacacccagctaatttttgtattattagtagagatgggatttcaccatgttggccaggctggtctcgaactcctgacctcaagtgatctgcctgcctcagccttccaaagtactagagttacaggcgtgagccactgaacccagccagtaaaatagtttcatacaatttttagcgattaaaaatagactttctgaaagataacaataaaaatcccagcatacagtatatgtactgaaaaaaacctcatgcacatgtataattatacactcatgctacagttcgtgcattcagcctgcctagtgtgcaagctatggaaatactgggccagactcttctgtcctggccactcaactcctatttctgcataatttatggaggaactgaataggaacacaaacctttgagtggaagaggtggagtcaccaaaacacctggtggtcctgggtgccctcgatttccaggatccccctgaaatcattcattcattcactttttaaaggaatattaattttactcatgttgcctggcattaaaccagtattagaacgatcatgtgcacattcatataagaagcagagattataggctgactagagaaatgaagcatccatggagtcttaggagcagcaaagatgcatctaatctcttatctacaagtagtggaagtaaatagcaagtcacaaagcttctacaaaggaaaagaaatttaactccagtgaaattattctatgcctataaattggatacctctgatgtcaccaagtttcttagatataccatgagcattaatgtctaacttggcatcgatgacaaatagtttattcacctaacaaggtccgaatctacattttattttagcaacaaatagcgtccctctaaattgtgttcctttaatgccaccatggctttaagggaacacaattcccttgcacatgctgagcaagtgccagatgaggtcacaaaagttaaaaaggaaagaaaaaatgcagtggtgttaaaagcagaaaactctctaagatgccctctgtttctaatctcaatgagcctatgaatttttttaaactctcatgattattcaccttcaaaaggatcacttctcaaatgtagaacataataatgcttaatatgacactgatatgataatatgataatcatgcataataacacacagcatgcattaaagtactatacagtcagcactcttataaaaaatattttaaaaaaaataacaatccaatgataaaaataataaaacaatagaatatgacaactgtttacatagcatttacattgtattagagattataagtaacctagagatgatttaaaatataagatatggcgtgtgtaagtattatgcaaatactacatcattttacatcagggacttgagcatctgagggttttggtagcctaggggttctgaaactaatctcccacagataacaagggacaactgatatggtttggctgtgcccccagctaaatctcatcttgaatggtaactcctacaattcccacctgttgtggaaggaacccagtgggaggtgattgaattatggggggtgggtctttcctgcgctattcttttttttttttttgagatggagtctcactctgttgcccaggatggagtgcagtggtgtgatctcagctcactgcaagctccacctcccaggttcatgccattctcctgcctcagcctcccaagtagctgggactacaggcgcccaccaccacgcctggctaattttgtttttgtatttttagtagagacggggtttcactgtgttagccaggatggtctcgatctcctgacctcatgatctgcccgcctcggcctcccaaagtgctgggattacaggcttgagccaccacgcccagcctttcctgtgctattcttgtgatagtgaatgagtctcacaagataatggttttaaaaaataggagtttccctgtacaaactctctctttgcctgctgccatccatgtaagacgtgacttgctccttcttgccttctgccatgattgtgaggcctccccagccacgtggaactgtaagtccatttaacctctttcttttgtaaattgtccagtcttggatatgtctttatcagcaacatgaaaaacagactaatgtaacaattgaataaaaaattaactgtatctcttctaaaaattacattcttgaatgattcctggcaatacttctaaaaataaattagataatattaaggatataaacttttatcaggatatattaaaataggctcactttttacctttgggccaattaatccaaatagcccaggatctccaaccagtcctagttctccctacaaacaagcacaaacatgccttaaaaaaaaaaagtgactgggtgacaaattatctcattctcatttaatttaagcaacacattgcccactgagaccatgcaaagtcttaacactgttcatcagttgcatcagacaatcttgtgcttcaatttttgcacccacagctaaatcctgcaatccataaaatgaatgtgtctgccttcctaattactgtgtttgcacgcaacagtacaacttctgaattatactaaattgcatttactaatgaaatgtatttattatctctataatgaggtacatttacctttaatcctggaaaacctggagatccataggaaccaggatccccctaataaattcacaaaaatcaggataaacagaattaaatcagaatgcattaaccagctcagtgcatcatttttcaccttatcaaattgttccatggatatttggtcctgtttgcaaagctagctgaataaaaggaaataaatataaaatagattccatttctttataacatttgctacttgaagtgatcctcagtcttattcaaaaaatccatgtcattgccagtgttttaattaagaatgtatttttgttgtcgttgcttttccaaatttaatttacttaacttagtgcttgcactgggccaaatatctttaaaatctctgcaatataatttgcctggaaattaatagttgctctgtgcatcattagcaataaaaatgaccatggaaaccaatatttccccattcagtactaaatctagaaccaaataaactcaatgcccatgccagctgcggtctggcctccatggtgactctatgagtgggctttctattagtgacatgtggtgatgtttggagcttaatattgtactttttttctagctcctgcccctatatcaccatgttgtttcctcaaatagacttaaattaactattccaagctactttcctactggcactgaggtgccagacaagagatggcacaatcctgtcacttttcccaaattcttctatcttttgcttgcctgttttatctaaatgatgtcaatggaaggatgctctgggatatttagatattccataattctcgtccaaaatgttttgttcttacatgagctattcttcacttttgagcttgtgggactactgacctggttttataaaaacatgaaagagaaatatctccaaattcactgatgttaacagcaaatgatgcttacccgaggccctggaaatccaggaatacctttttctccttttgccccaataccagattctccctttaagagatgacaacatttagaggggttcaagcaacaatatttcagcaatagggaaagcaatatttcagcaatagggaaaaaaaacaaaatgagaaacaaaaattattgtcagcagcttaaagaaaacaactactttagaatagaagctctatagtattatgataagatagtgaaaaattctggtaatatatattagcacttaaagcaatgataaagaccatgagaaataacattttaagttaagatagtacatcacacaaatgaaaaaaaaaaaggtacttaaataaactaccttgcgtcctggtggtcctggcagtccaaccattccaggaattccttttataccctaaaaattacaatgaatataatttggtctattcttattatttaacatactgaattccatctccttcagaaatcatctctttttacaatctgtttcaccttaaaaaaaaaaatcttaagagattactcttcacctgttctaattagcacacttataaaccagatactatttgagccagttctctatgtgagaggtatatgggataccacagtggaccacggaaccaggcagcagatacaatttgggaatgcagccattgaaaaagtggcttattttgagcaaagtaaagaaatttaacccagcaattgaaaagcaacaatagaatcttcatgtggcaccaataataccagcactggtagctgacagaggaattaatatttgccaagaatctattacggcccagttctatgcatttgttaccttctcaattatcaagacatcaaactcatctgtaacatctaaaggacaactgggcttccggtggtcttttcaatccacacgtcaaaacaacattaacaagcacatgtcataatttagcagcctgagctaggtctgccactcagcagctgggtaaacttgagaacactgggaaccttccaagcctcattttcaatgccgcacgatggggccaacagtagtaccaacttattaaagtaggtttgaaactagtgcagtgatgcatagaaagacctctatactttgctgccacagatccatgtcaaaaaatattttctactgctactttccaaggtgacatatggatttgggaattaccttttctcctttatagagacaaaagtcaggtggctctaccaacagggtgggtccaggagaaccttgctgaccaacctcacccttaaaaaaaaaagcaagataatgaaaatttcatattaatttatgttttgaaggttttcacccatgtattgtggtataatgcttccaatcctatgtgtcatggatttaaaatacaagttgtggcaagtacatcatagaatataaaaggatatttattttcttataaaaatttaatacacacttattgttaaaaataaatttaaaaaatgaaaatgattcttaatgctactatccagggccaggcgcggtggctcacgcctgtaatccgagcactttgggaggccgaggtgggtggatcacgaggtcaggagatcgagaccatcctggctaacacggtgaaaccccgtctctactaaaaatacaaaaaaaaaaaaaaaaaattagccgggcgtggtggcaggcgcctgtagtcccagctacttgggaggctgaggcaggagaatggcatgaacctgggaggtggagcttgcagtgagcagagattgtgccactgcactccagcctgggcgacagagcgagactccatctcaataaataaataaataaataaaaaatcctactatccagaagtaatctctattaaaactttttttttttttttttttgagatggagtttcactcttgttgcccaggccagagtgcaatgacgcgatctcggctcacagcaacctccgcctcccgggttcaagccattctcctgcctcagcctccagagtagctgggattacaggcatgcgccaccatgcccggctaattttgtatttttagtagagacgggggtttctccatgttggtcaggctggtctcgaactccggacctcaggtgatccgcccgcctcggcctcccaaagtgctgggattacaagcgtgagccaccgcacccggcctattaaaactttgatataatttttggtggtgtgtgtacatatgtgtatatatgtacatatatgtgtatataggtgaataaacaatttgttttatgtttatgaaaatataatcagaatactataataaatatataaacatgatttaaaatatacagcatattttattaaatttttaaataattttatatttttcttacaatattttgtgagcctttttctattatactaaaatctcttcaggatcctgatttttttttttttttttttttgagacagagtgttctctgtcactcaggctggggcacaatggcgcaatctcagctgactgcaacctctgcctcccgggctcaagtgattcttgtgcctcagcctcctgagtacctgggattacagataatgcaccatcgtgcccagctaatttttgtattttcagtagagatgggatttcgccatgttggccaggctggtctcaaactcctggcctcacgtaacaatcctgatttttagtgccaataaataatctatcacaagaatgtactgtgatgtattaagccatctcactctggttagattagattatttctatttattttcaataatattttaaaactgtaaaataatagccaaaatttttatttatgccatgatagatgtttttctactgaagaaaagaatgtttcttgaatgaattttgccacaatcataaattctcaccattaattagaaaataaatattttgtgcttttctgggtattactattattctacacttagtatgatctttctttttgtcatagttaagaacaggctatacataggtcacccatgtttgcaaaccaggcccttactggctctgtcacttggggcaagttccttaaaacctctctcagtcctcatttccttacttccttgaaacctcatttttcttctctgtgaaatggagattgtaatattacctacctcaaactattcttccattgaatagataatatacataaaatgcttcccgtattgagggtaacaaagtaaattccccaatatatcattactaaaactactaatgcttttgataggtggaatttttagaagaatatcaagtttaaatagaaaaaaaaaaaagagttcaatttctacctaaacctgggaaattgaagaaaagccagattagaaacattgtctgttttgtttttttttccttgatttatctacacacctaacacagtgttggtgtagcacctgccctaaagatatctgctgtgtgaataaaccattgaacaagcacattaacaaaacatgagtaaaagcatagcatgtattggtaaagatagccactcttattcttgtaattgagataaacctgaacaaaacccttaaaagctgacaagcagccggcttcttcaaaatattggtcatactgctatttttttcatattgtaaaagtaccatatactcagcatagtcaaaagtacaaagaaggaaaactatgaagaattaaaatgtaaaaggtccataattatatcatgtaggcataaatagcaaccatttagggcagtgtttcttaaaatgaggtgggcaaacatgctctagaacatctgagaattctgcatcaatattttatcttattttatttatttatattttttgagacgtagtctcactctgtcacccaggctggagtgaaatggcacaatcttggctcactgcaactgccacctcccaggttcaagcaattctcctgcctcagcctcccaagtagctgggactacaggcacacgccaccatgcccggctaatttttgtatttttagcagagacggggtttcgccatgttcgccaggctggtctcgaactcctgacctgaggtgatccacccacctcggcctcccaaagtactgggattacaggcgtgagccactgggcctggcccaaaattgtaaaattatgtgttcattcacctgacaatctaaaagaattaaggtaagcacatttgagatcatttgaatggccacctcatagccaaatacttccaagttattccacagcctgagtttgcaaatgtgtctgattggactggcgcggaaagtcactaagatgccaatgcttgctggattctgcaatggcacacgggctcctgtggcttcgacgaacatattccagagctccatggcttcccaaacttgaaaaacattgttttggtatattttcattcagtcatttctacaagccagagatctcaaggttgggggaaggggaaagtagttaggcaaccccttcccacagggacatttggcaatgttttgatacattttaagttgtcacaattggagggacgggatgctactgacatctagtggggagaggccagggatgtggctaaacatcctgtaattcacaggacagcctccacaacaatgaaatagcagcagcctgaggttgagaaatccctctctgtgtatattttaatgtctttcttgttgctgttgcttttacaaagttgagtttatatttttgtaacctgtactttctgttcagcattatatcacaggcacttccccacatcatgaagttgttatatatatttttgactcctgtgccgttctgttaaatgactgtaccatgacttactcaatcacgctggaactccatgagagcagggatcaggtctgtcttgctaaatccccacacccagtgtcagtcctagcttggcatggagcagatgcttaatattgacttgccctcagttgttgaaagagccactcacctactgctggatgttcagattgtttccaggtgagttgccttcttaaatcacttttcttttttttttttttttttttgagacagagtcttgctttgtcaccaggctggagtgcagtggcacaatcttggctcactgcaagctccacctcccaggttcaagcaattctcctgcttcagcctcccgagtacctgggactacaggcacgcaccaccacgcccagctaatttttgtatttttagtagagacggggtttcaccatgttggccaggatggtctcagtctcttgacctcatgatccacccgcctcagcctcccaaagtgctggaattacaggcatcagccatcgtgctcagcccttaaatcacttttctaaagcttattcttactaagttttacatgtcggccaaaaggacagtgggtgtgagtggcagggggaggagacggggaggacaggcatagaaaaggagtgggttggagattgtgtattgctcagtgctcttggttccagtcatttatatttgtatttatatgcatatttaagggtggagtttaggatttatgtgaaattaagcaaaacaaatccgtgatttgacaaagctgttactctggacataatatattgtcaaaaatgttcaatctgtttgctagggtgaaatgtgttgcacaaattaacccgaaagtagtgttaaattgtgtcagatctttcattttacagtcaagggtaatggtgccataataattcggcaaagaaaagttctcagccataaaattgggcagtgactagataatgagtacaagttcaaataatcagaacagcctccacccctgagcagcacacacacgtcaccatctgctcctcagagcaagagggaattcttaccgggtctcccatttgcccctttactcccacaccgggatttccctgagaaagaaatgaaaaagaatctaattgcttttgaattttaaaaaagtaattaaaagcaattaagacttctggctacacaatatattgcagttcatggaatactttgggaagtctgataagaggaaagccatcattctgacaaatatcagtggtcaaccatttcattgttcagggctctattgatgtatcttgctcatgactgcctaccttcaaacctggacgccctggttggcccggaggtccctaaatcaagggagaaaaaaacacaaatcaatcatcagacatagaaatcagaatgtgccttcttttgttaccccaaaatagggtcctatttaggaaacccttaattttaaaacatgcagtgatggagtttctatcatggatgggctgttttctgtgaagatgatgtcagtggctcatccgcagggacctgtgcttcaagatggagtcccactgataatggtgggttttcactgattcatcgattataatctctcaaacggcccacctgtgtctgacccaaaatggcaatgttgcttctttattttcatgtagaatctggtttttaaagggatcacatcagcagtgctgtacttaccactaaccctggctctccaggatatcctgtgggacctgccggtcctcctgcaccccaagatccctaaacatgagaaaaatcagtgcatctgttacccaaaattgtaatcatctttcacagaaagagttgcgtgtgatcccatgtggataaaaacctctaaagaaatcacagccaccagcacatctgccctgctaggacattttcaacagcagctttgatgcagccctaaaagggcaccaagcagtccgggcacggtggttcacacctgtaatcccagcactttgaaaggccaagtggggcagatcacgaggtcaggagatcgagaccatcctggccaacatggtgaaaccccgtctctactaaaaatacaaaaattagatgggcgtggtggcaggcgcctgtagtcccagctactcgggaggctgagacaggagaatcgcttgaaccagggaatcggagattgcagtgagccgagattgtgccactgcactccagcctggcgaaagagcaagactctgtctcaaaaaaaaaaaaaaagcaccaagctaaaggtagcagcactctggtagttgtgataaattccttcatttagggtccagttaagacccagagatcaatctacctatttacaaatacatcctgtaataacaaaagtggagagcaaagaaaatgcattactacctactcctaaattctgttacaattttgatatacatcaggatgcttttaaagtattattattaattaacattatatattaatgtatttatactttttagtatgtttttaaaacatggtctgcaagatctcaaattgcggaaatatagtccctaatttgagatcaagatgagtcagccatacaaaattttctacaacatgtaagttgtaacacaactatacacaaattgtcaaggaaaggttacagccaggctagcctggaagtgtggagagatgttccccgggctcctgctgactctgcccaggtcaaatgattggggagtgtataatgaaattactctgtttaggaggatgaactgatatttattttaacagcaacattgaggtatcacatttattacatggacctgagcttcaatcgtagtaaggaaaccagcccaggaaagtcgttccatcactagccagaagttacagggcaaaattatagcttaacttttggaaggcaaaatggagtctctgtcgcccaggctggagtgcagtggtgagatcttggctcactgcatcttctgcctcctgagttttagcagttctctgcctcagcctcccaagtagctgggattacagccacgcaccaccacgtctggctaatttttgtatttttagtagagacggggtttcaccatcttggctaggctggtcttgaactcctgacctcgtgatccacccgcctcagcctcccaaagtgctgggattacaggtgtgagccacctcacccagtcttttttttttttttttttttgagatggagtttcagtcttgttgcccaggctggagtgcaatggtgccatctcagcttactgcaagctctgccttccgggttcgagtgattccctggcttagcctcctgagtagctgggattgtaggtacgcgccaccacgcctggctaatttcgtatttttagtagataggggctttcaccatgttggccaggctggtctcaaactcctgacctcgtgatccacctgccttggcctcccaaagtgctgggattacaggcatgagccaccacgcctggccggcaaaactgctctcaattttagtcttgtaaacatcgaaaaactggaaagactaatataatcattgaattgctggtctgggcggccctcggtgcccctacagaaaacaaaattataagtgaagcatttttgcaaaaatatcataacacaaagattatgcactatgaatactcaaattgtggcatttgtgattcacacatttactgtttagttttgtgaaactttctcacatcagaaacatcagagagatgaagatgggcaaaatattaaatataatatacaaatactgattcaccaggcaaaatggtagcgagaagcaatgcaagattattctagctggtatatattatacatgtagttgctaagtggactcactttcctaaatattaagtggctgcatatacctgagtaatgtcacgagatcattagaagacagaagaggaaggcaggagggagcttgatgagcttcaagtacagcttcatgggcatgagactggtgcagttacacagggccccatgcttcatgttctgtggtcgccatcttgaaatgcttaataatttttgaacagggaacccacattttcattttgcactaggtgagccgcacaaattatgtagctggctttgctgggattaaaacgtggatcataggctatttgaggaggaaatagaagcatagagcctgctcaggagacttactggtaagccaggcagtcctgggtcccctctgtctccctgcaaaaataagaatgcattgctttaagtccacacaatgttcctaaaacagagattatgtaaaaatagaaatatacacaaaattatctggactcatctaactgcagtttgttcaatttttttggtgttgactaaaattgaggaagggatatgcggaggtgattttccttctccttaagctctgaattctccttctacccaacagagaaaggtcgctgaagtaatgacatggaatcaaaatgagattttttctttgtttaaattgttctaaattctcaatccagtggtcccgtttcctcacagtttacctgttgctggtgtctttccacaccttgctatgctttataaacatcttgacccccttgactaccctagagtggacagaaaagaaactcaggtggaaattgcctcacaccagcctctgtctacttctatcgccttgtgactctgtgctgagactcaacctactttaaaagatcaaaggctatatattctcttgaatgaagcctctttttttaaaatgtaaaatatatgtaagttaaaatatgacatttcaacctttttttttttttgagatggagtctcgctcttgtcacccaggctggagtgcagtggcgccatctcccttcactgcaacctccacctcctggattcaagcaattctcctgcctcagcctcccaaatagctgggattacaggcatgcgccaccatgcccagctaatttttttgtatttttagtagacggggtttcaccatgttggccaggctggtctcgaactcctgacctcaggtaatccacccgccttggccttccaaagtgctgggattacaggcgtgagccaccacgcctggcccatttcaaccatttttaagtgtacaggtagttcacttaatgccacttaagtggcattaagtacattcacattgttattcacccatgaccaccatccatctccaaaactcttatgtctcctccagtggaaactctgttctcattaaacactaactccccatccctcttccctgcagccactggcaaccacccttctattttccatctgtatgaatttgactatttttctatataagtgaaatcatatgatatttgactggtttatttcacttagcataatattatatcttcaaggttcatccatgttgttgtatgtgtcagaatatctttcctttttaaagcttttacagtcttcctttggatgaatataccacattttgtttatccattcatctgttgatggacacgattacttccaccttttggctactgtgaataaagctgctatgaacatgcatgtacaaatatccattcaagtccttgctttcagttctttggggtatatatccagaagtggaattgctggatcatatagtaattctatgtttaatttactgaggaattaccatattattttccacaggggttgcaccattgtccattcccacccgtaatgcataaggctccaactctccatgtagttgccaacaattgctagatttgttttttttatcatagccattagaatgagtataaagtggatatagactcttaagagcattgtctctcaaaggttattgatctacaggtcatttttattagggatcttctgtttccccttaagataaggaattctctatattcatcccccttctatatttgtatgtcacatgtcctctattaccacaattacaaaaaaatgctcactataactaatatgggacattaccatttacaatgtgctgcaatataaattattataacagtcttaacaacactaagaaaggggcagggtaaatattattttaatcttctttcacaaataacgaacatgaggctgaggaggttaagggagttgcttaaagtcacagtggagagtaagcctcagttctctccttccaatacaccatcctggttcctagaatgaccctgctgttgacgtttagtttattaatatatcatttaagctataaacaaatccatcgttcttgctgtttaagaaggacaaataggcacagaggctacacacataaacagtgagcttactaaagggatcactgctcaggtgtgtccattctgcgtggcacagaacctagggtctcatagaagcaatctaggactagttctatctaattgctgcagaatattcttccttaagagaaatgaccacacatcttgaacatgggctgtattttcctgttaatgcatcatttccactgatccccatcactcatccatggcttctcatctgagagatgaggtggtcactcaagagtttatttctgaacatttggacatcactccctgctgaaaacacaacaccattaaatgtatcaagcaaagtgctataaggtttacatcattttcaagttcaataatggtgacttttactgtactggatggcaagtactaatattacaatgttttaattacaaataaatcagtggtcctccactggggtgatttccccccaggggacatttggtaatgtctggatatacgctttggggagttcagaggtgggggatgctattggcgtctaatgagtagaggccagaggccagggattctgctcaacatcctataatgcacaagtcagccccacaccaaatgaatatgtggcccacaatgtcaggagttgagaaaccttgaaataaatacatcccttgcagttctgactagttcagaagtaatggaattttacagtgctggaattttactggcgactaaagccactgccttcacacaaaagcatgatgccatccctgagggtcagggtaatgataaaaattggtgtattcagggacattttgaagaaaaatcctgtctgagtatttcctgcatgggcttacctatttggaagaaaaaattttttaacccatcatgatcataatacttacctgaatacctttaacggcacctaaaatgaacactgaatttcctttttctcccttttccccaggatggccctgaaaataaaatatgtatgtacttaacaggaaaatagcatattaccatttcagtattttcttttctatataaaatataactcatcagttaaaattaccattattgacatgattaacaagaagacatttctgtatcctcttccatattattatcaccctaaggttctcacatatatttactccatattcagttaagatctgttaaggaatcttctaagacagaatatctactcatatatagctatttagcagaaaattttcatatttccttacaatataaaacacatgcattgttcctacaaataactaattttgcaattgttaatttatgccctagaaacagtaaaacgtatatatatatatagagagagagattttatccatttcagtacttgtattcaaaataggcctaagaattatttttaaaaacataacatgttcctttcagaaggtttttgtatatagttgctagtttgcttaggatattttttaaaagtgaatgaaataacctcagtgtattcttcccctccccaaggttttcctacttaatatcttaatatcctactttaattctttttttttttttttttttgagacagagtctcgctctgtctaccaggctggagtgcagtggcgcgatctctgctcactgcaaactctgcctcccgggttcctgccattctcctgcctcagcctcccaagtagctgggactacaggcacccaccaccgtgcctggctaatttttttgtattttttagtagagacggggtttcaccatgttagccaggatggtctcaatctcctgacctcgtgatccacccgcctcggcctcccaaagtgctgggattacaggcatgagccactgtgcccggcccctacttcaattcttaatatatcttctcttggttaccacataaaaatcctaccatctttatatatcaagctcatatgaaagatatatacatttcaaagttaatctctcttagaggagtgcttgacttggcttctgatgggagatatttaacagcataaggttaaattgcatcaacaatttacttgagaaatcaggtttggtagtatctgcagttttggctttgcacagttccagtctgaatgaatttcagtttcatagttaagttaaataacaccagttctccaacaacatggttcaaatttcagtcaccattgtgtattgagtacttgcataacgtacaaacttcattgctatcctctcagcccacaaatcgctatataaataacagatgtgaattgtgattactgcatgatcacgtgatgttaccaaaacatgttgcaaagaaagtcaatgactgagaggacgactactgccaaggaagaaggctttaattaggtgctgcagctgaggagttgggagatcagtctcaaatccatctcctggactgactaaaattaggggttcacatagcagggaagaaacgtaacaatgtattggaaaacaggacctaggtaaggaaacaaaatcaggggtctggcatctcattgtctggatgccatgatctggtgtgtttcagttctttgatacttcttgagaggcctgggggtcctctcctgaggaaggaactcagataaaacacataggtttcaaactttaagatcagaaggatccatttctatgttgatccaaagaacatctctgggactaatgggtcagtttcaatgatttctgtcaaagtctgtctgtgattggcccctgcacacgtattattcagagcacacacacagacacagacagcaaagtttgtagctggcttgcctccttatctcccagcaataaacccaaataacattttacaaaaatggatagttggaagaggaaatcggccaataatgatgaaaatgaagcaaagaaatgaaaatggtaatgctggaaatgaaattcaaataaaacataagtggagttatagaagcaatagctgatcatgggaataatgagattgttgtcatttgagagactatttgcagccagaggaacttagtaaagagaaaccaggaaagtggttgtgatgaaaaggatgacagcgtcctaggtaaagtgacacagatgaaaacttcacattaaaggaaccctgagagatatttcacaacactggaaacagatccgaacttaggagtatcatacttcctcaaaacataaaagacatattcctttagtatcacaagttacatgatgagaaaaaggcaagtactgttgaaactactcttgataagtttttacaaagaaataaaacactttggttctcaatgcttcaaattacagtatattaaagaaatatttagttttttcatttccttatataactggcaaagtttctaatgttttaacaaaacattttaaaagtcatgggacaatattaattttctcatcagttgataaggtttctttgcgtggtttttagcttgcctggtcattcttactttactgtgcaaagtgaggggtgtctgtatagtaaatgagtcaaggggaagttggttgctttgcaaagagaccattatgacaaacttcaggattgtggctggtactgcatgctatgttaaagttaaaactgagaacccttgctctcttgaatgctcatgaatctgtagaatgaggtttggcctgatttgaggagcttaataaatgtgcattcaccagactgcacttgagttttcaaatggctgagtttgaaagtaaaggatggttgaaaaacttaacaatgaaaggtggtggatgttcttatttgataccagaagaaaaatgtgagtatggaaaattctttttgagtttagtgttcagatcagttcctctagaatctggagcaaaaggaagactcgtgagtgacagcagaatgaatgattatggtggtcatgctaagaaaactttctagaaagaaacttgtgaaatgatattttattaaggaagggagaaatgctaaaaaaaaaaaaatcacagaaaaacaatttggaaaggtcaaataatctctgatctttatttaagtgagaaaaagaaaaagagagaaagaaagggaatatggggggtagctcttgctccagttatgtttaaatgaaagtccaaaattctgaagaaaaaaaaagctaagagccgtaagttttcccccaagtgctggatactatcaactgttgctggacatccattccaaatcttttctaatatatttttttgcattacaggggctagaaagataaaaactacattgcccagactcctttatagctggatgtgaattaggttccacctaggagatgtggaaggcagaagtttggaagagattctcttcctggtctgttgttgctgccaagcaggaaagcagaaacttgagtgttctgtttgctagtgtctagacgtggggtgacaggcagtggttacagtgcagttacagcttcctgactccggatctcagctagctgtgaacctttgaaatcagtggtctcgtgtggtcctaagttttactcttccaactattataataagtgccagaatccctgtagcagatccctttctgttcaaaatacctagtggggtttgtttctgcaattaaccctgaatgataaacaatttacattttgctacctggtctctctgctcttttttccctactatctattctcttcacagcagccagagacatcttaatgaaacatcaatcagatcatgttgcttccttccttaaaaccatccagtgcctttacctaacatggataagaaaatctagcctccttccatcatccacaaagtcctgcatgttctaagtcctgcctatctctctgtccttatcccccagccactcccatttgttgacaatgctccaggcacacttgtattaactctgtttcttgaatacatcaagcctgttccaccacagggcctgttcacttaagattcctgttaagatgaactgtgggtatcttactagggggcctcctgggccaagagctcctcttcctcctggaaaccctgggtcacctcttgagccattgtggccactcataccaggtttgcctctgggtccaggaggccctgggtgcccctgcagaaaacaaaattataagtgaagcatttttgcgaaaatatcattacataaaggttatgcaatatgaatactcaaattatggcaattgtgattcacacatttactgtttagttttgtgaaactttctctttaccccaaaaggctacgtagcatgtaaaaataaaacctaaattttttttaagataacaaatttaaactaatttagtttgcagtactctgggaaattgaggaggggaccttccttaaaatccttagaaatactataatgaattataaagcccccacatacctctttttttttttccattccattttcatatgagaaatgggagtattaagctcactacaaatattaggactcatcagcaaataaaaacattccttatgagtatgcattaatttcaagaacattgtacttgacataacaagtatacctagctcatattttggaattttttctctaacctgttagaaaacgttgctttccaagtaaagtgttttgctctgggagttattgtacaaaatttaaatgtaaacaccctttcatgcactaaaatgagaaaatataaaaagagtttgctatgtataatatataccatgcaccataacatatatatatcttgcaccatattttatacatgttatacaatatataattaacagatattatgatatataaactatatgtaagatataagatactatataaaatatatgtaagatagctatatatcgtatatactatagattttatatatgtaaaatataagatacatattgtatagtatacatactatacatatcttatatatacaatatatttggtgcaaaagtaattgtgggggattgaaagtaacagcaaaaaccgcaattacttttgcaccaacctaatgtattctatatcttgtatatctaatatatatcttttatatatgtagatatatattatggtgaaagatatatatatattacgttgcttgtggtatatatagcaaatatttgctatatataatatatatattgtggtttctataaatatatattttatgtatatatacatgtggttttaaggattttgatgagtacttctgcctttttgaaaaaagtggagaaaatttagggatacttacaggtatgccatctaaacctggaaatccaggaacaccagttggaccctaaaatcccagaaaataaaacaaagagataaaaattattaaattaataagctgatttacttgaaaatagtaacaattaattactcatctttaaacatgctgagcagtcattgtcacctattttttacatgatgagtctaaaagccaacatttaagaaccaattcttgtgcttttcttttgtacttgggaaaacagcctagcagtactgatttaagtaaatcattcaacatgctgtgaacagaaatctaacactccgaatctcgatcctagagtaacaaacccttaactgtgaacacaggcaattgataggattatttttgcacatctgcactacccaaagttggggtagaatctcaagtgctcatcaacagggaataaactatagttttattcatactatggcatattatacaatgttttttcaggaataagttcaatctacatagcctgataaggaatggtctctaagacatattgttgagtgaaaagagaaaactcagtgtgatgcatataattaatgtcatgtaggttttttaaaaagccatgaaacaatataacttctcactgggtacacacatgtatttaaaggtccagaagagcatgctcctctggaaaggggccaaaaatgaggatgaattattgcagaggagttcagggacttcatttattataaggttcaagtatatactactcgtggttataaaactccagtgctggccaggcacagtggccaacgcctgtaattacagcattttgggaggccgaggcaggcagatcacttgaggtcaggagttcgagaccagcctggccaatatggtgaaaccccatctctactaaaaaatacaaaaattagctggacatggtggtatgtgcctgtaatcccagctacttgggaggctgaggtgggaggctcgcttgaacctgggaggcgaaggctgcagtgagctgagatcccaccactgcattctagcctgagtgacagagtaagactgtctaaaaaaaacaaaaacaaaaaatggtgcagtagtgctggtgagtctttcatgtgaatctccacataagatgtggcttaccttatctcctttgtcccctgctgctccaggagggccgcggtcccctctcattcctttctctcctgaaagcccaatgggtcctggggctcccaggggtccaattggaccctgtggccctggtggtcctggtggaccctgagaaggaagattaaaaagaaatgggggtgcaattcttaattactgtcttctaacacaaacatatactcattcaggcctacagaagacttggaaattagatttgcacaactctaataatagaaacaaatggctggagatggtggctcacacctgtaatcccagcactttgggaggccgagacaacgaggttcactcgagctcaggaattcaagaccagcgtgggcaacaaagtgagaccccccatctctacagaaaatataaaaattagctgggcatggtggcgtgggcctgtagtcccagctattcgggaggctgaggtggagaatcacttgagcctaggaagccgaggttgcagtgagctgatcgcaccactgcactacagcctgggtgacagagacagaccctatctcaaaaaaaaaaaaaaagaaaagaaaagaaagacaagaaaagataaaaggaaaaggaaatgaaaggaaaaacaagacaagaaaagaaaatgattgacttaaaacataagaaatagtggcattgccctttttaatctgaattaagctatatgataaatttcaattactgcacatgtgtatatgtatgtatgtgtgcagtatgtatgtatgtgtgtgcacagaaacacatatatcaagtgattatagttatcttactattttcattctgtcaatcaaatttagagatcttgggctttttaatgaagcaagaaactaaaaaatcaaagttttatttacctttatgttcgtgacacaaatagagtaagggaaactgccagatcttttatttacttcaaataactaatgatttgcctgccctttcgaaggacaacatttcttttttggctgcttttatctaatttcttagtcatattttggaattagtctccatgtcacattaaatttatgtaatccaactttccatgaatgaaaaggccacctcttgttttaagtgaagaagctttatggggctcctacctcagaacccatgtctcagggccctgccccatctcccttctggggtctgggcctggccaaggccagcagcaccatctaaagcgatatcccgaccaggtgcagtggctcacacctgtaatcccagcactctgggaggccgaggcgggcagatcacctgaggtcaagagttcgacttgcaatatttcatacctctcaaaatttttgcaaagatttaagaaaaattattttataacttcttgcttcacaaaacagcatggatgactgcattaaataagcaagtaagtcttgatgtatggacagaaaagcttggcagggtttaggagatatctgctcagatcagatgtcttaggtctccagggctaatacagggttgccccttgggaatgcagggccctgagcaaaatatttcttgcagagtcgcatctatataaaaactggagtcacccgaaatcagcatgccagccctactctggcaacccaatgttgtgcagtcccatcaaggaaatacttcatgggcaaatggaagtgttctgctaggcagccaccctccaaaaccagggctcaaccaaagggccccagacaatcgcatagcatgaaggccagagctcctcatgtggtcaaccccacattgggtagaaggtcagagagcaccttgacgagaagaaacagtaactaagacccacctggtcctgatccacacttggggtgtcactttgtttatttttatttattattattatttttttttgagacagggtctcactctgtttcccaggctggagtgcagtggtgtgatcgcggctcactgcagcctccacctcccgagttcaagtgatcctcccacctcagcctcccaagtagctgggattacagttgcatgccaccacacctggctaatttttgtatttttagtagagactgggtttcagtatgttggccaggctggtctcgaactcctgacctcaggtgatccgcttgccttcagcttcccaaagtgctggaattacaggtgtaagccaccatgcccaggtgggatgtcactttagatagtgctgctggccttggccaggcccagacaccaggagggagatggggcaggagccccgtaaaaatagtgcaagaacattcaccacagtgttatatgcaatagcaagagaaaccggaaatccacgggaaaggcaccaacctgagactcagtgaataaattagggtgccttcaaacaggaaagccctcacagcctgacttcatcagggtgctccaggagcaacacagaggatgagaagtcaatgagaccaacttctccatttgagaagtgaaggaggtgcaggtcaggaacagagcgcgacccacggaagtgaaggcagccaagaaaggggcagtttcaggtcagttatactgtgggcacctgggacttaaccctgaggggagcccacatctcagtgttatcccgccctaggggaagggagtgggggtatttatctccttggctgagggccctggtgatgggtatggagtgcctgccaactgtgcctccggggctttggataaagccctgacagacacagatgccagcagctgaagtcccccagagcctgagcacagaaacaacaggtctgaggaagacgtgtgggaccccaaaagcacgtgcaagctgccagcaaagtccatctgttcaggccgacatagaacatcctccccaagctcatgagggagaaacagagtgagcacccaggctatgcgtcagcctcctgggtttgaagcccaggaccacactgacttgctgtgtgaccttgggtatgtttcttaacctctctgttccttggcatctttatctgtcaatggcttatgagcataaaaagaataatgcatgtaatggtgtttagcatagtgcctggcataacaaatgctaactattgttattatatattattattataaatggataattgttaaaggagaaaaacaagccacagaatagtatgtcatataatcccaccagtagagaaacaaaagaacagacactttccctaaatagatgtttataaatgaacatttctaggacataaaagaaactgcatgtctcataagtgaaaacacaagccagggcaattttacattctatgaggttggtgcaaaagtaattgtggtttttgccttttaaaagcaatggcaaagaccgcaattacttcttcaccaacctcatactttgtgtacatcttaccatcagcagaagtgattttataataaagattagttaccacttcttgctcaccattaagtcattaactcgacaaacatgattgacaacctttaacatctgcctaaattttacaaatcaaaactatattttataggcattttcccttttcttcatgctcattcatcattgttaaatagctactatttattgagtatccatataaatgctaaaagcttagaattttaaaggaaacttaaatacataaatatgtattatgaaaaagacaacaataaaatacaaagtgtaattacgtgagcacaaaccatttggggtattgtgagggtttatcaacttacaataggtgactgcacaaattctaaactacgatctaaaagtaaaaacaaacaatgacttcagagcacctttctgtctaacctgtgttagaaataagattaattaacataatctaaaagctcccatgttttctacatataaaattcaggaaataaatactttttcattaagtttgggaattatcttttcatcttgcatgcagtttatacataaacttccccaaattatcttttgtgaatgcagtactttacagtaatgtattatttagatacatactaaaatgcatgcttgaatataaaagggtaactgaaaaagagagagccaattaactgactataaatctctttaatgtgtttcattttaggcatgcaataccaaatccagtgagctaatgggaagtttgcagaggggaaaaaaggcgtggaaatatttaacacaacagttaagaataataaaactccatttagtatagaaacgtgtgctgatttgagaaaatgccatataaaatactttattttttttttgttttttttcttgagatggagtctcgctctttctcccaggctggagtgcagtggtgtgatctcagctcactgcaacctctgcctcccagattcaagcgattctactgcctcagcctccccccgtagctgggaccacaggcgcgcgccatcacacccgtctaaattttgtatttttagtagagactgggtttcactgtgttggccaggctgatctcgaactcctgacctcaagtgatcctcctgccttggcctcccaaagtgctgggattacaggtgtgagccactgcaccctgcccatataaaatacttcgggaggaaaaaaaaaaagtaaagcagggaatggttatttgcattattgaaggatgctaactcctctctctcaccatctcctccctcctcccagcctgccaccctgacctccctgcaccagatttctagacaagctctgttctttcacagcatttgcgcaggctgtcctgtcccgggagcgccccctctctgcctctggctgattcatctctcaaggctgcagtggaaagattcccctgatctcctgcccctgttctggagaaggagatgcctctccaaggtgcctctgcagtaacactctcacccgtgactatcataccctcttcacttgtctgtccctcccaagcccacagccacccaacctctgctcctggaggggaaggccgagtctaagtgcccaaggtcatgatggtaagaaaggcagagaacaacaaactctttataaaataataaggtagcccacttctaccccaaggcaagacaggcggccctccatatccctggctcccgttctgaggactcaaccgatccagatggaaaatattcgaaaatcaataaacagaaaagaacaatacaacaaaaattaaaaattttaaaatacagtataacaactgtatactgtatatagcatttacatagaattctaaataacctagaaatgatttgtagtatttgggaggatgtgcataggttatatgcagatactatgcaatttcgtatcagggacgtgagtatccatggattttggtatccagaggggaactggaaccaattcctcatggatgcaaagagataagtgtaaatgctgtcttatgtctctgaattgtcattcctagaacgttggttaacagtaattatgcaaaatggcaatgattccacagcaaactgtgcagagtacaacttcacaccatgagcaatgactctgaataacagagatgttggtgttttttgctgttgagctataatgtaggtgttgttatgcctttatttcaaccatatgcaatggcaaacactacccctactttgcaagtggaaaaactaacataaatttctccttttttacaactgtgaagactttgtgattttgtatttagtgcggtttttttgtattttaataagtattttgctacatgataaatttttaaaggaaatacattaaacctcaaataacagcacaaaatctgtcagaaagctgctcaccaaaatttcccaaacaccaatctttgaaatagtcatttgttagttcacctaatttgagtaaataatttattcacagcatacagagaataattctattttctttaaattgtttcatgtaaaagaatgggtcagtaaaagaacttgtgcttacaggtaaatatgtaggcttactttttcataaggttataatagaattcacttcaggacaaatagacataagtagcaggcccataaaagacatttttataactagagaatcattaaataatcacaggaattttgcatcactaaaaaaagtctttaaagaaatatttcacccagtcctaaccctgcactctccaccaccaacaataacctgctataaaacaagttgctgtgccagagtcagtctagcaaaaagagaaaaaccacccagtggaatgactggctttcagatgcacagcacccctgggtttttttggctacgtgcgcatgcaactgcctctgcagcttcgaagtcagaagacagagccgctgaatccagaaatgacaatcagcttgacagctgaggagactttggcatgccatgtgaagccactagatcatctctttctttctttcttttggttcaaaggccaaattgacaccgtatcatcaaacctgttatttgcgcctccctagagcagcagtaggctctcgggccagctgtacaaataaaggatgaaggagatgagagcagacacagaaccgccggcctccctgtcttctgaagccagggcattcctttaggattttgtcccttgtcggttgcctaagtctagaatgtctcttgaacagggctaagataaaattacttttatttcataacaacttagtaaaagagaccaaaagataagagggtatgtactgtactttttaaaaaccaaaatcttcaagtcagcctttttggctggcaatgatctggttgccccagggaccaaaacatatggggaatgacaaaaatctaagaaatcgtttgtcattttgtcagtaggagcactaggagaaacactacaaataaacaactacaaatacaggtacagccacactttttctgccatgacttcctgctctttcttagccagaaggtataaataaatgcaaggtataaatcagtgcaaggtataaataaatgaaaaactgaacaaacaggaaagatgcttttgttatactaattatacagattttccaaatcacccttgaactcttaagaccatgacatttatcataaaaaatgtcacaggaaggggaaggaatgtatttattaggcttggttatggattatgtggctgccatgctccataccttaccttatttaatgcaaccagcaacactgaatagtgtaggctatgatccccatatagatgaaggaaggtgtaacttattcaggctctcacacctagcaagctcagattcacacctggaccagtcagtctctcacctaaacctctcctcttccccctacctgagcctgagcctagcacaatggagggttcatccactaaatcacgctcatgccatgcccggagtgacgtttcaatcccttcaagcctcttcttatttttacacttaaaaacagtctatccagatacactcaatgttcttttataaagtttctttaggacacaatgttattaattgaattaattgaatacctctattttttgtggttctcaaatttaactttctggtcctatcctatatccccaactgttttctagaaactttcttgcatcctcttcccctgttaattcatctcacacattgggtcaaagctgagctcagccctctgcctcctccttccctgtcactgaagagagtaactctgttcctggcatcatctaagctcgccatccagctgccagccttgtcaccctctttccctcattctccatgtccttctcatgaccaagtcaatcacatctcgatttgaaccaaaacccaaatctcatgctcccatcttaccttcctcccactgccaagcacctggcccatggtcttgtcaactctcgcacgggttccacaagcaccaatctctcgcgtctccttaaccctgatcttctccccactgccccatgcaaccgtcaatgaatcttcttcagtcacccctttcctggtgtcattgctttcaccaacacctgcaatggggacaatctcctttccgcacacccgccaaccttattccctgcagtttccacacccccaccctctgccccaatcacacttgtttccatgaggtcagagtagcctttctttacctgtagctcaaattctgccatccctccaaaaatattataatcataacagtagcagtaataactgccaccatgtacaaatctagacacaacacaacagtgtgttaatacattcttctcatggaatccttaccaccctgtaaagcagaaagtcatccctgtatctacgacctcattcccaaaggaggaagctgagactcaaagacatgagacaaaggacctgaggctgttcagttctgacttcaaggtttctgcttccatttaactgcagtcctcatcaatttcactcccctccaaactaccacatctaccctaaaataattaatgactaaataacgtcatcacctatttttcattattgccttgtgcatgctactttgcttaatatctgcttggggtgatgtcttctagtatacttttttttttttttttgagacagagtctcactctgtcacccaggctggagtacagtggtgcaatctcagctcactgcaacctctgcctcccagttcaagcaattctcctgcctcagcctcccaagtagctgggattacaggcggccaccaccacgcctggctaatttttgtatttttagcagagatggcgttttgccatgttggccaggctggtctcgaactcccgacctcaagtgatccgcccccctcggcctcccaaagtgccaggattacaggcatgagccactgcgcctggcctctggtacactttttgcagccagggattcatgaacgtttttatttccacctcagcatcttgaccactgtcttgcacagtataaattctaaacatatactcatggattacatgatcaattaaaacttccacaattaaaatgaacaaataaatattcttttaaatatattcatcctttttatgagtctcattattcttaatccattattattatcattcctttcttttctaatgcttccctcctttttaaggcttgattgtaattcaaccagtcagccactgggtgacactacaacatcactcacgaatcctttggcagtgcctccaggagcctcccctattgcaggaaaaaggcccgttaggtgccaggaagagttatcaaaataaataacaaaaggtgttatcaacagtagacaatccagagactggacttcagtggcagagtgttttcttgtaccttaaagtaaccgcacttgttcacaatgaaataggggcaactgagggatttagcctggagtaacactcattcgagattttcactgtgttcttaagaggcagcatggtgcagtgggaagaaccctgcactgagaaccaggagacatggctttgccactgaacaacaaggtcaccccttactccaggccattggagaagggttttcccattttaaaacatggcatctgcgtcttctgcggggcctaaacaaggctaagggctcctggtaagctccctgactagctctaacccactcaactctccctccttcttgcctgccctgttctccagcatccctgccccttggccttgccttgatttgctcccacctgtgtcttgtggccccctcttcctcctgtttggagtctcccccagagctcttcagggctgccctggcttcttgtcactttctctccagccaaagcatccatttccaagtggtcaatttcacccacagacaatccctccgtgtccctccctaacccagacctttctttctgagtgccagtcacatatccaactgaccacaagcgctgcaagtccaaacctggactcatgatcgcccctgaaacgtgcttcctgagcgggcaccactgtctgcacagcagcttacacctctcctgggaggcccgcatgcctctaactgcctgccccaactgcgccaggtgagtctcctcattcctatcaagtctgcctcccaaatatgtccacctcccatccacttccctaccctccacactcaccccctcgctaagccaccaagacttcccacctgcatgactgcagcagcctcataacaggttttccctaacattacctacctgccaccagccacattttccaaacagcaccagatcatcttataacataaatccaatctgcttcttcccttcttaaaatctttcaaaaatttcttattatgcaggaaaatctgtctgcttttttttttttttctttctttcttttttttttaagatggagtctcactctgtcgcccaggctggagtgcagtggcacgatctcggcccactgcagcctctgcctcccaggttcaagcaattctctgcctcagcctccccagtagctggtattacaggcacccaccaccatgcccagctaatttttgtatttttttagtagagacaggttttcgccatgttagccaggctgatgttgaactcctgacctcatgatccacccaccttggcctcccaaagtgctgggattacaggcatgagccaacctaccctgcccctgtctgctttttaagctgcattgcatgctgccgggttccttacccactgtggtcaaatttctctctagtcacgtttcagtccctcaaacatgctagcctgtctccttcccacttcagggctcaagcggaggctgttccccttgtctgaacacttgtagggagctgaatggcgccacaaaaaaagatacgacatgtcttaagcccagagcctgtgactattgccttagacggcaaaagacctgataaagtgaaggttcttgagctgaagagtttctcctgggtgatttaggtgggccctaaatgctactacatgcacctttataaggaggacgcagagggagattgatgtggacacatagaggagcaggcgatgtgaagacagaggcacagactgaagtgaggccgctaggaaccaaggaatgccaaggactgctgacaccagaaggagtggaaggaggcaaggagcaggttctcccccagagccgtggagggagcctggcagtgccagcagcttgcttttggacttctggcctctagagaatacatttctgttgtattaagccaccatgtatatggtcatttgttacacagccatagaaactgacagaaggcttctccttcagactgtggctaggagagttctaattccacccggttcaagctcaagtgctaacccacagctccctgtgccctgaccccgatatgctcccatgcaaagcaagccagggcaccaaattgtccacctggggagggagcaaggatttttgtctcatcttttccctgatgtgacttgagcacctcaaacagtgcctggcgctcctcaggcagccagaaatagtggccggaggggagtcttgtctgtctctcggtttggctctgagctccaggctgcagggactttcttctttacgactgaggcctccatggcctggttggatgcctggcatgtggcaagtgctcaatggttacttgccgaatgaatggaaagctattattattggtattattattcgttgccattaagattgtatgatagaggacgagtgcagtggctcttgcctgtaatcccagcactttgggaggccgagatgggcagatctcttgaggccaggaattcaagaccagcctagtcaacatggtgaaatcccggctctactaaaaatacaaaaattagccgggcatggtggtgtgtgcctgtaatcccagctacttgggaggctgaggcaggagaatcgcttgaacacaggaggtggaagttgcagtgagccaagattgcaccactgcactccagcctggcaacagagcaagactctgtctaaaaaataaaaaataaacaaaaaaaagattgtgttatagagaaataagcaccttggagacagctgtttgtggatttcttggcaaattattgaatatggttgtttgaaaggagaaatttgcttttatttcctaaaaccattataattcctcatcttagctaattagtcagacgttacatttgtactaaagaggtattcttatactaagtgctttctattttcctatatagtagattatttcccccaaactgtgccctgcttttgagtgcacctgtatcgctagcccttatttcttgccaataacaagttcagtgtggccctgcatttgctgagctccgcacccagcctggcctgggtcatgctgggtcacacagtttggcagttgttgctgtggaattgaactccacatgaggagaccaaaggccctgttgcaaatcactgacaagttaatgaggtgactgaccagggcagatgtgcccaaaactgccttcagacccaaaccacaactaggattcccaggggagagtcttgttatgttagctctatacgtagactcggtctgtttggaaaataggtaatacattctacagtgtagtaggcagataaaagcttcttttctctcttttctcatgcacggatgctggatttaaagagatatttctcagtctactgaaatgatgttagttagttggagttattttcccatgtagacatcagctgctgctgctacttctaccactataatttattaatacgccaaaaagcattaaatgataggcagggatccttcctttactctctaggcctcccaaaccctgtccagaaatccttactcaaggccaggcgtggtggctcacgcctgtaatcccagcagtttgggacgctgaggttggcagatcacctgaggtcaggagtttgagaccagcctggccaacatggcaaaatcccatctctactaaaaatacaaacattagccaagtgcggtgggggtgcctgtagtcccagctactcgggaggctgaggcagaagaattgcttgaacccaggaggcagaggttgcagtgagccaagatagcgccacgacactccagcctgaatgagagagactccatctcaaaaaagaaaaaaaaaaagaaaaagaatttaaaaaagaaagaaatccttactcaagcctacacagatcatcctatagctgaagattcaggctttaacttttgcaagttttttattcttcagaaatcaaggttcctgttcttgacacaggggggacactttaacaagctaagcccacattataaactggaagctggtgggctgaattttactggggagtgtgtttaattgctaggcactgggttttttaaaaattctgaattctgatgcctttaaatgacaaatgcaccgtccagctcctagtagccccatcctgagcacctcctctccccattactacattcaggtcaccagctgttccccaaggacatctgagtctgccatctctgacagggacttcatttaccagggaattctccagtagtaacaaaatgagccagagagttcttggaggaggaagatatagcaagaagaacaaaaaagcaaacccaacaagctcaggggttgaaagaccacctttgccaacttctaattgtcactggaacttgtttacatcaaaatggaacacaattgacttaagtgaactttggggacataaaaattattgttctgaaccatgtatcaggctacaggtagaaaatgtcctaaaacacagctgtgtgagtgatagtgagactgagttctagaactttgagtgcaagtaattcaatgaaatgaaaaatgttaacagtaattaaactttcccaagtaaattccatttttatcatggaatgcaagctcttaggagtataagggatgagtgaatgagatcgcagggaaaatacttgcagttttttagtgatttgaaattctccgaagaaagaatgactcactcacgtttgattttggttttcaaaccaaaaagactaagacaattcttgacatttacgtcatttgacctccgtgtttgtaaaaccaccacatcataaggttttgttaattttgcaattgttatactcccttgaatagaaaacaatatggggaaaaaactgtggacagtgtctttattatcatccttgttactaaagtataacttataaaaggtcctcattctaatttgtaaggacatgtaattttccctgcaaggagcccaccagtaaacacagagagcttcctcccttgaaactgataaggaataatagaaaatcctgcctgatatacctcattcacacccttaaagatgggccatagtgaggttcatggaaatgttagggcctggtcacaagtcatttgggaaaccaagtaaatagctgtcatatgtgaaaacccacgccccatatcacagaaccatgggctgctagagccgaggggaccaaccagccccctctaggacaaattctcacatcccaggtgagggctctgaacccgaaaaagatcaaggaggtaagctccagtctcctcccctcagcctggagctcttagggtgccattgtaccttaaaaggtccaagagctgcaaccctcttatttgttgctgctgctcaaagtgcttatttctgaccctacctgaaattcacaagggaatttgaactatgtgagattactcatttcctaacaggcttaaatgctagtgtgtggggagaaagtctagggttggggaagaggctccccactaattctgtccccctcttctcttgggtatgggagatccccctacagagtccctgcatgctggcctgaccaccagctcagctcccaaatcctgtccaggctggaatctatttttttttttcttttgagacagagttttactcttgtcacccaggctgaagtgccatggcgaaatctcagctcactgtaacctccgcctcatgggttcaagcaattctcctgcctcagccttccaggtagctgggattacaggcgcccgccaccatgcctggctaattttttgtatttttagtagaggtggggtttcaccatgttggccaggctggtctggaattcctgacctcaggtgatccacccacctcagcctcccagggtgctaggattacaggcgtgaaccaccatgcctggcccctgaattttagtttcttaatttatgtgtattaactgcctgttgtgtgctatctactgtgataatctcaaagtacaaaaaatgacccccagtttacaaaggggagaagtgaaggtaggcaaactatatttcaagggtgtccacagtgggtcaggaatcaggatcaacgttttacttgtgttctcatgaccaccttcaagaagtgtatgcttgcaatctaatcaataaagtcgggcacattcactctcaaatccagccagagctacagagcagggcaggacaagtacagcaaaagagaagcaggtaagcagcttgctagggggctctggcagggagacatcgacactgactgtgatgagcagaaaggccttgtggtttggcatctccactgagctcctttgagaagaacaggaaagacagaggcagagtgcaagttggaaggcactcagaaaagggcagagaagtggaaatattcagattatcttcaagagtgaatgagtggcccaactgctgcagctggagagggtcaaaggggcagtaatggggattacagatgaaaactcatgctggggctagactgtgagcctccagcagtacagtgatggggctggacttcattctgtagacatcaaaggaggccccccttgattctccaccttagattgttccatctccacctctaactctagctctcctctccagttaaattgcgaaccatggccgttcctcagcacagaaccagccttgcctgtcaacgattgctttagacatagcagttttgatgtggggtttgatgaaactactacctactactacctactgctactacgggcattaacctgtaagagaggaacactttccttcttaggaatagcccgctatgccacttgaaggctgtgcagcctcaggcagatccctcaagccttaggaatttggtgtgttcctattctgatagtcccccgtgagctgtcactgcagctcagaaggttggccggctgctgaggacttgacagtgctactttcccaaaccaccttctgttacgcacaagtcacactcccaaatcctcgctggaagatgtcacaacgacttgcagccttcccatggaaaacccattcatctcaggaagaccacaggctccctgttgtggcacacacagctctccttgaccacgcagacacaaagacacacacagcagagtgccgctcaggactgggagccttccctatccagagactgcttagagggtggaaagtacaccatctacacatgcaatgccttgcgcttgtttaacagcccaaggacatagaagagaaggaccaatgggggtacgtgcaaggaaacccaggcttggtcagagtcaagtggcaacccaagtttacaaagtgatgctacaacccagcagttggtaccttcgtgtaatgatctttccacgatcatggagcaaatgctgggtttgaagccagacacgtgggtgtgattcctggttctcctgcatcctagcaagttatttagaactgttgggaatttagtttccttgctctgaagggtggaaataataatacttgcatcacagagcagaggtgagattagaacagggcttctcaatcttggcacagttggcatttgggatggataattctttggtgtggggactgtcctgtgcattgtaagatgttgaacagcacttctggtctctacttgctggaaaccagtagcatccccttttctgctaaaacaactctcagcctcattcacattgggagacccactgaggtgcctttatcaaagcaactggtcctctttgttttggggtcggctcatctctttcttgccacagggctgatcaaatctatttatcttggtcctgaagctcaaagtcataaaatttagaggcactgaggttttttttcctttttgcatttgtacaatcttggtatatttacattaataacctcacagaaaagccaggctttttttctatataatgtgcacatttacacaaaaaagctaaggactttgttttcttgaagcttcacttttaaaattatattatgaaagtggctcaagaccggcttcacacagtggctcatgcctgtaatcccaggactttgggaagccaaggagggaggatcacttgaagccaggagtttgagaacagcctgagaaacacagcaagactccacctctacaaataataataataataataataatcaaaaaaataattagcctagtgtagtggcatgtacctgtaggcccagccacttgggaggtggaggtgggaggctcacttgagcccaagagtttgaggttgcagtgagccaagatcatgccattgcactccagtctgggtgacagagtgagaccctgtctaaaaaagaaaaagaatagaaaagaaaaaggtctctggcctggtgcagtggctcacgcctgtaatcccagaactttgggaggccgaggctggcggatcatgaggtcaggagatcgagaccatcctggctaacacagtgaaatcccgtctctactaaaaatacaaaaaatgagccaggcatggtggcgggcgcctgtagtcccagctactgaggaggctgaggcaggagaatggcgtgaacctgagaggcggagcgtgcagtgagccgagatcgcgccaccgcactccagcctgggtgacagagcgagactctgtctcaaaacaaaaaaaaaaaaaagaaaaagctcaagataaattctgatgaacaaaatttttgatgtactgaagaaggaacaaagcagtttaagcatcagtggatttgtcataacttatgctcaataaggtagctgctcccagtaaaataggccaacaaaggaacccattgcacacctgctgtgtaaagatgaagcaataccatgagagaaatatgttgtcccttctcttgtgggtagtgttttgtgtccttgtagactcctctttactgtactgtgctttttgaatgtcatgcacagccccctacaattgacttgaacactgttacagactgaatgtttgtggcccccaaaatttatatgctgaaattctaacccccaaggtgatagtaggaggagatggggtatttgggaggtaattaatcagagcggagtagtcatgaattggatgaatgcccatataaatgggaccccagaggactctttctctccaccatatgaggatacagtgagaagacaccatctgcacaccaggaagcaggccttcagcaagacactggatctgccagcaccttgttcttggggttcccaccctcctggactgtgagaaataaatttctcgtaagccacccagtctatggtattctgttacagcagcgagaatggatgaggacacatttcaaaagaatcattgatctgactcaaaaattgtcccaaacttctataccacactcctttcttgtgagattgtgggagtaattgtaattagagaattgtttgatctaatactttatcacaaatgaattagtgggctgctgtcagaacatgggggagacattaacaaatgttcaagagacctgacagacagtaaccaaagaggttcttggctttgcagaacagagaatctagcgtggtcatcaacgcaaacgttctgggtggacttgagcaagacactaactttcttgggcttcagtctcctgcactgcaaacatggtatcctaagaaggttcttacgagaagtcaatgagcagaagcattttgaactcatagaacagtgcctggcacataacaagcatacaaaaaatatagctatcacttcattagaacactgtgccacttgtttcaatagcgacaatccaagaaagagtcctgtggtcaactgtctggaaagaccaaacaaacttggatttttttctaccaacttcagtacctctcagagcctttaaaatgccatatttcaggatggtgacccagtagttaccatttcacaccaggacccttcctccacaggacaattcacaagactagtgtcatataaaacaatgggtgaatcgcagcttcctagactatcttctaagcctggactgtctaatatagttgagattgctattagaatgtgaaaaacttcggctgtgaaatacataaacattatcgaggactaaaatttgccaagaatctgggattactttatattaaatattcacaagttctcaaaattcaggaatgctgcccatgttggtctttacatcacttacccgagaccccttttcaggaacacagtggcaaacagagcaatctcttcctccacaaggaccaatgtatttctttccactctggaaagtgaagcatcttatttagtataccagtactcatcgtttaactacgtgcataacacatacattataacaagcactcttggtttacctttgactccatgagaagaaaagactaatcatgacatataaaaagatgaagaacttacacagtagcttaataataaggagggttgattatatgagcaagaagcttccaaactgaggatgctgaaggaaaataagtatccttctaaagtcgtttggctttaactggaatcttctgcagtttctccctttcggtaagacttaatttattaagttgtgaacagtcttagagtgtaaactatgtggttaggcaatccatgcatagacagtggagtctagtttaaatgaaaagcttgtttttttttcagggcctgttttgctttatcttcaagatcagctacagtgtatctcctccctcatcaaactgtccttcctaggacaattcttctgtcccatccttgggcttaaaattaaaattgttgttcctacaatttgctgagactccaagatggtttctctaatgtgtttctcaaacagaaactcctgaacttgaataatttggaccttttccccacttttagcaaactttccaacactgtctttagagcatcacacacacacacacacacacacacacacacacacacacacacacaccctttaggaagaatcagctccttgttctcatgaatcctaatcacctatatccagagtcatcatccacttccatataaaagcatagtcccagagtactatttccataggcagatcccttaacagcaatcaccatgatgcacctgcaatgaacatgagcactgagcgtgcattcccaggctgggcctgccagtggggagggagtggtggtttaggcccctgtgtagtggacaaatcacctctaggtgctaggacccaagggcatggataagaatatcaagaaagcatcagagaaaaggtttgcctggctcatgatctggcctagctgtcattgcaacatttatacattggccatacaattttatgattgatcaacctttttaaacttaaggctgtaaactcaagcctttagaccactgtatgatgggaaaacataaaacaataaaactaatatttatagtcccatggaagacatatatacatatgtatgtgtgaatgcattgaatatatatgtgtatatgtgaatattcatgtacgtatacatatatatgaacaggtatatgtgtatgggagggaaaagagtctaatcagcatatattatttttcttttcactcgcacagtttaggcttattttttggagaaaaatatgctcagacacaatccaaaagaaaatatctttaagcattaattttaaaaagacatctttgtaaacaatattctcatggatcattaaaagcatacaagaatttgaagcttgacgagagtcaagcgattagatagtttaagtttaaaaatgtatttgaagtttcagaaatatatgcctcttgagttttgagtaatgttgttatctataaatgcagaaatattaagttaaacaccctgataaggttaaaaaaaaaattaaatgcccgggcccaggtcgggacagcatgaaagcacttaaagtaactagattgaatacttgggttcatttaaggttgggcttcattactatgtgttcgctgaaatatcaaaacaactagaggaaaaaaaataaggtcagctgattagatggcttgataataagggcaagtttgttattattatttctttgcttatttttgccaaacatcactgagatgtttgcagcaaaactatgtttcaggaaagaatcactttaaaatagattagtagattcaaaaaaaaaaaaaaaaaaaaacaggaatagtcacatatcaaggtttgacttggatcagtaaaaggaaaaagcaagaggtgattttagcctctgcaaagttattctacgtaaacattccccaataaatatttaaaagaggagggtgaaattatagaggtctgcacctcaaaaatagattgtataaattcattttaaaagataaacacaatatttcagacaattaaacattcaaagtacgaacgacattcactgggaatacattcacgctctcggaaactaatgttactcttcttcaaagagaaaaaaggaaaagtcactatctgccttatctcagatattgttaaacatatatttgtcacatagaaaagttcaaaggctggctgcggtggctcattcctgtaatcccagcactttgggagggcaaggctggcagatcacttgaagccaggagttcaagaccagcctggccaacatggtgaaaccccgtctctactaaaaataacaaaaaaattagccagatgtgatggcacatgcctggaatcccagctactcaggaggctgaggtgggagaatcacttgaactgggaggcagaggtggcagtgagctgagatcgtaccactgcactccagcttgggtgacacagtgagaccctgtctcacaaaaaaaaaaaaaaaagttcaaacaaagaagttattaatgtcttatacttgtaattccatcttcttttttgaaaaacaaataatatagacacataattttaaaaattcaaatggtgccaaagagtgtaacaggaaaacaaatgtcctctttcaacactggccccaagttccctcctatacaggataatttttttcaaataggtgtttgggcattaataagcatattcatacaatgacctcattcacacacacacacacacacgcacacacagaggcagatgagcacatgggcacacaggcacagatgtgtacaaacacacttttggtgatttggacttgttttatttttatccaaatggtggattgctctatattttgctgttttcacataattgaaagtcttcaaaatcattccaaagtaatacatatgcctatccatcagaccacataccatactttgtttaaccagttgttgttgaaggaaatttagggagctcccttctgtctatactgaacactaccctgaaattagtactcttgggcatatttatctgtatgcatgaatcagaataaacacgtatgacaaattccaaaaagacacattcctgtgtcaataggtacgtgcattcaaaatccggatgggtaataccaaatcgcttcccacagacatcgcatcgatttgtattgctacctttaaaacccaatgataatatggccactccctgtgtgaaatctctagactctctgcacaccacaagctggtagaagtcctgggatagaaaaatctttgattcagaaattatgtttacttgtatgcaatattttaaaaaaagtaaaatctaggactctgcagacttttataacaggaaaaagaatataacacaaaaataaacttttaaaaatcaggtaagagaaatagaaaaaatacacatgtatatatcatagtattgtttccactcattatttcaggtgatactctcaaatgcatgtcaacaaagtcgggcaagtcttatcatccctactcaatacaggagataactgagtcttatataagttaagaaatgaatctttggcagagccaagaaccactggctcctcattctttgacccaggtgttttctgctcccaacttgtaggaaaaggagaacagaaggtaattttgcactttgatttgctttgaaaaaacctacaataacttgattcactgaaattgcattgggtgaatccaaggtggagagtatgaacagatagggttatgttcactagagtgatttaaaccaagtcagttgtctcaagatcaacctgagttgcaggcaggccacaatgggatttcccagacacgtctgagggtgagtttaatgactgggattcttcagtgaggaagcagaagaaagatagcttattacagaatgttctgggcttatttttcttctgagctaaaatgttcaaattattcttgtatttcttgatttaatcttgaaatggcccagctgcctcttgcctgtctccaaaaaaaaacttttaaagaaagggttatgtttgtattaaaataaagaaatccccaatacctaggcaattcagaaagcagtcttgactatacaatataaaagaaatcttagagtttatttagtcctattctccattttacaggtaagaaaattgagtcccagagggtgatttctttgaaagtataacaaaaattatgcattctataaagtgaattttcacaacgcaaccagagctagtgaatgtacttaccccatatacatattgtacagaaaagagaatgagtataagtgacctacagaaaaacaaaaacgcagattaatttaaacagtttcttttcatgtgaaacaaaaagaaaaagagtaaaggaattaattccagaaagctactttttatttctatgaggctgctcctactagccgacttgtcatcagtgacaagatccatgctttcctctctctggctgccatcattgcctttcctctttttaatcagccaagaagtgtgtgttgaaccccttgtgtggtcctcattgtgctggggaccgtgaggaccctctgaaagtgagacctggagggacagatgagtgaaagaagatgattctcagaatgaaaactgcaggagagaaggaaggaggcagctttgttcagacatgcacattgctgagaccagtgtatcccataatgccatttagtggaagcaactagaaggagggaaggtggaaggaaacctaactggactgggaggatggtttggagaaaaaaggaaataatatggaatatttagggaaaagttatgtagtccagggccttataagtgaggcagaaatccaactggggtaacttcattattacaaacaaattttaacagaggacatatgcaattttaaaagaccactaaaaggccaagtgcggtggctcaggcttgtaatcccagaactttaggaggccgaggtgggcggatcacctgaagtcaggagtttaagaccagcctggccagcatgacgaaaccccatctctactaaaatacaaaaattagctgggcatggtggtgcatgcctgtaaccccagctactccggaggctgagataagagaatcacttgaacccggaaggcagagattgcagtgagccgagatcgtgccactgcgctccagcctgggtaacagagtgaggttctgtctcaaaacaacaaaacaaaacacccattaaacatctgcatatattttctagaccttatatttgtcaaacagcttctggatccatcatcttatttaacgcttaaaacagctgtggttagaacttcgggtcacaccattccaaaggatggtaggagaactggggctcagttctgggctgtgatttatctgccatccttgttcttttgttctctgtagagccttctcctctctaaaacctcatgtcctaagtgagcctttgttctccaccctctacttcttcctcttttgctgagatgccgacagacactacagatgtttacagggctgtggatctgggagacgagtaactgggtccagcccatacttaatggctcccacactaaatttcctctctcctcagctgttttcatgataattccaacacaagccaggttggcttttcattgtagtaaccaaataaataaagagaaaaatataaaggaggtgttaaacaccgggaatcaactgctttaaatcaggttgaatgtgtatttacaactcttgcttgttaaatgagttattatcactggacatttttaaataggatatgttgcattttatagcaattgtcgcttttctctatataatctcatcaaggattgtaggcacagcatgtttcttaaaccttttatagaagagcaaacagacttagaaaagttggacaatatgctccaaagagtgcagacagaatggccccgagggggccagctcgggtcaggtccgaagctccttcatagtccctttatactgcactggacttgttctttctgccactgtagatattaaaaagtaagatcattccttttttttttttctttaaaaaaaaatccacaattaagattcctttccatttcttccacgtccaccccaaatcagttaagactggaccatattccttcccaccaccttcacttctttcactccccgtaatttcttgttcattatcctcagaactttttgtattttttcactgtttaacatttccctgtgttaactcccaatgtcattttgagtctcgttgaacaatctcatattggtttcctgttttcctattgctgctgtcacacgttaccacacactcagaggcttaaaacaatgcatatatattatcttatggttctggaggtcagaagtctgaaatgggtctgactgccaagaaccaaggtgttggcagagctgtattccttctggaggtccccggggagaatctgattccttgccttctccagattctagaggctgcccacattccttggctcctggtccccctcaaccttcagagccagcagtggccagttgcgtctctcttgctgcatcccgctggcctctgtttttgtagtcaaagctccttctccgactgctctcctgcttctctccttcacttccaaggatgcttgtcattatattgggcccatccagatagtcaagctcaggtcaactcctctatctcaatgtcagctgattaggaaccataattctatccgtagctttaattaccccttgccatcttgccatgtgacataacatattcacagattccagagattaagacgtggacatctgtggagggctgggggtgttattaatctgtacttgtgaagtagtctgtcctaactcttctagttatagggaccctgaaactttgggcatatgtcttttgctattcaaacctagtgagtaagcgagcaagaatctggggcctttccttgtgcaacttcccatttggtgattttgtggatgcatttcagggaaaattgagagggttggtgttcaataataaaaatgagtcatgaaatggcagacatacccttagctttctggaatgatttggctttttgacatattaagcattcagacggtttacatccatagaacaaacattgagtagaaattactaaataaaagcaggcaatcacactgaggatactcaccagggacctgtggccaaggacttggtcaatctgaaggagcacctcattagtactatgtgcagagaccacatcgcaggcaagtcttagtacttaaaaaatattctgccagtcttctcttccagaaggttcttgttgacaagtgaggttctgtgttctgggtcaaagtctgttcctgttagatataaatatatcacttaaaacacagcatgcattataatgttgaaaataattactttcattttttatcgttatggaaatattttctaaagggtaacttcaacaatctttccttagtgatggtgaaactgaataaatatcagtttttatcttcagaaataaaaaatcttcaaaccctttctatatcatgaatatatttttgataaatggaaaaattatgtgtatatattatatttttaaaatatatatttttaaatataaaatatatttttatatatgtataaataattgcttcattttgctatgtggaattttcttctgtttaattttttcccttgaacatccaagttaaaattcactcaaatgcttcttttactttatgaaactagaaaaggaaacttctagtatacaaacatacatttttgtatatttgtacacatacagcaaatacatataaaagtatttttatgtaaaatgatacaacctctgtgaaaaatattttggcagttcctcaaaaagttaaacatagagttactatatgatctagcaattctactcctgggtatatgcccaaaataattgaaaacacatgttcacacataaacttgcacatgaatattcatggaagcatattcataacagccagaaggtgaacacaacccgcatgtccatcagtgggtgaatgaataaggaaaatatggtatatccatacaatggagtattattcagccatgaaaaggaatgaagtgctgatatgtgctacagcatgaatgaatctcgacaacattgtgccaagtgaaagaagccacatattttatgattctatgtatataaaaagtccagaataggaaatccatacagatagataggcaattgattaatagttgtcagggtttgggagaggaaagaattgagtttctttctgggatgatgtaattgcagtggttatggctgcacaacattatgaatatactaaaaacctctgaatagtaaactttaaaaaagttaaaatgctgaattttatttcatcttgtgaattatatttttattgagataaaatttaattttatcaatataaaatagaaaaaatattttaaaacttgactcgaagaagtctttactttgataaaagatatatttggctcaaataattgaaatgtatcatttaaaaaactttggcttctttaaaagacctgtctctatgagaattaggtagagagaaggaaaccgggaatgttcaatgttaccaacttttttttttttttttctgagacggggttttgctcttatggcccaggctggagtgcaatggcgcgatcttggctcactgctgcctctgcctcctgggttcaagcgattcttctgcctcagcctcctgagtagttagtgtgccaccacacccggctaattttttatttatttatttattttttatttttagtagagatggggttaagccatgttggccaggctggtcttgaactcctgacctcaggtgatcagcctgcctcagcctcccaaagtgctgagattacaggcgtgagccactgcacctggccattacctatttttaaacttctaggtaaaagctgagcaaattaattcaatgctgtatgtatggaagacttgtttcccaagtaagtggtagaacaacattctacaataaagtttcaatatcaagcagaaactgaatcactttgaacacccagatcttttcctatccctaaatccataattttaaatttgttttagttataaactcaggggtgcctaagggagagaattcagtcataggtccctagtttctgtttctggttgggccagtaaagccccttcctcatctctcttttctgcttatcactagagaaagaaactaaaaatcatggtttcaggctgctaaaagcctaaaacaaaacaaaatagaacaacaacaaaataaggcaggttggacaagcttgtctaaagcacatctcaataaaaacaaattcttgttttggaaggaaaacgcaaattttttgaatacttaaacagcatttgatattttttaataaataggaaacagtcaaaaattaaagaaaaacaagaggtatttacattttgatcccaaaatatatgatacaaataaaattcacatgtattgtgataaaggttgtacagaggagaattttattaaaatagagtgttgttgtggtcacgttccagagagggaaggcctgattatggtcctaacacctgggagtttctcagtacattttaattggatggatggatggatgaatggacagacagacagacggatggatgggccaatttgcagaaacataactggtctctcactagccaaaaccatgaaaggacactgggagtagccaatgcattctcatcacatgtccttggttaccatataatctctatgacaatagcgattttgtctttttttattcacagatgtatccccagtaccatcgtagtgcctggaatgtattaagttctcaatatatattggttgggtaaatgaacatatagaagatactttgggatcttttgaatgtaaatcaagtatatttaataggggatatgaaaggagactaactttgactataagtgagggcgtggaagaaggaagaatgagggataactggccttgggaaaagtggagagaaactgacactttgatcacatgtaggatatcaagtcacttaattcttaccatgatttagtaaggaaattaatattttcattgtgcaggaaaaaaagtgaatcaatttaagtaattatgcaaagtcacaaggctagtaagtggcagaaccagtttgttgactccagtgtgtgtcccttctccctagtgacactccagcttagctacctttggacttctctgctcttctactaagaattctcttattataagaattatcttataataaaaattttttaactatacacttttgtattagtccattctcaagctgctaagaagaaatacctgagactgggtaatttataaagaaaagaggagattaattgatttgcatttccgcatggttggggaggcctcaggaaatttacactcatagcagaaggcacctcttcacagggcagcaggagacagaaggagtactgagcaaagggggaagccccttatataaccatcaaatctcctgagaactcactcactgtcacaagaacggcataggggaaaccacctccatgattcaattatctccacctggtcccacccttgacatgtggagattattacaattcaaggtgagatttgggtggggacacagagccaaaccatatcagccctcctttttttttttttaacatcttaaaactttcatcttctcttttaatagctacaaagaatataatttctggagtattataaatgatgacctttaaaataaaactactacagcattattttagatgcatccaataaatcataatgtcacagcagtctgatttttaccagcatcagcttaaaataaatgcacacaagctctttaacaggaattttacattgctattttttaaattcatatttccattccattcccccacatatatcctaatgcaatgtatttccatacttgaaaatatattgatcacattattatatttctctgcaacaaaatacttatgattatgtctctaattcttaaaattttttccaaaattggctttcattataattattagtagtatataattcatcaaaaacataaattttaatcttgataaacaattattgaatatcaaaagtaaaattttgtgggaaatatagttgttagtgaatgaattgggcctttttatttcgtatcagcttatgtagctcaagatcaacgatcctttctactgaaatgagacaggttcagcaacaatcctattccattttagtttccaaaactgtaggtactaataaaatttattcaacataaacaagaagttgtgaatgaaaaaaatgtgctacacaaatatcactcaattcttttaacttctcttgagtagtaaactgccatggtctgaatgtttgtgtcctgcacctccaattcgtaggttgcaacttaacccccaatgtgttggtattaagaggtgaggcatctgggacgcaattaggtcatgaggattgagccctccagaatgaggtgagtgcccttacagaagagacctgaaagagcttgtttgccccttccttccaccatgtgaggatgcagcaagaaggcaccatctgtaaagcagaaagcagcctgcaccagacactgaatctgctggtgccttggcattgcacttcccagcctccagcactgtgagcaataaacctctgttgttcataaatcacccagtcttaggtattttgttgtagcagcctgaatgaactaacatatataccaagagtgagatactaatttatcatctagaattaatttgaatgatttccaggctgacaagtcctccctccattatgatgaaaacaaaaagttggaaactccctgacccaggagttgtggagctggcaggttcctgttcttgacaccagccaatgcactggccctcattcagcccccagacagttcttacaccctgggacaaagcagggtggtaatatttgggaaaaattggtggttgaggggttgcctttcttttgaaaagcagggcaattgtgaaagaggaagtgaaaacttggaagaaacacccatttttggatagagcaattctacaaaaggatatacatgacaattgagaatctggaaatggaatcctttagtgaattttccaagttgcttgcataactcctgagaatctttttgtctcccaagggtccatgtgcttcagtttgaagatctctgtcttgaatgagctgctaaaggttaaaaactgcccttttcactgtttcaccagaagcaggccttaaaacaagccacaaaagagttgcagagacttttatgactgttctcctgcctaagatgcaactgctagatcacagctgagcagagcctccatcttgctgttggcctgacactgtaaacagcagtgtgcctggcgctttgcagttcgcaaagtgcagccacatgttgtctgcaacaatctaagagggttttctttgttgcaaccacctgtgttaagagcacaaaatattttgtttcaacaaagcttttgactgcaccaaacaaaaataccccatcactcagaagagcattccactcatctaccttcccacgaatgaataggtgtcatcatgtgggaatagacgaagcagtgtgtttctgttcgagtctatcactatcaccaaaaaaaattacttgtatttagtctgttctcacactgctaataaatacacacctgagactgggtaatttgtaaaggaaaggggttaattgactcacagttccacatggctagggaggcctcacaatcatgatggaaggtgaatgaggagcaaagttatatcttacatggtggcaggcaagagagaatgagagccaagcgaaaaggaaaatcccttataaaatcaccagatctcatgagacttattcaccaccacaagaacagtatggggcaaatcacccccattgattcaattatctcccactgggtccctctcaggagacttgggaattatgggagctacaatttaaaatgaggtttgggtggagacacagccaaaccatatcataacagcaacaagccaaagtgttatagcactaacattgcagacaacagttttagaagattccctctacaggaaacttctgcagaggtgctgtgccttttaaagggcattattttgctaactgttattctcaagaagggagcattctctacagttgtgtcagagccccaccttcagctcagctatgtggaagcatgaccaggttttctatcacctgattttgtctccccagccacacggaaaggctcgagataagccactgacccaaagcagcccaacccagaacttggctgagtgacagagaactgactctgggatgaggatagtacagacagaatgtggatcactcctctaggagagttgaaattaggaaaccgagacaggagagaaagagagagatgaagaaagaaaaatgcatcaggagataccctgaccgtagaattggacattagatggctgaggcaggccaaagtgaagggcaaaactgaatatagagaaaatggacacactgagtaagcatgaaaacctgtttcaaaagaggaaaatgcaaaaagagaaggacagatggtttcatgaaaggataaatgatcagcttactcctgagagctgccccattcctgacataaagtcttacgtcaatttacttgagcaaactgacctctgcagcccagttggacagaaggcatggccccacccttcacagctgggtccaaagctccaccaccacaagaagcagctcacttcctcctcctcctctcttccaagagggaaatggaacataagcaccctgggcctttgaagtccaccttgctcaccaacccaagtaagatccacaacctctttcccagcggcagtaatttccagcatgtacattcagcaaataccattttgttatcctcctctaattccgtgaggcttttttctccccccttcactcctttatgaaaattcctggactccaattcccctgggacttcttatgagtctctgcccaatgctttccaaatgacaggtttgggaacaagatctgagatcttccaaatcattatctctaccacagggaatttattttctcagcaacccaatcttgaaaacaaatacaccctgctggggttctcatcgaatgggggaggagaaatgtctaagattgggggaccagataaacagaacactgagtattggatgcttccagtcacagaaaggtaacagaagcctaaaaatgttttctcctcttccaaagtaacattaaatctttgatttctgtttaatgataattttttattggttcagtaaaataatttactactaactcactgactgcacatattttcctttttggcctttcgacactgagccatctgaatactctctttccaaaataatttttgtgattgcttgaacacctgtttctatatacatttctctttctaaaacagaattctcgaatattcagcttttgtagagaaataagcagaggatctcagaggtcatgaaagtgttcccagaaaaagaatgacatgtcttattcacatccatctacctggacacctcctttggagggctacatttttttctgttcagagtcaacctaaccatttcccaacatacaagctggttacttggttttgctctttctaaaatcccaccttttggggttgaccctaccttcagactttcaaagaatttaggttggtttgagctctttagcaaaacagtcactctcatcccacatcccaaggttttcaaagtgggtcatgagtctatgtggtccatggaccaccggaatgtggatggagcttcatgttttctgagaagcagcaaggaaaactggacaattactcaactaaattcttgagaatgactcggagttccaacttgatcagaatgtgctggactatggccaagcccacccccacctttccttccctccagattcagctgaactgtttgagactgctgcagagtcctcagttgacactggagttgagtttgttagtgcaattggaccagatctcagttcacccaccatctggcaatataggcttttattatcattttccccttgaggtctcctcccaatatcaacagaaaatttgacagcaaccataataatgtcacttctcggaaccacaagaaggtaatacatgttccaaaattatacaactgactttccaaatcagaggagccctttgcctccaagttaagaatgacatcttgattcagagtattgtcaagtctcttgccaaaaccactaatcccccacatttgttttgctttatgattttccccataagtagggctggagactctatctgaattctctggacctttcagacctcctggaattgccttgggcgtgaactccagcggtaatactcaacaattccactaggcagggtccactcccaaatacaatgtgaggctagcatttgccttcgatgacttctcacctctgctgccactgcccctacatggaaaccatctgcctccctccattgctatctctgtgctcatggttactgaataaaagtagagctttgaagttaagaagatttgtgttcagatcttgatgactcccatcatataagtaattaattaattatgcaactaaaaattacacttcgccatgtaatccttagcaagtttgtagcccctgtgaacacttcatttctcagtgtgtaaattaatacctaacagacttaaatgagtaggacttggtgcctaccgcaatgcctggcatgtaggagcagctcaataaatgtttctttccttcctttctaatctgccatggaggaaaaaaaaaagagctcacaatacattgggaaaaagcaataaacataaaaacccggccgggtgtggtggctcacacctgcaatcccagcactttggggtgccagggtggatggatcacttgagcccaggagtttgagaccagcctgggcaacatgatgaaaccacatctctacaaaaaaacaaaaaatttagccagctgggttgcacgtgcctgtattctcagctacgtgggaggctgaggtggaagaatcacttgagcctaggaggcagaggttgcgtgagtggagatcaggccactgcagccaacctaggtgacacagtgaaaccccgtctaaaaaaaaaaaaaaagtgaaaaccagggcacaccaggcagaccccaggaagcagataagacttgatttaggaaggaaggaagatctcgggaaatggaaaaaaaaaataggaataagctatgacagtaccttataaagtatcttttaaacatcaggagagaaaaattacaagggataaatttttcagttagttagaaggagatatacagaaggacaattctaggtagaatcacagtcagcataaattcactctgagaataaaagactggaaaaagatataccacacaaacagtcagcataggaaacctataatggatatattaacagcacataaaaaagacttcaggataggcagtgacccttgataatgatttaaaaattaatattgcaggaagctataaatattaatatatgtgcttaacaacagaacttcaaattagatgaaggaaaaactgcaaaattgaaggaaaaaatagacaaatcctaaaatataattgggaattaataatcttctcttggttattgatagaacaaagtataataccagttaagacacagaagatctgaacaacactatcaaccatctttacttaatttaatatatactaggacactataccaagccataatagtatatattcttttcaaatggacatggcatatccaccaaaatagatcatatgctggatcataaaacaagtttcaacacatttcaaaagactgaaatcttgcagataattacactagaattcaatggtaagccatctaggaaagtcccaaatatttggaaattaaacagcacacttccaaataacccatgagtcaaggaagaaatcagaaaatgttttgagctgaatgataataaaaacacaacatatcaaaatttataggatgcaactaacccagtgcagaaaaggatcttctaggtataaaatttcctattagaaaagaaaaaaatcaagaatcaattacctaagcttctatcttagaaaactaggaaaagaacaaattaaacctgaagcaaaatgaagaaaataataaatattaaagaggaaattaaccaaggagaaagcattcaaacagtagagaaaaatcaatgaaacccaacattagtagttggttctgtatacaactgataaacctgaaaacttgggaatattaaaaatgacaatatgacagtattaaatgacaaaggggattaaaaagataattagagaatcttcttataattatatgtcaataaatttaacaatgtagaggaaataaataattttgtgaaagacatcaattatcaaaactgacataagaaacaatagaaaatttaaatggccctatagcaattaaatttataattaatgaattttgtaagtaaaaaccttccccaaagaaaacttcagggctaggtggctttactagtgaattctatcaaacatttaatgaaaaaataataccagtttttttatatcctctttctgaatatagaaaaaaagagagtgctggccaacttattttatgaggctagcattattcagataccaaaactgacaaagatattacaggaaaactacagaacaatatatcttgtgaatataaacatgactctccttaacataatattaacaaataaaatccatatatatgtaaatgcaaatgacctagaatagcctaagcaatttttataaaaagcaacaaagttgaaggacttacactagtcttgctaaaaaactagtcataagaatgatggtaaatgaatagacatgtagataaatggaaccaaaagactcaaacatgatgatcaattgatttttcacaaaggtgccatggcaatcatggcaatttagtgggggaaaaagtcttttcaacaactggtgccacaacaagtggatattcacatggaaaaaaaatttaatgaatccttatctcataccatacccagaaattaacttaaaagagatcattgaggtaaaagtaacaatactacacaagaagaaaacataggagaaaatttctgcaattttggcataggtatagagttctcaggtaacaagaaaagcacaaatcacaaaagaaaaaaattataaattatattccatcaaaataaaaacttttgcttcttaaaaataataagaaaatgaaaagacaattctcagaatgggagaaaatactcacaatacttgtatctaacattgatcttgtatccacaatatataaataactcttactattcaacaataagaagataaaaagccaaattttaagcggaaaaaagatttgaataggcacttcacaaaagaagctacatgaatgttcaataagtacattaaaagatattcaacatcgttagttattggagaaatgcaaaccactctgggatacttctgtataaacattaggatggctaaaattaaaaaattaacagcaaaataaatatatggagcaactggaactcctatgcatggtattctaccttgcattgagaaggtagaataaaaccactttggaaaactatttcttttataattaaatgtacatctaccatatgacctaaccatttcattcctaggtatttacttaagagaaatgaaaatgcatgcccacaaaaagacttgtagaaaaatattcatagtagcttgatttgtagtagccccaaactggaaacaatccaaattcccaaaaataggtaaatggactttttttcaaagtgtgatctccacacaatggactactactcagcaatagaaaataacaaactcctaatctacacaacatggatgaatctgaatattgctatgcagagtcagagaagccagatgtaagatagtatacacggtataattccgtcaacacaaaattctagaaaatgccaactaaaatgaagtctacagtgacagaaagcagatcagtagtggtctgaggatggggtttggaaagagggatggatagcaaagaggcagaaagaaacttctgggagtgatagaaaaatactgcagcttgatgggcagtggtggtttcatagggtggatgcatcggcaaaacttttttaattccatgctttaagtggatgcaatttatggaacatagattatacctcaagaaatatactttttagattccctaatgatatggtttgactttgtgtccccacctaaatctcatcttgaattgtaatcacataatccccatatgtcatgggagggacccagtgggaggtaattgaatcatgggggtggtttcccacatgctattctcatgatactgagtgagttctcatgagatctgatggttttacaaggggcttcccccttcgctcagcactcattctctctcctgctgccctgtgaagaggtgccttccaccatgattgtaagtttcctgaggcctccccagccatgcagaattgtgagtcaattaagcctcttttctttataaattacccagtctcaggtgattcttcatggcagtatgagaacagactaatacacttaacaaataatctctgaacattccctcaaaggctttgtaatatagaacaacaaatcaccacatattatttctgtgctatataataaagttctggacaaaggtgttcacagggaccatgctctttaatccttgacctagatcttaaagcacaggtagttgtagaagacagaccaagaaggaggtccctgtgggcagaggcaatagtaaatacgaaggtgtgaggtgaggaagtctgtatagtgaaccagagaaatcataaaaagcttgggatgacacaagagataaaacaaaaatgttgacttgagaccacactattctattccaagaaatgtgaaatcagttgtgaagttaaaggggaacttctggaagcttttaaacaaacaagtggcacgatgtgtgtgatgagtattactgacatttgccacctgtttcccactctttccaggcatgtggtagatttcatttccctgccccttacagaataaagcatgatcacgtgatccacttagccagtgaaatgtgagtagaagtagcctgtgtcacatctaggaggaaggttgaagggtagttttactttagcacattctcttccccttctgaggtgattagagaagatgttgagagggaatttccaggaggtccctgagtggctacaataaacagaggacccccaccccattcccacctccccatgtcccgtgatgaatatgtagtagaaatgataagaaaacttccataatgataagcctctggactggggggattgtttgtaactgcctctaaagtcacctgtccttgctagcataatttgcaattttaattggtaactctgataattacatagaagatgagtttcagagtagaaagcctgcaggacagaaaactagctagatagctaccataatccacagatgatagtgcaaggcaggagccacgaacttagagaagcagaagaggagtccagagatgcaatggcaagaaatgatatgagttggtaatcactcagattctaaaagcacccaagagcctaattgtttcagaggtatggaaaagagaaagttcttaaaaggaaaaggatggctaagaggggagatgaaatgaaacaagattaatgaagcagctgtgggcagcataagaggtgtatcttgtatctcattaaaagtagaggctcgtccctctacaatgaaggctagaggtagatcatgaacttaggaagaaaccagactaagtgtgaatgctgggtgaatttgacaagtcattcaacttcatttgtgctttcattaattcattcaggaaacagtaacagcctcactcattcattcaacatcagtaaagaacacaaaaatggcccctgccctaatggggcttacattgaaatgtagtgaagcagacacaactatttaaacagtgtgtagaaaacggacatgatactgtgaaaacaaattacataggacttgtcaaagacaataaccactcattttgtttaaaactcctacatggcatcaaagtaaaaaaatagagacctctgtgtcctttgaatgtacgaaaagaaccatcctcctttcctcttgctgttttacatttaaagaaccaactgtgaaaaatcaactctcttgacccaaagacaatttttttaacaatcaagccttccagttaattaacaccacctgtttgtttgacaggtgagcctgtcaaacattgttctaaatgtggcaggtggggaataggtggttaaatgtggcttttagataagcaacttctcagagttttaagtaccaggtgcatacgaatcacctggagatcttggtgaatgtgggatctgattcagtggatccagagtgagaccagagactctacatttccagcaagctcccagggaggccaatgctgctggtcccaagggatgccaaggcaaggttctagaggccttggaagtgtattaacctcaagggagttcataggctatgcttgcctccagccattttagtactgagctcagaagagcatctctaccacgtgccaccatttctcatcagggccacctattttcctttgtacaaaaaaaaaaaaagaatcaaatttcactatgtgactactgtgtgaagattctgcacaaagggtttttgctatctcattagattccaacaactccctgaggtgggtatggtgagtatgtctattttatagaaggaagactccagcccagagaggttaggtcacactagtaagtatggaaaggattcaaaactccagagtctactccagaggtcaagctctccagcattgcctctttcttgctgtatttacatcacaagtttctttccagctctgtatctgcaacagaaatgacttgcagttgactattacttcctgttccaaaattgataaaaccaagtctagtcctccaacaaaatgacttggtttcaggaaaaggcaattaaaattcaaattgaggaatcttctggaatttggcaaagagaagcatttaacattagcattgagatttttttgtttgtactttttaaaattaaatactgtcagtttgtgaaacataatcatgtgactctcagaactcttggacactgtcacctcatcaacagaacacctaccgtttcattccacaagagtggcagaagtttccagaagaaccttccctaccaatggaaagaagctactgcataccacacagcaacatctgcgatatggtcataaattccgcagtgttcccaagttgtaatgaagagtttaatatatgtgctttttattattctactaagaatatatcctaattcaacatgtgcgtgaaattttcacatgttcgtgaaaacaggagctctcatacttgattgtgcatgggaatgtacaggaaattttaaaacagctagagagtctgataaaattggcttggaatggtctgggtagcaacattgttttatcctcccaaagattctaatgcacaacgatagttgagaatcactggcataaaagacagaaagaagactgtaagattcatgctatagtcaaaataaaaagaatgggaggagtgtcttcattcactgttagggttttgcctacctgcatggctacaaagttctaagataccaatagatcccaaatttaactgcaagcaagtggttccctaaaatcagtgaccaactgcatgatcatacttggtgtctgaagccaattgcagcaaatatcagcaacactgttccaaagcaaagattcttaacctgaggatggaattcaggtgatctgtataggaaactcacataggaaaataagttgcatctttacttttagtaacatgtcacagaagttcaacatgtccttcccttatgagcacaggcaacagagcacagtagtattggcagttcttgataatttgcacccaccggtattttcatgtcacatttcagtttgggctattatctcaaaataccatttgcagacatcactactttgacattactgttgcttaatcggcctgctgttaaatcaagctatttaatgcaataatgatgatgcacctgtgttagttactatatcacgacttgaggacttccataattgcattccaataaaactgattctgatttaattgtattttatgcatttcacaacattcttctgagaaacagtctaattgctttaccagagccagtgtggtccgtagcacaggaaacggcgagagccggctggaggaccgtgccctggcacatttgcatcgcaggccacccccaggaagagcgcaccctgaccagagctgagtcttgttttgccctgcatttccgcagataagatttggcctgaaaagcagttcaactcagcggagaataagatgggctttctctttctcctcagctgcctctttctcttggcattttggagtgccccgactgccaggccggtaactcgagcctccaaattaatcaaaacacacagcacccagttaaagcccaggcagacaagcccaggagccagacgcgctctcctctggtgacccccgggccacaactccccagctgggcccgccaccaccccttgaatgccacgctccctccactgcccctcccaggcaggtgccggggccccgggacagcggttgccccacctatgggcgccttacctgtggggacgcccgcagcgccaggagctgccgccttgccaccccacgggacgcgcacctccagccccaatccacccgcgccccgctgcctcttcgcggcgctctcgcagccaagcccggcggccgcaagttggaggcgggctggaggcggggaacgcggaccgccgcgggcgcggggaacaagcggggcctcccgagtgcagacgcccggcgcgcctcccgcttaatctgggcagggccgctggccactccctccaccctgcgcagccacctccccaccgcgcagccacctccccaccgcacacccccaaacgccccacctccgaccgcaccccacttccccgcctgggcccccggaccttgggagcatcacctccttaaccccttaccctggatccgcgcccacctgcccctcaggcgcccagccctttctcgcctcctgggcacgatgcccgggtagaagggacactgcctggtaagttgggagggagggggtatgagggcgggacctgagccacgtcttccctcccttgaagccacaaccaaaaagcctgggtggggagggacgaaccgcgcgaccgagccctacaaaacccgccccggccgagtggcgaggcgagctttccagccgggctcccagagccgcgctgcgcaggagacgcggtggcctgagagcctgagggtccccggactcgcccaggctctgagcgcgcgcccaccatgagcgcccggaccgcccccaggccgcaggtgctcctgctgccgctcctgctggtgctcctggcggcggcgcccgcagccagcaaggtgagtgggggctgcgcgacccccacccccgcacttccatccctcctccacgcgtccgggggacgcgctggccccacccgcagcggcgcggtagtggagcggctgccgggctagtggcgaggctgagggcttcacgcaggtcccgggacaggcagcgagcggaagggagcaagcggggatgccccggaacaggtggaatgcgcggggctgggggaagaggcgaggagggggcttgtccagtgcctaggagtcagggatggcggggacaggcctccagaggtcagtaaattaaaaaatagacacatagataatcgccagggatgatacgtgagaacaccggatgtggagatgcacggtgtcacgctggtgaatcaaatcaagcagcttggcccagcgcacagagggctggcaggagacacctgcagggagtcccagccgccacttcctagctgggacgtcacactaaaccctgacctctctggggctcagtttcttccttgcaaaacttgccctccagttttcctttgctattgttgggaaaagcaaatgctatcactgaaaaattaagagcaccttagaaatcgaactcaggttagaatcatttaagcaatctgacactttgatttgatttttgacttggaatttgagtgaaactggatttatttaaatccatcccatatttcttattctttgccattaaatagaaattgattgtcctcaaaacgattgtgcctcctagagttgactcacttgattttaccttgtgaaagtaaactttaacttttcagatacttgttatttttacactttaaaaagttgatttgggtgataacgtggcataggaaatttcatttccaaggatgagcagatgtttttacaaatgttatcattgagattatgattggaaattaacggtcacataaatatttatatatgttacatgaaaagaattttagaacctatggtcacatataggttctatatgtttttcctatttaaattaaatgaagacattgcagacattataggtgaaactaaagccctctctgacaccccccatacctctccccatttccttgtcttccaagaggtgtccactttcaccactttcatatttcatgtagttttccaaacattgtccatgaatttacacacacacatatgaacccacaaacatatatgtatgtttttgttggccttttaacataaatgatactgtgctgtattcctttgcaacctgtagaccagtccatgtcagtatttaagatcctcctgtttttctttttgctttgttgcacagtatttcacaatatgccaaagttaattgaaccatttccctatcagtttacatttagattattcactgtttcacattctaaaggacatttgtaatctatgtaatctgtttgtgtagctggttctaacaaaaatgcactttgcatacattaggaattcccagaccaggtatttaaatgctactaggcatgatagataaaactcagtggggattatctaccagctttaaccaggacaaataaatccaaaaaagcaaaatcctaaaggaaatgtgtgttgtggggaagcctggagaagagatccagagcagggtttgcacatgtttctgaatttagaagaacaggaatgagattgggaaggggtggaagaattgtacttatgtgaggatcagcctgaaaaagtaatgcttggggaccatgcaaactctagttataccattttcaattctgttgttacattcctttgttatttttacatgtaaacttttctgttttgagtttggccaaatcttggtgacttcttgctgaaattaatccatttgtattgtttttctcatcacttgaagtaagtctttcattaacaagttttcaggattatcatttccagtgtacctgctgggttagagagaaaatatgccagtaaaataatgaaatgtgccttcatcttgtagaaaaaggaatcacaacgttcactgataatcgggcaatgtgcaccaacatggctcccttcacagagaaactctgctgttgggcaaggctgttgaccactctgagcctcagttttctcatgtgtaaaatgagagttgaaaccccagtggggccagcaggtgaagtaaggagtaaggcaatggggtaagagagactcttcagaacctagttgttagcatgctagaattcaagcccaattgtgccagcatcacttcaagagagaagttgggaatccagtttttattagaaacttctcaaattctaaatattagcaactaagccaaaactttacaaaaacatagtgtgggccaaacaatgtataagtgagagctaaatgtaactttggagccattatattttattatttttgttctactccagttaaggatgtgtttcgctccaatttattcagttttactttagcatttctcaaaacagggaaatagcagcggtgttgactctacatgctaagtttgtttagacggggtggaactgtccacccacacaatttggactgatgtgccgagaattaaatacctctgctactttgcacaggcatccagttccaggctggctgcccagcgcatccccaggttttatagctgtcagggcccagctcacccacttgaaatagggcggcaccttgttgttgtctcaggcaatagacctgggagtggaggtatagaaagccccttctttgatttctggataaggtgatgttcacacattaagatatcatggtttatccttcttcttgccttagcattccagacagggcagcaatatgagaagcaaatgtcaaaacgtgaaaaacacctacatttggggaggatgccttctcaccgggcttcattttcaaatttaagcactttcagttaaattagaaaacaaaaagtaatggaacagacaccaacttatctatccctgagattaagcaagtattaatatactttgacttgtttgttctcagatttctacctttaggaaaaaaaaaatctgaatacagaaagtcatacacacattctttactccctcttccatcccaaaaagtttatgtatgtaatttccctgcacagttttgtgtgtgtgtgtctgttctccgtaaaaaataagtattattgttttgtggtctttcatatgtgataaatagtttcacattacacgtatctattggagcttgctttttatcactccatattatgtttttggattttatccatgttggtacatatagatatgatgtatttgtagtaatagctgctgcatagtatctagttatataaagtatgattcatttttccatctccctaaacaaagtaagcttgtctttatattttcattttataaagttgcaatgcatattttggtatatgcaccactgtgacaactagaatttgaattcctaagtggttcgtagagaaaacaaatttaaatatattaggaattgacaagttcatctgcaaaagggttgtaccaacaatgtaccagagtgcctgtttccctatgtctttggcaaagcttggtgtgcttagatgttaatggtgtgaaatgagatcttgttttgaccagtgagtttgtaaacttttttcttttttaattggccctttatatttccttcagtgtgaactgcatagtgcaactttctgtctgtttatctattgtgaactttgcctttttgttgctaattaattagaagttatttatatatttggatacaaaacttttgtcattaaagtgtatagcaaatattttattccaatctttggtttatctttgagttattggtgccttaatgtataatactgttttcactataatctcaaactgattttgttttgacattttgtcttttgtaccttgtcaaaatttttttttcctttcctgggattataggaatgttctcctacatttaaaaaaagtttcatagtttagctcttttacagttagatctcttaatcctgtaattattttctgaattatgagatctacttttatctttttccatgtagatgacaaatcgtcccaacattttcaatcaaatagtatattctttccttcttttttttcttttttttattttattattattatactttaagttttagggtacatgtgcacaatgtgcaggttagttacatatgtatacatgtgccatgctggtgtgctgcacccattaactcgtcatttagcattaggtatatctcctaaagctatccctcccgcctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccagtttcatccatgtccctacaaaggacatgaactcgtcattttttatggctgcatagtattccatggtgtatatgtgccacattttcttaatccagtctatcgttgttggatatttgggttggttccaagtctttgctattgtgaatagtgccgcaataaacatacgtgtgcatgtgtctttatagcagcatgattcataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgagagatggtatctcattgtggttttgattcgcatttctatgatagccagtgatggtgagcattttttcatgtgttttttggctgcaaaaatgtcttcttttgagaagtgtctgttcatgtcctttgcccactttttgatggggttgtttgtttttttcttataaatttgtttgagttcattgtagattctaatgttttgcagtgttatagctgcaaacgtgtataccattcatatgtggatctatttgtaaactctctattccattggtccaatatttttttgtccctccaccaataccacactgttttgatcactatgtttatattaaatctatgtctggtaggacaagtagaagatagaacagttatccctattattattattctttaaatttatgacaggtattctttcctctttgctcttctggttgaattttagcatctgcatgtcaaaggtccatcaaagatttctgtgggatgttaattggtattgcactgaacatataggtaggttaactgcttgttgttgaagtataaacacatggatggtacacagaaatgctactgatttttaatttttgatgttgggtcaagcaatattattgaattttcttatttaacagtttgtagatactcttagatttttttatgtaactagtcacattgtcagtgaatagtttttcttcctttctaatctttatgccttttttcccttgtattactgtgctgaccagctgtattaatctgttttcctgctactgataatgacatacccaagactcgataatttatgaagaaaaagaggtttaatggactcacagttctacgtggctggggaggcctcacaatcatggcaaaagagcaagggacatcttacatggtggcaggcaagagggaaagagacccaaatgaaaggggaaaccccttataaaacatcagatctcatgagccttattcagtaccacaagaaaccacccccatgattcaactatctcccaccgagtccctcccacaacacataggaattatgggagctacaattcaagatgagatttgggtggggacacagccaaaccatatcaccagcacttcagggcaatgctaaataaaagcagtaatagtatgtatttttgtctcattactgaagttaaaggaaatattttaacattttattaagtatgattttttctgtagagttttaataattgtcctcatcagtttagggagtttcactccctaatattactgtcattgttctacttaatgactggatgttaatgttatcatttatttagtctgtatctattttaagaaaatcatacattctttagtcagtcacggtagcaaattaatttatttttaaactatttaaccatccttgtattgctgtgggataaagtctagttaaaatggctcttcttaaaacatatactattattaaatgtggcactaatatggaaaagtgaattaacaaatgtagcatttaatggcttattagctgaatacccacataaagaccattcgggtcaaggaacagcacactgctagcacccagaagtcacccttgcatctgtctcagccacaatcccctttcttttccctgaaagaaactagaatctgacttctaataatcatttccttgctttttaaaatggatttatcatctaaatacttattccaagtgctgtattttggttctgcctgttctgaactttatgtatgtagattcacacgctttgagatagtgtatgtaaattcctagtgccatgctcagggtataaatgtagctaacacaggagtgggcacctgtgagagtccacctaagacatatacactgtggccatatgtttgctgacacctctaaacaggaaagttgaggtgttaaataactgacgtgtatgatggaacaaaatccacatgtgcgttgttttctggaatgaagctgttggcgtctgtcttagtctgcttgggctgccatcacaaaataccatagactgagtggcttaaacaggcacttacttctcacagttctggaggctggaaagtccaagatcagggtgccaaattgttcctggtggtgaatccgtgtgggtctgcagaaacctcagttcttgcctcctctgaagaaagaattcaactgaggggcagaaggctgaaggagagaccaaggcaagttttagagcaggagtgaaattttatgagaaagctttagagcaggaatgaaaggaaggaaagtacacttggaagagggccaagcgggcaacttgaaaggcaagtgcctcgtttcacctttaacttagggtttttatacgttggcatacttctggggtctagggtcccttctctcctgattcttcccttggggtgggctgtccgcatgcgcagtggcctgccggcgcttgagaggggagcatgcgcagtgtgttcactggagttgtatacgtgttcacttgagacattcttcctttacacttggaatgtccctggaaggtcatataccagttaaactccgccattttgcctcttaatgtgcatgcttgagcccactctcccaactcctgagatcttatcgggaagatgctgctcaccaccttcaggtgttttcatttcttgggagactgcctttccctggcactggctgcaaccaattattactttacaaagactgttcaataaccgcctgaccatcatatgatagtggcctgacattcctgatgaggcgggggccctctcctgccctgctcatgcctgactagctacctacagtaacaaaatgtctgggtgctggtaagggccctctttctggcttgcagactgctgacctctcattatatcctcacaaggtagttcggcgggggtggttggggagaaagacagagagagagctactgctctggtttcttcttctccttctccttcttcttcgtctttgtcatcttctttctcttcctcttcttcttcatcatcttcttctttcttcgtcttcttcttttttttttttttttttttttttagatggagtcttgctctgttgcccaggctaaagtgcagtggcactatcttggttcactgcaacctctgcctcctggattcaagcaattctcctgcctcaccctttccagtagctgggacttcaggcataggccaccacacccggctaatttttgtatttttagtagagatggggtttcaccatgttggccaggctgatctcagactcctgacctcaagtgatccacctgcctctgcctcccaaagggctgggattacaggcgtgaggcacagtgcctggcccggtttcttctgataagggcacagatcccatcatgaagaccccaccctcgtgacctcatctaaacctaattaccttcagaggccccacttccaaagaccattaccctatgcttacagcttcaacctaggaatttagagggacagaaactttcagtccgtaacattctgcccctggtctcaagatgtattacaaacataaagaaggccttaaaactctttaactgaaaaaatgagttagagcaaagctactaaatgaagcaaaggaagctcggtgggtaaacttaacctgtgacaatcacagtttaaaatgttagttttaatatcatttctataataaaaattctcagtgttagacatcagtgggaattaggaactattaataaaaaccttttgatacaacagaaaactctttgctcttcctagcataaaggattagacagaagcttcactttatggtgacgaaataagtacaaatctggtaagaaagcaccttactccaggttccacgttgatctcccaaaatgtaagtccctggctctgcttttctcaaagtagccatgtcagcctttccattcttccaggtgttcctcatgtaaatgctaattagggcctccgatttcaggtccatttcctaaccgagactaaattaaattctattactgcgatagttttcaacatcacacacctacaaaacttcgggtaaacatctgtttccatgctatacaatagaaatataatgtgagccatgactacaagcctcatatgtcattttaaatttaatatcttctagtagccacattaaaaaatagagatggatgaaactaattttaatatgttttatttataccaatacatctgtaatattatcattttaatatgtaatcactattgaaaacattaatgagatattttacagactttttttcctattaagtcttcaaggtctggtgtgtattttgtacttgcttccagaacatctcaattcaaatgagccacattttcaagcatctatagccatatgtagccactgtcctggacagcatatgtctatgtaagtggcatccagaggagagtaggtgatacaatccatcatgtcattctgtggagagaatagattttgtctggttatttaccataagaaataaatacttgtctaaatgaaacactttaattgaaggcaaaaaatcaggctgagttgtgcataaatatctgtgcatctttacctccagaaaattaagatagttggccttggctgcaatgtttaaatctatacaaattagcattgtaatttgacaagcattgtaattttctaagttatgtacaggaaaaattgaaaacacatcacaaaacggaaaataattggaaaaaggaatggggcaagggaaatatattgaaaaccaacacaccacaccttgcctttcattttaaactagaaatcaaattatcactagcatccagacaggtaagaggtttagtattacattggccaagtaaattccaaaaaggtctctctttttcttgtctgaaaatggtgacaacatatttatagcagacagaagtgctccatatagtgcctggtacagaatgcatatccagcgtttttagtctagtgattattattattattattattattttgagatggagtcttgctctgtcacccaggttggagtgcagtggcgcaatctcggctcactgcaagctccacctcccaggttcaagtgatcctcctgcctcagcctcccgagtagctgggattacaggcacctgccactatgcccgcctaatttttgtatttttagaagagacggggtctcaccatgttggtcaggctggtcttgaactcctgacccgaagtgatccgctcaccttggcctcccaaagtgttgggattataggcgtgagcccctgcacccggcctagcgactattattttattatcattactattcaaggccagacgctaagatagaagacataggcgctgggctaggtgctgggactcattggtaaacaaaatagtctgaatccccagccatgatggagttagaaggcagcagcccagtgaagagacaaatgtgtaacatcagattgtggtgctgcaggagaggatggggtgtggtgatggagaaggagactttttaacatttggtagaggtggtcagggaagcagactgaggctggacatggtgacaaccttgtgaagcactgagggatgtggtccaggacagggcctctcagaagtggagagaggccacacactaccaattttaccacttctgggttgtcaaagaataaaaccaggccaggcacagtggctcagccctgtaatcccagcactttgggaggccaaggtgggcagatcacctgaggtcaggagttcgaaactagcctggccaaaatggtgacaccccatctctactaaaaatacaaaattagccgggcatggcagcaggcacctgtaaccctagctactcagaaggccagggcaggagaatcgcttgaacctgggaggcaaaagttgcagtgagctgagatcacgccattgcattctagcctaggtgacagagcaagactccatctcaaaaaatgaaataaaaaaaaccaagacaaacagagcttttgaaataaagaaataacatgaaattttaaaagctgagtttatatgctgatcacaaagggaattcctggccctgaaggaatatgctgagtattttgctacaggtgaggtgggggatgggacacagggagtcagggtaccacagaggaggtgggtctgtcgtggttatgctaattgaggattgagcattgctggataaatagggtgcaataagtccacaggcctctacatggctgtctatggtataattttaatgttcatgtttaacaaatcaaaattttagcaaaagagatataatgcagtgtttttatgctattcccaagacatttgcattagtaatgaaatgacagtgtggtttgggaatcagcccacatataaaatggtgtgatggaaacattcttctttcattcctgttgacatatctctgcccgtctttcttcagtctcattgggataggtgtgaattagccaaatgtggctgtgaagcccacagcaagattgccaagctaggcccaagagcccttatcccacctgacacaggaccagcacagagaaagatgaaacccagttaaggatctggaagaagtgaggagctcctcagatgaagaggaggggaagagaaccagtctagatcaacatggcaattgctcagtctgtcccgtttaattgatttggtgccattattttgataattatttatgtacatatggaaggttaaaaatccaccccacttctagtgcttagtacatacaatatcagactatcaaaaatgtttcttgaatcttcctagggtataaaaataaatatttccacataccagcgtcggtattgtatatgtatgatatgagtgtgtacatataaatttgcacacacgtatatttaaataatattttatattctcagcattttggtattaattattgcggtgagatcatgactttaaaactcgtaaccttcagagccatttgaaacacagccatataaaaatcttttaattttctagcggtagttttagggtaagttaggagttttccagtttaatctttaagatccatgtttgttaattagattgtctctccaaactggtttcttagagaagtgatcccagtgtttaaaaatgagttcaagtgtatttagaaactttgagagatttgtcgttatgtagacaaaacagtcaggtcattggatttttttcccaccgggatattttggttgttacatgaacttctcaaggaaaaaagttccacaagtgggaagttggcaaatctgcaatattctttctctgtatcaaatgacgaagtttgtctggagagacccaaggcaacaaggccagatatttattttctttgttgaaccagaatgataggataattttatgctgtttgcttatgctgatattgggaaagctaaagaacttgcatgctggctttaaaaaaaagttatatgtgctgtacaaaatttggaaaaagtctacaagtatgaaaagaaacataaaaattaaaactatttataatcatattacccaaagaggattactggtaacatgttagtctatttccttccagatttttttttctccactctgctttttcctcctaacaacagactggtgaaaatttttgtgtcatttatttttctttcctttttttttttttttttctccagatggagtcttgctctgtaacccaggctggagtgcagtggcgccatctaggcccactgcaagctccgcctcccaggttcacaccattctcctgcctcagcctcctgagtagctgggactacaggcgcctgccaccactcccggctaatttttttttttcgtatttttaatagagacagggtttgactgtgttagccaggatggtctcaatctcctgacctcatgatccgcccgcctcggcctcccaaagtgctgggattacaggcttaagccacctcacctggcctatttttctaaatataatttttaaatgtctatagagaactttattgtagattggtaccataagttatttaagtaatgccctcttattgaacattttgatcatttccaattatgtatttagaaatacggtagtcctcccttatctgctattttgctatttgaggttttagttacctgtggtcaatgggttccaaaatattcagtagaaaatttcagaaataaacgattcataagttttaaattgtgcaccgttctgagtagcatgatgaaatctcgcaccgtcctgctgtgtcccactggggcgtgaatcatccccttttccagcagatgcacactgtctatgctccctgcccacaagtcactgagtgccctctgggttatcagagtgactgtcacagtatcgcaatgcttgtgttcaaatagctcttactttacttagcaatggttccaaacacaagacttgtaatgttggccattgggaaatgccaaggaaaagccataaagtgcatcctttaagtgaaaaagtggaagctctcaacttaataaggaaaggaaaaaattgtatgctgagattgctgagatctacggtaagaacaaatcttctattcatgaaattgtgaagaaggaaaaagaaaatcgggccgggcatgctgactcacacctggaatctcagcactttgggaggccagggcaaaaagttcactgtattacccaggcctaggagttcaagatcagcctgggtaatacaatgtgacctctctctaccaaaaatttaaaaattagccgggcatggtggcatgtgcctgcagtctcagctactcaggaggctgaggtgggaggatcgcttgagccctgcagagtggaggctacagcgagctgacagcacaccacttcactccagcctgggcaacagagtgagatccatatcaaaaaaagaaaaagaaaagaaaaaagaaatgtgtgtatactatatatagagttccatactctccgacgtttattaaagtcattttttaaatgattatgtatgcagatgctttcttaacaaatgtctgatttagatgatgaggtaatgtcattattttattttattttttttgagacagagtcactccattgcccaggctggagtgtagtggtatcatattggctcactgcaacttctgcctcccaggttcaagcaattctcatgccttagcctcctgagtagctgggattacaggcacacatcaccacatccagctaatttttgtttttgttttttttttgtatttttagtagagacagggtttcaccatgttggccaggctagtgttgaactcccaacctcaggtgacacacccacctcagcctcccaaagtgctgggtgtcattcttgatttataggtgagagactgatccaatgatgttcatcaaattagtagagaaagtgggcttataattgggatttccggttataaggatatttggtagagccttttcctttaaaaaaataaatcatcattattattattttgagacagggcctcactctgaggcccaggctagagtacagtggtgcaatcttggctcactgcagcctcaacctcccaggctcaagcaatcctccctcctcaaccttccaagtagctgggactacagatgcatgccaccacacctggctaatttttgtattttttgtagactggggtttctctattttgcccaggctagtcttgaactcatgggctcaagtgataggccggcctcagcctcccaaagtgctgggtttacaggcatgagacatcgtgcctggccacagccctttccaaccaaaaacttcccagataattaaaaatgagtgtcagatgccactgtatttaccatttaagtaattaagtaatatatgagataaatttgagttttaaaatgatgaatgcttcatgagacttaaaaaaagcatcaattaattacttttatttactgaaatattacttgactctgcaatctaaaaatagtttaacctacttccatgttgcttcccttactcaactccttgaagaagttttcacgtctcatccatctttgtggttcgagctcttaatgtcacagttggtattttattagatatccaaactaaaaagtcaataaagaattagtagttctttaatcctttgacagaagaataaaacgttattttgggacaaaacattgaatgtttcattcattcattccacaaggcagcaaatacttttccatatcttactatgtgaggggtacagtgctacacgctgggaacaaagggagataaaactcatgtggtcccttctgtcctcatggagtatgcaatcaagtgatgggcttagatacgtgtgcagagaataatagtaaaattatgcatgttataacgaggtaaatatggaaaagcaaactttgagtggagttgagaggaggaataagattgataaatgtactgaacagtgaacttgcaggcattatattaagcaaatgcgtaagtgcaacggagccagaaagtattatagtaagatttcagtggcttgaaaacattgtttatctgcaaagtaaagtgcttaaaactgttggtaatgaactcagaaagcaacaagtagagttactgggcggtgcggtgcttttactgtcttctactttatgccccagatcaagcccttgtcagcgattagtagcagtgcttcaaggtttacagacacggactagattcttattttgccatcttacgcaaaagcagatcagcaatcctttccaaaaagcaataaaaactgagaacagggcagcctctgaaatcttatgagatgaggttccaactgattggaagcaagactgcatgtcccacgcaggtgccagtgctctctaattgctgcagaaaggcagaagaatgagatgtggatttattgagtactgtctgtgcctgggactgtgcccacgaaaccgttcagagcttctactcgctgtgacctgctcaggcctttcagagacggaacattcagagcccatgtgacctgaatgagcagcatccccacaccctacaagggcagtcatgcaggcaaggacatctgaggcaccctgggatctaaaagaggcagtgcccggcagcagtaagaacccttcatcatggtccagaagaaaggcactgttgtgacagttttgggcaagtcactaaaattccaaggccactcagattcaaattcagtttctgtttcctgaatcacaagatgtggcacataaaatcttcccctcctatctcctgaaacaatacaatcgcacattttacacacagtcaagcattccacaaatgccaagtattactgagacaggaatgagattcaatatcagaaaagcaatagtccaaatgttttttatactcatttaattctccttttatttcgtgacctagtatcaacttcctggaatgcattaaggagtttcttgtttttgaaaatattattcagtgcattctttgctgctggtattttctaataacattatttgaaacatcagcagaaatggcatcctcccttaggactatcccgattaaaaaatgagcagagtatttaccttacagcatcctgtgtaaatactgacgctaaaactcagccagtgatttcatcacttttgtgatgactttatcaggtacctcaatgaaaatacctgttaatagagaaaaaatacctggtatagagatatttctgggtaacatttaatattaataatttctgcctttcttgtctttaaaatagagaactctttgacatgtatctaaaagagaaggcatggaaccagctttggtacacagcctccctcaaattccattaatgcgtagttggctgcatcagggtcggcagtataaattcattttgtgcacatttaccgagcacttatgtgtgatgcactcttttacagaaactcttgaaatatccttcagaggatgaatccttgtgaagtttcaaaatgaagccactgcaactaattattagattgaacataactattctttatacacagatcttttttccctaactatacatgtaatgcatgtcatttgtgaatatttgagatatatagataaaagtaaaaacaaaactataaaacaaaaataactcctcatattagaacctggggataaccagtgagaatattttggtatatttgcataaaagtgagatcatatggcatatggtattacgtatccggcttttttgacattatattgtattttctcacatcagtaaatatcccttaaaaatgaatgcataatatttgatgatgtttatataccataatttaacttaaagtttttatgtttttaacaaggctatgatgatttttgcctacatatctgattttttaatgacggacatatagtagaattattaattagagtaatgggtataatttttttatactgcaagttctcctttccaaataatagacacagttttaatactaatgagcaaaaacataaataaaatcaccctaaattctatcttgtaaatataactagaattaacattttgatgtatatctatcttttcttatttaatctaaaatatgatttcccataaattgaagatctaatttttaaaaaatttcccccaaatagccaattttctcagcattacttctagaataacctactgctgattccctattgatttgtctcagctcttaccaaaaatgaaccataggaatatcttggccacaaataaatatggaatttacagttattttccttgtttattggccaggagtcagccaaatgtttgatagatttaaagcctccagccacaatcagctctccacttctgtgcccctccacccactcacgacagctatgaatctggaatgaggtgggttcagagacctcccattcatgaacaccataaaacatgcacattggctcaagatcattcactcattggaagagaattttgagtcagtgcatcaaagagcaatgtcctgtttttctagaccactctactcatcccatcccctcctgattctctcattcatttttaatgacctcccagcaggggatatttgtgaataaaatctattagatttttttctaggtttcttaaaggctgatctggcttaaaccatgcatcaaaattaaaactaaattgacttccttatatcaagttgagcagtagcttgataaacattatagtgcattataatctcagaaatagattatataatagctatattattatctcagaagcaaatataatggggaaaaaacagatttgtaataaaggccttaacacccacaattattggggaaaaatgttaacaattttaatcagcctctattgaaacagaatatcaatcaaacccctcttgagctatcacacatatatccaattcaagaattatttagttacacaaatcaacatttgcaatgtgtttaatatgttctgatataaaaccagaagactaataccaactactctaacatttactaacatactgtaaatgatttacttaggagtctgttttaataaagttcaccttcacaaagcagcatttagagaagcttcccctaagtcagacttgtttttacatgtgaaactgctatgctttttcaattggataaatcactgaattgatctaaatagagtgggctgatctatgttgttataagctctttttggcctctaattttcctgtttattcaaagtaaagaaagacagtactttttgtttctaaaatcagaatggtagttcctcactctataagcaaattgaaaatgattacgttcttcatggccaccatagcaaaccatgtcccataagagatgacctcccacactctcattctggggcctccaggagaaggaggaacaagctatgagttagaataaaactaagggatgattaattcccattttgaaaaataaattagaaaaaagaaatggtgctcagggatatgtaaaagtcccaaggagcagtgcagaccagaaccagagaccagaacaaggtggtggatggaaacgaggaaaatacaaatcagagggctcattggaattgcatttgacttaagactttaggtcagaccaggcattagggggcatacaggtagaagattgactcaaacttggtggagttaccaaacttggccaaaaggactccaaaccaagatgagatagtatgtccaaggtcaacaggcaggcttatggaagccatggacaccagaaaacagagtgacatggatatctgctactttcccctgacaattattctttcctacttctggtggtagcacatcaatttcacttgagagaactactctctcctccttgcttgtcagtcccttagtcaaaagattgggcacaggacctaagccaagccagtcaagtgccctctcccaggaatttaaatcttcaactgagagtgcaaggaggttattcatcctgacagcagcgccttgcaaaaactctccatcagttcttgtaccttgattctcacaacagccctggggctgtttttttctgagttgtgtttatttaacttttcttcaatttctatgtgctgcccccatgtcattccaacaaattcctttttgatcattgcattagcctaaatcacttctgttgcttgccacctcaaaaccctggcaagacatcaggaatccagacaatagtctggccagcagaactggtggttcagcaaccttctgcctcagccaagaagcctcttatatgaacaagtgaggagagaagtaccctcaggatcaacaaatgcagaccagcaagtgcacatgggtgaaccctggctaggaaactcatctggcagttacccaagatggacaagggaatgcggagactgagttgctggttaattattgcttatcagcaaactgtgaggcacttcaacttttgcagacatatgagtgtcagccctggtaaaattaagattgactcaatcagtctctaaaagaaatgataactattgaaatatcagtccttcttgggtgaccttgagtgccagcttggtttcagcttctgccttgctcattgatgcccctcaaaaagtgataagtcttatattttgtaccaagaaagatctggtcaatatttttgctatgctactacattttggtattcacttccaagtctttctttattaatatatccttttactttttggggatcacgtttccttttccaccagcaataacttaaaatattactttactgtttcaaattactcaaaatataaaatagtgaggtatcaagttaataaaacataacaaaatttgattatgcttaaagttcatacccgaaccagataaaccaaatagagcattttaaatatatagaaagactcatctttttttcattatgcgcattttagaaaaattctctctaaacttgtgtatacattcttgacccctcctttgcatggctgcctcactggccttttttttttttttttttttttttttttgagatggagtctcactctgtcgcccaggctggagtgcagtggtgtgaacttggctcactgcaagctccgcctcccaggttcatgccattctcctgtctcagcctcccgaatagctgggactacaggcgcccgccacacgcccagctaattttttgtatttttagtggagacggggtttcaccgtgttagccaggatggtctcaatcttctgacctcgtgatctgccctcctcggcctcccaaagtgctgggattacaagcgtgagccacagcgcccggccctcactggacttttggcattaggttgcaattcttttcttaggagtggattcagtcagccaaattgtaaaaagcagaaagcttctggccaagtgcaaggtctgatcaaacaaaggatgggtggtttgaggtgctttgacacagggcttttcgcagttaccccaagtgtgagtgcacagtgctgctagacaacatgccaagatcagataaaatctctatatggaccagttaccttttagctgtatgagaagaagggcaattgtacacgttgttcttgctcttgaatataggtaagctagtcattactactaaaaaagcaatgacaactgtaggtttaagatagtgtgttcatcttcatatataaagagaatatctatttaatttgttatatagtccactgattttcccctactcccatcaccatgtagctatttggtgtaattataatccccacagaagagagaaaacattccttgtcaatagggaagaagtaaaaagagaactgaaattcagaaggaaagccttaggctactggttttcaaacttcagtgtgcatgagagggagtgtatttgaaaatgcagatttcctggcaaaatccccagggattctggctcaataagtctatggtgtggcctggaaacctgcagttgtagcatctcagttcattctgatgcaaatggtccttggaactctcatgtgaaaacattgcctcagactgaggaagaagagggaacgcctgcctctctctgggcatcaccctcttggacctggaattctagacctgtgggctactggaagtgtccagataatgaaggagtcagcatctcctacagggaaggagaactcaacagcatgggagtggacagtaatttgttaactagaatagctggttgtgtgttagtcacgccttctgtttctaaagatttgccccccacccttggggtggtgtttggagaacgggagattatttgatttggtttgatttttcgtatactttcaggcttctatcacgccctcgatcacagcactgttgaataagataacgcgcattacataatgagaagtcaaagaaaccaagaaaataaaaatcaaacagctgttgtgatggtgtgataatgatgagtgtccaataatgaggcttatgatgacaccattgtcttggatgtcccactgggaattaaggggagactctgctgtcacccttgctgcacaaggccagtgttgacagtggcatcatcatctctgctctcccgaggccaggctagtgtggggaacagctaatagtgagagcagcacaaaaggagtttgaatttggttgacctgaaattagagttacaaagttcagccagtgtcctcttcacaaggaagttcttcccttaggccaaccttggaggatgctaagtttggttttattaagggggtaagtaggctccaccatctgtagatgttaataggattgggatgccatgagggagagtgtagatcatctgtttttgagggggtattctatcacattaaatgttcttgtttcaggacaggtgaagaatagaaaaggtttttgtcttagtctgtttaggttgctctactaaaacatcataaattgggtggcttataaataacagacatttatttctcacaattctggaggctgggaattgcaatatcaaggcactggcagatttggtgtctggtgagggcctgtttcctggttcatagataatactttctcattgtgtcctcacgtggtggaaggagtgagcaaattcccttgggactctttaataagggcactgatctgcttcctggaacattcagttagaaaagagttagttgaaacagctcctcttgatggtgttctcctcactcattagagattttccagatatttttagtacacatgatgaacagtaattcatttcttctatctttgtgtgcaggaagacacactgtctttaaaagtttaaagcaccctactcaggatactagagtaatttttccatcttcttcaggaatctggattccagcaacctttcagatattgacttaccaagttgctggactgggtcttctgcaaacagaaaattggagggaggatgagggtgaggatggggagacgctgataatcacacagttgtgactaagaagagaatggttgctccagggatgcctttgaatagaaattgactttgatggtgtgatcatggcaggggagaagtacagcagcagggatgagctgtgtatgatccaaatggctctacaagctggtgtgcacatatataactagatggggtttcttgcaggggaggaagcttggggcaaagacccaagaaattgagttttctgtaagtatacacccttaataattggataaataggaagttagttcttgaggcaggtctcatagataatggaagttattttaggaatatgcaggcttattgacctcattagcccattgtcccttccacagtgggaattatagcaatgcagtagaaattctaccattcctgctccagacaaccaacgcatgtatgtcctagctcatggtttctgcctactcagcttccacatcatggtttctattcattcatgtcttctccttccagagtgtctgccttctaccttctctctgtttatctcagcttccattcccactaccaagcatctaatgccccatatctccagagggaataagattggtccagctgatcacttcatgtttgtctcgatagagctgttgagtcagggcatatcacagcacagtagacttgcctgctttggtccagtcagctgtacccaagaatacagtttataacaaacaaacagcagcccccactgttttgtttttatgagggctagaagaacaacatccccgaactactcctttaaaaaaattaaaataaatgttagtaactccagatattttctgattgttctactccagtagaaaagtatgttaaacccaaatctagcaactcttctttagaggaatcctggcttcttcactacattgttaaaggactttgtaaaaaaaaaaatcacttttagtatcaatatcagaattctttttaagtatctggagttagaaagtggtaacatttggacattgtatccttttttctaggagagttttagtctgatccgtttataagcagatatttaacactgaaaaaggaccccaaatagtctttttaaagctcagcgagccattgtgagtcattggcttaacacaaaatacttttacataacccaggccaccgagagggatatccggtcaggtcagctatttttaaagcacttctcccccactccatctcacgtaacagagttacagcagtttgcttagaaaactggctcaggttctgtggctcatggaatcaaaacccaaatgaaatgtttttaacttgtttaaaactggaaccattttcacttaaatgtgctacactaccaaatcaataactttctgaattagacacacatatatgcaagcggaatataactttttcactgacatgtatatggtattatgtgttgggcttgccatatcatttcctaattcattaactcattcaacaaatatttataaggcacttactgtgtgctaggtgctgtgttatggctgaagacatgagactgagcatgatggacctgtcctcatagcttccagtatagtaagagttatggaccaagaaatgggcaattgtaatgtcacatgataggacagggatgcaatgacagagaatgcctgccgaaggagcatatagaagggtgtcagaaaacccttcccagagaaaatgatgtccacactgagactgaaatctagccaggaaggatgggaggagagactcttccatatacagaaaacagcccatgttggcttgggattctgtttgagcaccagagagaaggtgagtgtctggagggagagaggccaggggaggaaggaaaagggagctggggagaaaggcagggctccatcctgtagtgtcataagaaggagtttgaccttgatccttagaggaatggagagcacagaaaaatcttgagcagatcagaaacatcatgagatttgtgctttggaaagagaccctggttgtggtgtgggaaatggattagaggtgagcaagagaggaggtgggtagaacacagagaagcagaggcaaggtgtggtggtgatccccgtgagacaaggaggtggccaaaaggaacacagtgaccaagagggtggaaagaagcaagcagatctgtgagttttttggtctaatcaacgtgatgtggtgatgactgatagatgactctgcaccctcccaaatttagcatcaaagaactgctcacccagagacttgtgctacattcgtgttacaagttagtatcggtaaaaagcctgtccatttcactatattagtatgcatttcttttatcaagtaagacctaaataacccagagttctaatttgcaggcttgaaattgtaagtaacctaaaactctccattcaaaatagagtaaaccattttacatatatttatttgcttccataatttaaaaatttagaagtcatggaggtttcaggtgaggctggacctagcatttcaaagatatcatcaaagaccaggtttccttcaccccttgtcttcacatgatgtctgcttcatcctaagattgctttccctcgtggtctcagccatatacttctctgtgttattctgctatgaagacaagccatttctaccagtaattcttccccccaaatcaggaagtttcctttcccagaaatcatcagagaaaaactttggagttgcatgctctaacgccataacagtggctaggtagatggatgtgcttctaccaagagaaaggaagaatgtcaggtggaaaaaaaaagaaaaaaaagcaaacatcccctgcattcagcacattccctgatgcatcttagctgcagtcactattcataaatgagttgaaaaattcatcaaacaagaatacattgagatcaattgtcatattttaaatgcaaggcacatgcaggtccctcaagagctggaggtaactcaagagagtgatgcttctcccttactgccatcttggcgtgcctgctccatgatactatatttcctctgctggctctgcaaacatgccttgaattccatttcttgcagatcctgactcccttttaaaatatggacatgcatgatgcttctcacaacagtctgtacccattcctgaggaactaaaatggaaacacttctacagtctgaagcaaacacataaatagatatgttttatatgtcatctaggaatatatacatatcagtttattatttcggatcaaaatatgtaacagaagagggactttgtgtattctttgaggttgaaatgtatcactaattaaaacaaagtgtattaattattttctattataaaagtaataggtagtctgggcatcgtggctctaatcccagcactttggggaggccaaggcaggcagattgcttgagctcaggagtttgagagcagcctggccaacatggcgaaacctcgtctctacaaaaaattaaaaaattagtcaggcctggtggcacacacctgtagtcccagctactcagaaggctgatgtgggaggatcgcttgacaccaagaggtgaaggtttcagtgagccaagaccatgccactgcactccagactgggtaacagtaatatgtcataactaatgaaaatgtgcaaaattctgaaaagttaaaaggaaaaaagcaaatcatagtttactacttaaggacaatatcattaatgtttttagcatcttcttctagcacttctattatgtatagaattttttaaaaaatagatgcaaaggttattatatatgaaattttatgtcttttttctcttaaaaatagactacataaataatacgtatatggccatggaaacaatttttgacatttaaattttctcaaccactttgctctttttggatacttggggaataacaaaatttttattattataagtaatactgctatgatcatgccaatgacactctgcttgatttggaagtacattcctcgtacacattcccagaaatggattttttttttgtaaaggacgcaaaagtttaagactgttggcatatacaaaagacctattttctgaattcagactttaggcaaaaacaaaaaatttaagtgggtgagggggcaggaagaacaataaagaaagctaagaagtgttttgaaaagcagttcacaaaatcactctttaccagccacatacaaatgttgaatggctccatccacggtgcatttgtggagctcccctgttggccattccccgcatcaaggattcaaagaacctgccaaggggctgcaatgggagattacagtgactcagcaaatcaggatgatcagatttcaaagtcggccaaataactcatcttggagacagatgtagctgaagttttacattatggcctgcaagaaactttattctaataaaagacaactgtgtttacaactactgggcatatctcaggttaccttaaatgaaaatcattttcttatttttgtaattatgaaggctaaaaataaagatttttttcataattagtttctggaacgctaataataagaagaacttagaatattacagattctcttacaaaacacaaagaccttggaataaatttggcaatttcttcaacagcagtgcccttatcaaaaacagacacttgagaattgtggaaagggaaaaaaattatcgaaggaaagtcatatttccttaaatttctctgtgaatgtgtacagtgaatttcttcatctctaaagcaaatctttaaaaaggaagaatttgctctaaattcaagcattcatttttatctctctgtgctcaagtattcatttttatctctctttgcttttgacacagagtataaacggtaattataccatccagttgcaaaacgtcattgaaaaacagatggtaaattaatcccaaacaattattactccaggttctgactatcaattttgtcttgaacagcttgtctaaacctagttatagaattgtgaagaaggctaagtttgtgtctggttgttgtctttctcccctaccattttattaaatatttaatttcttcatgtgcacataatgctttgaaatgttagatgtggtttagcacacactatcatatttgacttgctcatttcattttcctcagaccctgaccagggcaggatgaaaaccaaccttttcatctctaccctcttttcatctcagctaattgtggaatcaaatgatgctgtatacataaatgtgaacccctgtcccacccttggtattggggctttgaaagtcttcaaaccccaccacaatggtggttgtatggagatcacttgacggtctcatgtgccccaagtcctcaatctctgcaagtgtcccttgggactttgctcagtgtgtgtttgtggtagttgttgtagtgaagggtggggagaaggttaggggtgtcctggagggcagggagagaggtttcattgtcccctggggagtgagtgtgaatcatgaatgaacaatccttgacgaatcgagtcaacccaaataagagtttggaacagtgtttctcaaactttctatagtgaagaaaattttgttttgtttttacatttccattatattgtgagccaatactttcttaaaatataagaataaaaaattaaaagaaaatgaaattaaaagatataaaatataagcccaaatattttaatcagcataaaatcactctatcaaatcactctaagctttctaaatgcttactttcaatttctatatttaccttgtcataggtaagaaactgagacccatgctttgagatgcactagtttagagaaactgaataatgcaattaaaaagtttcacctgataggactaagtgcatctcctccctacaaggatacatcttcattcccagtgctcatagaatatttataaaaatggaccataatttgaccacaaagaaacaatgaaggaattctacaaattagataaacttatggaactggatgaagaatcaaaatctgtttacaatgcaataaaatttaaaacaacgacagcaaaaggcctacctatgcattttaaatctttttcctaaataactcttagtttaaggaaggactcaagatcacaatggcaggatgtttaaataaatattcatgatgcaaagattagaaataaaatcctggctgggcacggcggctcacgcctgtaatcctagcacttggggaggccgaggtgggcggatcacaaggtcaggagttggagaccatcctggccaacatgatgaaaccccatctctactaaaaatacaaaaattagccaggcgtggttgtgcatgcctgtaatcccagctacttgggaggttgaggcaggagaatctcttgaaccagggagactgaagttgcagtgagccgagattgcaccagtgcactccagcctggtgacagagtgaggcaaaagaagaaaaaagaaagaaagaaggaaggagggagggagggagggaaggaaggaaggaaggaaggaaggaaggaaggaaggaaggaaggaaggaaggggagggagggagggaaggaaaggaaggaaggaaggggagagaaggagaggagaaggagaagggaaataaggagagagggagggaggaaggaaggaaggaaggggagagaaggagaggagaaggagaagggaaataaggagagagggagggaggaaggaaggaaggaaggaaggggagagaaggagaaggagaggagaaagagaagggaaggaaggagagaagaaggaaggaaggggagagaaagagaaggagaggagaaggagaagggaagtaaggagagagggagggaggaaagaaggaaggaaggaaggaagagtcctatgggttatgttccaaagagtcttctgaagaaaatgcatacctgttatatcatcagcatcccaataagaaacccacgacacactcacaattggataatttgagaagtttatttatagagacactgtttacaaaggtgaggttcaggtaaaccgtctgagatagttcaacagacaagttatttccaccactgctccctttcctggatctaagaaagagagtggtattgagttggccacaatcaatgagggctgaggggtgaggggctgtgagggagggaccaggtgctcaaggtagccctgcagggagggagccaggaaagtagaggccctgacctcgctctgctccttccctctctctgatcttttgccagaagcctgaaagctcaggacccccttgtgggagcccctttctgtggtcctcatggtcagccccttaagacaaggagcaggcctggaaggaggagtgaaagttatctggcattgctgtgagcacattcttaataaaataaagaagataaatgcagtatgcaatcaactcaaaaaattttcttaaattcaaatataaaaaattaaagggggaaattaagcaaaaacgtaaaaagaagtgaatacaaaagaaagtagaaatgctgtaaattcataaatattgtggctaaatgtttggaaaatacttgaaaatagaaaaatactagctcttctaatcaaagaaaaatagaaacaccactgatacacaaaatgagaatatagaagagacacatacaggcaaaagtaaaaataatttgcacctgccatgctaatgaatttgaaaacatgaatgaacttaaatgatttcctgttagagtatatattaccaaaattaagagatagataatctaaataaaccaataatcttggggaaaaaagaaaattttctattaattaccctttgaggaaattcctaccctaaaattgttataagtgaatttttttcattatgtccagaaatgactgttaggctattcaacagttcggtgcatagagaaaaatgatggggtcctaacattttgtttccatttttgttattttacaaatctttataaatagattttgaacttgagcaacattaggcagaaaaataaaatcataatcccaaatcacgtaaaatcccataatcccaaatcctgaaaaaaaaatcttgaaagaaaattagcaaaataacataataaaataaaaactcagtataatcatgcattgaataacaatgatgtttcaaacaaagacacaccccacatgtacaatggtggcccataagattataatgaagctgaaaactcctatagactagtgatgtatagcagtcccaatgccacagtgcaatgcattactcctgtttatggtaatgctagtgtaaacaaagctactgcactgccagttgtataaaagtctagcacgtgcagttatgtacgatacataatacttgataatgacgataaatattttactagtttgtttaccataatatactttttattattattttagagtctatgccacatatatatatatatgtgtgtgtgtgtgtgtgtgtgtgtgtgtatgtgtgtgtgtatgctgtagaacagcctcaggcaggtccttcaggagatatccagaagaagacatttttatcataggagatgacagctccatgaattattgccctaaagaccttccaatgcaacaagaggtggagatggaagacagtagtattgatgatcccgaccgtgtataggcctaggctaatgtgtgtgtttgtgtctgtattcttaacaaaaaaagcttaaaaagttaaacaataaataaataaacaatttaaaaatagaaaaaagcttatagaataaggataaagagaaagaaaatatttctgtacagctagctgtaccatgtgtttgtggtttaggctgttattacagaggaatcaagacgttttaaaaattaaaatttataaagtaaaaaagttatagtgggctcaggttaatttattattgaagggagaaaattagtttttataaatgtagggtagcctaaatgtacagtgtatataaagtctacaggagtgtacgatagtgtcctgggccttcacattcactcaccactcactcactgactcacccatagcaacttccagtcctgcaagcttcattcatggaaaatgccctatataggtgtactatgtttttatcttttttttttttttagacagagtcttgctctgtcgcccaggctggagtgcagtggtatgatctcggctcactgcaagctccgcctcccaggttcaagtgattctcctgcctcagcctcccgagtagctgggactacaggcaccggccaccatgcctggctaattttttgtatttttagtagagacagggtttcaccgtgatagccaggatggtctcgatctcctgacctcgtgatccgcccgcctcagcctcccaaagtgctgggattacaggcgtaagccactgcgcctggccgtttttatcttttatattgcatttttaccgtatattttctatgtttagatatacaaacacgattgcgttataattgcctacaatatacaggtttatagcctaggaatcacatctgttatgtacttttgatctgaaccaataaacctacatatggttgtaggtaatatgtaaaacacagttatctatttatgtgtttgtttcagactgcaggtatactatatagcctaagcgtatagtagtaggtcatgtggtttggatgtgtccccacccaaatctcatcttgaattgtgtagctcctcccataattcccacacgttgtgagagggacccagtgggaggcgattgaatcatggggggtaggtatttatcatggtgttctcatggtagtgagtgagtctcatgagatctgatggttttagaaaggggagtttccctacacaagctttcttttgcctgctgccatgtaagatgtgcctttcgccttccgccatgattgtgaggcctccccagccacctggaactgttggtccattaaaattaaacctctttttctttataaattacccagttttgggtacggtttttttgttttgttttgttttgtttgtttgtttttttgagatggagtctcgctctgtcgcccaggttggagtgccgtggcacaatctcagctcgctgcaacctccacctccctgggtttaagcaattctcctgcctcagcatcctaaatagctgggattacaggtgtgtaccatcgagtatgtccttatcagcagcctgaaaacagactaatacagtaggctatacatctaggtttgtataagtacactctatgatgtttgcacaatgacaaaattgtctgatgacacatttctcagaacatatcctcattttaagtaacacataactgtatacttaaaaaaaaatcaccaagaccaagtagtattattccagaaatgcaaagttgtttaacacttgtatttatagaattgaccatgtttatgtcaaaagagaaagacataatcttatccctaaggttaccagaaagcatttgggaaaacttccagtcatttctcacaacacatacacacctatcttggaaaagtggaaatggaaacaagaggataagcagagtagtcaatactctctgagcccactgttctgtgccaggcatggtggtgagggttcccccacacctccatgaggtaggttacaacaattatctcatttcactgacaaggaaatggcagagaggagaagtaatgtgtaaggtgtgtctcaaggttggtgagtggtagaactgggaagtcagcctggcagtctctctctagaactctggggtgacccctccaatatattgcttctcctgccttctctgtaagttgtggaaatcgtgtttatgcagaggtgaagaacagtcaaaatgccaaatcccttggaagtggccactgtttgactcttccctcttagagaggccccgcttgccagcttgttgctctaaggactgttgcatttttctcttggttggaatagatttaattcagttctcagctatctatgtgggtcatcttctgtaagtgatagtggaggcagctaacttcctgattgtaaccactcgtgccattgaaaccaaagactggagccaagatatttgtttctgtatcaggatttaatcaagcttggatttgtgaatggccatcagagtctgattagaaccaggttcttaacctcaaatgccgattttccaaattgtagcaatacttatttaaaaattcaaatatagtatatcatttatgaagaacataaaccattctgtcagtaaagctgtgtgtcaaatgaacaaaattaagttgaatatattgttataaataccttatgttatcacttcaaatgaagcatggttagacacgtttttagacaatcacattaaataatttctttattcatccagtctttttttaaaaatgtattcatctaacaaacactccacaccatgtactactactggagaaatgaaaatgaatgggaaaaaaattccctgacctcaaggaattcccatcatggtggtaggttttaaaagtttcaaagccaattgtctatctgttacagtgaggtaagttttaacaagttgagagagaagagcctgtagaaaaggaaaagatattccatatttatgaaaaatcctcttttatttatttaaattttgaccattaaaaatcattttgattttgtattgaaggcaatggggaagcagtatagggtttttagcagggaatcaacagagatttgtacttaagaagatccttttagaggcaggatgaagtgaaggatggctggaaagggaggtgaatgaattagaaatggcagcaactgagatggccctgcggagtcacaggaattagggcaagggacgtgggacttattttccagtgcagagtaacagctgttctcactcctaaggacagattaggagcaaactgaattgaggaatgaaaaaattcaggttaggctcagaggaacatattaccagtaagtcaaggttggtaagcatggcaaggggcctttgagtgagatgtttatcacaagaaaaattccactttcttccggaggatttacctgtgtaattgcaacctcagtagttttatagcagagttagtcatgaatttccttgtctatttcacccccattcctcccccaggattgggtcatttctatctctgatactacttggcaatctttacctctgaaaattcttgcccctggcatactatcatcctagaaaataagtattttagagatttaaatataaccaggtaatcaatgccctgttgtagttcacttcggctcattcagtctgcaactaagactggatcaaacagacctaagggatttgtctctaatctgaagcattccaaagagattgatttgaaattttcctaaagtccctgaaagtcttcagcttgagaaatgacccaaggtcaggattaatcccttactttagtgtttctgcattgtcgtccataacccacaggcatcggaatcacctaagatcttaaatattgagattcttgggcccagcccagactaaacattcatatctgtggccccagccccaattcagtgaatcagaatgaagacaggttgttgggagaagggcaagttcagaagggtttgtgcttttaacatgcatagttcttgtgcatataaaaatgtaaaaacaaacaaacaaacaaaaaactagtccgaaggatggatcgtgcctcccaatgttaataggaaggctgcagcaagagcttatctttatatatgttaactcataaattatattgcatgtttactcacagtctagaaggtaccacattctgtagacatgtatggtttgacctaatcacagaaagctagaagtaggaaaaaacatagagatagctttgtccaatctaagaaaactgaagaccagaaagactgaagcttttcccaggtgcacagctgaatgctagcagagcctgactgtcaccccaccatcttatgatatttctttttgtgatctcgatgtagatggaaaagaacaggaacgaagtttgtatctttacatagtgtgtatgtgtagatacaattcgaagaagggacttttttcctttaatctacactgattttccattagaacattcttgaacatccactgtattcacaaagtttttcctgggtgccagcaacccaaagcaccacactcttccccatcatcccacgtcatgctggttctacacagagtttcaactcttgattgttcaattattggctctcatctcacttctgttctgcataaggccagcccacacaaattttccattgtcccaagtacagccatagcacatagtcgatgcctaaagaatgcatatagatgtaatagttgccctattttagaaaacaaggaaggcgctggtgcatgtttctagtgtgcattggaggcaggactcaaaaatctgctcagactcacaaagccattcatagctgactcttcagcagtacaagcagggctaaaatgttttgggtctcaattgcaaattctagaaacttatgcacagactccaaaagcaagcatcttagttctctgtgatttgtacttgtaaacttgtttctgtcataagtaacatgatgttaatttacattaaagtttatggcttcatttacatgttcaattgcatgtacaattacaattgaacaattacatgttcaattacaatgaaatgttcaattacaaatgtcagatctcctcaactctctgcttatgttttgtttggttttgctttgcatttattccaaaatgttattatgaaaatgtttaaacattcaagaacatgggaagaagtgttcttcttaaattaagtttagattagaaattatattattcacatttaattttaatgtaataatgacatgccttaagtatctttaaaaagttttgtgttaacaaatacatttattcttattaggttatgttaccttaatgactctctttttacagctaatcagctcaagaagaaagaatcaagatagtaaaagctggacagtatttacttagcatctgtgtaaaaagcaagaggagattttctgtgagaaaaacggtcttatttacaagttcatgaatagttttgaaacttttccactaaggaggaaaaaaaaattcctctgttgttaaaatgttaacagtagtttaataggagttgacatagttaggtggaatcaaaaagcaaaatgcaaaagcccaacacatgttgggtagaaaaggcaaatttgtcacatcccaggcttacattgtatttgccactgtcgtctcagtcaaaggtttttgttaaggtctgaagacgcagaaagaagaatagtagcactgtatccgtttccagttgacgttagaagaatagtagcaatgtatccgtttccagttgaccttatttcaatagactgtgaaatccaaggtgtggggtcgtgtgtttagagaaacaagtagttcattctaaaaactgagaaatacctgatgtcactatagacaccaatcagaaactaccaaatccttttcaactgtaaaacagaaaggattctgaatggaacgagagatttaaaaccatctatgggactcaagcattgcaactgtatgtgtttctcctattgaaattaattactcttgtctattggaaatggatagccagattaatttttttctaagcacctcctgatcccaaatgaagcactggtctagtttgccattacttgttttgatgtatttttcaaacaccatggaatgatgtattattaactaaagtattaaatggaaactatagcacactttaaataccaacctttaaccattaacctgaatgctggtaaaaggacttcaaatgattttccagtacactaagccctgtttagcagtttgatttcacgattggttagcaacacaaaaatccaggtgcagaattcccttccagaatatattcttgctattttatactattaagtacgggttcattagaacttgatgttttgaatgtgttgtaacattgtagggtgtcaatattagagcacaccagttctagcttgcctgtggtatgcaattcacctgtattcggagagctatgtaatttacacttgtctgtattttccttgtggctgtccccatgccttttttcatgtttcattgttcttcctaacaaatgttaccatttccaactataggtgtttcttgaagccctaaataatcatgcctgtcttattttagtatccaaagtttactaactggagtgaactgataatgctggtatgcgggtatttttttaaaatatattaatactagccgggcgcggtggctctctcctgtaatcccagcactttgggaggccgaggcgggcggatcactaggtcaggagatcgagaccatcttggctaacacggtgaaaccccgtctctacaaaaaattagccgggcgcggtggcgggcacctgtagtcccagctactcgggaggctgaggcaggagaatggtgtgaacccgggaggcagagcttgcagtgagccgagatagcgccactgcagtccggcctgggagaaagtgcgagaatccgtctctaaaaaaaaaaaatatatatatatatatatatatatatcacatatatatacacatgtgtatatatataatatgtgtatatatacatatatgtgtatctatgtgtatatatacatatgtgtatatatacatatatgtgtatatatacatatgtgtatatatgtgtatatatgtgtatatatacatatatgtgtatatatgtgtatatatgtgtatatatacatatatgtgtatatatgtgtatatatacatatgtgtatatatgtgtatatatacatatatgtgtatatatgtgtatatatacatatatgtgtatatatgtgtatatatacatatatgtgtatatatgtgtatatatgtgtatatatacatatatgtgtatatatgtgtatatatacatatatgtgtatatatgtgtatatatacatatatgtgtatatatgtgtatatgtgtgtatatatacatatatgtgtatatacacacatatatgtgtatatatgtgtatatatacatatatgtatatatacatatatgtgtatatatgtgtatatatacatatatgtgtatatatgtgtatatatacatatatgtgtatacatacatatatgtgtatatatgtgtatatatacatatatgtgtatacatacatatatgtgtatatatgtgtatacatacatatatgtgtatacatacatatatgtgtgtatatgtgtatacatacatatatgtgtgtatatatgtgtatacatatgtgtgtatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatgtgtatatatacatatatgtgtgtatatatatacactacagtagcaaagtcatttattatctcctagttttattttcagcaataatattccaaaaatatttgccacatatcaagcccattcccctaaaatataagcctcttaagcatgagaattttgtctaatgtcaattgctggattcccagctcccagaccagtaccagggcttaataaatattcattgactaacattcagcctagatagaacctgaggatgcagaagtggaaaaaatggtaagaacctttatagtatggtgctgacattaaatgaacagcactaatattaagtggcatcttaataattcgtagtagacctaaattacctggattcaactccaagaatccaagatccaccatttactagccgggtgactttaagaaaattacctagtctttctgtgcctcaattttctcatttgtaatatgcaataaggattaaataagttattagaaataatgtacttagaacaatgtctgtcacatgagcattcaataaatctaagctgctacttttagctgccacctggtactgcttctattgctcttttcttcatttccttctatttttttctctttctctatcttatgttctcactattttttcttctctttttaggcttcacacttatcctttactatagttctgccagtgactctcacaaacattgcttaaactttctgatgatgctcagggttagactccaccatatacgaagggacccgtgcaaatgatggctgaagcaggacagattgtctgggattctaaagacaggctaacagaattccttgttggcattttccttctgaatgcctctgtcttagcttaatcctattagccaacaattgcctagctggacacaagtaccaagtagccagggattttcaaattctatccccagatttgcctcagccacactttagctcttaagccgttcatgcgtagcttccatatttagtcagggaaacctaaaatattcctttactgtgtatctggatcctcagaacaaaacctgtaatgtcaagtgtgtttgtgaatatgtgtacacacataatcacaatcttccaaatgtttaatgtttccaatgtacatgactaatgactggtcatatgcgtgggcacatacataatacatgaagttgtgtgcaggtgcaacagcggtgatggaaaacaggattcgtatgtcttttccgttcatcttttacaatgggtaagtgaaaattatggcaacatttgattatattgcaaataaggagcagaagtttatttagagagaaatgtaaatgtggttactttacaaaaaaattagcatacttctatatgcaatcttgaaatcccaagagctgatatattcttttatttcatagtttaaaataatcttatctgtatattaaaaatagagactacaaaaaatgttatgaggttatgtgaggttatgcatatgttattcagctcattttggctaccctattatgtacacatatttcaaaatattaggttgtatatgaaatagtgtatatacgatattctatcaaataaaataaattaacttttgataaagatcaataataatatattgttccagattgccaatctctgcaaggtacaaacattgtgatatgtttataacataggagaatttgctttcaatgcattgagacatacaatgcttctatagtatctcatagttatagaatgaatattttatattagaaattatttttataattgtacatgatcccagacatgtaagcattttcttgataatatttatagctaaaattattattgattaaattaaaataacatggaaacaagtaaataacttcaaaaatatttatcaataatagtattacattccttcccacaatgcttaaaacccatatgactatacaacttaattcaacaaatatttttttttttgaaatcgactaagttcaaaatactctcttaaacatttcctgagctttaaatattattaagacagtctccactttcaaggaacttctggtttcttaggtataaaaagacaagggcccatgccactaaataaagcagcatgatgccaaatgtcgtaagagcagtgtcttggcaagttgatgcattgtatctggggagatcaagagcagcttagctgaggctttagggcaatggttctcaccctggactctacaaggaaaatcatctgggaaacttgcaaaaatactgatgactggggttttgattcaacacgtctggggtgtagcctgggcattagggtttttaagagttcccccaggtgattttttttttcgagatggagtctcactctgttgcccaggctgaagtgcagtggtgcgatctcagctcactgcagcctccaccaagcaggttcaagcaactctcctccctcagcctgccaagtagctgggattacaggcacccgccaccacacccggctaatttttgtattcttagtagagacagggtttcaccatgttggccaggctggtctcaactcctgacctcaagtgatccacctgccttggtctcccgtagtgctgggattacaggcctgagccactgtgccccgccccctcaggtgattctaatgtgcaaggaggttctcggaaaaattgaaaaatcatcttagactttggttctgaagatcgaatgagattttgataggctcaggtgggaactgaggagagggaaggaaggacagcaggaagagagccagctgagcagcaaaaagtgagttagtgtgggaacactgaagagtaggaggaaatggctggatccttccaaatgcggcccgtgacctcataccaagaggtatgtaacacctgagaacttgtcagaaatgcagactctcaagccctgccccagacctaatgagtccgaatctgtgtcttaaaaagactcacaggtgatttgtatgcacgtggaggttggagaagcttgggcttgatcacagggtagcaataacgacgaaaatcactgacacacactcgtatgcaggtttacatgtcttagctaagcctcataccaacccataaggaagtattctttatcatcaccccattttctagatgaagaaattgaaactcaggtttgtttgctcatctagaaagtaatggaacagagattcaaacccagacccctaactgctacaaagcacttgcactgcatacttgcactgtgtcaccacttttgtggttaagaggaagcccaggagacaccctggaatggaagaggagggctctgatatgtactccagaggaaatcctgagtcctgggctaggaagagcaggtctgtgaatgagggggccctgtcctaccctccaagccagagcccagaaaaggcaaccctatccctttccactcgtcatctcttgcctttcattccaggtttctaaactaagagaacttatctgtgccttagaaaaagagttctaggaaaacaaccaagaaagttagtaaccccacagaaatggaatacctagtcaccaaattaaaaataaaacacacactaaaaaaatgcattttagtataacataaaaataaatatatcttccaaatatttatttcttcttcacttcttgtttatttccctacattctccctcctctctctcgtagccgaaacacaggttcagtggcccactgcttgcagagtccagttaacaagagtgtggtttggtataattaaagtgactttttattctaaacctagcttacgggaaggagtacagtacaggcttcccaccttaaggatactgcttcacttttggagcagaaagcaggtgctttaaagggcaggggggtttgcaggggcagaagtgactagttaggggttcacatacgcactttggtgccttatctaccgggcattggagctggtgtcttcatgggcagaaataggttgtaaatgtggccaaaagctctccaggtgagacagagtttcacagcaggcatactttggattgtaaattgagtgttatctctcaaagcagtcccctggtgggggagagttctgctctggagcttctaagcccatagttggataaacttgccctgtagggagtgtctggtgaaggggaggtaaaaggttataattgaaggggctaagtaggaagtggggaatagggagaaatggagaaaagagaagaaaaataattaaaaaatagtaatgcattctcctcttagaaaaattggagtattggttactctctccccccgcccccccacacacacgaaaccacctttgcaaaattataactgaggaaattatgacagtgaaataaatctaacttaaccaactctattttgcttctaacccttaagctgtccttgttcattcctgggcataggccgaactgactttgggaaggaattcagttcatggtttgactctgaaacaaaattgataacagccctttcccaaaaagacccccttcttgcctggggaccagtttgcctttgcaggactaacaaattagctacaagatgagaaattacagtttcagggtcatgcggcttctggcttcaagagtccgaacctccccaaattgctcctgggggtaacatcattattgtaaaacctaagatcagtgcttgagacattttgtagaccctgcactcaatggatcagctaaccccacccagacctgtaatctggtccaacccagttgtaccaatgcactcaggaacagaagacattaagaaaacctaactccgacccatgaagattccatctccaacctgaccagtcagctctccccacttcccaagcccctacccgccaaactatctttaaaaactctgatccccaaatgttcggggagactgagttgagtaatgatgaatattccgtctcctgcacagccggctctgcgtgaattactctttctccattgcagttcccctgtcttgataaatcagttctgtctaggcagcaagaaaggtgaacccattaggcggttggttacacacacacacacacacacacacacacacacacacacacatatatacagaaggaggtaagtacaaagttctagaaagaggagcaaaaaacaaagaaagaggagggagagaaacaaaattatgctgtgtgcaaatatttcaaatatgttaaaattttcctaaagttttcatggaatttttatcttaaatggcaagagaaagaaggaagaaagaacaggaagagaatacaagttgaggaattcccaagggaaagcagaaggaaagggaagcattacaaacaaacttttggaacctcattttttgcctaagccagatgtttctgaacgacacaaaacatgacttgagaaaaagtggctctgccaaccatggtcatacatcaccagcacaatgttaattcctgttccaaacaggggtacttgaaaggtcatcccaggataatcttggggattccctaagagtatgtggcctatgttgcgtccagctggttctagatggtccaattcagatgcatctgcttttccagtggaccatctagaacatcccttcttgctcccttcactccagccagactggcccagtggccttaggtcctcagcaggcctgaaccttttacttctggactttgcttgtcatcctccctgcctggtatatcttccccaacggattccttgttttgaatcctgctatctctgttaacgcagtactagccccatctcttctgtgaagcctctgtgtccgaatcttctgggaactccacctcctctgtgttagaacattaaaagatgggacctaggctgggcacagtgactcacacctgtaatcccagcactttgggaggctgaggtgggtagatcacctgaaatcaggagttcgagaccagcctggccaatatggtgaaaccccatctctactaaaaatacaaaaaaattagctgggtgtggtggtaggtgcctgtaattccagctactctggaggttgatgcaggagaatcacttgaacctgggaggcggaggttgcagtgagctgagatcgtgccattgcgctccagcctgggcaataagagcaaaactccatctcaaaaacaaacaaacaaacaaacaaaaaagatgggacctttactctgtcctgttcagtttctttttatatggatatgttctgaccaactctcaaatgcctgatggaatgaactgggtaattgggatgttaggcaagttgcttagctttcttgtctgtaaattgggaataataatacaacacacttataagattgtaaagatctaatgagttcctgtaagtaaagttcttaatacagtgccaggcatgtagtaaaagctatctgtgttatttatgagtttacctttgggacattgttgaaccaaaccttaactgatgttaaatattgttgcagaaacaggacagaggctccaaagcatctttgtaggtgcctttaacaagcattgcaaagctatcctacattataaagtacaatcatccatgaaatgatgtacatattatatatgcacagtgtaaagaatacaaaataggctgggcatggtggctcatacctgtaatcccagcactttgggatgccaacgcaggcagatcacctgaggtcagaagttcaagaccagcctggccaacatggtgaaaccccatctctactaaaaataaaaaattagccaagtgtggtggcacgcacctgtagtcccagctactcaggaggctgagacaggagaattgtttgaacctgggaggcggaggttgcagagagccgagaccgaaccactgcacaccagcctgggtgacagagtgagactccatctcaaaaagaaaaaaagaatgcaaaataaacacccaagtacacatgtacacagcacgcatgcaagcatgcacgcaggtgcacacatatgcgttaagataaagaacataagcagtataactccagtgtaatctaccacaactgcattcccttctcacagccaccccaccaccaaatgcaattcagacttttatgttacctattttcttatttttctttgccgtgtctccccataaatacttattcccaaacaaacaaaaatatatatacatatattagtttcacctgtttggggggaactctatataaatggaatcatactgcatgcatttgttgtgacttactttttcagtgtacgtgtgttcgttttcatcttccatgttagttataaagctgtagtttttttgtttttgtttttgttttcatttttgtttgagacagagtctcactctgtcgcccaggctggagtgcagtggtgcaatctcggctcactgcaacctccgcctcccaggttcaagcgattctcctgcctcagcctcctgagtagctgggactacaggcacatgccaccacacacttctattttttgtatttttagtagagactgggtttcaccatgttggccaggatggtcttgatctcttgacctcgtgatccgcccacctcggcctcccaaagtacagggattacaagtgtgtgccactgcacgcggccccataaagctgtagtttattcattttcactgctgtataacatcccatcctatgaatgtaacaaaatttgtttttccattctaccattggggcatgcatggggtttctcagtttttactatcacaaagctactgtgaacacgtttgcacatttgtcctgatgcaagtatgtcagggtttctccagggaatacaccagggtggaattgctgtaggtttggggatgcatatacatttatctttattagcaagtgctacattcatgctggaaatcgatttacaatcttacctggaggacataggcattctggtttctccttgccttcactaacatttggtgctgtcagacttgattttatttatttatttatttatttattgagacagagtcttgctctgttgcccaggctggagtgcagtggtgcaatctcggctcactgcaacctccacctcccaggttcaagcaattctcctgcctcagcctcccaagtagctgggattacaggggtgcgccaccacgcccacctaatttttgtatttttagtagagacggggtttcaccatgttgaccaggctggtcttgaactcctgacctcactgacctcaggtgatctgcctgccttggcctcccaaagtgctaggattataggtgtgagccaccgtgcccggccagacttgatttttgcgagtctggaacccacttttagcttttgccaaaatgatgtgtgtgaaggcatacctgagtttgggataaatgtgcagtttttctgaatactcatgacattgagcatgtgtttatatgtttatggattatttgtgtatcctcttctgaaaaatgactgcacgtatcttttctgttttttttgtttttttttgtctttttcttattgattcttgggcactaattctttgttatagatattgcaaatacatcacagtttgtgacctatgacatcttctgagaaacaaattcttaaattttaatatagtagaatttatccatcttttcctttatagtttatgtttttgcatctttttaatgatatctttccctaccccaaggtcataaagataccctctgaaacttccccctaaaggttttaaaattttggcttttccatttgagtccttagttcatttggcattgaacttttatgagttagagaaactttgcattgttttctatatgaatgaccaatgcactcagcctctttatctgtcctttccccaggaatctgtagtgccaggtctgccatatatgaggtttctacatatggaggacccacttctgggttctctatgctgttccattggtacatttgtccatctgtacaccaacaccacagtatcttaattactataattttatactataagtgttggaatctagaagggcaagctccctcctgggtccctcccattgcacttccaaatacattttagaagggtgctttacattttttatgactcttggacatccccagtgcacgttattgctcttgtcttacagcaaaaagaatattcttagctctcactctgaggccacagtgtagggtgaacacccatgatttaatgaaagcagttgagaggtttcaaagtcaagacacaacattgtctttcttgactaattggagactataaacctgcttaaagccaaactaaagacccttgcactaaacatggctcttgactcaataatagccttggccgttcataaacaaacctgttttggtcaaactttggtttgacatttaaaaccttgtaaacataatagctacttcctttcatcctgacccaacttggcttcctccaaggcaaatcaaggtcacagtgctattttagggtacagtgaaaattaagtttcttaggatgccttaaatagctgaagcgtaggctgaaacataaactggaattaattaaaagagaccacatgtataagagtgtggagatccagagagggtacttaaccagcccaaggtcacacagtctgaaaaactcaagtctctttactctctgttccaattttttctattctatactaggtgttggatgactttttttggagagtaaaagagtaaatatcttaggttttgtgggctaagaggcaaggtcctcaattattctagcaattgttcccctagaaagaccaatattccttttatatctaaaaatgtaaagccattattagctcaagggtcctgcaaaaacagtggggtggactagatttccctgtaggctgtagttttcaacccaagctctacaccatatgtaagagatacgtattcttgtttccgctttttagatgattaaaaacatacatataaatggccaggcgcggtggcttacgcctgtagtcccagcactttgggaggccgaggtaggcggatcacaaggtcaggagatcaagaccagcctggtcaacatggtgaaaccccgtctctaccaaaaatacaaaaattagccaggtatggtgacaagtgcccgtaaacccagctactcgggaggctgaggcaggagaatggcgtgaacccagaagacagaacttgcagtgagccaagatcacaccactgcacacaagcccgggcgacagagcaaaactctgtctcaaaaaaaaaaaaaaaaaagaaaaagaaaaagaaaaaacaccgtacatataaagaaaattacagatcaaatattacaatgcatattaggaatcagcagaggtgaaattgtgttcccagaaacaaactaatgctatatggtatgcatttgaggattagttctgaagatagctgaagtaaattggagtccacttcattttatcctccgcatattgaaaagtctgttatgcctcaggaacttcttggtactaaatcacaaaattaagaatgatcattgatacaaaaattctcagtaatttgataatatacaatgtctgtgtggagtctaaatatgcattctgaggaaacaaggttatttatatatattataccttttctccatttaaagattaaaagtcattgttgagttattcttagatagccttcaaacccaagtatattataactgtgagtatatcagacatgctattaatttttcctgtgttatatatagagaagccttctttgatgtgaattttgtcatttgtatattctctgatttaaacgtgttgtttgtatcttaaacatcacaaatgaagttgcattttcataacagcttagcatcataaccttttctatatttcttgctttaattccaaatcactatagagtgtgcccacagttgtatctttttacatgtttttattccttaggccagagcctattaaaacacttcacaggtcctattgctatctctgggcatgttactggctttccattcttcaaatacctgtccattgtgaattataggcactagctgtgtcaaatgaaaacaatttcaaagatttgtgtgtggagaacttgagaatcgctacctagtcctttgaaatgtggtcagctggatattgttagcctccttgtcatttattttgtgtcccatattttgaagagccttctcataaactcctagggcttgacagtctgggtgtctggtttaagaactttcttatcacattattacctaagggctgcaaagggcactacttaccaactccacaaaaatgaaaagtgtctctgaaaatatttgtcttcagactgactcattcttgaatgtctgaaacgtatactggatactttttggtttgtttactcggcttagaatgtgggattaaaatgagaaattaacatcaactaaacctaaaacttagacttttctagcagtgcatttttatttttcattttgtggataggtcaagagcctaccagtctcatcatcatcattttttttttaatgaaaagtcattatcgtttttccctcattatgaaataatgtacaaccaaaaattttaaagcaattcaaaaaagtataaagtcaaataggaaaatcaccatgatccccagagtaaccatttttaatcattctatgtatttacttccagaatttctgtgcatatataggttcttacaaaaatatcatataaatctgtctgatgtttttatgagttgctgtaatattccactgtattgatatggcacaaggtatataaccacctccgtatgtgcttgttgtttttgttttttgtttgtttgttttgtttttgcacagagtctcgctctgtcgcccaggctggagtgtggtggcatgatcttggctcactgcaaactctgcctcctgggttcaagcaattctcttgcctcagcctcccgagtagctgggattacaggtgcccaccaccatgccaaactaatttttgcatttttagtagagatggggtttcaccatgttggccaggctggtctcaaactcctgacctcaggtgatccacccgcctcggcctcccaaagtgttgggattacaggggtgagccactgcaccgggcctatgtgcttgttttatgtgcagatttatcctccctcagttttccctagcatcataggtgcaggcagtgtatcatagccttagctttcactaatagatgtttgtactactcttttgatattaaaaattttccttaggataaaacaaataagagggtgtttacatgctacaacatagatgaaccttgagttccttatgctaagtgaaagaagcaagtcacaaaaagacaaatactgcacgattccatttgtatttagtacctacagtagtcaaattcatagagacagaatacagagtcgtgtttggcagggactggagggaggagagaatgagagattgctgcttaataggtacaaagtttcagttttacaagataaaaagaattctggagattaattgtgcaacaatgtgaatgtacttaacaccaatgacctgcacactaaaaaatggttaagaaggtaaatttggcaaggtgcatccttccacaattaaattttttaaaatcaaaggatgtttaaaatatgattgtatatattttattgtaaaatgtactgactgggtatataaacgccaccctttcctgtcaatttcagttatctggaagacaaacaaaaaccaggacaatactacaaagattctgcacttcatttgtagttgaggccctcagaccttaccgcatctctttattctgaatttataagtaattcaatcgagctttagttactgatttcttaattagtagcatagattaaacaattagaaatacagaagaggtatcagagagctataggtaaggaagcagcagtagaaagaaaggaaggtagaaagcctaataccacaaaaagaatcttcctccaaaaaaaaagcatacttaacaatcaaaaccatagaccatcctgcaattaaatgatataaatgcaaataaatatctctatgtatgcaacagcatcactcaacaaatatttcttaagtatcagttatgtaccaagaatcccttagggcccaaaagtgttcacagtgacagcaatattgttcaggaaaggaggattatgtcactttcagtctgtttacaaggcaggagagcctgtcatacaatcacagatggtcagagtttgggttttaatggtaaacttcagttatctagaaattgcacttctatagactctcatgtttcctcaaatcctgtgtccaaatggtatcctgtttaataattgtatatgatttagtgactgtattggtctattctcacactgctgataaagatatacccaagactgggtactttataaagaaaaagaagtttaatggactcacagctccacatggctggggaggcctcacagtcatggcagatggtgaaaggcatgtcttacatggtggcagacaagagagaatgaggaccaactgaaaggggtttccccttatgaaaccatcagctctcatgagacttatccactaccatgagaacagtatgggagaaccaccccatgattcaattatctcccactgactctctcccacaacatgtgggaattatgggagctacaattcaagatgagatttgggtggggacacagccaaaccatatcagcgaccttacctatctacatggacttgtaccaccttgctccttttgtaagcaagcaatttgtaagcacattattcaccaagcagcagtatgtgcttgttaacaaagacatattttagccacaatgttaacctgactgtagtcctgttttatttgactgtttgtaccaatagccacagtttataggtttgggctatagaaaaagctgatattgagcataacaaaataatgcatgatgtaccatcactataggatggtgggtttattaaaataaaatatctctccctttctccagggaagccgtaaattgcaaaattatcaatatgccatctagcagtttatttatcatgtgaaaatttggaagtaaaatgtgtggtttcagcaactgaattcagtagtaatgacaactgttcaagaaaaatgtgctcatacagaattcttggttaccatcacctgtgatggggcctaaatatttttctttggagaaaaagtaatgaaatttggaggccttacagttaaacattattctggacattactggttttgcttgttctgttttacaaaatgcttctgcaaacaagacagtgctggcacaagggcagaagacactctcagcattgctttaagagtcagattcatccattaaaatacacattcaaactccatataactatatatagtcacatatatagttataactatatttaactatatataaaataactatatatatagctatatatatatatatatatatagttattttaaatttgccttaatagctaaacccctttttaaggttttccaaatgcgactgctcatttgaaaaaatgtcgtgtgggccgggcgcagtggctcacgcctgtaatcgcagcactttgggaggccgagacgggtggatcacgaggtcaggagatcaagaccatcctggctaacacggtgaaaccccgtctctactaaagatacaaaaaattagccgggcgtggtggtgggcgcctgtagtcccagctattcgggtggctgaggcaggagaatggcgtgaacccgggaggaggagcttgcagtgagtggagattgtgccactgcactccagcctgggtgagggagcaagactccgtctcaaaagaagaaaagaaaaaatgtcgtgtgaaaatactgcattttttattaggatatgataatgattccatctctgtcttaggaaaactaatttaaatgcacttttgttgttgtttctgtactcttccttccaaaactaacagtgaagcaagctatcaaggtgtctgctctgttgatccaacttgaacaatcaaactctactttagcaacaagaaaaacatatttttaatattaaaagaaaagtaaagcacatattaggaaaggtggaaatagaatcatcttggagacttataaaagatatctgatgcttaacgtttagaaatcttgtgacctgaatttcaattgttttgctttctaaattattttatatttgtttatttgtattttggttgtaaaaaaagcagaattaataaaaattcttttttcatatcctttcgtatttctacaaaacagatgttgccattatgtggaatttgtcatcttccaatatacaataaaatagcctaacatgaagtctctatcctcagtcccattatttctttttttttttagacagagtctcgctctgtcccccaggctggagtgcaatggcacaatcatggctcactgcaacctccacctccaaggttcaagcgattctcctgcctcggcctcccaagtagctgggattacaggcatgcaccaccatgcccagctaattttgtattttttttttaagtagatacggaggtttctccatgttggtcaggctggtcttgaactcccaaactcaggtgatctgccatcctcggcctcccaaagtgctgggattacaggcgtgagccaccatgccaggccccttggtcccattatttctatcccatctttgccttttccatttgctctgccacctggctcctgcactcacccttctcttagagccttttccacttatgacactatacactgtgccagcggggtgggttgtttttgcagagccaatcccaaagacttttgttaattcccccttggctttcttgtctatctgcttctaagattttatttacttggtattagtcatctggatgagaagaaaaactcagtcaatcatcaaaatgtctaaaatatccaaacgtttgtattcccagagatgtagcttacattttcttatttatttttgtatgacgtctcactccagctgtcattgtatttacatgcttatctccccatagtctgtttttagtgctgtgaagcactcttgtatccttgacattttccaagtttaatttttaatcttcttttcttgtttttaccacagttatatattttatatagttaaataatttacacctatgacttatgttatctgtctagtactctgtgatttactttttcatatagtcagtatgtattgagcatcttctgtttgcatttgtaaccccagtgctgtctagaggtatcctgtcctttgaggtttaaaactacatgaaattccttgaataccatctcgacctgtaggaagtccaaattctgccccaagatttcttcaccttccctggggcctgcattttcttggtagcttttccttctgattttctgtacttgctgaagatttgaatcttacccacatctcaatttccacaatgattcttccattaatggaccagagcttcttgtttaataaggcggttttatgtgtgtgtgtgtgtgtgtgtgtgtgtgtttcagagacaaagccttttttttttttttttttttttgagacagagtctcactgtcacccaggctggagtgcagtggtgcaatctcagctcacttcagcctctgcctcccaggttcacgtgattatcctgcctcagcctcccaagtagctgggattacaggtgcccgccaccacgcccagctaatttttgtaattttattagagaccgggtttctccatgttggccagggtggtctcaaactactgacctcaagtgatccacccgcctcggcctcccaaagtgctgggattgcaggcgtgagccactgtgcccaaccagagacagagtcttgctccactgcacaggctggagtgcagtggtggagccaactgcagcctccaactcctgggcttcagcaatcctcccacctcagcctctggaatagctggaactacaggcactcaccaccatccatggctaatttattttattttattttttgtagagacagagtctcactatgttgcataggctggtctcaaattcctggcctcaagtgatccctacctcagcctcccaaagtgctgggattacaggcatgagccaccatgcctggccataaggcagttttatatgacaaagtgtattgaagatttagagataacacaggaaatttcaactacattgataatgtgctatttctgagctgggtggtagctgcaggagtatttattacattattcttgatacctttccatatatatggagaatagtttaaaatttttatgtgtcagtggagagtcctataactcagaatgaataatgattttatcttcatgttatcagaaaagaagtcagatgctctgaggagctggatgcttttgtccaatgagttgcagacagacgttattgctggaattttttattaagaacatttcaaagtcatcacccctctttgttttaccttgtccagcacaaaggaattatcaacacctgtacatgtcatgaaattaccattgcagtggtctcatcttcttcttgacctctgtcactggttcccctgtaagacagtactcttgatcttgacatcaccaatcacagttcctctccaagcaccctccagtctttccatctttgtccctaggactccaaatcccataatccttccatctcactggtacccacaattcctttatccattgctttgtcactgtctctgtgctcctggagtctcctgtcttccctcattgatgacctttatttcatggtcaaggagccatcaggaccacttttttttttttcgcattcatcctcagctctcttgcttgatcaaatccatctggaaaaaccacaaatctgcttaaatcccactgtgtctatgcagcccagtcactgcttcccctccttctttcaagtctttattccaaaaatcacctcctcaggtgagccctttcgtgaccacattatctaaatgtttacaacccacccctgacatttcacttctttctttcctgcattaatttttcttggcaattataattagttaacgtgtgtattatacatatatatttatcttatctattgttttcttccccctgttagaacataagctaccgtgtcccctgtatctagaatagtgcctggtgcatagtacataataaatgttttttgaatgaatgaataaatgataccacttctagatttgaatataaatttgaagttggacattaggaaaaaaaaagtgaaaataagtgactgagggaaaatggctttgagggtgagaaagcgtcccatcctatcactgagcacagtagatcatttaactcagcatccttgtgtttaaaatgctccttaagccaggtgcagtggtgcacctaagtagcttgtagtcccacctacttaagaggctgagatgggaggattgcttgagcccaggagtttgagaccagcctggacaacatacggagacactgtctctaataataataataataataataataataataataataataatgataatgataataaaaagctccttaagcacccttgacatacaatacccaatcttgctcctgcagtccttcagccccctgcccctgagcttgctatctttcaagcttccttgcacattttccttttctggcactgtttctgttctgcctgattcatgttcattttatacgtagtgaaagttatacatttcttggcctgttctcaggtcaacacccacctgcaggctttgtccagagagtgtcctattatcatcaaatgggcccctgaagtcatgggaggcagctaagaggacactttcctctccccaacactgtgaacttgtcccccctcctaggaatgtagagatgagtaagatgtggcttgctatgagaaacttcgtggggtggtggagaaggcatgtaaacaaataattacagtgcaattaggtacgtgttataagtcagttatgcacaaaacaaatgagggagcaactaaccaccttgcgggttgagggaggtagtctttcaagacaggtaactttgaactgctctggaatcagcaaaactcagccaagcaaggtcagaggcagtgagaagtgggcatgtcaggccaaaaaaccatgtggaaaagcacaggaatatgaaagcaagcagagggtctcagcgggcaggaatcgcacctgcagccccatgggggccaatggcctctctgctggggatataggggacacagaatacagagagcctcccacaccatgcccaggagttcagactcagcactgatggccaggtctaaatacttttaatcaaccaagtgacatcatctaattcggggaatttatttaggattgatcattaatctcaactatcctatatttttacaaataacttctgttttatttcataaatatcaaagagattggtataaaagttctggggatgaatcttagttcctttttaatacttgatatgctaaggaagttctcagagtgtggtctggggaacccctgaaactaagcccctgcaagctgcttgttttaagtaccgattctaggcctcagacctgctcactgaggatgggatctcgaggggaaaagtatggttactaaagacttcaaataattcatatacatgaaaagttgagaaccactgtcctaaggttctgttggaatatcatgaaactatacagagatagttttcttaatcacaatctgatgtgaactgatactatcaaggaagtgtgttactcataacaaatggggaaaaatatcccaaacatttacatcatatactttagaaggcaaattcaggccaggcacagtggctcatgcctataatcccagcacttcgggaggctgaggtgggcggatcacctgaggtcaggagttcaagaccagcctgaccaacatggtgagacgcccccccaactctactaaaaatacaaaagaaaaattagccgggcatgattgtaatcccagctacttgggaaattgtgatgggagaatctcttgaacctggaaggtggaggttccagtgagccgagatcatgccactgcacgccaacctgggtgacagaatgagactctgtctcaaataaataaataaacaaataaataagcaaattctggtatcagattttctccttatcctttacagagagttatagtcatgatttatctcacttatatccagccccaatcaaagtattaattagatagtgtctattgtcctccacttgtggggagaagatgttttgcatagcagtgagcaactaagccaggaatgaattcagctctaagaagttactcttctccatagtgagctcctccaagacaaagcctttaggtgtgggctctgatactccaagcaggccagactgctgggcagaaaagtcaacatgaagcagagcctctgtgctctgaagtttgcacgcaatcgctccgaacgcagtcagcttatcggtccaagggaaaattagaagttccagattccaaataagatctggactgaccttggagtaatgactatgagacagatgaactttaaggcgttttacgatcttaatattctattacttataacaatggagagtgtagctctcccaccatcagccagtggaagcgcaggtgacctctggggtttccctgtgtctgcagataactgtcagctctaagctttcttcatcagatatctcaaccattgtctttaaaattttcctatgtttattctgactttgtttttttctaccaggaagtaaaaactaagctagtagttttccaaactgaaaaaacaaacaaacaaacaaaaaattacttaaaatgaatgctgctgggcatgatagctcatgcccgtaatcccagtactttgggaggccaaggcgggtggatcacctgaggtcaggagttcaagaccagcctgtccaacatggtgaaaccctgtctctactaaaaatataaaaaattagccaggtgaggtggcggcaggcgcctgtaatcccagctagtcaggaggctgaagcaggagaatcgcttgaacccgggaggcagaggttgcagtgagccgagatcatgccattgcactccagcctgggcaacaaaagtgaaactccatctcaaagaaaaaaaaaaaatgaatgattatagtttgagaaaacaattaataaattataggactttaaatttctatttttgagatgaactgtctttttattgctctgaatgaattttcttttttgttattaatttttatgtttagaaaaagtaatctagttttgttttgttcttgtttttgacagggtttcactctgtcgcccaggctggagtgctgtggcgcgattacagctcactgtggcctcaacctcctgggctccagcgatcctcccgcctcagcatcctgagtagctggaactacaggcttgcgccaccatgcctggctaattttttttatagagacagggtcccactatgttgccccggctggtctccaacccctgggctcaagtaatcctcccaccttggcctcccaaaatgctaggataacaggtgtgagccacctggcctaaactttggttttgtaaataacattttcaaagattttttttcaaatggtcctatgaatagacaaaccaggcacatgacctaagaagtcccatccgccttaatatgcgtctccacctgccagcctgcagctcgaattttccatcacttgtggcactggtggcagctttctgtcttttttgtttgttttaagaggtaatgttttctgaaaaatgtgtcagttcccaggcggatttttaaaaattaacccattagcatcatgtctctcgataagattagtttactttcacctctcagacagaagaccctgcagcagcaggtgacaaagcaaagagtgaccaacaagagagagtggaggtgggtgtggctaatttagtggttcccagtgcagggttgcaccaggccaaagcaagtgagaaaaataagaacgaggtagagatttttttttttaatcaagtaaaatgggagctttttatcaagttcccatgttaagggaacagctttttctttcttttttttttttttttttgttgagacagatctcaccctgtctcccagactggagtgtagtgatgtaacctctgcttactgcaacctccacctcccaggttgaagcgattctcttgccttagccacccgagtacctgggactataattacactccaccatgcccggctaacttttgtatttttagtagagacagggtttcaccctgttggccaggctggtcttgaactcctgacttcaagtaatccacccgcctcggcttcccaaagtgctgggattacagtcgtgagccaccatgcccagccaggaacatattttattctgtgggcattttacttgctttatggtatcttaatttttctctggaatatgaggacagtagatgagaggtctgctgtggtttggggggtgggtgattgtgttggtttgtgtttggaggtggccattgctcttatattgaaaaatataactaagacagccctctgtttgtcttccttttaagacacatttattttattgccctgtgaagttcaaaacatgaagaacttttggactagaggatctgctgggttcttccagtccccaaattgtattccctgtgtcccccaagctctggacagaagcacagtgggagaaggggaggcacatgggggtaggcggacagaaagaagagacaggtcccagtctgccattccaaggtagaagaccatctctcactggaactcacagctgatctcttctttaagtttctattctaatgttaggtttgtttttttttttttagatggagtcttgctctgttgcccaggctggagtacagtggtgcaatctttgcttactgtaaccttcacctactaggttcaagcaattctcctgcctcagccacccaggtagctgggattataggcactcaacatcatgccaaactaatttttgtatttttagtagagacggggtttcccccagttggccaggctggccttgaactcctgacctcaggtgatctacctgcctcggcctcccaaagtgctgagattataggcatgagccaccgcacctggcctctatcttaatttttaatgcaatttttatattgccatagaaaaaatataatgaagataatttgtaccaggaatcaccaagcttttcccataaagagccacgtagtaaatattttaggctttgcaagccaagaggcaaaatgaaggctactatgcagatacctatataacaagagagaaaataaatatccacaacatttgtattgatgaaatgcaaacttatggacattgagatttaaagtttatataattttcacattacaaaatgttatttctctcttaattttgtttcaaccatgaaaaatataaaaaccagtcttagctcataggccggatggaaacaggcagagggctggatttgtcctgcaagctgctgtctgccaagtcctgcattatacagctaatttcatgagctactatgttatgtttttcactgggattttacgtcccatcatgaggggcacagtgatagggtgagagggggagaaacatacccctcctcccccagtgccttgtggccagcagagcccgtcaataatgaaatacaggccgggcacgctggctcacgcctgtaatcccagcactttgggaggccgaggtgggtggatcacttgagctcaggagtttgagaccagcctggccaacatggtgaaaccccatctctactggagaatcatttgaacctgggaggcagaggttgcagtcagccaatattgcatcactgcactccagtctgggtgacagagcaagactccatctcaaaaaaaaaaagaagaagaagaaatgcaacactgcacctgagaatatgactgaccctgggtcagactgtctcacctgaattcagatccccactccccatgttccttactatccttagcctctcaaaatcctaggtttctcatctattagatggagcttataacagtacctcccttacagaattgttgtaagatataatgagataatatgagacagccagcactgaaagtgctcaaaacatactgagatcattacagtgctgatggaagttcatttcctctaccaccatcctgatcaagggatcccgtggagcctatttttcttacatgaatagtgaagttttctcagtctttctgcattcaaaaccttttagggggtaaaaagaaaagaaaaaaaaaggaacctggagttaatgattataggtatacttaccattctctgcattgcataagacgggcaaaattttcttaccatattatttattctcaaatgtaccagagagccctcactgcaccgtctttgtcagagttagtaatctgtatgcttgctgtcatccagaaaatcaaaaacgggtggctggcttacatgtctagactagtgatgtgtctctggacgggagttgagggataggaagtggcagctgcagtgagatttctttgatgtccaagggtggtgacagcagcttcagggcggggcaggcgggggcatcccgcaaagcagtccatgggtgtcattcttcttcactggagggcatggtgccagggcacatggttggttgcttaaggcagacacgggcagaggcggccctgcagaggacagctcgtggcgtctgtctggcacggtttggctatacttggtcagctcttcttttcacacacaaaaactttcccctcaggctattggctgggcagagggactggcagggtcagtaatcataatgcaaaatcaacagacctgctcagtagggtgttaaccagctgtgaacggtgccaactccccctgctattaaaccaggctgggctgggctgggctgcgggagagagattggagaaaggcagggcaggccacgtctgtttcaccagcatgcacaggaacgagcatgctggctgttgacagtagagagagaaatagtcaagattatttggaaattatgttctggtctattaataaaaatgcatgtgcatatttcctgatccttttaacgaacaataaaaatggatgtgtttaatgagatccttcatgagttttaaggataaaaagataattgtttacagtgctagggggatataaggaattgtgagacaccgttcccacctgcagtttagggaaagtgataaaccctcaactcaggagcacctaatgatccatgtcaagtcaatgagttagtaacagcctacagtaacagccctcagtgtatcctatgaactcttctaagggcttacctgtgctaaccaatctgaccccatttcacagatgtggaaaccgagacacctgagactgcctagactcacagaggtgaggtggcagagctgggatttagacccaggaagtacgtctctggaactggtgcccttcaccctgtaccactttgcctcataagagaaagcgatgtgcaggtgagacatgggtggcacacgggcactgcgagaattgagatcaagagaagagtgtgagacccaattgatccgcactcctggaaggcttgctgcctttgtgtaatatatttgatctggcacctttcttggataagcatcaagtaccattggggtctctaaccaatattttgttaaataaaacattgtaatgtgtctgtgctcttaggcaaatgatatttggttaatcaaccaatatagtcagtgtactctaataatactattaacaaatatgagttaattcatttattgtttgttagagatagataacagcagtctctcacccttgctcttagattcaacaccagttctttggcactggacaagggacttcaagaggaaatgtcagggaggaaggtggctagtgcagactgatggaagaaaggatcaaacaatagttgtggatgtcctttggcttggaatcttgaaaaggagaaaggggagtcccccagtgactgagtccttattgagtgcagggtaccaggcaggctagtgacagcatctcaactccttacaaaaacactgcaaggtacatcctagtatctcccttgacagatgggggaacctggaaggattaagaaatttcccggccgggcgcggtggctcacgcctgtaatcccagcactgtgggaggccaaggtgagtggatcacgaggtcaggagatcgagaccatcctggctaacagggtgacaccctgtgtctactaaaaaaaatacaaaaaattagctgggcgtggtggtgggcgcctatagtcccagctactcgggagactgaggcaggagaatggcgtgaactcgggaggtggagcttgcagtgagccgagaccgtgccactgcactccagcctgggcaacagagcaagactccatctcaaaaaaaaaaaaaaaagaaatttcccaaagctccagtttgtagctacaatgctgggagtagactcaacatagatgggtccgtatatattcagtaggtccatacatacatggcctgtgatttctggaattccaaacctttttggattctctacaatgaaagtttattttgcattttaagtaaggccgtaaaacagaaatgcaactgtgaaaaagaatgatttccacaagtttaactacttaatattcaaaagtgctaaaacatcatgtaatctcgggtcatttcctgatggcaggagggggtttaaaagccataatattattattaagagctttctgttcatgacaaatgattttgtattccattaagatatgaggaaactatggggtaatttattgctggaaggagaaaaatcataaaaatgttgcttaagaaatatccattagttatgcttccttaatagttagcctttggccatcctggttttttatgtgatttaacagttgaatagtaatgaatgggttattactattaaagtaaccatagtgtttcaaaaaaatgggtccaacaatgtagatggattaaaatcaatgagaataaaaatatggactctgtatcttttaaattaaataattcatttgaatttttgaattactgaaacatttgcaaattgaaaatgtatttaagaaaagacagcattagtgagagaaattaatatcatgagtcttgagctactgtcatcaccatccaaaagtattcaagtgcccctgtgctggggtctctgcaatatcatacaggcagggcttatttctacagcagcagctgaacagcagccagagagcagccctgactataattttgagttcacacaatcaggtgcagcatctacatgtcagcaacattgtcatgtgctctgaagtcctagtcagcttaattatgtagctgcacaagcaagccacaccttgccaatttaactgagaattaaagctggaattattttggagcagttccactaacgcaggcatagaaacacagctctagacctggctctggagcctcatctgcagggcagaccacatgcaagtagatgatatggcagacatgtataactggtacatgtctgccatatcatctgagatatgtacagtcaacaagagagaacagtcaagcctttcacaatggctcttcatttatctgactgctggatggaccagaattctccatacctctgtgcaatagcagctcagagctggaggcgtccccctagtataccagcacatgtctgctataccaatcagttttcttttattttttatattatttaaacattttttgtggccacatagtaggtatatctatttatggggtacatgagatgttttgatacaggcatgcaatatgaaataagcacatcatggagaatggggcatccatcccctcaagcatttatcccttgagttacaaagtatccaattaccttttttttttctgaaacagggtctcattctgttgcccaggctggagtgcaatggcatgatcttggctcattgcaatctctgcctcctgggttcaagcaatcctcccatctcagccctctgagtagctgagactacaggtgtgcaccaccatgtccagctaaattttgtttttgttttcatttctttgtagagatggggtttctccatgttacccaggctggtctcgaactccggatctcaagtgatccacctgccttggcctcccaatgtgctgggattataggcgtgaaccctcgtgcctggctgcattctttattttaaaataattaagttattattgactataatcaccctactgtgctaccaaatagtcttattcattctaatttttttttgtacccattaatcattccacctcccatccaacccttcactacccctctaagcttctggtaaccattcttctactctttatgtccctgagttcagttgatttgatttttagatcccacacataagtgagaatatacaatgtttgtctttctgtacctggcttatttcatttaacatagtgatctccagttccatccatgtcgttgcaaatgacttgatctccttcttttttgtggctgcatagtactccattgtgtatatgtaccacatttcctttatccattcgtctgttgatggacacgtagattgcttccaaatcttagctatagtatactctggtttctcttcagattgcataaatctttcaccttttaccaaatcttagctattgtaaacagtgctacaacaaacatgggagtgcagatatctctttgatacactgatttcctttcttttgaatagatacccaatagtgggattgctggatcatatggtagtgcaatttttagttttttgaggaacctccacacagttctccatggtggttgtactaatttacattcccacaaacagtgtacaagggtccccttttctctacttcctttccagcatttgttattgactgtcatttggatataagccattttaactggggtgagatgatatctcggtgtagttttgatttgaatttctctgatgatcaatgattttgagcaccttttcatatgcctgtttgctatctgtatgtcttcttttgagaaatgtctattcaaatcttttgcccattttttgaccagatggttttaaattagccatttcactctaattcctgatggttgaaattactattttaacgaagtaatttaattaaatattaaataaataagtgattaaatatgaatgcataaaaagacatttgtttatgtaaaaataaggttgaaagatttgataaaatgaaattaagagaaaaactattcaattacatgtggctgagctagcacttaaagagttagagaaaaatatggattaatatccagaaggactctatagtcagattgttccacaagcatcttttatattttttattgtatttatttactttttatgtttttgagacagagtctagctctgtcacccaggctggagtgcagtggcacaatctcagctaactacaacctcagcctcctgggttcaagcaattctcatgcctcagcctcctgagtagctgaggttacaggcatgcaccaccaaaccctgctaatttttgtatttttagtagagacagggttcacgttgttggccaggctggtctcaaactcctgacctccagtgatccaccagccactgcctcccaaagtgctgggattacagaagtgagccaccatgcctggcccctacaagcaattggcctgttaaaaaaaaaaaattctaaaactggaatttgttgatggtgcactgtgggtgtgatttagcaggaatgatgccactgaactctaaacagcagacccattcccaaaggaacaacctggaccctgtctcactagattacagaatttgtgaacatctatatatttgaagttaactagtgttcatgtttctgtttgtttgtttttgactcttcaactttttcaattaactaataagctggtactcagctatcatatagaaattctaccttaatgtgcaaacaaaccaaatacaacaaaaactaaatattttaccactaaaagttcaagacccaaactaagggacaatatcaaaaagaaaaaatcaagaactgtgattttgatgacaataaaggaggcacctcatggcggcaggtggtgatgggaaagcagacaccaggcagggaggactcacgggaacagcacgctcacatcagagcctctcacccgactgctaagcacccaggcgggtcctatggattcttgcaactgtgatagccacttgttgacatcaggcctcaggtgttcttgggggtgaaagcactgacaaaatctctggcataaaatgatggatttgctaaaaatcaaacagtttttcattttctatggtcattgaggaccttgtataaggctgaagatctaatttaaaaactggtatcctgaagttactgtatcaacattgatttcttagttttggggataagggttgtaattggatgggggagaggcatacagaagtatctggggtacagtgtcatgttgcgtgcagtctacttttgaatgatttgggggaaagtggtgtatgtgtatgtggagagagagaaagagagaaggagagacagacagagagatggagtaggtgggacaacttaacagttggtgaacttagatgggaggagacaccagtgtttccggtactgtttgtcagctcttctgagggttgggtttaaactttttccaaaagaatttcttttaatccaagcaactaataaataattaggcttgtgttaattttaacgtgtgttaaaatagccaaagcctctggttccattttttgccattttgatcatagttgttcataattcatacatacagaaaatatctgcatcatggcaccccatcaaatagccatgcaattcataagccttcaaattggatgcaaataaaccagctgtccatccactgattcatccagtcaatccataaacacttgtttacgacatcttatatgccaaagataccagtgtgactatgactgcacaattccttctctcctgggacaaacagtcatcagaaaaaaataggcattgaatatctaactgcagaggctcaatgggagtgtataggcaaaggggaccagtctagtctggagaagatcaacaaacacttgcttaagctaagaccgaaagatttccagtagcatatggtgaatgtgactcttactccaagaaataaaattaagcctgtctcaaggcccccacaccttctcacaggttagagaattgccaatctgctcttcttccctctagccctagaggctcagaatccaggtgttgtgtggcatctgggaggcagaagaatcagaggtgatcattgcccatttgaaaacagtggccggcttcctccgtgcacacttgagcccaaggtccatgcccaggttaagcttccttacccagtatcttgtacccttgggtgaaggactcaggctttcctttcggaggccctgctgcctcttccagatgctgtgagggagtagcatgctcgggggtgggagggggcactgaggacttgcatttctgaggacttgcatttctgaggacttgcatttctgacaagtctccaggagatgctgccgtctgggaatccacactttgagttttagtagagtatacttaaaagatgtggttgaaaagagcattaaagtttaaaaacccagaaagacaagattaaaatcatttagtcaagacatgacttcatgatcccaaatatctgggaggaaaattgcaatgagttagtcttctagaaataagaaatatgcaactttgaggagactatagaatttccttctcagtcggttactttctcttcatttatttcaataggttattggggaacaggtggtgtttggttacatggataagttctttagtggtgatttctgagattttgatgcacccatcacccaaacagtgtacactgtacccagtgtgtggtctttaatccctcacccccttttacacttcccccaaagtccattgtatcattcttatgcctttgtgtacttatagcttagttcccactgctaagtgagaatatgcgacgtttagttttctattcctgagttacttcacttagaataatggtctccaattccatccaggttgctgctaatgccattatttcattccttttttttttttttttttttaatggagttttgctcttgtcacccaggcttgagtgcaatggcgcaatctcggctcactgcaatctccgcctcccaggttcaagcgattcacctgcctcagcttcccgagtagctgagattacagatgcccgccaccacatctgactaatttttgtatttttagtagagatggggttttgccatgttggccaggctagtctcgaactcctgacctcaggtgatccgcccccctgggcctcgcaaagtgctgggattgcaggcgtgagcccccgtgcccagcctatttcattcctttttatggctgagtagcattccatggtatatataccacattgtctttatccactcattgattgatgggcatctgggctggttccagatttttgcaattgcgaatagtcctgttataaatatgagtgtgcaagtgtatttttcgtataatgacttattttcctctgggtagatacccagtagttactttccattcctataaactgcagtgtatatgaacatgatgagtgtcaaatgatgaatgcctcaaaattactgtgtgctcccttcctggaatgacagcaaggcctactgcccaagactaaggaaagatattcagttaaagatactcttgtttgtgtgggtttttttgttttggttgcataagtagaattctccaccttaggaatatctagcatttctttttttattttccctactaaccatccagtatatctcctagatttgcctggcctctgccatcaacatattttctggagaaagcaaattaattttcagttaatattaacctgaagaaaaaataataaagcaaaggattaatatgtaaccatataatatgcagcatatatgtcaaaacacattttttctttttttgagacagagtctcactctgtcaccctggctggagtgcagtggcatgatctcagctcactgcaacctccacctcctgggttcaagccattctcctgcctcagcctctggagtagctggaattacaggagcccaccaccacacccagctgatttttatattttttagttgagatggggtttcatcaggttggccaggttggtctcaaactcctgacctcaagtgacctgcctgcctcggcctcccaaagtgctgggatgacaggcatgagccactgtgcccagccaaaacacattttaagtctattatttgaaactatttctttatttgttcctctgctggcagagaaaagttttaaaaatttgatgtccattggagctggaatgtgcataggtgtgagggctggggggtaagtgtgtcacagtgactagttaggtaggataaggtatgtctaactcacagctgaattttttgttttggttttggttttataagaaagaacattctgttgttcaaaatatttgagaataaaaaaagaaagaacattctgatactagcattaatgagttagtttgttctctttaaagatgtgtaatgggtattgatcctcttcccagtcttaaacattatttaagtcaaagaaaaccttaatatcacctatggaatatattgcatattaatctacacaaatatatataaggttggtgcaaaagttattgtggcttttgccattgaaagtaatggcaaaaaaattgtccaagtaatggcactaaccaaatacattgtgttctacataaaaggtacatatacatgtatacattatacatatatacacatacacatatatgaacattatgtagaacctaagaatttgccagtatttgaccactttttaactatgacagcagcaatttcttatgattcaattagatattatcctgaaaaaaaggatagctttgtcgtttccatatataaattattaggttggtacaaaggtaattaaaagtaatggcaaaaacggccattactttaacacttaaaattcccaagtacaatacaaatgatgtattcttatccgacatttctcccttatgcaacatgttctcagttttctactttattgctattcatatattgatatatttctattgatatattgctacaaggtcacctggctcctaacagatagtgtccaatactcgaagaacagagaaatgcatttgcttttaccctgccggttgggatttattcagctgtttctaaacaaaaccctttctctttccctcttcctagggttgtgtctgtaaagacaaaggccagtgcttctgtgacggggccaaaggggagaaggtaaaaacaaaccctaatactgcttgtttacactgtaaagctctagaaggtaaaactcaaccttcttctttcatcggtagcagaaagatccgcagtatgttgttccatttcccaaatccaatgttaaagtaattgtatataaacattaacctaaaaaaaaaaaaagaaaaaagtcatctaggaagcttcagataccttgtatatacaatggcaattaaattacaactctctcggtctgtaaagaataagtagcaaatgagaaaaagaaaaagaaagtttatgacaagtctccatatgtatacactatttacaatgttgctaaacacaagagaagaactgaaaacgatttgattcattcactttgacagaaaataaacattgaaattcacagatttttgtcctgcagcattggttcaagttcgccccctggtggagaaatcccacagcagcacactggttgaggcaaaacttagcagagggaagtagctccattgcagaattcaagaaaaaaaggaatgccgtgaaatctcattaattcgctccattaacttgcaatttgtgataattaagatagaggcagaactaaagtttttttctttgtttaccaaaccctttcctcagagacactaattaattgtttaacaacattgaaggatgactattttaaaatattttaagaacatatttaagctctttatctaaactaatttctatataatgtgtatgctaattataataattatacttattttaaattatttcataattcacatgtagttggatttaggttttttcttgaatctgtgaatgtattctaattcaggttcccattgagaagcactttctctgtgattctccttgcattcaagaagcatttattgagtttctattatttgcaagatgctactgtagggtgtataaaagtaactgagtagcgagaggggtctagcacattcttttatttctcttcttgttgagtgtgtgtgcacacacacaatgtaaaatagctgacttgttcttttttgttttaatttgccaattgtgtaactaaattgacccaattaaccaaatcagccggtggcctttactgttgaagagtacagtcggccctccttatccacggtttctgaatcctcagaatcaaccaatggcatactgaaaatacttcggggagggggggatataataaaaaataatacaacaattaaagataatacaaataaaaaaatgcagtataacaaccatttgcaaagcatttgcattgtattaggtattataagtcacctagagatttaaggtatatggaaggatgttctaggttatatgcaaatacgatgccattttgtataagggacttaagaatccacaggttttcgtgtggggggaaggtcctggaaccaatcccccaccgacactgagggacaaacgtaattccaagatacaaatccatggaaaaattatttgttggtagaactgtgtcaagccttgggcttaaagtactttcactcacttttactaggtactttcccctaatattatctgactccttctagaacattactgagctcacacctttttggttatgccacccttgctacctttcctgcatctcctacacaaataacagattaaattactaactcctgtgtattaaagaaagggctcagactcataacctgcctggtggcgttctttcaagctacatagtaattatgcacactccccaggcaccttcttgcacctgaccctcactgtctctccatcccacaacaaacactccactaaccttgatgcttctacctgggctttccctttcattttttattccgtctcccttaagctctgctctacatagccctaccatttgggagaaagtcaagtttctacaagaccaagagccaccactttcaagcctatagacaaatactaacaactggtagctttctggttgcctatgtagtcactcctgagtgctaattatgatttttttaatccaaggaaaaaacatgcaaagagtcaccatgaagtcataaacaagagaacataatggttattggtgtgtttattgtgggatagttgctgctctgtgtgtttctcacctcgttttggttttaacagggggagaagggctttcctggaccccccggttctcctggccagaaaggattcacaggtcctgaaggcttgcctggaccgcagggacccaaggtatgtcatcctgcaagcttggaaaatccccaacccacctaaccctcttcctgcctaccccctggctgctgcaaacctggagagaattccacatcttagccaactgctaggtgcatggtgaactcctggtttccggtattagtgggccacatagaaccgcaacctgctccaagactattgcaaatgatcatcattagcttcaagtctgtggctccagttcatctccctccctaacctacagtgtctacatctgcatctgttcctacctctattcctcctacagtgaaaactcagagctctttttgcttctattcaagacctgtccaaccacctgtgccccatctttgggattccttgttccacgaggtgcctcccctctctccggacattccaacttttcttttgttattggcttttctctttcagttcttaaacatgcaaatattttccatgataatacaaaacttcctctccatcttttaggtcttgtgaccaaaggattgctatcttctccctgactttcctttctctgtcaaacttcttaaaagaatagtcaaacatgctgcctgtagttcatctactattcagtccttagcaataatttgccttctaccacctctcctctgaaaacactccagcaaagatcaccaatgaccttcaagtggccaatgccaatacatacttttgtgtcttaatctgacctgaacccctctgcttagtttcaaattgtgtggatcgctctcctctccttgaaacacttgtctgtctttctttctgtatttctcctgtctctctatccttcccttcctttgtgggtttctcttttccttctggtcccttaaacatcccgagtctatgacccttcacactcatcacacattcttatcctaaagtctgtgatacagcaaagggctttgtttaaataaataccatagaggatttactaaataactgaataaccactggatttgctgagtactctttcctgctgtggacattagctagacttaagcctggcttctcacgcacccacacattcattcccctgactactgacctccagcaagctataaaccaactaataagctatgaaaaatgattataattgatctatacaggtcttttacaaatttcataatatattagaatatgtattagaggccagacacagtggctcatgcctgtaatcccattgctctgggaggctgaggcaggaggatcacttgagcccacgagtttgaggtcaacctgggcaacataaggagacccagtttctaccaaaaatacaaaaattagccaggtgtggtggcatatgcctgtggtctcagctactcaggaggctgaggtaggaggattgcttgagccctggaggcggaggctgcagtgagccatgatcatgctactgcactccagcctgggtaatagagcgagactccattaaaaaaatatatacgtgtgtgtatatatatatatgtattaaaataatgtatgaaatatgtaaatgataatcaaagccaaagccaacctactgcatatgtactctgtgccaggcattgggccatctatttctccctggatctcatttactcctcacatcaatcccacaaatcatgactgtggtgatttacaatgtagttcccatcattacctccactacatggatgagaaaacggacacagagcacttgagtaatttttcctgggtcacgcagctcacaggaagcaaaatcagagttcaaacctggtttgacactgtgtgtgggattttcctcaaaccaaacaattctccaactctctggatgccaactgggtacccctcaattcagttatgacattaaatacctggggttagtgcagaccccatagggtaagggctcagtcccacaagactgtccctgtttcaggactagtcataagtagtgggtcctcagttacccataatgccgtccaacttggctacaaataaatcaggggttcccatgacctcctcctctgctttgataatttgctaaagagtctcatagaactcatgggaacatttatcagtttattataagggatatgaatgagagatgaagagatacacaggagaaggtccagaagggtcccaagtgcaggagcttctgtcgccatggagttaaggtgcattaccgtcctggaacgtgaacgttcacccacccagaagctctctgaacaccatgcttcagggattcttatggaggtgtcatcatgtgggcaggatcaattataaactcaatctccagctccgctttcctcactgaagggtgcagctggagctcaaagtttcaagcttctaatcaagacttggtctttctgatgaccagcccccatctgggagcccaccaagagttgcctccttagaacaaaagacacttctatcacccaggatattccaagtgaggtcaaacaccaaatattagaacaaaagatggtctttactcccctatcactcagaatattagaagggttttaggagctctgtgtcaggaaccaaaggcacagaacaaatatgtgtttcttatgtcacatatatgatgccagaatcaaactcttgaaaccacacccacagcttacatgtaaaatgcaaaatcttgctgttttccagtaatcctgccatttccctgtctaccatatccatgtatgtgttctttttgtccatttctccttcttccgatcctaattttgaaaaagtcatccagattctgggcagaaactgaacactgacttcctctaaggcatggacccaggttttcttccatttctattggtagaacgagtttgccacttcaaccctggacttagatcagcctaatgccaattccgtttttaaaaaaattgttatctgtagcctactctgtttaattctcttcagcatttctttagagatgctgaaattcattaaaatagtcacaaacacatggcacttagtatgggttacatgagtgcaggcattccagaagattaatccagaaaacctgagtaccatgttgtcatagattgatattttaaagcatgtaaggcttacagatatgtatgaatagctacaaaagataatacaatcaaaggcagacaattagagaatattaaaacctgaccaaaaagatgttttagatttacaagattcctatcttaattttaaatgttttctgcatgaaaaaagtttacaatgagaaagtaaaacctgcaagtaaaaccttctgctttcggcatcacgtgaatagaattctgtgggaaggggaatggccttgaacacagccatgcaccccggaattccgccatagatgggagagactgactttggccttgacagtgcaatctcagaggattctgtaacaacccttttctcaaataataacaataaaattaaaaatcaaaacatactgaaactctctggaatgatgaaaatggcttttggacaatgaaactttcacaccacgtggcctagctgaaacagtcaccatttaagcttattctccaagaaataggacgtcgaaactgaatgcattacatgcccaaagcaagtttatctctggttcaggcagtccttacttggctatatatttccttgtgcatgtcaggcacattttgttaatagagtgtttcttgtgcacagaaatactggctggcattctcatccacaactgtagttgtgtcattcatttttatcagacctcagcagctgtgaggctaattaggacttttgcacagactttaatgtgcacaagaatcactaaagaatcatgttaaacatgcagattctcggtcaatagtctgggaggtgaggcagatctaagattctacatttctgataagcttccaggtaatgctaatgctgcaggccccaaaccccactttgagtagcaagggtttgaatgaatttttgtcttttctgataaacaattatcaagttccaatgaaataagcaagcaattgaatcttattaacaatgaaataatcagaagggcaaaacagcttggcatgtgactgagactgggtttgatgtatgggtttcttagtgccaaataattttcagagtgtttactttttcttttttcacttgaatctagggctttccaggacttccaggactcacgggttccaaaggtgtaagggttagtagtccaaccagtccaccctgatcgttaaaagatcagcttttcacagtaagagttatacaaatgtcagaaaggagtacactgtgtatggttccatagatgaagttcaagaacaggtaatactaatctgtaatggtagatgtcaaaggagtggttaccacattaggggcaagtgttaaactgaccaagaaaggccatgaaggaacctctggagtgataaagatgctctgtgtctgatgagatgatggtatataaaactgcacataggtcaacctttgttaagctgttcaattaagctgttctcaaaagattggagcacttcattgcatgcaaattgtaccttaggaatcgatccaaaaaagccaaaaataatcttaatgatatctttttaagagttacataaatgtgagatttacaaaagtttgttaaacctttagtatttgttttcccaatcgtttcgagctattcccagttatagtggaggaaaaagattatcgcaatggtaaataaatttatgtttatagattgaacatttttaaagttttttttttttgccaccccctcctttttcctatgtcttcagggaataagtggattgccaggattttctggttctcctggacttccagtaagtaatgggaaaaatccgtagctagaaaatttaaaagtaagctcattttaataaagatgttaaaacagtcgtgcaagaaaatgtgttctgatgcatttgttacatgaagaaaatagcaccttaggatggtatattatactagtgtgtggatttatatgacatatgagtcaaaatgtacttcctgaaatacaagcaggacaggataggatagggtaggataattagtaaattatatggtaagtcggccctccatatccagtgattccacatccatggattcaaccaaccaactgtagatcaaaaatatttaaaaaaaaacaataaaaattgtacaaacctaaaaaccattacactataacaactatttacatagaattcacattgtattaggtattataagtaatctagaaatgactttaagcatacaggaggatatgtataagtcatgtgcaaatacggtaccattctatataagagacttgagtatctatggattttggtattcataggggtcctggaactaacccccacaggtgctgaaggaaactatatgttacaagctgatagaataggataggatagggtagaatgaaatgattgtatttaatagcacagaataataaaatagtttcatctgtgcacactttcctcttctttttcccttcctttctccccagcttaaaacagcatgttaaaggactcttttattttatggataaaaggcgtttgctttatttgaaatatccacatctcatttgataagtcttcatatcagtcagcctgtttagtttgttgctactgaaattatatgtaaaaccacaatgtacatttactacttaaccatttaaacaatcatttatatttcaagagctatttaaatcagtgcatcttttcccttgggttcagtgctgtttcttgggatgaccctcctcattgagacttgttcttcttccagggcaccccaggcaataccgggccttacggacttgtcggtgtaccaggatgcagtggttctaaggtaagtacttttcacacagaagatgattaataaatgctttgctgaatgattaaatcaaggtgaaatggcaatgaaaggcagacaggcttcccttgaaaacattcctttaggccagaaccaacagcataatttggaggcaggaaacttcccattttctttcttcgcattccttgctttctaattgtcttttaaggaaagttctcccacagaaagaaaacttggagctcaactggttgttttcatctgaggctgtgtgtataaatcagaaaccaaagctttgagtgcagaattagttttggggaaggaatgactgagcttttcactgttcactcacctccttttgttttcgaactgagctctccttttctccagaatggtggccatgaatgaactaattactcaagtttgaaggaaacagcaattaaaaagttcttggcgcaattagactttgccatttatgcacaatttgagaaacagtattctaatcctgtttttaattaagataatggttttttggtcttcagcctcatgacccagtagccataaggaattcgggttactttgtctagatttaccattgcaaggttggaagcgagaaacaggaaaaatatctgaataggctcttctagaacaactaagaataataagaaactttgtatgtcttttagggtgagcaggggtttccaggactcccagggacactgggctacccagggatcccggtaggtttgcatgcctaattccccaacaaagacataaagtataaataacagtggtctactccatatggccatatacacaaatccgtcatgactttagggaagtctggggtagccatagtagacattcaactaatagttagggaatggatgaatacatgcattatgagtgtaggattagaggttgaggctttgttttacttttgagacatccaagtggagatgcatgagaggtacttggattcactcagagaagaggttccagctggtggtgactcaaggagtcagagtgaggagaaaaggggcttagaactgagacttagctccagcagtgatgttgagatcaaggagaatgatcctgtaaaggaggagcagccctggtgggagaaagaaaaccagcagaggtgtattatggaggcccaggaaacacctattgtagtagaagggagtggcagacagctgctggatgctgctgcaaagtccagtcagaggagtactgacatgttggcattggttttagcaacatcaatatcatgtctgaccttagcaagggacaattccacggcaggatggagcagggggcagatttggaactgaggaatgggtgggaaatgaacaaaatgggaagttcacaggtgagacgaaggagagacaggacaatatggtgggaagtaaaagattaagggaagactttgctttgtaaggccgtgggaggtgtacagtggggagaggatacacaatagcagagagggcagagcagaccgagtaggagtgtgtgcgtttgatattcctctagttgttcataggttgcttttttcctagggtgctgctggtttgaaaggacaaaaggtaagtcattggtggaatgctgtcactgaaaatctctaactgtacatatgaaaaggacgtctattaaataatgagacttaagtcattacaaataagatttcataatccagaccttaatcattcagaaacaataataatcgggacatgatatttattcctattaaatagctccttctggctcttgtcataaagagtcttaaggatacaggttttgtatcactgttgaaagaaatagggtcttggagaagaaaactgacctcatgctcagggccccacattctagggcagggattgtcactatttttggtatcttgggaaatgttttattacccctgcgtctttcttctttccactgtaaattttttatttttttgagatggagtcttgctctgttgcccaggctggagtacagtggcacgatctcagctcactgcaacctccacctcctgggctcaagcgtttcttctgtctcagtctcccaagtaactgggattacaagtgcatgccaccacgcccagctaattcttgtatttttagtagaaatggggttttgccatgttggccaggctggtcttgaactcctgacctcgggtgatctgcccgttttgatctcccaaagtgctgggattacaggcatgtgccactgtactgggcccactgtaaatttttgattttagaaaatatgaaaatgctttgaattcttcataatggaataattacaaaatcataaatcatttctctgagtacataacttgaaaagcatttttatctttgaagaaatataactttgaataagcacttgaaggggttttgaaaatataacattgatgatgtttgatgaacttcttcattttcaagggtgctcctgctaaagaagaagatatagaacttgatgcaaaaggcgaccccgggttgccaggggctccaggaccccaggtacagcacttcagagaaggtccctattattctcagtttttcactctctctctctcttttcgcctctctttacttcgtctctcttttcccccataagtccctctcactctcttaagaagattttaaatagaaattcctatttattctatttacatgtctggcctcatttcattctaaagctttcaccctattctggaaaactacatgatgctgatatgcaaagatgatttgagtatgtttttcgtcctcttcttcactctcagtcaccaagcttgcctgaatctaacaggaatagttatgtaccacttaatttgtatttgttgaaaataagggtagctttgtatcacacattgagtatcatttaaatctgtaattttaaataacagccctattttaaaatttgcataatgataaataaaaggtttttatttaaatgcaactctctccagttgaagttgagataataaagaaaagaaaggtttttgtttaaatgcaactctctccagttgaagtgtttgcttttctgatttatatgtacgtagcctgagtatgatccaaaagggatacaaagagacacaactgcctttggggctgtgtgtgctttcctttgtgattcaaaaagaccctttcatagacctaaaccacaagtgctaactttcaggttataattatatataaccaaaattagctagtatatatatatatatatatttttttttttttttttttttttgagaaggagtctggctctgtcgcccaggctggagtgcagtggtgcaatcttgggtcactgcaaccaccacctcccggattcaagcaattctcctgcctcagcctcctgagtagctgggactacacgcatgggccaccatgccctgctaatttttgtatttttagtagagatggggtttcaccatgttggccaggctggtctcgagctcccgacctcaggtgatccaccaacttcagcctcccaaagtgctgggattacaggcataagccaacacgcccagccaattaaccagaattattttaacttagttcagaattatatgtaaaaattcctgggtagagatgggatatttgcctaagtgagtttgaggtgaggctgttgaaatcctgtatggtgcgctatcctaactgaggatgtgaagttagattaggagctgcaaaaaatgcagaatgatgcaattaggagccattataggcttctgaaaagagatgcaagatatgatggctctcgcttttttgcttagaaaacatttaagagtccagatgctgaaggcaggggatccaggaagaagagataatagtaatctgagatattgatacattctttaaatgtgtattgattatcgtatatgtattagtcattgtgatgatgctgaagatataatgatggtacatttgattacacaagaaatattttttacctgccaattatgtgctaggggctatttctaggctctaggaatacagtagggcataaatcagccaaaatatagatttaaggctgggcacagtgctcacacctgtaatcccagcactttgggaggccaaggcaggaggatcacttgaggtcaggagtttgagaccagcctggccaacacgctgaaactccatctctactaaagacacaaaaattagccaggtgtggtggcgtgcgcctgtagttccagctacttgggaggctgaggcaggagaatcacttgaacccgggaggcagaggctgcagtgagcagagatcgtaccactgcactccagcctgaggacagaatgagactctgtctcaaaaaaataggtagatagataaaagatgatagatagatagatagatagatagatagatagatagatagatagatatttaaaaattgtatgaaccaggcatggtggcatgtgcctgtagtcccagctacttgggaaagctgagacaggaaggtctcttgagcctagttataggccagcctgggcaacacagcaagacccagtctcttaaaatatatatatatattgccttcatagagcttacattctcatgggggaaacaaaagcgtgtaaatgagtaactctatggtgtgtgagtaataaatgctaaaagtaaaaataatgcacgaaagcaggataggaagtgtctgggttggaaggtgggttacaactttggataagcaggaaggctttatggaaaggatgacaattgcataaagacaagaaaaggaaaagggagtgagttatactgatacctgggaaaaggggattctaggcagagggagagcaggtggcaggccctaacgtaggagcatgcttggccaaaatgagagagaaaggaaaagggagaagaaaagaggtgggaagaaagagaaaagcaaaattttgaaacgtctgaagtaaagcaactactttggtcattttagaaatgttatcgtccagttggtcctgccagcctgttacacatggcaacactttttgatgtttgttatcattagctgcagccactgaaaggggaggtgttatgctcttctgattttattaaaatattttaatgcatttaattaatggacattgttattaagtgagaagtaaatttaaacttactcttattcttctctcaatttcaagggtttgccaggccctccaggttttcctgggcctgttggcccacctggtcctccgggattctttgtgagtatcaagtcatccttgctacagactctgtcaactaatagattcattatttattattaaaaagttattaaaagaatttttctggttggatgcatttcctgctgtgattttcatttgtggatttttctagggctttccaggagccatgggacctagaggacctaaggtagactacagttcatatgatgtaacagctagcacaccctactcaatctcaaagccaaacctggtctgcttcttcatgtgggtcactgttaggcacctctctggaactcacaaggatccctagcagggaagagcatggctagctgctctcacctcttttctccttgcatttcagtaccttgatccctgatacaaagaatcttaattcaatttataagaagctacttatcacgaaaaaaggcaaggattcttaatccacaggttttccatttctgatcatctcacacagcacattatcctctgagtttttgtagtgtgctgcttcacaaagccaacctggtcttatgctagtaagtaaaagatgactatttgtgtgctcattacacagggtcttgcatgcatttctgttaagaccagcccaggcgcattggttcacacctgtaagcccagcactttgggaggccaaggtgggtggatcacttgaggtcaggagttcgaggccagcctggccaatgtgatgaaatcccatctctactaaaaatacaaaaattagccgggcatggtggtgcatgcctgtaatcccagctactcagggggctgaggcaggaaaatcgcttgaacctgggagttggagtttgcagtgagccaagatagcaccactgcactccagcctgggtgacagaaagaggcaccatctcaaaaaaaaaaaaaaaaaaaaaaacagaagtgcaattgttagtttaactataaaaatgttgagtgaggctgagccccaacaggaaattggtcctaaacacagtatctcctactatcaggtagccttttattttattctttctttctttttttttttttttttttgagatggagtctcactctgttgcccaggctggagtgtagtggtgcgatctcggctcactgcaacctccatctcccgggttcaagcaattctcctgcctcagcctcccgactaagtggaattacaggtgtgcatcaccactcccagctaatgcttttgtatttttggtagagacagggtcttaccatgttggccaggctggtctcaaactcccgacctcaggtgatccgcccgcctcagcctcccaaagtgctggaattacaggcatgagccactatgcccggcttgggtagccttttatatgaggtattttccaagatactttcatatttattatctcattgatacacacaaatgcacacacacacacacacacacacacacacacacactcatgcatgcacgcaccctgagagatggataggttctggttaagtgaattttccaatagacagtacatggcagagctgaggtttaaagtgttttgatctagctttggtctaacaaggggaagatctgcatactcagtggtgaaaaagcaagcagatatgagttgaaatgatggatcagccatcattagtgaagaaactattcgcattagactcatgtcactaaattactagtgaagtcggtagctggaattctattcttagattctctattaagtattgaatttcagaatcctgaaatgcagctacccattcttatttttaaaacaagaaaacaagagcatcaggaagttaagtagccggccagtgggattaaaactagctaatgcagagccagaaaaatatgctctgagctgggctcctttccctcccccacaccactgcatgtcagcatttgccatgttaggtaaatcccttaagctttctgcaccttaagagctcctcctttaaaagaaacatatcaatgctcttctctaagaaatagctaaaatatgtatcattctaaaatgaaagttaaaatataaatgctcccttacaaatattggaactttgatgggtttagactatttattcatatttatttttagaaaataatttggttttgtgttttcttacagggtcacatgggtgaaagagtgataggacataaaggagagcgggtaatttaaatactatgttttattagcaggcgagatattttatgtcccagagcatatcagcctataccgtttacttacgggccaagctgaaattgatgggccttcatttgttctatcttcccgtataagcactaaaggggaaaagtagacctttcaaacgtagtaacattgaaatgttgatgctgttgtttattttctcactcctgagtgtttttgtctttagggtgtgaaagggttaacaggacccccgggaccaccaggaacagttattgtgaccctaactggcccagataacagaacggtaactctgcgattttatgattagtgttgtgccttcccgtgtctaggatgaagtccttgtgaccctgcacctcttttacaagctcttgttatctaagtccagctcagcccagctccctcagccagccagaacctccaggattgattccttcccgtcctttactcataaatcctggaaatattacatggggaagatctgaggctccagcttgggcaacagagtgagacttcatttaaaaaaaaaaacaacaaaaaaaagatacttaaaaaaaagcttgcaggtagtttcagtgagttcgcaggtataaaatttgaaatgtgagaaatggaaggtgtattgggttgtgttaacacgaggcacattcatagtttgtaaacccagtttattgaacagatagaggatttgtcccactgttgaatcagtgaaatctcatttcatccatttgtaacaatgttgaactgtttctttggcaggacctcaagggggaaaagggagacaagggagcaatgggcgagcctggacctcctggaccctcagtaggttatttaaagttatattgtccccataacacataaagtagagccttagtatttactttgatgtgtgttttgtcttaagttgtttttttttttaaagaaagtaaaggaataaaagaatggctactccacaggcagagcagctattgcttttaagtcttaatattggctaaaatacaataacatttgaccgcagagatcatgaatacactagagttattttacggccactcctagctgaaatccttgcactgctgtacatgcacccaatgccacccatcctatgacttatcttcagcatcagcttttttagcatctgttttttaattactattcatcaataagatttctctcttagatggctcagcactgaaacatgtttttaaatggcagaataaccaaaagggacaaattaataaaaatcaatgtaagtaaaaaaatcagtaattcataaaatttgacatggctctaattaatacagggactgcctggagaatcatatggatctgaaaagggtgctcctggagaccctggcctgcaggtaaatttggaaattcggtgtcatgtgcagttttgattagtcaggacttgggactctttaggttacaggaacaagatgcccaactcaaactagctcaagctaaaaatttctgttctttaagatttgggaggcaggatttacttactcaagtatctaagacgttcaaggctaaaacagggttcaaggacttcagagcctgaaaacataagggcaggactccctctccatctcacttctgcttctctctgcatatcagcctcattctctcctctggcagatgatcttccatgtcaggggagatggggagaaagagctaccctgcagcagacaacttcaggctaatggcattagaggagaaagagagcatatttctccctgtgtccatttataaaatcccagggaattcatctcattggcccagcttggtcatatctggtctcactctggataaaaggcagtgaccaagagaaaagggtactataattggccaggccagtggggcagtgggctactgagactgacagtgccatcagaaccacccagagggagggaagagcagcccccacaaaggaaatagggcaatctgtgaccagaagtgggcagctggaaaaacggaagcagcaggggcccccactaccccacccagatccattttggaaagatttaaatccatatattgtgttaaatctctaaaagttatacatttggaaaagtaaaatctacaaaacttatacataagcaaagaatgtattttttggcctgagaaaaaatattcaatgaacatgatttttaaattttatcaggaagggcaaataccataaaagtcaatccaaactgccggttgagataccacactatatcttttatacatatatttaaatataggcagacctggggtccaaggaattaccaatatttcaaataaataaataaatggactgtaaacaccttcctttttctaggcttccttatttacttctctgcccagtgtgtgtgtgttttttttttcccttccaagtttagaatgaacagcatcagctctaatttaagtttggctgttaatgtccttccttccttctctgactttctccagtttcccattctgactggcttctgctttccctggaaagagagggccattgtgtattctgtggttaatagtttttccttctaacacctgggtgaagatctttactcaggcttttcatgcctgaggtcaagaggagatgatcatatcacttaagatttccgtatttgtaaagttagccatatttattacatttcatgtttttgatttgtttttgctgtagggaaaacccggaaaagatggtgttcctggcttccctggaagtgaggtatagagttgatttggcctatggaggtagtaaaaatgtcagtcctactagctgaagaaggattttttaaaatcactaaatagttataaacaaacaaaaagcttacagcttttaaaaactgcatttgggaatcatagttttacatccccactgtgaagagagatcatctgagcacattcttttgtttcagaggagttcaaattgcacctgctcccccagaagaagttggctcctgtgtcttctgacccatttctttttgttcttttctttagggagtcaagggcaacaggggtttccctgggttaatgggtgaagatggcattaaggtaatcctctccctaatagcctattttaataggttgggttttgcctgtgcttttacttttacctccaaccctggacctaagtacaagggattacaataacagacttcattcaaataccctactaggtctgttaagaagaaaagagagatgtggcaactttacttaaacatttgaagggtgttcttgaggaaaaggtattaaacttgtactgtgtacttgaagctgtctgacttaggaccagtgagagtgcagcttcccatgaggaagaggttgaaaaaatcctacaattgtaggaagtttgtggttatttgagatcaagcataggctagagttcatgagtcttaatctgagtcatgatacattgaaaggtcatgatcaattagttgtgaactgtattctgcccttctgacaatatgttacaaatattttcaaatcatgtgtagtcatgtgttgcttcaagatagggttatgtcctgagaaatgcatcattaggtgattctgtcattgtgtgaacatcatagagtgtactcacacaaacctagatggcagagactgttgctcctggactacaaacctgcacagcatgttactgtactgaataatgtaggcaattgtaacacaaaggtgggtatttgtgtatctaaacatagaaaatatgtagtaaaaatgtgatattataattttatgagaccactatcatatacacagtccatcactgacccaaacattgtcatgtggcacatggctatatatgtaggtatatgtgcagagtcaagatttaccctttaatagtatcacttccagtagaattctgaaatgacttcttgaaggaaagggggttggttacagctgggacacttggaaatgcatacaccccacagactgatattcctgtgcctctgacctgggtgagaacacaggaacatgcaatgaacatgaacaagcattgcagatggtgttgtgaaagaaacctggagaaccaccagggcaataactacttctgtacaaccttgtagatgggattccttacccagatacgcgctctccaggaaaataatttaaagtcagtgtctctttaactttaatttggtttgtacatgacatctacatatcaatatattgttcattttaactgtacatcttgctttttatatgtaaatactttgggtgaccatattcacaatttgtaaatgtctttcactgtagggacagaaaggggacattggccctccaggatttcgtggtccagtaagtgtgattaaagacaatatcaatgctatgtttgatcaagttctttaaagtagcaaggaaattttgaatcagtgtctctcattaactgtgtgagagagattataacatttaccttgttgtcaaaccagggcagaaaatagctggtcactatgtgtccctttgaccacgggtaaatatttctatttggtccctggaaggcactagtgatgcccatgatgggctatggaagagaagaaaagctttgtctaagcagcccaggcccaaggtgatcctgccccttcagggtagaggacagtgagacaacaagggatgaagaagtcaacttctcctccctccacctgggcccgggttatgacaacgtgtttaatacatggtcagcaaaaagcaatcattccggcccaagctctgtgtagcaggcagtgctccccttcccagtggacatgtatttgatgtcagctcctaactgcagagcagccacattttatattctgtgactctgcagctgacgaaaaggagaaaggggacccggactctgagtgctggtgtccattcatctcctacctcaaaaaacagtggttctcacattcagtgcgccaagcaaggctgtcgtgaatggtcatgcaggttaaacaaaacggcacatggtggcaaaagggtcatgaggggaaggggtgtcctgttaaaaatgcagttctcagacccccatgctcagtaatgtaactcaggaattggagtggggcctggaaatctgcatctttacactggatgcatagagcccctgtcttagtctgttctttgctgctacaatagaatacctgagactgagtaatttgtaaagaacagaaatttattttcacagttctagaggctgggaagtccaaaatcaagatgctgacccttggtctggtgagggcttttttggctgcatcctcacatggcagaaagcagaagggcaagctgacctgaggctgctcaaagcctcttttaatagggccttaatcccattaatgagagagaaacactcatggcctaatcacctcctacagaccctacctcttacttctatcacattgataacacctgaattttggagggagcacattcaaactatagcagttcctaaatactttagtggagttgccaggaagattaaataagtattttgtgaaatcacttagcactgtgcccaacacttggtaggtgcacgcatatcattacagatttcatggtggacattattatgttatattattaatataatacttttgtgattttatatatattgcttaaccacaagactcttgttaaataagtcaacaaagtaattgatccatctagcatatgaaaaagcaaagaggttttttttttttcaaacctttgatatttccaccttttttccttcaagataaatatactgaatgctaaatgaaatctaccttttcattacatttcagaggaattcttagcactcttcactgtatattttcttatattcaattccatataattctgtttgcagcttctactaacctcaaaagaagttccacttaggaaggaaatggttaagaacaccagcagtaggtccactgagcatgtcagaaacaatattcctcgattcttgcaggtcaaggattccctggaatttaaagaaacaataaatacagtattttttgatgtgtgggttccatacacttccaaaatggaaataagttcagtccaccaggaccagcaattttgaaaagtgaagtagaatagaataaaaagtatcagggttgatcatatgttgtaataataagtcattattttgtgaaactttaatttttctatacatatacacacatacataggtatgtatgaatgtgtacatataaatgtgggtgtgtaaactgagtcacatcataaaatgtatttctaattgaaagcccataaaatatctgatactgtgataccacaaaggtctacttatttaaatttttccacctacatttacatgactatcatatacctgctaacatgtaaacctatgaattcaggaaaataaggaagccatctttgggccaaaatgaagaaactgaagtaatgatgtttggtgagctgtccataaatagctatcctttctctgtatttgtttctttctcctctaagacagaatattatgacacataccaggaaaagggagatgaaggcactccaggcccaccagggcccagaggagctcgtggcccacaaggtaagaataaatttcttcctaaagcatttgctgaacatatttctggctttctttcaaggtaataaatagcatgtgcttatggaattgacatgggtgaggaaagggaacagagatctcttcattttcataaaggtgttattttttgatgtctcctgctcttcatatttttatttcataggttgtataccaggaaggtaattaaattatctttatgtagcaaaacataaagttcaaatctgtcatggaaacatttgctggagggcaggaggagggagtgcaaggcattggcaatctcaatgggattacgaagggaaaaatggagaccgcgaacaaactcacacagagatgtgcaagggggaactgaaaccctggtttcctgatgcttgaagcaatgatctgtccttgatgccgtgaattattgtcacatgtacttatgctgtatcactttggagaaatccaaaagttctgggccaatccctctcatctctggctacatattgaaaaccctgggaacttctataatggcctcgtcaaggtcccaccctgtgattctgatttcattgtctggaggagggctctggacactagaagattgtaaaaactccctggactagtccaatgtgcagccaggattgggagccactgatctagacaaattattgctatgaagaagatttcaaaggaaattctacttaaaagaataaaatttcccagtgtatttaaataaaaggacagatgaatacagacattgatatagattttcttaaaaatctggtacacttactgtaaatcactcacatgtatatataaaggaattataacccccagaatattacagatggaagcaatctaagatggaacaccaagacaaactgctatcctggatgttccagcactgtttgattttctggtgtctacacttccagcaaagtgctaaacacagagcaggctcttagtaaatctaggctgaattatgtgaaaatgataaggcagcatgatttacttttgagtgttagacttccaagattagttttctcttgtctaaataagtgaaaatttctgatatttgtctaggtgagagtaggaaaaaagtatgaaaactctgtattattaactatcagtatattgtcacccaagattccaaaagtggatgggacagcatttatatctttctaagcaattaattaatgttatatattcccaggtcccagtggtccccccggagttcctggaagtcctggtatgtccatgtttcttggggtacaaatagaaatgctattacaaaggaaaataagctgtcctctattaagtttacattatttacataagacaaatgtttcattaactgatctagaagtgtttccaggctgggttcaatggctcacgcctgtaatcccagcattttgggagaccacggcaggtggatcacctgaggtcaggagttcgagaccagcctggcaaacatggcaaaaccccgtctctactaaaaatacaaaaaaattagctgggcgtggtggcgtacgcctgtaattccagctagtcgggaggctgaggcagcagaatcacttaaacctgggatgcggaggttgcactgagctgagatggcaccactgcactccagcctgggcaacagtgagactctatctcaaaataaaataaaacagtgttctcagcttcttaaattgtcatctttgcaatttatagtggaagaaggagtggagctgatacaaactgatacagaaatgctctttttctcttctcagcagttttaactatttgcaaaagctttattgtccgggatttttacagtgacttttggagtatgagcagggaccttgaaactcagaggaggtacagaaatagaaaacaatgtcatggtaatgaggttgcttgaaaatgacagttttcataacatatcatgagttgcataaggatacctacattacactttttctgtaaagttctaaactttcgtctctgactcattagagtgtttaccttttgagagaggaaaaagagttggatcagggatggtccacagggactcatcaagtataactgtagtgtgttctttttaacgaaaacaaaactaagaaaaaagagcaaaatttgataaactactgggcatgtgccctgccactgatcatatttttctctatatgatgttgtatattatactacttcataattttgaaaattaatcaaaataaagcagactgcagaactataagtatactataatttcactattaaaaaaatagatacagaaatggataaatattatatgtacctgaatatgcatggaaagatatacctcaaactgttaatagtagatatctcttacagttagaatggggcaaaaagatattttagagctctgacattaaggaagacctccttccccctgccaggcccctaagtaaaaaaaacaaaacaaacaaacaaacaaacaaaaaaacaggctcctttaataagccgatgagaggaaaactacaaagctctaattccagaagaattttaggatagttttttctgtttctgtgaaaaatggcattggtatcttgataggaattgcactgaatctgtagattgctttgggtagtatggtcattttaactagattagttcttctgatccatgagcatgggatgtctttccatttgtttgtgtgctcttcaatttctttcaccagtgttttatagtttttcttgcagggatctttcaccttgttggttaaatgtattcctaggtattttattgtgtgtgtgtggctaccgcaaatgggattgccttcttgatttcttttttggctattccattattggtgcataaaaaatgctactgatttttgtatgttgatttcatgtcctgcaattttactgaatttgtttatcggctctaagagtttttttgatggagttaggggtgaagagagattggttaatgggtacaagcatacagctagatagaaggaataaattctaatgtttgatagcacagtagggtgactatagttaacaacaatgtattgtatatttcaaattaactggaagagaggacatgaaatgtactcaacacagaaatgataaatacttgggtcaaagatactcaaaaataccctgacatgatcattacactacacatttgatacatgtaacaaaatcttacatgtatcccataaattagtacaaatctaatatgccaaagtaaaatatgattaaaaaaatacaaaactctgaaatggatgtcaatcagaagattttatctttgtgttcaaataataggacataatcagatattaccccggctggtttctcagtcctttgctggtggcatctctcttcttaatagttaaactgtttgtgggacagagatttgagactgtcccctcctcacatcctcaccactttaagattagggtggggttcgtgccaccaggcacggctcctttcccaggagatgactatcccccatcacagccttttatgtctaagacactggcaggaataaagtccacttaacaactttctctctttctcattttgcgcactgggggcatcctctagtctctaataaaaaaaatctacaaagtagcatatatggaagtattcctcacttccttttaaataaaaagactatagtgcatcccaaactctgtttcagtttcttgtaataaattttcttgtgggaatggaatgttctgcacttcactgtactgtggttatttaacaaggccacagatgaaaaaagcaaggatattcacttttttattttatatgtgttatgtacctctccattgtgcaatttttataaataaaattaaatcactcttgcaattaaaaaataaattcgtattaatcaggaaaaaatgtaaaatacaagaaatgattattttctccaaggatcatcaaggcctggcctcagaggagcccctggatggccaggcctgaaaggaagtaaaggggaacgaggccgcccaggaaaggatgccatggggactcctgggtccccaggttgtgctggttcaccaggtcttccaggatcaccgggacctccaggaccgccaggtaaagatgtggaaggggaccccttttgtgcacagtgccaaatgacagatgtgtgcaaaccacgggcaacaaaccctcctcacagcttagccatcagtctgtgtggtttttatgagttacctttccaatggtcttcatttcactaactgtctgtgaaagaaactgatgcaatgactagttaacaaatgcagcaaagtcttagcccgagtttcccagagagcagagtaggaggcagggacaaagagagtgatgtggggaaggatgggtggctatcaagttggccttgaccaattgcaactgcctgttcagccctggagactatctgtgccaggggagaaagaggcaagaatttatccatttgctcctagttcccatgggtcaaagatttccccccaagagaggagccgccccccacctcccatcctcccacttccaggctgtgtctgcatggttcccaggaagtcccatgccttggcatcagcagggaagccccaggacagtaggccagaggtgtgccgcatgggtgtaaggcaacatgctatgaggtaaaggggtcagagatgacagagatgtggcccaatggacttgaagtggtgctcagaggtcctgacacagggagcctttccttcgcatccctctagagagccacttagcattctgtgttggctcataggtacaataggtcctcacaaacatatagatcacactttatattttaacataccttttctggggccaggtgtggtggtgtgcctataatcccagcttcttccaagtctcttttaagatggaggtttagtatcctctttttttctatgtcaaggctgacatacagagttcacagggctaatgaagctaaagctgggatctgggcccaggtgcttgcggctctctcccgaaggtgtcatgctccctctgtgcctgctacactctgtccaggggtctttgcttcctactttcccttcgctaagcaacacccatctgtccttcagacttcagcttcaagttcaagtccagcagaaagctttcagtgagtccacatcctgtaacctccaaggttatcccaactgtagaagttttcacattgccttctctttgtctttgtcagtttttcttacaagaatcaaagtattttgaggtcaaagactgtgtctttttggctgtttaagcccagtatgtagcatggggaacactgcaggtactcagatattttttgaattaagcattaattgagtatgaaaatgtataagtatacaaaaatgtatgaatgtagaagtattcatataagtctacactaagtattaaacttttatcagattgtactatttaaagatgaccttccaggtattttaaagatgcagaaaactgatcacaagatggtcattctgtgttccaacaaaattaaatggttccagtggtaccttgtttttctgaaatttgggacagctatggtagtgtttttaaatatttactttcatcaccattgccttcaacctgtaattgaaatggcaaagccaaaaattagattactgaacacaattaaccagtttaagagaaggagctgttcattgcaacattacagtagcagataatgtggaagctgagaagagctttcttagagacctgctttaaggatgacaactcaattgatgtggacaagcaacaaagagaaaacagatgataccctgagtcagaatccatttttcttttactcaatatatattaagcatctacagtatatcaggaaaatacaatgtatccaaaaatatccagaataagagttgatcctttgcctcaagatgctaaagggattgtctgtgtattagtccattctcatgctgctaataaaggcatatccgagactgggtaatttaaagaggtttaattgactcacagttcagcacggctggggagtcctcagtaaacttacactcgtggcagaagcagaagcaaacatgtccttcttcacatgatggcaacatggagaagtgctgagcaaaatggggaaaagcccattataaaaccatcagatctcataagcactcattcactattacaagaacagcatgagggtaactgcccccatgattaaattacctcccaccaggtccctttcatgacacatggggattatagaactacaattcaagatgagatttgggacacagccaaaccatatcaacttggaataattggaaacaactaagtaagataaaataggttgattctgtgaccaaaaaaaaaaattatacaatgagctttcaaagatcaactaccttaaaaataccacatctatgtaatatgaagggaagagctggtcaccatgctttctcagttgcagataaacttctaaagactaggcttccaatacaaagatgagagagatgcattttaaataatacatatattacaatacttgctaattgaaaaaaacacaaataaaaaattgtctttggtgctgtatttttataggtgacatcgtttttcgcaagggtccacctggagatcacggactgccaggctatctagggtctccaggaatcccaggagttgatgggcccaaaggttggttcaatcaataatgttgtattaggataagcctttttcatcgtcattattatcactgatttttccccctgagataacaatgatcccaaatagctaccagtcagtgatgacttattttccattagctaaaagtattcatttatctgtaaatcaataatttatttggcacccatgcaataaattgttggatatccctaaaatgtgagtttttgcctgcatgcaaggaaagaaacactgaaatagatgttttatgttagacttttggaatttcccctttcagaagaactgtatagctcagaacattaaagtaagcagatctataataaatgaatttttaaattaatatgtataacgtcctagataattttcactacataaaaatgtttaaatgtaataaatgatagtgtggttggaaaatatttgttctttctgaggactcaatgtagctttttaagtaatgctagtatgctctcattgcaggagaaccaggcctcctgtgtacacagtgcccttatatcccagggcctcccggtctcccaggattgccagggttacatggtgtaaaaggaatcccaggtacaaacaatttgcatgcaagtgtttttgcaagcacaaaagggtcaatacactggaagaaaataaaggcattggattggtggatgtcacaacgtggtttagatgaacttggagggagagtttcaaaaacatatattctattaacataaagtcagccaaaatccaagaaaagctggtatttttccctattccattttagttgctgacccctagcaaagtattgtgttaggcaggaattgtgaacacagagtcctacaagagaacagcagttaactgaaggcagtgaagcagctgcatgaaacacacaccctctttctcttccataaagaaatatgctctctccctttttttctcaaaagacacaaccctactcagtccattttttcatgttcctacttttaaaagagtcatagaaaaatgtggtatttcactttcttcttaaggatgcaaatgctctttaaaaaattgcaacatcctccgtgctggggacaagagagttgcagaaatgcaataaacaaactgagggtacatttgaacgggccagcgggcacttggctgcagcccattgttactgtgcaacatgtcaggccctgcattaataaatcttccaagttttcatgagaagaaaggaattggaatttttatttaaaatctcatggtgtttttttaaaaaaatattagccactaagtcaaattttgaaaggaaaaaaaaaaaaacacaacattttatagccagtgtcctgaggcttaaataaaggatgagtcacaagccttctcttgacaactgtgtgccaggccaggactctccacaccacacggttactcccggctgtcaccacctctgctttcgacctccccgtcttcagtcacagaactgcctatgggcaaaactttgaagtacaaaacgtctctgtttactgactgggttcctctgcccctcgggccactcccctgactacacagggcctctctctccctcgctaccacccacagtcctgactctgccaccagcaccttggtcttcagacaatgtcatcaaattatgtatcattgaccattgagaggtgaagttacagagcccttggcctgtgtgttgggcgctgttctaagggtcttatgtgcctccattcctttatctctcacatcagcccgagaggctggtgctataattaaccgcattggacagatgaggaagctgaggcatcaggtggcatagctaataacatggtagagactgaactgaaatctagacgcgtgctcttaccctccacgcctgcatcccctgactgcggtgctgtcgcctgtctcctagggggctgcttttggggagttaatccaaaggtctacctgacaacctggatagggaacattatacattatcactgtccagtagccatttgcattggcatagggtcttctgggagactgggtctcaatccaaagatgaaagactaatggcggcagccgtgaacactgtggtcagccactggatgacatgcacttgggcagggatcctttgtcccctcagatcccactcacttctcctttatgaaggcctctgctactttcagtggctgcccctgccctgactcacaggcttgtgagggaaggggcaggggggaggtaggagctgttcctcttgttactcctgttcagtatccaaatatccagcggaaatgttctattaaaacaaaaaccaaaaggaaggaaatgaaggagggaaataaggaggaaaaataataaaagataaaaaatcattattttcctatactctccttgagtctcctctttggctcaaggggagcaggtgagcagctcactgatgctgaccacttattgcattgttgcattttccatagtttctctacatttggcctatccaggtgcagctcaaagaagatatgtaagcagtaaaatggtttggatcactataaaaagatacaccccagctcaagatcttgcaaaaaatagaatctgaataaatatgtgttgattaactgaccagagacccacccagaaggtcatttaaagggatcatcttgatagagatatttaaatacctatgggaagtataaaattgtacaataaaatgcaatttggcaagagacattcaaaaccttagaaaagtttgagactatttggctctgctattacacttttaaaaatttattataaaggaaataattggataaatttggagagctaaatacccagagacatttttcaaagcattgttcacaacagctaaaagttgaaaaatgtctacctaatgtctaaatgtctaaaaacagcatttagctaaataaatgatggctcgccaacacaataggcagcatgcagccatttaaaatgaagctataaattcatacttattgacatatgtatactataaatccaaaatagtgtgtctacgagtcctatgcacttatggatataaaaaatgtatcattaatttacattaaactttggcaaatattatcttctggtagatttataggtgatttttagtctcttctttctgcataattttcttataatgagcatatattacttttaaaagtaatatatactcagaaaaaataaagatatattcttaaaattatgaagataaaattttaagaagctaagatctgagttactttttacatgatctcttgttctgttatttactcccattctcttattgcatttatgttttatgatagaagttgtctttctttccccacaaggaaacactctattttcttcatacattgtattaccctgtctacttagagttggcgttcaatgaggagttagttaataattcgttgatttgcaggaagacaaggcgcagctggcttgaaaggaagcccagggtccccaggaaatacaggtcttccaggatttccagtaagatttcatgtttttaaatctttagcttcaatttgacaaattgcacactctagaaatatggttgcaacacacttaccagtttggtgccttgcaaacagtaggcacttaatagatacctgttgattaaatgaataaatctgtgactgattaagtgaatgagtcaatgaatttataaacagtttgaaatggtatcagaaacagaaagcagattagtggttgcctagggctgagagtgggaacagaggttcattgcaaataggtttgagggaatttgggagagtgatggagatgtttgaacgtgattgtggtgattgtggcataattctataaatttactaaaaatcattgaattgtactcttataaaggagaaattttatggtatgtaaattatacctcaataagtccgttaaaaattagaatcttgactgtcatagtgaatcaaaaagttatagataaatatacttagatcaaactattcaaagaggcttgttaaaatttaccaatattcaaacataacctgtattatggtgattgttctatggtattaaattatattattgtctgtattgctttgaattatactatctaactgaattatttttcagttttggaagttaacaacaaagcaaaacaaacaaaatgcttgtaataatagttgtggaccaaagagtgtgttgaaaaaattcatgttaaaattgaaaagttcttgtccacactgtttttaagattgacagaagaagaattctaacaaaatacaatacagattcatttgtgtactaccctagggtttcccaggtgcccagggtgacccaggacttaaaggagaaaaaggtgaaacacttcagcctgaggggcaagtgggtgtcccaggtgacccggggctcagaggccaacctgggagaaagggcttggatggaattcctggaactccgggagtgaaaggattaccaggacctaaaggcgaactggttggtatttagcaactttaccctccctataaatgaagtactctgaagttaagagataaagtgatttcttttccaaaaatggttggccgctcagcacagttcatcactctaactgcagaatgaaacatcttcaaattagcaggaataacccaagcaaatagttatagtattttgacagaataaataggtagcattcagtgatttcaaccaatcaaaattctacattgataatgaccccatctcatacacaaattacagttccatatttgtatcaaatgagtctatggaaaagttcagaaaatgatgtatagtagaaagtttagtaaatattttggggcgatgtccatatttttaaataaaaataaatgcataagaagacagcatatttaggggtatggtagtcaaataaagagattaaatgttttgtcattcatttaattttatggaaatttaatcccttttcatgagagagtttctcacatatttaattgaggtaatacctaccaagattttttttttttttttttttttttttttgagagggagttttgctcttgttgcccaggctggagtgcaatggtgcaatctcagctcactgcaacctccatctcctgggttcaagtgattctcccacctcagcctcctgagtagctgggattacaggcatgtgccaccacacccagctaattttgtattttcagtagagacggggtttcaccatgttggccaggctggtctcgaactcctgacctcaggtgatccacccaccttagcctcccaaagtgctgggattacaggtgtgagctactgcacccagacctaagatttattttaaaatgtcacagagtgagagggtgagcacctgtcatcataatgtatttacaagaggtttgcaagggatgctgcccaaactattctatgaaataccagtttctcccagggctaatctgtgttagccaataaaacagatcttacctcaaagaggtttggagaaacttggtaaacaaatttaaagattcatttacagaccctttaatatcagaatatgaactgtgagtcttccacatgaagataagctatctggtctttcctaaatgcttctgactacaaaaccctttttggctggcagcatctatggtgccagcagttctcagaccctgccttggccaagtcccaggttgttcactttgtggtagttatgcttataaagtgacagtgccagaattctgatggtctaatattaagagaatttgtatgatgtccctacttgcatctcactgatttttctttataagttctggtaaagatgctccataaagtaaatgagagaaaaatcaaggtggtgatttgttgagtcttacaccctgtcattaaaaaaggagacagaccacttagccatctgatgatattgaacaatgaaaaattgagtcaaatttatttcagagggccatgttgggaaggaagagggcttaaattattttgtcaaattcaatttcttttaaatctacaaatcattttcaaggttatagcatatgaagatttaaaaactagacagtttatgagagaaaatggaagtgggaaatcccctttgtcatgaaaatacctggtgaaaccagaaataaaggtttgctgtgctcattttatttcagaaatgtaacattatcatgaatatcaccactaaagtcatttgaactattggtcaatttgaacatagttttagtggctattaccatatgggagacccatcattgtaagatatctcaagtgggactcaagacagttccaagttcaaaaaatgttgctaaactccaaaggacacaaaacggaagaaacctgcagtgctcttactttagtaataattctcatcaaatgccaaatgcttttaattcaagatctcaatgacagcctaactggtattcatatttggaggatgattaacctgttgtaagaatatactggaatgaagcacgattcaaacacattcctgttgtcacaggctctgagtggtgagaaaggggaccaaggtcctccaggggatcctggctcccctgggtccccaggacctgcaggaccagctggaccacctggctacggaccccaaggagaacctggtctccagggcacgcaaggagttcctggagcccccggaccacccggagaagccggttggttagttttctttccagtcctgttttccgatggagtgggttgatggtttctagagctaacgaagcttctccaagactaaggaaaatatagaaacttgcttctaacgaatagaatatgtcaactcacagataccaggaaagaatatgtagggtatgttagagaaaactcattttttctccattactgggcaattcaactgaaatttcctagaatattctatatctattacatacatacatatatatatatgaaatgaatagatcctaagcgttattgcaaatttgttttttgtggttttctagagacagggtctcactgtgttgcccaggctggagtgcagtggcataattatagtttactgcatcctcaaacttctgggcttaatagatcctcctgcctggtctcctgagtagctggggctacaggcacgtgtcaccacgaccagctaatatatattttatttttattttttgtagagacaggatgttgctgtgttgtccaggctggtctcctactcccaaccccaaacaatccttgcttcagcctcccaaagtgctaggattacaggcgtgagccactgtgcgcagccacaaatttgttgattttgatccataactccataggcaggttacaaataaaactttaaaatatctaagacaaatgaaggaaaatggtctgataatagtttaaaagtccaggtaacttttgggatatacatatactggccgtagttctggattcaggagtgtggctgaaggtcagaatagcatgctactgatagttttgagcaaataatgccaacatggtcatgttttacttctaaaatcaccttaggctgggcacagtgactcacacctgtaatctcagcactttgggaggccaaggtgggcagatcacttgaggtcaggagttcaagaccagccgggtcaacatagcgaacccccatctctactaaaaatacaaaaattagctgagcatggtggcacatacccacagtcccagctacttggaaggctgaggtaggagaatcgcttgaacctggaaggtggaggttgcagtgagccaagatcgtgctactgcactccagcctgggcaacagattgagatactgtctcaaaaataaataaataaataaataaataaataaataaattttaaaaatcactttaaagggtaagacccagtaaacctctaaatcattttgtagtgtcttccctcatcagtaaaactttttgagtgcacaaccttacattatatgttataaatgtatgcatcatttctgtccacacatgtatgtaaatcttattttatgactttctctatatattaaataaacaaataaatatttatgtttatctgcaccttactttggagctgctttttttttttttgtctgagatggaatcttgctctgtcgcccaggctggagagcaatggcgcaatcttggctcactgcaacctccgcctcccaaattcaagttactctcctgtctcatcctcccaagtagctgggattgcaggcacctgccaccatgccaggcgaatttttatatttttagtagagatggggtttcaccatgttggccaggctggtcttgaactcctgacctcaggtgatccacctgcctcggcctcccaaagtgctaggattacaggcatgagccaccatgcctggccgaaggaggctgctgttctaatccaggtactagcaaacggtggtggaccacagtccaagaccagcccactgcctgattttgtatgatcctcaagctaagaatggttttcacattttcaaatgattgaaaaaaatgtttaatgatattttgtgatgcatgaaaattacatgaaattcaaattagagtatccataaataaagtttcttggaacacagctgcactcctgtatgtactgtctctggctgcttttatgctacaatggcagaattgagtagttgggtagatttcaatcacgaagcctaaatttcttactatctggccctttacagcaaaagtttatttagccctgttctaatccatcaccaaatgctctgttgttgttgttgttgttgttgttgtttgagatggagtcttgctctgccacccaggctgcagtgcagtggcgtgatctcggctcactgcaacctatacctcctggattcaagggaatctcgtgcctcagcctcctgagtagctgggattacaggcgcacaccaccaggcctgattaatttttgtatttttagtagagacggggttttactatgttggccaggctggtcttgaactcctgacctcaagtgatccacccgccttggtctcccaaagttctgggattacaggtgtgaaccaccacacccagcctcttctgtgatttctaagtgtgaatctttactaaaggattccattgtcataaaatatattattaccaaaattgtcccatcacatactgtaaacctatttttttctataaataaatgactatatggacaacacttatcactaaacatgtttttaatgtttgccactgtggtcagaatattatctcgtgtccttatctgctaggtaggcattctttcccccgcgacagatgaggaacttatcagagaggttaagaaaagtgtccaggtttacaaaccaatgtcagccttgcccatatcaaaacttactgttttgttcaatagccttcctgtggaaactagccacccaataaataagtatcctatcagtattcaccaacgtttaaacttaattccatattatcaattttttggaataggctcttttcaatagaccagcatgttgggctattaatttcccttttagaaaaaaaaaaaaattgcagctcgctgccagcgctcatttaattttacataaacacattctttgaggctgaagcaaatctgattttcaatgtgaaataaaatacaataactgttcttggagttatttctaaacagaatttgtctctaatcctaatgtaagagggtaaagttaggaccgtcatctgtgagttatctcagagtaaacaggaaacaggttaaaacaaagtttagacgattgtctacacttataaatatttgttgattcaataagaaagtttctatgggctggtcgtccttaagctagttttgaagtctgtgaaaacagaggttattttttattttttggggatatgtttataaaccctttataatcgtattttccgctatcgtctaagacaagcttcaatatataccccaatcttatgaccacaaatttccttaaggccctaggggagagctcagtgtttcaacaccagttccaggcccaccaggacctccagggccccctggccatcctggcccccaaggtccacctggtaagtatcctctgccaaatctggtacatggcatcagacacacacaacaccctgactctcttggaaaaatactgtccccattataaggaaaaaaatgtattcattggctccaaaagagagcacagggcagtgtcttacctgataagcaagcaggctggggacttgctatagttctctgaggttatccaaattattctcactggtgcttctaatataaaggttcccgaggagaacctatgtaactacttaagaggaattttagagcagaaaaaccgttctggagttttggtgggggagcaagtgatgtttgcccactggcaattcatcaggatattttccatagcatcttcatttgaaaactgattgtctttgccaacgtgatctaaaactgagttttgcatgcatggagggagacttacatagttcaagacatctagaatatttcctgttaggaattaaattatattgacaaaattctttgcagttcctaaagattagtccattggatagggacagggagggggagcatatgattggggttgtgttaaaaattttttcttggccgggcacggtggctcacgcctgtaatcccagcactttgggaggccgacgcaggcggatcacgaggtcaggagttcgagaccagtctggctaacatggtgaaacctcgtctctactaaaaatacaaaaaattagccgggcgtggtggcgggcacctgtggtcccagctactcgggaggctgaggcgggagaatggcgtgaacccaggaggcggagcttgcaatgagctgagatagcgccactgcactccagcctgggcgacagaccgaaactccatcaacaggaaaaaaaaaaaaaaaaaacaatgtgcaaaagggataggacgacacagagaacttagacattttcttttaaaataagatgaaggaaagttgctgatgtggagatgcatatgtgtatttgtttctaaggtatccctggatccctggggaaatgtggagatcctggtcttccagggcctgatggtgaaccaggaattccaggaattggatttcctgggcctcctggacctaagggtaaatttaaaattttttcaaacataaagtttgttgtggatatttagaagatgttcatatgtataaataaaatgagtaaaatacaatatgaagatataaataggatataagatataaaatgagtaaaataggaaatatccataatactctttaaaatgttttctggccaggcgcagtggctaatgcctgtaatcccagcactttgggaggccaaggcaggcagatcacttgaggtcaggagttcgataccagcctggccaacatggtgaaaccccgtctctattaaaaatacaaacattagccgggtgtggtggcatgtggctgtaatcccagctactcaggaggctgaggcacaagactctgtctcaaaaaaaaaaatgttttccaagagccacaaatggaaaaaaatcttataataatgttaggtgaattaattgaattttttaaaacacagagaaaacaactagaaggaaactcaccaaaatggtaatagtgaatcttgattgtcagattttaaagacatttttgatacttctcagtaaatgcctgcacatttcacatgtatacatttcttttttttttaataagaaaggaactattaaatcacaaatggctgattttcccataaactccaaaataaattatggaaattattttcctttagggaaaaaaatgctgtttcccctcaaagaggaaacactccaaaaaaatctagacgctgagagctcacacaatgacataagcctgcccactgacaagtacatgaaagtcctgtccaggatggcatatgagtaacctgagtccctggattctcacatagaactgcaagttttatgacaatttcatgtttgttacaatattctttaaaatgtttgtcaaaaatagcatccttgttttggtgtttcagctcttggattagtatgtcatcagtgtttattatacattaattttgcccaaatatgagaatattgatttcaatttatgagtatttgaaatggaaaacataatctcatttctcctggagtcttaagaatggctttgagtccaatttcttggttttcttcctaatgatctgtgaagtaagggagtctgcctcacatttgtacttcattcttcttggaccctgcattaataaattacatccctactttgtaactctaggtattgactctctggaagaagactgttgactgtgggaaccagaactagcccaagagctccttgaaagtggagatttacaatttcacaattgaatctaatgaatcccatgaactaactgcaaattaaatattggtcaaattagggtatgaaggaactccctgaatgcagccttgcttcaccgtggcttcctcttctgaaccagagatcacagaaagtgtgttgacccctttctcaagtcacctactataaatgcataagaagttaatcccttgcatgcaatggatgctatagggcattaagacttaattctcttaagcaacccctgttgagaaaggctacctggggtgctgaaaacgttctatatctttttttttttttttgagacaaagtttcgcttttgttgcccaggctggagtgtaattggcactatctcagctcaacacaacctctgcctcctgggttcaagcgattctcctgcctcagcctcccgagtagctgggattacagacatgtgccaccatgcctggctagtttttttgttgttgttttttttgttgttgttgtttttgtatttttagtagagatggggtttctccatctccatgttggtcaggctggtctcgaactcccagtctcaagtgatccacccaccttggcctcccaaagtgctgggattataggtgtgagccatcatgcccagccaaaagctttgtatcttaatctaggtcatgcttacatgaatatatccatatataaaaatccacttacctgtacactgtatgtaaaaaatacttcaaaaacaaagtcaaatggtcaaccagcatcagtggtttgaagaattgctgaatcaaaatcatggccctactaaacaacaaaatagagaaagttattttttcaaataggaaccaatgtaatttgatttggaacttttaaaaaattgctaatttatcagttggttttattatcatttaaattttcataaaagcatctctagctggttgagagataagagagttactgctcagaatatttcaataagactaatcctacaacaatgtttattgttttttctctgtaggagaccaaggttttccaggtacaaaaggatcactgggttgtcctggaaaaatgggagagcctgggttacctggaaagccaggcctcccaggagccaaggtatgcaaaaattcaagctatcacagaagagagggtgggtgaccattaactggccagtttgtatgcacttatctggcagagcactctagatgtagaaatgatcaatatatttgtagatgatgaagatattaaattttttaaatgtttctctggatcatcttccattttagaaaggaaaacataaggtgtcagaatgcagatttcatcgtgatatcatctttaatggtttcataaataatcagagtatttaaaatgggacaactctagaaagaaatgtggttagctataagaaaaactatcaaaagtaaaaacatctagatttttctctttatagacaatcccacagtcttctgaaaaagtggaggctacatatcctgaagtattattaaacataatcttacagaaaagtcagcaactagagctcaaaaaggaaagttgatgacatggtagtggctgtgcaacagggacttagagcctccataacagagagtcaatatcagtgaagatttggaagcactatatagtaataacacaatttctatgctgtagggagaaccagcagtagccatgcctggaggaccaggaacaccaggttttccaggagaaagaggcaattctggggaacatggagaaattggactccctggacttccaggtctccctggaactccaggaaatgaagggcttgatggaccacgaggtacaatagcaagtgtcattacttttctccactgtgagctctgctaaaatgcagcaaactgaatgtgaaggtgttctaggcatgaagaattctcccatccaatgttcctgccctacctttcttccttctttccttcttccttccttcttttttaatgagtgccctctagaaaaggcatattaatggcagtaaatatagatctgatttaggtggaaaaaaagttaacagaagaatgactggtacagcaataccaagaccttaagttctagcacctgggtatatacttgtgctttcttttgcaggagatccagggcagcctggaccacctggagaacaaggacccccaggaaggtgcatagagggtcccaggggagcccaaggacttccaggcttaaatggattgaaagggcaacaaggtaggaggagggcctcaaaactggccaccagaagggcaggagacatgagactcctgctctgtgctttgctgcttaacatgggaactgtccagccacaagtcctgaccactgttcaatgagaaatacttcagaagtgtaaaccttgctgttatgggtttgttgcacacagtagtgtgtaccacctataaaggaagaaacttgaagttaatatagtgagttgctttgtgtcttttatgcaagaaaaatatgaatgctgaagacagagattggtgtgtgtttacatatatttatatacatattaaattctcagaaaacattttacctttaatattttcataaatatattaaagtggtaagtttatccttattattaaaatagggtaaatgtatgcaatgataccagtttaaaaacttataaactaaaatatgtagttgattgttttacatacaatataaaagaaaaaacatgaaaataaatctaaatgatgcaggctagatgttccagatgatggaaaactttgtttttggatcctctcctcatcagatctgatgaactgttcctggaaaaatgtatttagaaatcagttaatgtctgtggtctatcatactgcttatatgttcacaaataaatttttgaccaagaccttaactgttacagtggcattattattttttccagaggcatccagtggcttacctctatgcgaacggctctgtatgtcttctgcaggaaacagagtgagcagcactcataaggtgcagtcccagaatgtgtctgcaggactagaaaatagatataaagactacacttgtattactgcataaatcattggagcagagaatgttagagccagaagggagctcagaaattttacagaggggacattaaatacatacacacacacatgcgcacgcatgcgtaagtgtgcagttaccccaaatcacaaagctaaatatttacagccataaaatatttctaaagtggccgggtgcagtggctcatgcctgtaatcccagcactatgggaggccgaggtgggcggatcatttgaggtcaggagtttgagaccagcctggccaacatggcaaaaccccatctctattaaaaatacaaaacttagctatgcattatggtgcacgcctgtagtcccagctatttgggaggctgacgcaggagaatcacttgaaccagggaggcggagggtacagtgagccgaaatcgccccactgcaatccagcctagaagacagagggagattccatcttaaaaatatatatatatatatatatatatatttctgaagttagtaggggaaagcatttgtgggttaattaattcattcatttattcgtacacaggcagaagaggtaaaacggggccaaagggagacccaggaattccaggcttggatagatcaggatttcctggagaaactggatcaccaggaattccaggtcatcaaggtgaaatgggaccactgggtcaaagaggatatccaggaaatccgggaattttagggccaccaggtatccttttgtgtgtttctatttttcttcttatttcttcttcttcttaaggtggctctgtcaactgtacataggcatacgctttttactctatgcttttacttaatataaggttttccttctaaattatttgtaagaaaccaggggccatggtgcagggaaacggtggcggcaggatgaacaattacccagaatgtggctatttttgctgtgtaatcctttttatatacgactactataatatacttgctagtattttgttgagaatttttgcatttatattgagaagggatattggtctgtagcgttcttgtgatgtctttggtgttggtgtcagagtaatgctggtctgatggaacaagctgggaagtgtttcctcctcttgtattttctggaacagtttgtgaagaatcgacgctctttaaacatttggtagaattcaccagtgaagttatctgggtctgggcatttctttttgggaagtctctaaatgactaattcaatctcttcatttcttataggtatattcaggttttctatttcttctggagtcagttttggtattctgtttctctagaaacttgtccatttttataagttatctgatttgttgttgttgttcatcatatttctgtataattgttttaatttcatggctatgtttattgtttatatgtttggggagaatattctgttccctcatggcataaggacctcaccgatctcccctctggaaaagagcctaaaacaacttaatcgacacattatcctttcattcatgttattgggctactatcacatgccagcattcttctaggccctagagacacatcagtcagtggacaagtctccccttctcatagtagaggatcaataatagaaatatttaaaatctaagttcaatttgagacaagtgttatgaagaaaataaagtgaagggatagaatagaaagtgactggtcaggggctgggaggatggaatgctccaaaacttccacatatgctatcctcatccatgaatatgatttgctaccaatcacttccacataggtgagtttaaaagaccacttaccgacccatctcctagactaatacagtaattgtactatgtacagaggccattttttcaactcccaatctctgcttctaagtataatttattttagtatatggaatattttgcttttctcactctgtacaacacgtgctgctttgtgttaatttgtttccataggtgaagatggagtgattgggatgatgggctttcctggagccattggccctccagggccccctgggaacccaggcacaccagggcagaggggtaagtgatagagtgtctttctaaatagcaggaagcataaacaatgttcatttattttgcagcaaaaaaagttatgtttcattggagggaaaaatagttctgagagagcaacagtatttgattttgctgttttctatgttccttttctccatttgaatggaatcctgttttctgtaggcttacaccactacccttatgaggctgcctgcctggggaaactatttatcaagttctcagcactgttagccttttttgtttgatttgttctgttttatagtaagcactgccaactttttaatccctatgaactacctgaagaattaaggacctgatgttgttactcctgtctgttagggagccctggaattccaggagtaaagggccagagaggaaccccaggagccaagggggaacaaggagataaaggaaatcccgggccttcagagatatcccacgtaataggggacaaaggagaaccaggtctcaaaggtaaagaattgcttgtttggaatcaggacatcagagctgattctcaggctaataaattatccaggcaaatccgtttggttgacaaataaggacagtgagggccagtgtttagttacctgcccatcacacagccggttggtggctgagcaggccttagaactgagtcaccttccacgacatgttgcctcctcgatgtgtaacatttttatttctaagttaattctgcattttaatttgctatatttaaatcatcagcagtcagtttttaaattataagcctcaaaactccctctttgccaagtatggggaaaattaaacccttaaaaaaattccacattaaaaaacttttctggctgatgttgaaacctccatctcaaattcaactttattctgtagactaccagaataatattttctgattctatctaaaaacttcttctcctgttcaaaatcctttggagaataattactaaaaagaaatgcttcaatgaaaatttaaccctttagaaagactgttgttagatgtggctactaggctaaaattcaaacccattcacattatttcaagttatttgggccctttttatggcagttttcatgatatgatcaatacgaccaatataaaaccaaattttcagaagccctcccttgcagtcttcttgaccaaatgtaatcccaagcaactttagaaaaacagagaactgctgggtaaaatattacatttgcagatcagactctcatagcaggaaaggaataaaagaaaaatgtatcatggcaagaaaggaaaaaagaaaaatgtgtttgcagttgcaaaaccatgttaagttttgagatatttgaaatgacttttgagaaatgagactgtgttcaacaaatatttatatgcatggcacatgaggatgtaacaaaccttcacatgtactgccaaacctaaaaaaaaaaaaaaaaaaaaaaaaaaatttgcacagggtgctgtagactacaatataaaggctgactaactggcaagttaggaagtaaaggccttctatgtacatagtcctcatctaacctggtgttgaagagacactttagttctggtacaaaaagaatattgcatttcatttttagcaatgaaaaagaaagtaatgcgacttttataaaactctgctaggactagtctaagccaagatatgaaaaaaaaaaatactggcaccaatctccagtcctcataaactgtctgcatagacaccacttcactagactattttagattatttaagtagtgttagaaacattttggaaaaaatatgaatagcatatctctgcctacataagcagaaatttggcgctcacagtataaatgcgcagtgagtactaatttgcaattgaagaattccttttgtaaagtacagaaggacacatgatatggggctatttctatacttccaacaaaactcttttactcaccctaagtacagtatgcatcgaggctgttctgtatgttttctttaggcttttcaaatgcataaccaagggacacagattgaagaacaacaaaaaaataacctgtatctaggcctccctaatttcaatatgatccatttatttttctaaatctgaatttctgacttaaagctattcacttcaaatgtggaagagatattgaatatacagagaagcacaataacaagtcactatcctctccacaaggaggctgcgtggcagacttaggcatatgtagaaaaagataataaagacgcgaggtgcaaattagcatgctatattatttaacaacgacctaagtagcatttaccatgtgcaggtactgttccaagttttacaactattgactcatttaatcctcacaataaccctaggagtaggctgggcacagtggctcacggctgtaatcccagtattttgggaggccaaggcgggtggatcacctgaggtcaggagttcgagaccagcctggccaacatggcaaaaccccatctctactaaatatacaaaaattagccagggtgggcggggtggggagcctgtaattccagctagtcaggaggctgaggcatgagaatcgcttgaacctgagaggcagaggttgcaatgagctgagattgtgccactgcactccaacctgggcaacagagtgaggctctgtctcaaaaaataaataaatacataaccctaggagtaggtactactattgcaatcatcccattttacatacggggaaatagggaggtcaagttacttgcccaatgacactctgataggaaatggcagagatgggcctcactcttggcctcctcactgtgctgccagagctctgtaggagttgagggaagtagaaaatacagcaactaagatagtcagtgaaacctccataaaagaggacttaaatgttgaataagattcagatgaacaaataaaattcttggcttaaaatctttccaaggctccctgtgctttgagaagtgaaacttcttggactgacatacaagtttattcaccacttgcacttggcctgtctctccagccacatgacatttatgtactcaataattaccttttacttaataatacctatggactaggcattttgctatgccttgattatacagaggtgaacaaagcagactttagtttcctagtcatgatgaaagttacggtttagtgggggaaagacacataatgggtccataaacattttccatttaggctaggtagtaagtatcttacgctttgtggctcacatatggtccctgttgcatattcttctttgcttttgtttttaacaaccttttaaaaatgtaaaaaccgccaggcgtggtggctcacgcctgtaatcccagccctttgggaggccgaggcgggtggatcatgaggtcaagagatcgagaccatcctggccaacatagtgaaaccccaactctactaaaaatacaaaaattagcgggcgtggtggcacacgcctgtaatcccagctacttgggaggctgaggtaggagaatcacttgaacccggaaggcggaggttgcagtgagctgagattgtgccactgcactccagcatggcgagaaagcaagactccgtctcaaaaaaaaaaaaaatgtaaaacccgtctttaaccctaaagccatacaaaaccaagccagattcagcctgaaagctgtattttgccaactcctaaaacactgaagtaaacaaacagactaaacagtatatatctttttagattgcaatcaatgacataaaaggaaaaaatgaaagttgtaaaacaaaacaatctaactccctgatactcatcactcctttctacatgctattttactctctgggaatcctgtctcattccagaccttcttcacccaattagttttcatttggtcttcaagactgagctaaaaaataccacctctttcagaaattcttccctgtagtatattgtgcccaactctagtatagagtttatcttcctggatgataattatttgtttacttgcctgtctccccagttaaacactaaaaacctggggaaagagaacatgatgatttatctctctggtgctcagcacaagacctatttattaattagatgctccatccatatgtgaatgaataagtacatatgcaggaaaagagccaagggaagtgaatctgcttgagaaaaagcacaaaggcaggctatagacagattgcagaatgcttcatgctgccgaaagagtttgcaatttactctgtaagtaatagagattcagtgactatttatttatttattttgagacggagtctcgctctgtcaccccggctggactgtaaatggtgtgatctcggctcactgcaacctccgcctcctaggttcaagtgattctcttgcctcagcctcccaagtagctgggattacaggtgtgtgccaccaagccagctactttttatattttttagtagagacagggtttcaccatgttggccaggctggtctcgaactcctgacctcaaatgttctgcccacctcagcctcccaaagtgctgggattacaggcgtgagccactgcacctggcccaatgactatttatgaacaggagaagagtatgatcaaagtcatgttttagggaaagtggaatggtttcctgggacgtttatgagctttccagctgggcagaactggattcaaatccaagtgttattaactgattgacactgtgattctggcctttgacttacctaatactttataaattataattttaatacatggattgagaatagaatcatctagatgagaatactgtagtggataacactttgtctttactattaaaaaatgaagaggtatttaggctgctaattcttaaaatgttgttttaaagagtacatattaagatcattgctagtgttcattgaggaataacttatgccaggcactgtgctaatgcttgacacatattatttcatttaatcctcttctttaagagacagaagcccaaatccgcccatgctcttaacatatatgctatatgctgtactacagtaatatgccatcggtttaaaccaggatgtggatgggtctgacaaaattttaacatgaatttttgatgcctggttttttgttttgggtttttttttttttttttgagatggagtctcgttctgtcgcccacgctggagtgcagtggcacgatctcagctcacttcaacctctgtctcccaggttcaagtgattttcctgcctcagcctcccacgtagctgggattacaggcacctgccaccacacctggctaattttcttgttaatacctggtttctaacttcaggattcgcaggaaatccaggtgagaaaggaaacagaggcgttccagggatgccaggtttaaagggcctcaaaggactacccggaccagcaggaccaccaggtacagctgattctcaaatagaaaaatatcacattttacactttcctacatctaaagtaataaaagttgtttctaggcttactgggtttaaatatcaattctgttctgatagtgttccagcagaaatttgctactaaattaactaaaagaaggtgttgatagttggcgtgtcattaactaacatacattaacctacaaatagttccattttgtcctcaaaatttcattctgaaattgctgatatgtattataaattataatgtatcactatatcacatatcagagatgaaaattagagaatgctttagaagttttcaggtttgcatctttcttttttaaaacaagtaactgagtttacaaaataatttttaaataattaaagtatcccaccattcctacaaccatctcagtaacaaaatatatgacatggcaataacacttcaggatgcagttggaaatgtattaccatatgtttgcaggagcccacttttttcccgctggtgttggtcctaggatgattttagtgtttgaaacccaggtctgctaacgagaatctaactttctttagttttccatgttccaggtccctagttccctcttatttgaaggaaaaaggacagctagacaagtgcccaaaccagccggtctggctgttctgcattcattcatgcatgcaagcaacaagtatttattaaacacatactatgtccaggaactgtgcagggcaataactacttatttgttctcaaggccccagaggagatttgggcagcactgggaatcctggagaaccaggactgcgtggtataccaggaagcatggggaacatgggcatgccaggtaatgcataaggtcctgttatgagcccacaagctcatgatgggtgaggactccagattttctgtgttgtgtactgttttggttttccacttggtagaaagcttatattaaaaaactagatttgcggggccgggcacggtggctcatgcctgtaatcccagcactttgggaggctgaggcaagcagatcacctgaggtcaggagtttgagagcagcctggccaacatggcgaaaccccatctctactaaagatacaaaaaaaatagctgggtgtggtggcacatgcctgtagtcccagctactcgggaggctgaggcaggagaatcgcttgaacccgagaggtggaggttgcagtgagctgaggtcacgctgctgcactccagcatgggcgacagagtgagactccatctcaaaaaaaaccaacaacaacaaaaaaaacagatttcctattagacaaatacacagtgtgcaaccagaaaatgggtgagaacaaaataaatattgatattatataataatcatctattgtaactacctgatgcagttgcaattctgaaaaagccattcttgggagaaagcttatgtaaaactgaaaagtagaaaacttcaagatcctcatgtttatctattttactctatgttttccccctaatttcaggttctaaaggaaaaaggggaactttgggattcccaggtcgagcaggaagaccaggcctcccaggtattcatggtctccagggagataagggagagccaggttattcagaaggtacaaggccaggaccaccgggaccaacggtatataggccactgaaatatttacattttagtggtggagtgagtgccttgaaaaatatcaacaagtacccagattcggtgtgggcagagaaaattgaaactgttactatactttcagacagttatttggatttttaaaatcctatctccacaacagaggatgcttgtctgtcacagagctgtcaacttctgagagcctctttcagtcaccaaggaatttctcacactgtctctgcaatttaggtgtgctgccagaagaaggcagtgattacaggcccatacaatcagataggacagtgggttttttcttgtgatacaaagtggcccatttctgctgtactcatctcagacttataaaaataaatttccaaaccttctaataaaaaacacttgtcggccgggcgcggtggctcacgcctgtaatcctagcactttgggaggccgagacgggcggatcacgaggtcaggagatcgagaccatcttggctaacatggtgaaaccccgtttctactaaaaatacaaaaaattagccgggcgttttggcgggcgcctgtagtcccagctacttgggaggctgaggcaggagaatggcatgaacctgggaggcggagcttgcagtgagccgagatcgcgccactgcactccaacctgggagacacagcgagactccgtctcaaaaaaaaaaaaaaaaacaaaaaaaaaaaacaaaaaaaaaaacacttgtcttacaaagactaacaaaagatacaaaataaaataactttacagcatcattagaaagcgaacaaaatcctaagatagatacatttatctttcttgttttagaactttttctgtgtaatggaatggaaatgcttaatcttgtttcaatgttttcagtgtttgtgctttgtcaaattgaggttggatgttaaagcccttactactgtattatacaaagcagcaaccagatgtttcaatagggcttggctgctttcttaggtttattctcttcccaattatctgagtacagctctcacactaaaagccagagatagaccactagagaatgattaatagaagttcctataagcagaagttgctaacgtgggattccatggaccactgggaaaatctatgggatcccaagaagcccagcaacctcttgaaactaaatgcaaaatgtttgaaaatgtttttgtagggtagagtctatttttcagatttagatttttagattttcaacagtatatgtatgactccaatatataaaaagtattacttagggaaccttctccctctttttggagacaataaaataccacctttcctaaatatttccaccagctatagtctccagtagtaactgctaaaacaagaaaaaaatttagacactacacagacccaagaaagcaactgtttactacttggagcacagacaaatgtctttgttctttatatttagattaagtcctcagaaaacctgagattgcttccactgagatatttgctcaacgaaaaatcctatttgacttcacactcaattaactgatagtttcatttagatttaaagttttcacaggtaaccaccagaataaatttttagaactgtgcattgaacacaaaatgagctggttttatcatgtcagcaaaatgagagtaacagagtagtatattttaattggctaccatagaaattttgtaaatctttatcaaacctatatgttcgggtttgtcgtaaaactgaagtgaagatttaatgaacactaaatcattggaaggtttttaaaacatgtgattgacatatgtgcatgcatagcatttgtaggatacatctttatttagtctatttctttcttactcccagctactcatcacaatttgtaactatatatttgtgtgattatttaatatctatctccttactggtctctgaagctccatgaaggcagggactgtgtatgtcataaatctatataggttaccattatatcctggtaaaagctggcttcctgggtatgctaccagtgcagtcacagaaatcctgtgctaagaagggcctccacacttggtctgacgctatgctgttgctgtcttgaaattcactttaaaaagttttaagggaaactgcattttcattttgcactgggccccataaaccatgtggccgtcttattcccagcacctatcacagtgctggcagatagcagatactaatatgaattgatgaatgaatgaaaaaattagtgaataaagtttatgctgaattcttaccacatatcctgcttatatgagaattttaaaggtatttgactacatttaagggggatccaggactgccgggtgatatgggaaagaaaggagaaatggggcaacctggcccacctggacatttggggcctgctggacctgagggagcccctggaagtcctggaagtcctggcctcccaggtaaggcttgagtttacaattctaaaagctggaagcattactcagagtatagccctcctgaaatcattgtggtaaacagaaagctatttatacttttatgctgcagttgcttttattcaactttgaacttcaaattctaacacactaagagaattcattaagagagcccaattttactaatcagcccatttggactgaaatacaaaaatatgttcctataaaaaacacttttgaagaactgcctcaacaaattcagcccaaggatacaaaatgttagccgttatacaatcataatgtttgtattagtttgtccaggcttccatagtgaattccacagactaggtggcttaaactacacttgatgttagccaaaaggctgagaagtgattaggtggcttaaactacagatgtttattttctcacagttccagcagctccgagtctgtgatcaagctgtcggcagcgttggtttcttgtggggcccctgttcttggcttgtggatggctatcttcttccagtgttttccaagtgtctgaatcttcttttcttataaagacaccactcacattggattagggcccaccctactgacctcattttaatttaattacctgtttaccagccctatccccaaatacagagtcatgttccgaagtactgaaggttaggacttcagcatatgaatttggggacaacacaattcaaactacaacactgtgctgtgactctttttcgaacccatttctggattgaattttggctttctggcttattagcttacaattcaggtttagggttttgttttattaaaaacaactgtgaaactatcgggttgcagattcaggtcttacttaaatacaataaactacctgttcaaatacagaaagtttcaataaatttgcatttaactcgcaattaaaataaaatcgcatattgagtggtgcttgtggttggtgtacacacatctttgaaagtgattagacacatctctgcactggttctccaggaaaattgcagcctggacaaaatcatggggtgaccttgcaacaagagagcttccttaaggccagcgtgagcatggttgactataaaaacagaccgtttcagtcactgttgtaatcatttatcttttggtgatcttttttcttccttcccctctcttcatttccaggaaagccaggtcctcatggtgatttgggttttaaaggaatcaaaggcctcctgggccctccaggaatcagaggccctccaggtttcatttttgtactttctctttttccttttcatgtgggagacacattttctcctgaggtttggatttctgtaaacctactactctatagaaggtagctcctagttactcagtatccagacaaaaatgcaaaaaaaatggggttagatatttctatctatttaattcaaatatttggcaacctattccaaactgataatcctcatgataatagtaatctgtatgtggttttccctgggaacatagcttcacatagctacagttctgaaaaacagcctgtttaacacaattccacacatctccctggtattcccattaggccactggcaagaaataaatcctctttttgtataccatagtttggggtttttgggttttttttttttttttcaggtcttccaggatttccaggatctcctggaccaatgggtataagaggtgaccaaggacgtgatggaattcctggtccagccggagaaaagggagaaacgggtacaacttgctcattatctttgatccgttagttttattttggatagaatcattagtaacagtgtaatcctttgctgctctaaagatttttctctgatagaactgattatctttaacatgttttcggtgtgtactaaacttttctcatagacatataatgtaatgaaattgaccaattattaacatgccaagattatctctttcaggtttattgagggcccctccaggcccaagagggaaccctggtgctcaaggtaagcagttcttcttccctgtcctaatgtacacattttcaaggagagaaagcagttgaatatgcttgaaatataaagtaagcttaacctagtgaattaaagatgttccaatagtaatacaggatatttatcatcttggtcttcaatttaaaatgtttaattattaccatcacaacaaatggaatgaattagaaactgtgattcaattttggaatttcctactaagaaagtcttgaaaagtaaaaaggattcttctgtatatgtcttgctgttgttagcatggtttaaagataccacctcctaaaaggtgaaggtggaactgatgggttctcagtaagcatctgtccctgctgttctgagacacaggagtaatccgaatcctttcccacctgtatcttcataggtctgactccaacccccagatccagcttgcggtccatgctattgtttattaaaggcgacccagagagtctctcaacatctcagacatggcagtttactgaacatgtcattcagagtatttacaagttttttgtttggcaggccacagatctggatttctcatgtcagtgctttacaagataaacagcttcttttaactcttttccattttctagtcaaaccttccaggagaaacatcagattgtttgcacatttcattgacccgtctcagccacgcgtcctatgaatgggagcatttcattagcaaagaggcctaacacactgaagggctctagttattgatgttcacgcaaaccagcaaagagcagctggatgccaatgagaaactcagttgggcaggaaccacctcttgacaaaacagttaaagtgtaaaagtagacaagagctgttctctcccatttgtttcttactggtttgattgttctttcggttgagctcagtcttcccacatctctcagacctctcctttcccaatgaggatgaaggctcttcctgttccacagtgtagctttagaattttggtcaaaaggagagttgctcttcatgttcccagggtaactcacagtttaaccatttggaatgagaacactagcttttaactggaaataaaatttggtataaaacggtcataccttaggtttaaaagccttaaaactaacaaatagcctaattatgtaagtgaatgattatgcacctcaatccctctaggataactaaatatggagaagagttcattgagacttggaaggtatgaatccttttaattagtttattctcccaaatcctaaaaagaaatcatattgcagagcatgtaatcattttaatgaacatgaaatatataatccaagccatcttggtacttcaggtcattgccatgcaaatacagtattacaaagcttggagtgaactgaagtcatctaagcactttcttttaaaagcataaattacaggcattaaaaagctaaaggatgtgaatagacatagggctagatcgtcaatattcatcaattttattttcattgtaagtctttactatataataactccccaagccctcccctgagctattagcctccctctccttctccctctccttctgcacatctatcttccgttttcatgccatttactgctgctagaataacacagagatgggagagcagagggagacattatttgcaattcatacaatatttttcattcatgaatgtcaaagcacaatttcttgaaggttttctaagatgaaaaatattagtattaacctgtgacctttttggagggtctttggtaaatccaaacctcctgccactagtattcctattatggggaatgtgtggggaagttaactaaaggacagaataaagactgcaattttgttgctcctttgtctggatttagctggataatacttcaaatgcacacatcagtgctacgcagtttagcttcttatgctctaatgaattatcagtgactcaacaatgtcaacatgactaagttaatcagctgataataactggcttatatttatataacactttagagcttacaccatgcttttatgtctgtatgttatctcacttgatctgaaagaattagctagaacaggtattaccttcattttttaaaataagaaaatcaaaatttgtaatagtaggtaaatctgaagtgactttgccaagatcagacagctagttggagacagactgagtctcaactcagtttttgtagctctatattgcatttaccagcaatatattataaaatatatattttagaaacatatattctgaatctgaacacttttaagcaaagtacctacattattaaagatagtcaagaactctaacccaagcatatgggcattaaagaaacttattaagccttcttctttgcaggagccaaaggagacaggggagccccaggttttcctggcctcccgggcagaaaaggggccatgggagatgctggacctcgaggacccacaggcatagaaggattcccagggccaccaggtctgcccggtgcaattatccctggccagacaggaaatcgtggtccaccaggctcaagaggaagcccaggtaaagggtttacttttaaacagcataaaataacaaaaatcatgtttgacctcaaaagttttcaacctcctcctcatgttaccttgttgcttcttctttccctgtggtcatctccattcccccactacctgtggttcccatacccagcagttgtcaaggcaaggtagcctgtttgagggatgcatagttaataaattaacgagcctggctggacgcagtggctcacacccgtaatcccagcactttggtaggccaaggcagacggatcacttgaggtcaggagttcaagactagcctggccaacatggtgaaaccctgtctctactaaaaatacaaaaattagccagtcttgcttggtggtgcatgcctgtaataccggcaactcaggaggctgagatgggagaacctcttaaacctgggaggcagaggctgcagtgagctgagattgcgccactgcactgcagcctgggcaacagaacaaaactgtatcaaaaaaaaataattagcctaaaagacagtgatgcattcattcaactctatttgttgaatccctagagctgggctaggctctagggaagcaggcacagaccctgctgtaacagaccctcactggggagaagcagatcctgctggtgggtgccaggtgcttcgctggcatcatcttctcctgtctttaccacaatcccatcacatgctccaggggaaagaatgtttgtggcaatgctaagtgaagggtttatacttcattagaaacaatcactgataaatagaaccttccaagctccctggctggcaatactgacagacttttcatgaattcaggtgcgcctggtccccctggacctccagggagtcatgtaataggcataaaaggagacaaagggtctatgggccaccctggcccaaaaggtccacctggaactgcaggagacatgggaccaccaggtcgtctggtgagtatggataattattttgactcattattaattcaatatcaacttataattattcttatattgtatattatatcatatattgttgatgttaactgtattagtccattctcatgatgttaataaagacatacccgagactgggtaatttataaaagaggtttaattgactcacaattctacatggctggggagacctcaagaaacttataatcatggcagaaggcacctcttcacactgcaacaggagagagaatgagtgccaagcaaaaggggaagccccttataaaaccatcagatcggccgggcatggtggctcacgcctgtaatcccagcactttgggaggccgaggcgggcggatcacgaggtcaggagatcgagaccatcctggctaacatggtgaaaccccgtctctactaaaaatacaaaaaattagctgggcgtggaggcaggcgcctgtagtcccagctactcaggaggctgaggcaggagaatggcgtgaacccgggaggcggagcttgcagtgagccgagatagcgccactgcactccagcctgggtgacagagtgagactccgtcaaaacaaacaaacaaacaaaaccatcagatctcatgagaactcactcactaccatgagaatggcatgggggaaaccacccccatgattcaattacctcccactgggtccttcccaggacatgtggggattataggaactacaattcaagatgagatttgggtggggacacagccaaaccatatcattaacattgacttatcgttagtacaagagtactattatactcttataaattaattgccagatcagatgggcctggaggcagcaaaaatttacaatttttgatgcatctgtgcagtgtgcctaagggaacacagtccagaagtttctgaaaatcaaaaaatcttcagagttggaatgatttggcctctaagaggcctccaaaactttggtctgtatgggactcacctctacagcattccagatccttgcttatttagaccctgaacaagtccagtgacggaatcttcaaaaagcagctgggagttcagaatcactctaaatgacattgtcacttttccctctacttacaggcttctgaagatttctgcattcccctgtaaatgcctatttattttctgccccccaaatgcctgccaatgtttctaaataactgccatttctttccaattattttattcctggataaatacttggttctttcaaattcagtttaactatttatcagccttgcctctatactgaatacaccctagtttcaatcgccctaaaaaatatagcctctggaatgaacgccctccagaagtaagaagtcaataccccagtgagtggctaaaggacagaagggtctactgtccggaacatcaccattttaggaatcagacctaaaattccacttgggccattgggctgacctacctgtctccacattgtgcctgtaatcaactaaagcccatgggccttttcctcatgaactgctactaagttttctccattatttcttgcctagcttgttgttgctgatgtttatttgggacttaagtgtagaacttttacatttatcaatcttagacatcatcttattcatttaggcctgtgccccaagcctgcaatctctcaattcatattctctctctcaacaccacagccgtcgtccctagctttctcttagcagcgtattagacaagttgacccctctgtttacatcaaatccttggagacagatgttgaatagatgaatgtgactcagggatcataactgagtgtctactctgtaccaatggatagaaaaacaaaaagctacagtcccttgccctagaggagcccacaataaagtgagggtgatagacacagagacggccattttcacactgtgtggtaggaagaatgcagggggctgtggggacacagaggaagggtatttaatccagactgtagagggaaggtgttcaggaaaggtccctccccaaggagattgatgcctggcctgagtcttgaaagacgcataggagttatccaagaaaataggaaaagccggggtatgggtcgggtggaggaaaggagctttctgagcaaaatgacaatgggtgtgtgtgagtgacacacacacaactctattactggagctgaggtgggaatgaggacaccttgggaggagtctggagggctaagcaggagtcaggtaacggaggtctggttttctagactaagaagagggaggaggacatcacttgctgatccaagaaacacttaacaaagcagctctttgtgcccagagtttgctctctaccagctggaattaatcccttaatgaactgccttttgatgtggctattcaccaagctttaaatctatccttgttgctctatgcagcagccattttgtccacaaaaatatagtagagagagctaccatggcacatggcacagctctctctaccatgtaaattgtcagtgtaaatacattgacaattcatatgtaaatacagaacatctatggtataactcattttgtcctctactaacctcatcagtgatgcgtaatgaggtgctttgccatagctcattgttaggaatcgctcttaagtactcttggtatttgatttccagaatctaactttaaaagtttttttgaaaaatgacatatttgcccatcttcagtctgtaggtgtctctcatgttctccatgattctttgaaagttgccaatttgatccatgattacatctgaagaccttccaaaggacactgggatatataaagcttggtttggaaacatgatcttacttaactcctctggtgatttcgtggtcattcataggcttctatacttacagttgaaagatatttcttgatggatgtctcaactggcctggggcctttaacagctccctcctgctgccagggataaccctggcaacatgccctttttcatagttaccttagcctcaagagaacaggcagacatcagaagccagcaagtccttgaccagatggttctgttttgtctctctccttttttaacaacactttatccaagcaatcagatggttccttctttggtcttcttgctccaaagatagctggttcaaggccagttttatccttggcacttttcatgaccttcaaagcacattattctcaggtaatagcattatctcaattcacatggacagtatgaaagtagatttagcatacattttgacaaatagctctttccagaagccctgctccctcctccctccttctatggctttgcttgagcatctcctggctataagaccagttcatgtgagcctcacaagaagagagcacctcgttcctgcttagattattgcatccttgtcaaatatgcctgtcaaatactctctcttgacaactcctgtacactcccatccctagacattacttctcctaccatcatgatcaagtgtaatttatggctctgctagcttagtgagaatgaagcttaggtgctgtaactcaacaacggttttgttgtctttgcagcaattataaatacagattataattttcattctgggccaggcatggtagctcactactataatcccagcactttgggaggccgaggtgggcagatcatttgaggtcaggaggtcgagaccagctgggccaacatggcgaaaccctgtctctactcaaaatacaaaaattagccaggtgtggtggtgcatgcctataatcccagctacttgggaggctgaggcatgacaattacttgaatgtgggaagcagaggttgcagcaagccaagatcatgccactgcactccagtctggaggacaaaacgagactctttctccaaaaaaaaaaaaaaaaaaaaaaaaaaaaatcattctggcagtactgggctactccatttaggacacagaatatccagttgaatccaatactaaaacaacatacaccaacattagaaggtatgtttgctgttgggcttaagggaagcttttgttttacttttaaaacgatagtcctaaggaaaggttctaagtggccagaggagttatagccttgattgaaagataaaaatgatgtctgctaacttcagcttattctcacccaacataatattataccctatttgcatttttaaaaaactgctgtgaattgagtgattttaaaaatttgttttggttctgctccctttatttgaaatatagggagcaccaggtactccaggtcttccaggacccagaggtgatcctggattccaggggtttccaggcgtgaaaggtactgtttttgtgcattgctctttatatgcaaataccataacctcaattcatattttagggcacacaagtgtttgctgaagtacagacagctggggttagtacaaataggacctcaatacgagtgaagtaggaaggctccactacactatttcaagattctttgaaatagagtatttcttcagatcaatggctctcggtaaccttcttttatttgtgtaaaagactgtgattggaagagaagtcttaccactttattagttcacatcaaagcaaatattctctatgtgctgaaaagaactcctaacgtaactaactctaggctattagtaaagctagagtaataagctgagaaagtaggtaactatgacaaccaagcaatataattcaccacatggtagaacaggttttaatgtgactttgtatgttaccgtaaatatcaaattggtttctgaactcaaaaagtggactcttagggacccttccccttcaatgttaaaatacaagttcttaatgcctacttctggaatatatttctttacagactcattaagcatgacctactgggtcccagtgacatgccaaaacctatgtgaacaaaatgaaattgtagcccttgtgacagaacccataggacagagcctccaggcacacttctagtatttgtccttagagtcaatcatcaacctgaagaactaggaaacccattgatctaagtggaatcacactgtgtctttgtttgtttttaggagaaaagggtaatcctggatttctaggatccattggacctccaggaccaattgggccaaaaggaccacctggtaaataaacgtccttactattgctgtcaatgaagaaaggtaacacatccgtgaggccatcatcttcttcttatgtttatgtcaacaggtgtacgtggagaccctggcacacttaagattatctcccttccaggaagcccagggccacctggcacacctggagaaccagggatgcagggagaacctgggccaccagggccacctggaaacctaggtgtgggactggcagcattgacttggatcactaggaagtggttgaaccaaaatacctgtaaactgctttggaaacagctgatacaacttcacagaaaatgttgaacatgatagtggttttcacaatcagtcttaggattgagctcattttacccttgaccagcaaataaaagaccttggaatctattgaaagcagttgttcatagtataacttgaacaaatacactttagggcagcatgttttttttattattttttattaaggtaaaggtatgtctatctcctctgacaactgtcagtctcggggctctatttctaaatgattgtctgaatatacctgagttctgtgaatttatacttttctaacatttggtacagcaaagtattaggaaaaaatgatttagaaatcttttcaaaatactggtgtttggaaattgaactaacccctctacatatgcacagcatatcgtaataggcttctgaatggaatgattatgccttaagtttgtctgaatcacctgggagataaagatattacttatttgtttgatcaattcagggacatagtgaattctggaagaacataaataaaaattgcagcacaattttaaactgctgcatttagtatcctcatagttcattttcgagagtcttattttctgggaagtggggctaacaagttaggtgactaatcatcctagcttgcccaggactgaggatcttcccaggatgcaggactttcattcctgaaactgagaaagtcctgggttaacgggatggttggccaccttacttttcatcctatatgataaaatgcaatacaatgttggtttttgcctaggaccctgtgggccaagaggtaagccaggcaaggatggaaaaccaggaactcctggaccagctggagaaaaaggcaacaaaggttctaaaggagagccaggtaaacccccagcttgtttcctcaccgaagaagtgctatttcgacatacagagaagtcttgttcgagtgggtgactatatgagttatctaggcctttgagtttatgttgttcagatcagaccaaaggccaaggatcaaatgttcatttggaagatgagaatcaagaattattggaacacagtatttttccgacctcttagctggtcagatgggctccaaactgatgcacagtttagcctgaggacaaatagaactaataagtcctatgggtgttctttcaaaaaggccaatacctgtttttaataacttataggagttgttagttaataattatttataggagcagtacataagtatgtagctagaaaaatattaccttggtatgagtagaagagcaactgagtatccttttttaagaaagccatcttttaaaaatgccattcttcatggtggtgggtgcctgtaatcgcagctacttgggaggctgaggcaggagaatcgcttgaacctgggaggtggaggttgcagggagccaagatcacaccaccgcactccaacctgggtgacagactctgtctcaaaaaaaaaaaaaaaagccattcttgaatagaattcaacaattcatgcgtgtcctgaaaagggaactcttaagtatagtgttttattctgaacatatgctgtatgtgtcagtttgatacctggatcaacatctaccttctgcagatgtttcaaagcactcttctggaaactacctcgatatccaaatcttctatttttaggattgctgactttgttaaagcaagaaaaaattctaaatgtgctttctgaatttactgacatatatcatgctcagatctactatattaaaatggtaaagactatagacttaaatttttaaaaattcaaatatgatgttaatataatactaattgcataactacatgtgatttaatattgtcataggtgcacagtagagtgctattaatcattcaactttccttaaagtgtggtttttgaagtgataaaccattcttattaagaattctattaatttaaaaattttaatgaccaaggctttaatgccctaagaatggggcaacagcaagagcaagggcactgcaatataaattttgtagagaactaattagcaagtagacagttcaatgctatggaggcctcacaagaatgacaaagggatctaagagtcaaactgcactggcataaactgatagccctggcccctttcttggagatacagaaatgcattggatatcacacatttgtataaaagctcacttccagttcctgccctgctcagctaatcacttcccaattcctgtgcagagatgaggagacatcttttgtttggggccaactatagctccctctgaatgagggcaggggttaggaaaagagaaaaatgtgtctccccaatatattaaaaccatggcaacttggatttttcaagtaagacatcagaccggagaatttggatgtggcctatttttaatttcaaaaaaccactcaaggtccctggaggagacaagagtgggcagaattcagagaaaattgaaaaaatgcataatattggggcttttacaaatttctgaggaaagtcctgacttccgagtcaggactaaactgtgaccctgcctgactcccaggggcacggatgtcccaggggcaacaaaactaattcctgtgatgatgtaggcccaaagtctaaccatcgctgttttctctgtgattccttaggaccctagagaaccatggcccaagtctggttggggagggagtcagcgtacagtggcagcagaaatggatgggagtgaggaagtggtagccaatgccaataccataaataatagccgttcaatgaaagaaaggagaaggaagttaaagaggaatggaagagaggatagctcactggttctcatctagaacacgacaagtgtggattagccttgtccaaatccatactccaaagtatagaaagtttttctccacagagagaaaaatgtacagaaacgatttactttgtttttaactcatataaataaactaacccttattacagtgaaaaaaaaagccttctcttcttacttgacttacaaattgatcaaaacttccttgaagtttgaacctttaaaaagagctttcaatgttttctgcaattgtttattgtagacaatgttgcaataatttgtgaatttatcaaaaccataagtaatttttgttatctactcgaatagactaagttgtagatatttgatttttcccccatcacattgtaggaggattcattcatttattcataaaaaacatacataagacctaccagatgcaggcaggccactgtgccaggcctcacagaggaattcaaagataaagacctgatctcaaaaaacgcatcaaatatacacaaacattgataagaagaggcactgtgtgataaactgcttaacatttaataatactgtttggccatttttataagccactcttctctaggattgctttcaatttatgggctcaacatatataaaatatatttaaattagtactttgaaaaaacgagtttaagatttttgtgtatgttgcaacatttagaatgtgttttttgaaggaccagctggatcagatggattgccaggtttgaaaggaaaacgtggagacagtggatcacctgcaacctggacaacgagaggctttgtcttcacccgacacagtcaaaccacagcaattccttcatgtccagaggggacagtgccactctacagtgggttttcttttctttttgtacaaggaaatcaacgagcccacggacaagaccttggtaatgtcccagtcccagttgccagttgtgctgttccacatgcagattgtaaatctttatagcctaggatgcttccctctgaagttaagtgtaaataaccttgagtgtctcctgatacattttaaagagagcaaataaaacactggcctgtctaattttcattctggaatgtaaaatggtggaaggagcctagctcaggaatgctagcctagctcctcccattcagtgcaaacaatttgcccctaaaactccctaaaccacctgtctgcatttatctttttggtgctttttctttttcttttttctttttcacacagggtctcactttcatcacccaggctggagtgcagtggtgcaatcatggctcactgcagcctccacatcctaggctcaagccatcctcccacctcagactcccaaatggctgggactacaggcacacaccactataccaagctaatttttttgattttcagtagagatgaggtctggctatgctgtcaaggtttctctcaaactcttgaactcaagcaatcctccctcctcagcctcccaaagtgctgggattacaggcgtgagccaccatgcccagcccacccatttgcttttcaatctcacaaataactgcttttctaaacctttatttggttattagctattatgtacatatgaataagtgggaatactttgaagcaaaaacactatcccaactgatctatgctagcccccatgttctaaatcgattagaaagagccaccggaagtattaaaggtgggagaaagaagatttgtttgcctattggatctttgatttctatcagtatgaaaacttttcaatactacattttgcagataactcttttgtgttgtctttgtccagcttttgctgcaggttacatttaaattagcttctctctagtaacgatgctgaaaataactttaacttactgaaagtgatactcagtctgatgtttcattaggaactcttggcagctgcctgcagcgatttaccacaatgccattcttattctgcaatgtcaatgatgtatgtaattttgcatctcgaaatgattattcatactggctgtcaacaccagctctgatgccaatgaacatggctcccattactggcagagcccttgagccttatataagcaggtaaaaatccaatcccctagttttacaatgggaccaagtgaatcacttcccttgtaatggaatgaaaggcagcacatgacagtgcagaaagtggcaatgccgccatagtctttgtttcatgttacagatgcactgtttgtgaaggtcctgcgatcgccatagccgttcacagccaaaccactgacattcctccatgtcctcacggctggatttctctctggaaaggattttcattcatcatggtgaggagaaaaggaacaggaggtttagggtaaagactacctgtagaatgttacattgtgctgggtaaaatgtgattcccagggtcgatgctgcctgctgtccgtgtgtgcaacatgccatagacatttccttgaaaatctacaaacagactttttttttttacttttggtaaataatggagtactaaaaaagacttctcaggaggagattacctacaaattctattatgaaatttaggtgaatagtagctgcgttttattgataatggaatgtctctttttattattttttttatcttttgagacagattctcgctctgtcacccaggctggagtgcagtggagtgattttggctcactgcaacctccgcctcccaggttcaagtgattctcctgcctcggcctgctgagtagctgagattgcaggtctgtgctaccatgcccagctaatttttgtatttttggttttttgtttgttttgtttttttagtagagactgggtttcaccatattgcccaggctggtctcaaactcctgacctccagtgatctgcccaactcagcctcccaaagtgctgggattacaggcatgagtcactgcacccagcctggaatgcctattttttataagataactgctttacatacattctctgtaatttttatgaaaacgctcataggtaatttctatcatttacagttttacaaataagaatgaagtactttccccagggtcttacaactatttagtggaaaagctaggatctgaacccaggtctatctgctccaaaatctgtgccccttttgacattcatatggagataaaagcaaagaaaaatagtcttttaaagaaaaagctttcagatgtaaatgctagtgaagaagtttatggattggccatgtgtgactgtgatgactgtcatagctgcacgcaggtggttctttcttttttctttttctttgtctcttgagacagaatctccctctgtcgcccaggctggagtgcagtggtgcaatcttggctcactgcaatctccacctcctggctcactacaatctctgccttctggctcactgcaatctctgcctccagggttcaagcaattctcttgcctcagcctcctgagtagcttggactacaggcacatgccaccatgccggctactttttgtatttttagtacagacatgatttcactatgttggccaggctggcctcaaactcctgacctcaagtgatctgcccacctaggcctcccaaagagcgagctgggattacaggtgtgagtcactgcgcctggccacataggtggttatttctaatctgtagcatcgctcatgatcattcctcccctttctttactcacagttgcccattcattcaaaaaaaaaagtagagaattgaaaatttgaaccccaatggacagagtgtttattcagatttttaaaattgtggtagttcacaagtgcaggttctgagggcaccgggcaagcactggcctcccctggctcctgcctggaagaattccgagccagcccatttctagaatgtcatggaagaggaacgtgcaactactattcaaattcctacagtttctggctggcttcattaaacccagaaagaatgttcaggtaactattcaccatcaagcttaatctgatgactcaattgcagaactattcaaaggttgcctgtgttcttgggtcaacgagtagccatgattttgtactactgtgccaataaagacaaaatatgggttttgtcatcactaaacacatttaatatttgtatatgaatttatagtaaattacttgatacaatcacaaaacgatctctcatctgaatttactgtattgaaagacttgtgaataatgtggataatttaaagggtgggagtagtttttattaccaaaaagatgatctataagttttcatcaaggcctatgtttctttaatgctgctgaaatatgactaaaattataaaatgccaccatatataccttttcagaaatatacttcttccataaagagaaatagtccattaatataataaatttctctccttttttttttttttcttgagatggagtctcgctctgttgcccaggctggagtgcagtggcgcgacctgggctcactagaacctccacttcccaggtttaagtgattctcctgcctcagcctcccgagtagctgggattacaggcgtatgccacgacacccatctcatttttgtatttttagtagagattgggtttcaccatgttggccgctggtctgaaactcctgacctcaatttatcctcccacctcagcctcccaaattgctgggattacaggcgtgagccaccacgcccgaccctgtaataaatttcaaaatagcaaaaatattcattaataaaacaaactcagcaaaaattcccttttatgcataaataaatgaatttttttggtttgtttttatttcagaaagcctattccatcaactgtgaaagctggggaattagaaaaaataataagtcgctgtcaggtgtgcatgaagaaaagacactgaagctaaaaaagacagcagaactgctatttttcatcctaaagaacaaagtaatgacagaacatgctgttatttaggtatttttctttaaccaaacaatattgctccatgatgacttagtacaaagtttcaatttgtttccccacaaaacaaagcaattctttcaagtcagttctgtgatctgggtctctaatctgtgctgtttcaaagttctctgtggcaaagcagcaactattcacaaaatatcaccaaaaacctattccacttacatccaaggcactgtcactacggtgattgtatgaagtttgaatgctgcaagttatgaaatatttggcccgctggattcccacatttgtcttctttctgtctttaagactcagggaggctaaatcagtgtttgattgccccgccaacccttcctgaaacttcagaccctgggtaggggaagagaagggggcatgtggtatcctggagcattgtgtatagaactggattttcagacctgctgaggaccgtaaggcctgatggaacacagaactgaactgaggttcatggattttccaggactgtttcaaacatgcccattactaacggcaaaagggggattccctgatggaaccataatacccttggaaatactgtatggttttgttttgttttgttggtttttaaagatttttgtttgtttattgaattcatttcactgtagctctaaaatctgcttgtattccaagcatataaaattttcccccttagtgaattagttttaaaatgatattgttatatacatactatgaaatatgtataactttaacttctgttttaccagcatacccacacaaataacaagaatactacttatgaaatgtgcactttatcctcattccataaatgtcggtgcataccttatgtaagggagcagttcaataatccatgaaagaacttaaggcatttgttggtttatcagactcggaatctattttctcattgctctgaatatgtcatcactctaggttttacagatttattcctttgttacttctctaattcttcctttgtaaaaaaaaaaaaaagcaacactttttatgttatatgttgttcttacaaaccatactgaaagagtccattgtttaaaaatcttaatgtatcaaactgtataacttggccgctgtatgtcttaaaacctgcttttcaatgtgttgatacattcccaaggttacttaattcaacttaactatcatcttattcagcaccaagcatgtcccaggcactgtactaacctacagagatgctaagagaaaaaaaagacttgtttctgatctaatatcccagaaaaagtaactcattgctctgttaataatctcacatatacaagtagcttccctcccctctagttttttcttccttttcactgctgttatatttcatcatgataattcagcaggcccaagtaaaggttaaaaataaggtctatgcctagggaaactcagggcttctagtttctcttagaaaagctaagagaagataaggtctgaataatagcagaaaaaccaacatctacaaaacattaaactagtgttatacttgatgataacactatttgatgagtcttagagtccagacacaaagagacaaagctttgaagatgctttttgatctacctaggtggagttggtggtgctgatatttaaattcaggctactgcttcaatctcaattgctttgtaagtgaaaaacatgacccagaggacagcacagactatggccatggctcacatggtttacatccttcactgctcacgtgtttgctgtcaagccatttttacatctaaactaagatgtgcagcatttcacttatttagattcacttaacaaacaaatttttctgctttaaaaatgtcttattgtcccaagtgtactatagcggcatatagagctagctaatctctacaaaccctctgtaggccagtagttctcaaagtgtggtctctggaagagcagtatcagcatcatctgggaacttgtcacagatgcagattctagggaccactccagacctacacaatcagaaactcttgggggagggcccgaaatatctatgttttaccaagcccaccacatgattctgatgtactctaaatactgagaaaacctgttctagacaaatacccaagcaacaactccgcaggcagttaccaagtacggctggctacaactgctccatccgtgcctctttttaaagttcaaactcacaggtgactctaaggttatctacttttactcataagtaaaagccctagactggtgctaatgtcaaaccactggcctccactcaggcctccatcttctcatgccctcttaccagtatttaacttctgaggaagacaagtgatgctaaaacctgaaattccaatgaagccatatgaacagctgttcagttgcacttctaagactttacttagcagtaaattatagctcatgtgcattattttccagataacttagcttatgagtagcttatacaattatgaagatttaatattacagataaaatgtaaactgtttctttaaaattggggcttcaactttggaatttcacagcgtgctaaaataacagatttctcagaagtctttcagcaagataaacattattaagtaacttatttatgaaagtattaaaatgcttacatttgaacttgatggctaacttacaaagattctctatgtatcaaatgtaacttactgcgactaaacttaatttaatatttactctataaccaaatgaaatatatttaaaatatattgaatattttatattgttatatcctgacaagattataatattttaatgtactaatatttctgtaattatatctaaaatattattttattatattgcctaagaataaacatttgttaaattggagctggtccttttttttcaaaatggaaataaattttttttggattgtaagaataacagatgttcactgtaaaaagaatagacaatacagaagttatgaagaagaatataaaaatggccatgatctaatcctcactcccatccaagataagtgataaatctatttttaaacaaaaatgagataaaagtatgctattttgtcaccaggatttttttttttttttgagacagagtctcactttgtcgcccaggctggagtgcagtggcatgatcttggctcactgcaacctctgcttcccgggttcacgccattctcctgcctcagcctcccaagtagctgggactacaggcgcccaccaccatgcctcgctaactttttgtattttcagtagagacggggtttcactgtgttagccaggatggtctcaatctcctgaccttgtgatccacccgcctcggcctcccaaagtgctgggattacaggcgtgagccaccacacccggccttttttgtcaccaggtttttaaaaacttaatacatagtgggcacattttcacaccaacagacaagaattaatcatcatttgcaccacagttcattgcatgggtttataacctaagataataaatccccaattgacagacatttaatttagttatattatagacatattgtacctatgtcaccacaagtttgtccaattatttcttcaagataaatctctagaaggaacactatagagtcaaaggtctcacataatctttttatatacaaaaatgctctccagaaaggttgctagaattttcagctgcgtcaaccatgtaatgaaaacactcatttccctattaatttaccaatacagactattgctgttattttacatctttgcctatctcattgcagtgaggcagaatatttgtcacttttaattagtgttttttttttaatcaaagaagtattttgatgactgcctgttttcctgtgaagggcctaatcatatctttgcttatttttctattgaggtattaaaggagtctttacaaatcagtaaaaaaagcatatagattacagaaattatgggtcatatattttgatacatgtttcccatttataatacaaatactccttattcaaggaaaacaattcataaaatttcagatgtggagagttggtaaagaaaaaggtttttaagatgcaaaatataggctgggcatggtggcttgtggctgtaatcccagcactttgggaggcctaggtgaatgggtcacttgaggtcatgagttcaagaccagcctggccaatatggtgaaaccccatctctactaaaaatacaaaaattagctgggcatggtggcagacactgtaatcccagctacttgggaggctgaggcagaggaatcgcttgaacccgggaggcaaaggctgcagtgagccaaggtcgcgccactgcactccagcctgggcaacagagactctgtcttaaaatacatatacatgcaaaatatgaaatatcatagagaaggaactttcaggctgcattaaatggcaataatgatataatcaagggaagaaatggaatgaatagtgatccgaggtaataattctaagaagaccaagaaaattgttgctcgcataaatacttcagaaacactgtcacctattgtcataggtgggccaaaaaaaatctaatttgaaaagactttgagtaaaaaagtactaatccctttcaatgaacttacttttacttcgagtaagtcaaagaatgaatgctgtgtttgagcacattctctatttataagctcgtttggaaagaaaaattttgattaagccctaatggattcttagtaatctattggcaggagactgacaaaaaagtgattgcctccttcagtttgtgccattggcatctaactcatctcaccctaatcccagctctacctattagaaattaacagataagcaaacacagaggaaaatgtaattggtttttaacaaccaggctaaacttaaatatttagataaatatgatccttcctaggattttgcagactccatgctttttctaaaaatactgactgctcaaaacctttttagaatgattgctttggaattataatatcttcaattccaatttttgagccaaacaaggagctaggtctcattattttatatccaagacctacaacatgcttggcttgttgtagacctacaatatgtttggctccacagcatatacttagatgagtgagacacagaccttggtctcaagcatagagtttacaatctggtaggggaaaataagacaaatacatggataactttaatactagacagaacatgattaagtgctctaagggacaacaaatactggttcaaaagttggaggcctcaggaaagaattcataaaaagaggggatattttcagtggtcctttaagggcagttaggatttcaagaagcagaagatggtcagaagcagggtggcattccacgtggcagaaatagcatggatgaagctaagtagttaggaaaagatgaggcaatctcagggaacaattaatggccaagaatatatgatatatatttatatacatacagagtggtaaataaagaagcatggcaggaggttaagaccatgttgggcagggtttagaataccaggttgaacttgtacttcattgattgctactagagattcagtgaagattgtgagcaaaagagtggaattaccatataaccaataacctggaagatccaatatttaatatatggtacttgctaggctatttcatagtttcaaaattttaaaaaaattactggattgcagttatgaacttttgaattggaagataactataaatcatcaattttctttgaaactggggcttcatatttgagatgccacaatttataaacatcggttctacgtagacccaatgtctaggaattggagaaataaaaatactagggatgaggaggccagttaaaaggataacagcccagatgatgggtgatcatctaggagtaggaaaagaatggataaagcagaaagctggcattgaagagggacaatctaaaggatgaaggatactagggaaaataaaccattttaccaagaagacatatgttcatcacagcactattcacaatagcaaagaaagggaatcaaccaaagtgcccatcaatggtggattaaagaaactgtggtacatacacaccatggaatactacacagccataaaaaaggaagaaatgatgtcctttgcagcaacattgatgcaggtggaccattatcctaagtgaattaacacaaatgcagaaaaccaaacaccacatgttctcacttagaagtgggagctaagcattgggtacacatggacataaagatggcaacaacagacactaggaactactagacgtgggcgagagggatgggggcaagtgctgagaaactacctagtgggtcctatgctcactatctgagtgacaagaacattcataccctaaacctcagcatcacacaatatacccatgtaacaaacctgcacatttaccccttgaatctaaaataaaagttgaattaaaaaaaaaaaaaagaaaggatggtgtggccgggtgtggtggctcacgcctgtgatcccagcactttgggaggccaatgcgggtggatcacctgaggtcaggagtccaagaccaggctggccaacatggcgaaaccccatctctattaaaaatacacacacacacacacatacacacacacacacacaaaattagctgggtgtggtggtgggtgcctgtaatcccagctactcaggaggctgaggcaggagaattgcttgaacccacgaggcagaggcgatcactctgttgcactccagcctgggtgacaaaagtgaaactctgtctcgaaaaaaaaaaggtatgtgtggaaagaaagatagatagatctatgagaagggatactagcttatgcaattgaggaggctgaaacttcccacaatatgttatccacaagctggagaaccaggaaaactggtagcatggctgagttcaaatttgaaggcctgagaaggtgggcaccacttgtgcaagtcctagagttcaaagactggagaatctggatatctcatgttcaagggcaagagaagtgtcccagctccagaagagaaagagcaaatttgtcttgcctctgccttttcgttctacacgggccctcagctgattggatggtgcctgcccacattggtaagggcagatcttccttactcaaccccctgattaaaatgtcagtctcttccagcaacaccctcacaggcatacccagaaataaagctttaccaactatccgggtaccctttaatacagtcaagttgacacctaaatttgaccatcacatgggacttgggtgacagtgaaagataactttggtactttgaaccctgatgactggggagataacttggccattaactgaaaaaaaggaattcagaagatggtatctggagcgagaagagtggaaaaaatctgagttggaaaccctgctgggatcaaagctccaatgggacacttaagtagaactggctagaaccagtgcaacagggtaagactagatggatgagataacttagatttatatatcaccctttccaacaaaagatttgaggcaaccatggttgcaaaaatagtcaatgatggattaaatcataagacaggaatctccacattaatgttgcaaaaagaaatatatattacaatgaatatactaaatataaatatatattacacaaaatgagggagtagagttcccacataaggaagagaaaatgcctttgctctgagaatcgtctactagacagtgttaggtactttgagacacactgtctcatttaatttaacaaaaaacaaatgatgcaggaagataaaggacaatgaggtttatggaagaagacatcgtgtttggtaattggatcacaatctttatttgaaagttatttcaaaatgtttttctttgaggggagtacaggattaaaagccaaattgtaagtaattaagaagtggaaaggttagtgaagcaggaggaacatcatttctaaaggttttaaaggttacgattatagattggtgcaaaagtaattgtggtttttcccattgacagtaatggcaaactgcaattacctttgcactgttgatgaaaaaagtcaaactccataaaatatttttagagatttattctgagccaaatatgagtgaccatggcccgtgacacagccttcaggaggtcctgagaacatgtgcccaaggtggtcggggagcagcttggctttacatattttaaggaggcatgagacatcaatcaaatacatttaagaaatatactggtttggttcagaaaggcgggacaattcaaagtaggggcttctgggctataggtaaatttaaacattttctggttgacaattggttgagtttatctgaagacctgggacccacagaaaggaactgttcaggttaagataaaggactgtggagacccagttttattgtgcagaggaagctctcagcaggactttagagagacagtaggttgtaaaattttgtttcttatcggaactaaatgggtgcctggctcttagctgattatctcctagatctggaaaggaagtgagaggtgacaacgtgttagcagccctcgctcactctcagctcctcctcggcctcggcgtccgctcaggccatgcttgaagagcccttcagcctgccgctgcactgtgggagcccctctttgggctggtcgaggccagagccggctctctcagcttgcagggaggtgtggggggagaggcgcaggcaggaaccagggctgtgtgcagtgctcgcaggccagcacgcgttccgtgtgggtgcgggcttggcaggccccacgctcaaagtggccggccagcaccgctggccccaggcagtgaggggcttagcactcaggccagcagctgcagagggtgcgccgggtcccccagcactaccagcccacctgcgccacgcttggattctcaccgggcctcagccacctccccacggggcagggctcaggacctgcagctcaccatgcccgagccacccccaccatgggctccctcacagcctgagcctccctgatgggcaccgccccctgctccacggcgcctggtcccatcgaccgcacaagagctgaggtgtgcatgtgcgcagcacgggactggagggcagctctgcccacagccccagcacaggatccactaggcaaagccaactggactctagagtcaggtggggtcttggagaacttttatgtctagctggaagattgtatatgcaccaatcagcactctgtgtctaggtcggggtttgtggatgcaccaatcagcactctgtatctagctaatctggtggggacttggagaacttttacgtctagctagaggattgtaaatgcaccaatcagcactctgtgtctagctcaaggtttgtaaacacaccaatcagtgctctgtgtgtagctaaaggtttgtaaacgcaccaatcagtgctctgtgtctagctaatccagtggggacttggagaacttttatgtctagctagacgattgtagatgcatcaatcagcactctgtctctagctaaaggtttgtaaacataccaatcagtgctctgtgtctagctaatctagtggggacttggagaacttttatgtctagctagaggattgtaaatgcatcaatcagcactctctgtctagctaaatgtttgtaaacgcaacaatcagtgctctgtgtctagtaatctggtggggacttggagaacttttatgtctagctggaggattgtaaatgcaccaatcagcactctgtgtctagctcagggattgtaaatgcaccaatcagcaccctgtcaaaatggaccaatcagctttctgtaaaatggaccaatcagctctctgtaaaatggaccaatcagcaggatgtgggtgggggccagataaaggaataaaagcaggctgactgggccagcagcagcaacctgctggggtcccctttcatgttgtagaagctttgttcttttgctctttgcaataaatcttgctgctgctcactctttgggtccacgctgcctttatgagctgtaacactcaccgcgaaggtctgcagcttcactcctgaagccagcaagaccacaaacccaccaggagggacaaataactctggacaggaggaatgaacaactccagatgtgctgcctttaagagctgtaacagtcaccgcaaaggtctgcagctccactcctgaagccagcaagaccatgagcccaccagaaggaagaaactccggacacatctgaacatctgaagaaacaaactccggacacatgacacaccatctttaagaactgtaagactcaccgcaagtattcgcagcttcattcttgaagtcggcgagaccaagaacccaccaattccggacacagaaggaaggaaaacaaaggggaaagcagattctctacagaatgtggatttttcccataagagactttgcaggacaatttcaaggtagggcaaggaaagatatttttgggtaaaatatttttattttcttccttattatgccagagtcagattggaaagtaagtcatgatatacacggttaaataaaacccatctgatgtgcatttatggtttggagaacatgactccccaaaccccttagataggaatttgagcaagataaaaaaatcagagcttagtcctcagaaccaacctaatgcatgatctcccaacttgatctctatcttcccacaaaagattgacttggaatgacttattattcctaaaaatcaatctattcttaaaggcttatttgtctctgtagggtagttgttaagagttaaagaaagaagagagaaacacaaaaagtggctcaacaatcaaggataggtttattttagagaataaacctgagaggggcttctggccaattttggtcaggagcactctctcttacagactaagagtatttaagggtttagggtgagagagcttatcacaggcttggaatatttctgcttggaggagaagtttattacagggttggaatgtctctggttggaggggaggggttatcttggggctgacatcgctccggtcagagggaaggttatcttggggctgacatcgctcggtcagagggaaggttatcttggggctggcatgtgtctggtgggagaggggtttatcttagagttagaatgtttctggtcggaggtgtcatttgtggtttgtggtcatgctgacagccattaggctgatgccctctgggttggatttaggtggtttttgatcaaggggcactttaaaatggcagtgcttctgctctgtcaatagtaggatatgccaacccaaaatatggcactttggcataaagattattttcgagtcaaaggcacttaaaaaaaaaatgcaaaaagagcactgtggctttcctttttccttcctgaaagcaggagataaaacttccgtatgaaaggtgccctccctgtataaggaggaagggagatgttctcaacaccagagacatggagtcaaagctgagctgtatctgcacaaacttaccgattttcatttccactttgttacaacaacctttatcttcttagtcacttctgcattaactgcactaacccaaatctgtttgttttctcacattttcacaatttactactctttttagccttccctagaaaaatggagactcaaaagcacttagggtccaactgttaatttgggtctccatttttctagggaaggctccaatgtaaatgtaaaaattactaaataaaatttgtatgctttcctcctgttatgttttatgtctctattttacgtcagtggagactaagctctgattttttttttaatcttgctcaaattcctatctaaggggcctagggattcatgccctacaatccataaattctcatcagatgggttttatttaaccctatatattgtgacttactttccaatctgacactggcataacgagacaagaaacaaaatcaaaatattttaccgcaaaacattttttttagtttttgacatatcttgaaacggctctgcaaagctgtcctttgttgggggaaaatctgcatctacatagaatttctattaacatagctagatcattttcttccaggtcctcccaatcctaaagagattacgtaagaatctagcaccttttaaagatctgaataggaaacatttgtcatccattgtctctaagggcagccactataagacttcaaaagaaccttggtctccacaatcttttattttaacctcaacatttcctttctatgggtcccaggtcttcaactgtcaaccagaaaatgtttaaatttacctacagccttggaagcccctgctttgagttgtcccacctttctgaaccaaaccaatgtagttcttaaatttatttgattgatgtctcatgcctccctaaaatacataaaaccaagctgcgccccaaccaccttggacacatgttctcaggacctcctgagggctctgtcacgggccatggtcactcacatttggctcagaataaatctcttcaaatattttagagtttgactcttttcctcatcagtttaattcttaggcccagccaagaccccaagaggggagaggaaatattttcactttccctacaccagtgttaagaagcccaagaacgcaattcagagggcttcccaaatcattttgaagaatggtaacatctctagaatatcaattagatcgtaggggagtacataagtcatgtgtacacctttaggtgtttgtgaaaaccaaggcatataaaatatcacattatttggcctcagtacattcccatactgacaagcactgtaccatttttcccccgctctaagcaagggcttcctggggggaagagtctgtggttgggtgttcagaagcagagagtgctctcccaaagctaaacgatgccgccaactactgtgaaacttaacttcccctctcccggaattctcatggaagacaaggtctgatcaaccgagggcttaagaagtatcaaattggaactcatggaatcactggcggagctgatttacatatgagaattcctaagcctcacagcatagaaattttcatgccagatggtcctgaaaaagttgttttaattggctaccaaaggtttaccttgcaaacaccaagttcttaaagattacaaaatctaataaagccgaagtgtgaattaaacttaaccgcaagaggagtcacctgcggtcacctcgtttcgcccacaacaaagatgtctgcgcatcgcttaccgtggagccgttccagtgcgtgggccacgcgtccgcccttttccgcgtcacatgaccacgaacactcttccgctacggctcccagaaggggccagcccgcgcctttcgcgcttctgccctggccctctgcgggccgctccgccggtgctgtccctgggcgcctccgtgctctcagccaaccacctctgagagcgcccactcgagcgccccgggagccagagggcgggggtcctcgccgggaccctcctgtgggcccaggggtgagtgttgacgtcttcccgacccgcgacctgccgcccgagctggctgccaggcctatcgccgccgccgagaccctccggccaacagggacccgcggtggccccggcccccccggtagtgtctccctgacccgagtcccgtccccgggcctcttgccttcaaccctggtctttcctcctccccgggaccttgagtccccgaggagagcgagggagaggagcgtcttctgcaggtgtttttgggcgaacctcttcaccttgtgtggttcggcgtctccttttgtgtattaacccggacttttccgactggaaaataggggtttgggaagcagcgggagtcccgtgagcgtgaacgccgggctttgcaggtcttcactcatccttccctgccaaggccctgacaccttacaggctgaccttaaacctgccttgtttaaaaggaggtttttgtgttgttttgtggcaagtacattttggaaaagaagggccttgttggaagcccaggttgtggcatcgcgggtggctgcgggccaccctgtccgtctgtgagcatccctgctcgcagatgtggctgcaggcagttgctctcgggtttccttccaggagctgggaagccggaggaaagctgcggttcctgttccgccgagcttctgaccttcctctgcaggacgtgtgctactattactatcgtaaaagaacacccctgtctacctcccacaaagttagaagcaaagggcattctcgagggaagagcaccctttcaaaagtgacatgttttcattggagaacattaaaggggaaaaaaaaaaaaaaggtttctggcccttctgcccaaatatagaaccatttgtattcaggcctctcatccaccgagagacttaagatgatcacaaatgttttgtctccctgcgtgaaaaacattttttctgcctcaattccgttggctaatgagagcccaaaagaaaaacccttaggaaaattaggacgatttagttatacttagtagtcttttcccatgcaattaaattgcttgggggaccttctatcttttggtttcaaaggcttgtatattggttttgccattttttccaaaaggaaattgtgttctctcccttcctgtctgatagagctgcctcctttcagaattgcaaagtttagtcttcgctctcctctcttctggtattgaaacttttctgtgggttcataaccttattttaaagttcattaatatatagttttaaaagtttgcagtgactttttaaatatagtttctttgaaaaagaactgaaacagggtgtgcagagtggcccatctgtgtgaactaggtccacgcagtaggtaataaacaactggagggttttttttggtttgtttttgtttgtttgtatgtttgtttttgaaaagtacataaacatttgcaaccacagtcagtttgactcaagttgtttcggtgacttccgaggctttctgggttccagtgttctaatacagaaaatgagaaagttgggctggaatcattgtgtcccaaaattggtacactttccgctagtggcatgtgacttgactctaggcggtacgtggatgaggatttttttgtaataggatgtttttgcaatctgtatttatatatgtacagccatggtttaaggtagtgatacaaaattttcttttacaatacttttttgattttaaaaagtcgagttaaaaaaattaactgtagcaaaaagttaatgtactctgtgaatatgggaaaaaaaaaacccatgaagttggcaagttagttactggtgtttgggaaccactgggcttagaaagtagaaatatgaaatcatctgtgattctaagagagattttgcctcgtttgttatgtaacagaatcacgtactggttgcctactggattctaaggtacaaaacttctggaattaacatatcaacaccaaatgagacgtttatttattgccaaaagatattatcagaaatgccacagtctaacgagggagaaaaaaaatcagattttgattggttttaagcagaaaacccaataattgggataatacagtgttaaatcttagtagaaatccagttactttttaaatgtaagtagttcagctacaggagaacttggctttttccagaagttggcatttcagcatccacctttattttctaagtcactagttttttacaaactcagatattctcgtaagaaaagatgttgctatagaatggaatatagtagtgagacctatgagatgtactactagaaagttcgtaagactgaaatgcaatgaatggaatgcagagaaagcacatttcaaggagatactgaggttctagccacttggttctcgtttattattataaaacttcaatttataatggccaaaggctataatctttttgaggtagcttttttcagtgttagttctgaatatgagcttttgctatgcttgagatacacgcaagtattagaagagcatctcatctggaatgatgcacaaaaattgattataaaggttgcctgtgggaacctgggtggttaaggataggattgaaagtgggacacttccttttctctgtatagcttgcgtactttgtaccgagtacatgcattactagttcaaaattttaacatcgtaagtgaatgaaaatttaaacaggccgggcacggtggctcacacctgtagtcccagcactttaggagacgaaggccagaggatttcttgagcctaggagtttgagatcagcctgaacaacataataagaccctgtctcaacaaaaaatacaaaaattagctgggtgtggtggcatatgcctgtagtcccagctattcaggaagctccattgcaatctagcccgggtgacaaaaaaaaaaaaaaaaaaaaaaaaaccaattcatttgttcttctttaacatatatgtgtacctatatgcatatatatacgtaagtattagattcatttaaacttacgtatttttcatctgccacatttttctaaatacaaatcagaaacaatgacagagctagtcttttatattgccttaactaatgaatagttgtaggaccccatctgtggaactaagattggtggtaagcttaatttttttctttctttattttcttactggtctcttgatgtcaggttgtgcatctttgtgactgttactatttggagaatttccagtaatgaatccctaatagtggtttcatctagtttctcaattagcccctgtttttcttccccagggacaaaagtggctctcaatccagcacatgcacattgaagcaagttaaaggatttaatatgaagcacagaagcagatagtgccaaatagcaagcagtagttgttacacatttgtgagtaaaaatggtcccttttggcttactttcttagtctttaaatcgtctgcatgccaaatccttaaagatctatgtccccagagattttttgataaagaataaaagatgtgagttagcagtcatagtcaaaccagttgctggggctgagcgtcctgagcaacctctaagagctctcctaggcatctcagtgaggcgggggcttagggtggggctatatctccagcatggagtttaggaaataccttagccatggtaaagtcatgtatactgtctttaactttttatgtctttaatttatatatagtgtctttgctgaaaatttagtgtaatttccatttgaagtttaccctaaattttgaagtttatttttatttaaagaaaccattagacgtcaaatatgtaggctgcctcagttacatttactttttaccctttgtattcccttcatgatttattcatttgggcttagtcttaaaaaaggatttttcccctttggagtataatgattagaggagttttatggcagtattgttttcttcgaatctgacttcacatttgtatatacatttgatacagcttctctgtatcctgtttgcaaaatcataagacagtgactgtgcttacaactgtctttatgatttttgaggtatagaaaaactcttcttaggatagatttaacaattggtttctcaaatcaagccctaagccatgttcaaatccaaaagtcattttacgtagatatttacttttattcatagttttcttatgaaatgaattgttgaaatactgatttttattctttcttttttacagctggaaaagcagtgtccgtgttgttatgtacacctccaaaaaaagttcaaatgtgtaggggaattgttgtgtaaagtaaactgaactgcagggtagcagtattttaatagctattatagacctgtatttactgtatttaaatgagtaaaggaacaagcagtgacacatcactaggaaggtcagtgaaattttattcagttgagctggtattataggtttgagagacaatggctttaaagcttactgccgtaggctaaccatgctcttttacatttttatcagcttttgtattggcggcaacattctttctactgcattaaaaaaaaaaacacatgtaaatatgatattaaatacagattaatagtgtaaaactttcagtccctccaaaaatgaatacaaacatgaggatttattattacaaattctaaatttggtattcattgcatctcagtcattaggagaagttttagtttgtatgatgtgattttcagggagttgcatcttcttttttagtaaattcagagttaatgttatgcatctgtcatttaaaggttttgaataacagatgcatttgtcatttaaaggttttattttttcatgcatgacagtaatttttaattttatatttttaaagtccaagcagctttccctcaaattgatgaggaaattttaagtttaaattttattgcaggcatttttttagttacaagcagcatgcatgtttacgcagagagtatgtgtgtatgtgtgtgtacacatttgtgttgtaattctataataatttaaaaaatttgctcctaagcaatatcctcaaggtacaatttcagctgataattaagaaggcattttgttgaggaagacattttctttcatcttttatttttgctttgtatgtgttcagtacttgcaaatgagaagtttcctttcgctctttctataaggtattgtcttctaacttcactgcgtagaggagactgacattttaacagtcagccctgtctttaaatttttctcccacagggtgagcagggcagcatttccttctcccactgctgctgagatggcagaaattagtcgaattcagtacgaaatggaatatactgaaggcattagtcagcgaatgagggtcccagaaaagttaaaagtagcaccgccaaacgctgacctggaacaaggattccaagaaggagttccaaatgctagtgtgataatgcaagttccggagaggattgttgtagcaggtatttcacctttacttagaaggttgcctgttaaatctttgttttatatgtttctatgaaaacttttgagtttttctaaatgttatttagaaaaggagttggaaaatgcaactttatacttttgaaatttctattcattattatagtctgaattgcaaacagtattttttagtaattcaactaattattgaggttttacacacataaaatgtatacatttttaagtgtgtacttgatgagttttgacaaaagtgaacacccatataaccaccaccacagtccaaatagagaccatttttgttactctgcaaggttcctttgtgcctctttctcactcagtccctacccctcaactctaggcaaccatgatctcctttctatagccagagaatagatttgtctttcctagagtttcatgtaaatggaatcatagagtatatactcttatctgtcttcttttgttcagtgtaatgtttttgagattcttctgttgttgcatatatcagttgttcattcagttttattgctgggtaatatttcagtttggatacaccataatttgtttttccttcatcttcattcgttgattgctttttgtttgaagctgttaggattaaagccactgtgaatattcaggttcaagtctttgtgaggacatatggtttcatatctttaggagtgaaattgctggattatatacaagttattttcaactttgaaaaactgctaaactgttttccaaattcttgtactatgttgcattccatcagtgatgaataagttacagttgctccacatccttgccaacattttgtattgtcagtctttttaattttagctgtttgagtgggcgtgtagtgccatcttgcgatgttaattctatttccctgattattaataattttgaacatctgctcatgtgctttttgtccatttatatatatttgttgtgaagtatctattcaaatgttgtgtcagtttaaaaaattggctgttgtaagagttttaaatattctagatatcagttttttggttatatattgtacattgcataatttcttatttctgtatgacagtgataaatattagtgaaatgtcaatacgctggaagcattttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggcctggaagcatattttgaaagaaactaatgcttattgggtggtataattcaaaagcagaagaaggtaaatacattttaacaaaaatcactgtctttttaaaaaacctcccgcttttctcttctttgtctcttttcttgaaaactcctaggaaataatgaagatgtttcattttcaagaccagcagatcttgaccttattcagtcaactccctttaaacccctggcactgaaaacaccacctcgtgtacttacgctgagtgaaagaccactagattttctggatttagaaagacctcctacaacccctcaaaatgaagaagtaagtagaactttagtatcaccggaatttgaaataatgtagacaaaggtaaaagagaagagcaaagaggctttatcatatctttagcaatatgtcatgaaagctttccatatggaacattactaataattctaatttacaaatgtgccaaataagttattatgctatttttaaaatttgaatattatgttttaggaaaaatgtaagttttgtggtaagtattattaagttcctgtggtttgaagaaagagcctttatgggtaggtgttacttgttaaataataagaaaatgttgggaagtttagcaataagaagtaaatgtatcactttgttataaaatcagtctagcaaacagggcaaagaaaaccctttttcgcttgacactacccattctcgctacttgattaaaagtttctactgagctactctactgcatcacgttaatgtgccagttgacctaaatgtagcagtgtagactaacaaggtgttagtaacagagttcgaatcctgcctttgtcattgacttacagctaacctttgaagctgctttgccgtgatgattgctggggttacatctttttcatatagcttttgaacttctaacatgttgtcatgaagctagtatgagacaatgtgcaaacatatgtttttattaataatggtactgcttgtgtctggtttcattttgcatgtaatactttccaaagagggtaaagcacccatactgtctagggcaatgcaattttctaggattaggttcttagattgtaagtttctgctgacataattgaggtaatatgctcacagttagtttggatattctaggtatttggtgaaaagcactaaatctgagcctttacatgacagaaaggcactaacatacttgcagaattgtattatttaacaaacattttttaacttttatctctgagatactatatgcagtataggaattaatgagacatagttcctgcattcaaaaagtttgctgtctgtctggtttcagcaggacaatgatatgagtgagggaaagacatcaacgcatgcagaagatacaaaattctttaatagcagaaaataatgaaagttaccaagatggttacataaaacaaaagtatccagtgtgctcccagtttaaggcccagctttctaactccccaaagttccttgggaattatacctgtgaaaataattgtcttacagtgacgattttgccaggaaagaaatgctccttattgtattcttcgggtttttctgttggtctttctgcttctcctaattgaaagcaacccaagcaattccctgattgattattttaagagtgagtgaagaaagtttgccgggatttccctcagtagacccaggctttaagactctacggggttcattcctgcattaattgtgatatttagtcaaatgtgatagatgttcagagtgtataacactggggtaaaaaagtttgtgtgagaattagaactaattttgaagacctactttgccatttactaaccacataactttgggcaagttatttaacagttctagggcgtatctctgaaataaagataagaataatgccaagtgcatgagattgttatgagaattaaatgtaatcatgcatgttctaattcgtgttaaaagctcaatatatataaatgttattgttaggagagacttaaaatcctgtggcaggagccagatcctgaaatgaaagacgagtttctgagattaataccagctgcttattgaaagcaaagatgatggtttggacttcaagtttatacaagcttatagaagggtccagtagccttcaagaagcactcaactgcagtgagcaagggaggaaggggtaagggagccagggttctagtagcttctagaaattgactgaaatagagaagcagtaagggcctgagtactgataacattgatgattcattcaggtgttaactcagaatcgataaagtgagatccccagaacatttgctctgtatcattctgcagtggatgctagaatgaggtagagcaatagtgctctacctcagcactgttggcattttggactggaaaattccttgttgtggtgagagccacctttttgcactgtagaatgtttgcaacatttgtgatctctatctacaagatgccattaccgtcttccaagtcatgatatccaaaaatgtctgtaatagcaaaaaggtggaagcaagtaaaatatccatcagctgatgaatggataagcaaaacatcatctagccatatagtaactcttattcagccataaaaaaatgaggtactggctgggtgcggtggctcatgcctgcaatcccagcactttgggaggctgaggtgggcagatcacttgaggtcaggagttcaagaccagcctggccaacatggtgagaccctgtctctactgaaaatacaaaaattagctgggcatggtggtgtggacgcctgtaatcccagctactctggagggggaggcaggagaatcacttgaaccccggggtggaggtagcagtgaaccgagattgtgccactgtactccggtctgggcaacagagccagactctgtctctcaaaaaaaaaaaaaaaaggtactgatacatgccacaacatggatgaaccttgaaaacatgtaaagtttaagaagccagacaacaaaggccatatattgcatttttctacttacatgaaatatccagagtggccaaatgaatgaagacaggatacagagcagtggttgtcagggggttagaggagaggggacttgagagtgactgcttaatcagtatggggtttccttttgggctgatgaaaatattccggaattagatagtggtaatgattacacaacgttgtgagtgtactaaatgccgctgaattgtacacttcaacatggttaaaattgtgtatgttatgtgtgttttaaaataaaaaagaaaatacctccagacattgccaaatgttctctacagggcaagatcaccccctactgaaaaccactgacctatctcaagaaaggagaaggcttatgaggaagcctataaaattgttgtctgaaagcctgattgatgcaagggataaatttgtagaaagcagttgtacttgagttcttaaactggcttaaagaatccaggtgagcccttgaggagggcttaaaacataacataaataatcccttagctcaaagacagtttaaaaatgtgaggcttggctggaagagaggaagttgacaaacactttcaatatgcctaatctccaccaatatttggaaatcagctctaagataagaccattgcttggtgattctgtctgctgggaactaacaaagcaactgttcaataaaccatgtgatctgggcatgaaatacaaaatgcccaagtcatgacagttttcagtgttcctacagtagactaggcagtgtgaatgaggagaaagaagctgtaacactgacattaccagctcttctcaaaaaggaatccgaactggagccagtggggaaggatcttccagagaacaagaaagaagaactgtaaagaaagagttggaaaatgctgcctgtaagaagatttgacacaaccttgaacagtgtgactaagtcaaagatgtggactctgccgttaaatcctatcaatcaagccgtgatatgctttgaaaaaatcagctacaataaaccctaagagctttgtgagaaggccattgaagttggaagaaaaaacagactggtctaaagatagagagtaaaagcttttgcccaagttggcatctcttacttcaaagaggagaaatacgagaatactattcatttctataataaatctttggaagagcactgaaccccagatatacacaagaatcgtcaatagttaggaattaatctggaaagagcaaaatcagttggcatatataaaatctgacctgattttggaggagaagagtaaaggcattgagtggtttcagaaatggaactatctccaagccatgccagctttatacagaagccatcaaatggcatcctccacaggatgccaaattctacagcagttatatccaaagtgtacagccagagctggaggagtagaagaaatatctagctagatccacccttaacacagattatacttagaaagcagcagccttagaatctgaaggatgacacaaaagccatgaatgtctagcagaaggccctagacctgtaattctaccgtaaagaagtagcagatggttattggtgcccagttcaattgatatgacaacgctaaggatgtgaagcaaaaaaccatagctatatgacatatcctaaaacaaatgcagaagggctcccagggactcagtgaatatttaaaagggtcctgtggaagcttagaaaatcaagaacttcatgaatatgggtctgatcacactttggtgatggtttcttgagctctttttccttcctcatcacttctggaaagaggagctgggactgcaatgagcagaatggagcaaaagtctggagagaagaggaaaagctgaattgtatatatgtttacacattcatgcatggaaaattcagagatggacacttgcgttctttgtacagctacagttttatggccctcttagcacaagcatggtctcgtcactcctgacaaattgggctatgtgtccttcccaaaacccgcagtcactggcttaactgttctccccatgattcgtgattttaaattttggacaatgcacatgttggggagggaagatatttatcccaactgttcagtctacattgataatttgtacctttcccccttctgcataaaagtcccacagaaaatgggggtgagtatagaggaaaaacacgaaggctctgagtagattcctgaagaagaggtgggctttgaacagattgagagaatcagccatcaaaaaacctagaggacatttacttgcccaggaatttatgaacaatcaaatttaacttggggtgtaagcatattaaaggagaattgtatgcaagcatgcaaagtgtctagtgctacatgttatataactatgtagcactagacactgtgacccaacttccaggaagctgcttgaacttaggaaactatttctcagcctccgggatgaataaaactaagtgcataaccactgaaggatgattctgaaagacattttaaaattctgcattgaggccaggcacagtggctcacatttgtaatcccagcactttgggaagccgaagtgggtggatctcttgaggtcaagagatcaccaagcctggccaacatggtgaaaccccatctctaccaaaaaatacaaaaattagctggtcatggtgtgtacctgtaatctcagctactcaggaggctaaggcatgaaaatctcttgaacccgggaggcagagattgcataagccaagattgtgccactgtactccatcctgggcaacacaatgagaccctatctggaaaaaaaaaaaaatctcagattgaaacaaaacaaacatccaggccgggcatggtggctcacacctgtaatcccagtactttgggaggccaaggtgggtggattacttgaggttaggagttcaagaccagcctggccaacatggtgaaaccctatctctactaaaaataacaaaaattatctgggcgagatggcatgcacctgtaatcccagctactcgggagggtgaggcatgagaattgcttgaacccaggaggtgtaggttgcagtgagctgaaatagcaccattgcactccagcctgggggaacagagtgacactctgtctcaaaaaaaaaaaaaagaaaagaaaaacatccacctgggattacaggtgtgagccaccgtgcccaaccaaaaacatcaataaatattgattgatattttgaaaatcttaattttcaagtccttaattcacacactatttgtttttttactataaagtttaattttttaaaaaccataatgtcggccgggcgcagtggctcacgcctgtaatcccagcactttgggaggctgaggcagccaaatcatgagattaggagttcgagaccagcctggccaacatggtgaaacaccgtctccactgaaaatacaaaaatgagcaaggtgtggtggcacacacctgtaatcccagctactcaggatgccgaggcaggagaattgcttgaacccgggaggcagagtttgcagtgagtcaagccgagattgtgccactgcattgcagcctgggcgacagaacaagactctgtctcaaaaaaaaacaaaaaaaaaaaccataatgttgccatggctattttagtggggggttttttgtttgttttgttttttttagtatttttgttgggctcagtggctcacacctgtaatcccaacactttgggaggccaaggtgggcagaacacttgagctcaggagttcgagaccagcctggggaacatggcaaaacccccatctctacaaaatacaaaaattagccaggtgcggtggtgtgtgcctatagtcccagctacttcagaggctaaaatggaaggatcacttgagcccaggaggctgaggctgcaacgagccatgagcatgccactgcactccagcctggatgacagagcaagatcctatctcaaaaaaaaaaaaaaaggtattttcaaataagcagaaaagttaatgattatcactgttctagttatccatttctgtgtaacaaatcatcttaaacttagtggcttaaaacaaacaagcctatgttttgctcaagcattctgtgggttaggtatttgcagttgccgtgaagggaaaagcttgtttctgttcttcaatgtctggggcctaagctaggaagtctcaaaggcaaaggataactcaacagctggatctgcagttatctgaaggtttgctcactcacatgtcacttggtactagctgttgtctgggacctccattagggttgttggcaggtgcacttacacatggcctcactgtgtggctacttggccttccttgtgtcatggtgccattcttccaaatatgagcaacctggggaaagaaaggcagaagctgtactgttatgacctagcctcagaagtcactttgcatcatttctataggagtcaccagccctctgaatttcaggggaaagaaacagatcctgtctcttaatgaagaaggtcaaagatacatttcataagaagagcatgtgggattagagattgcagccattctggaatgccaaaaccattaagctagatacatttttagtctagttttcaaatattcaaccaaatcttaatttgttacaaccgtagaagccaggaaggtttatttataatacagatgctctccatttcctatatgtgcctgtaaacacttttataaattgttcttataaataagtatataccataaggttaaacaaataataattgtaccaagtaaaattgatacttaaaaagaaactagagtagcgttcttaaagtaaatagacattcctgtttatctgcattatagtaagtagggtgtgtgtgtgtgtgtgtcttgttttgtttttaaagcaagtctgtcagtaatacactgcctggcagcaattcttggttgccttttcttagttcgttgtaagttttttgagtagccttgtatcgaggttcttttgatgctaagcagctactagcctactaagaatatttctatttccttccctctctttgtgccttaacagatccgagcagttggcagactaaaaagagagcggtctatgagtgaaaatgctgttcgccaaaatggacagctggtcagaaatgattctctgtgagtagaagcactagcattttatctcgtttgtaagttttctcaggatattttctgtacccatgtttttctaaataattacttcatgtagtttttaaaatttgttttacatcaattttatatttttgtaatactttttgtaatcttaaaatctggccattttgttggtcctgagaatttttcagtcaccttatcctttcctgtgtagtatgatttgctaattaagttgtcataagatggtgaactggtcctttccagctttgcttctaatgagctatgttaaacagtgtagcaagacaaatagaatttttttctttccaaaagtattttttagctttctcccttacgattcattgaattttttggtccttttcattttcagaacatacaagtatgttgtttaaaagactatttgtttaaacctttctttttcatttggttgtattatcaaattctgatcttaaagctaccacaagattattaatgtcagtgcttttttacttttttattaaaattaatggatttttacaaacaaaatgttcttcgaaaactggtcagaattttaatcagaaagtcattgtcagtagtggctttttaaatataaattaatatttcttcctcattaatgttttggccaattttcgtaaactcatgaaccacatgtgatggcaagtatcatgtaagcgtctgtggaaactgaaagaatcaggagatgatacatctcttctgagagctagcaaatctaaatagaagcaaagcatttaattttatttacaaaataactagaggacaatacagtgatttatattacagcatattaatctctagtttggacctctctaaagagtataggggtacagaaggggttttgttggggttagggtcattgatattaaaggtagagagaggttttttttttttcaaatccttgctttgaaagaacaaggaagttctaatttctatataaattatttgcttgccttactgaaattccattctcttgtgttaggtgaaaggagaactaaaactgctctgatttcttatagaatattgaaatatctcctaaggtagttaaaattattctgaaaggctgtgtaggaagagagcaggttaaaatgaatatatatctccttcagggaatgcttatgcaagattcaaccattagtaatataaaattttttgattgtgttttccctaaaggtatctggttagcagtgatgtcagcaggcccatgaaatccattttttctagactatttccaaatgtattacacaaacggtaaagaggctgtatcatttatggctaaggtggcttcttgatctgctttagagtgattaaacatacactcaagagctttaattattttctttttgtaacattatcctaaggcaacaaagatttctagtaagcttttccactttataaagatgtggcttactatttaggttcttagctactttgacattttatattaataaaaacaagattattgtaatatagcaccactcttattttttctcccgaagtatatattatttatagctgcattcagctgaagagaaaggaaacccctttattatgtacgaaaaccagtccagtgaagtataatttagagtagatgatatagatgtttttgtatttactcaataacataagttcctcataacagaaaagatttacagtgttaactaatacttgattttctttttttttctttaagttgctttaatgacattttctaaatttttagtaaaactgaaaatctcatttttgatagtaaaagtaatgaatctttatacattttcacagtgaaacacttaacattgcttaaccatatttttcattatggttgtaaagtatattaccatgttatgtatgtattttgttaataatgtaactttgccctttcttttcctactgttgttaattttataatttacaatttatctttaagaatctacatcttactaactttagaattttgtataatgaacatattattcagtgttgttaacgtagtgaggaaaaaacaattgatataatacctctattaaaataattattaaactcttactatctttacctactttagtgttttctttgtaacatgaaattgttgtgcgtcatagtgcatgaaactttgcctgtctccactttattttattccatggctttaagaataaaagtgcgaacgggtatgagagcaggagcactagcctttgttttcttaattacttcgaagaggcaataagattgtggtcagctattagcgcaaaagtgaattctaaacagtaaaatcagatctagctttttctttgtgttataaaagctgaatatgtaaaagaagcataattattatttaaggtggcacagatcagattctgccccaagaaataaaatttcaaggttccaggcaccgatttctgcaccggagtacacgtaagattttatctgctctgcttttgacaagtagttgttttgattttgaaggattatgttaatactaatctattcaccaggtaattgacgtatgctatcctaattatcttcctgtttggctttttagtacctctgtttcaggatttctcaaactgtcattatatgctttattaaggaaaaaaaaaaactagaccatctaaggaagttgtatatgattttgcatgtgttggtgaaaggaacctgaaatataatatgcacataaggaccaagcatccttttttgtttattttgctttggttggtataatagttctcaacagattcaacgtcacctggtgcagtgatcccaatttttttttttttaatttcagcgcactgtcttttcttcttctatcttgtttctgaaggagaatggagcataagtgtggtttgtcatttattttataatcccatagatgaaaacgatgcttggaagcacttttttgctattattaaacccactctttccatgtgacaaaataaggtatgagaatgactcactcatggagcacaacgttttggtatataatacaggtattcaatagctaatacacttcttaagcaacagaagaaactgcaccgaaagccaacagttttcctcttattctggttctattattatgcttccaggaactattcagttgccatagatagtggcaatatattaaaatttcctctgtatttacaattccaagagaaattaatatatttgtgttttagtgaaaattttttctctttattgttttaccctattttttggaagagtgatacctcaccgaagaggttaaattcacaggttgggaaacattattcctatgaaaactcaaagaggtacttgattttgaacttacttttaataatgatatagttatgccaagtaaatttttatttaaattttaattctgacaattggctggtgtttttttggttgttttgtttttttcttttgagacggagtctcactgtgacttccaggctggagtgcaatggcgtgatctcagttcactgcaacctccacctcccgggttcaagcgattctcctgccccagtctcccaagtagttgagactgcaggcacatgccaccatgcccggctaacttttgtatttttagtagagacagggtttcatcatattggccaggctggtcttgaactcctgacctcaagtgctctgcccaccttggcctcccaaagtgctgggattataggcatgagccactgtgcccagccctggtgttgtttatgtaactcttatgtgataagatttcatgtaagcatgaggtagagctattactaatgaagcatggtaaacatcagtgctttcttcaaaattttctaatcttttcttttaaaaaggtaatgttgagactttgctattttataatatcactggaatcagtttatcaaattgcatttttattaaattactaatatatatataatgccatttacttaatcttctcagtgcctttgcagtatgtttacttttttattttccacaatagttcacttgtcaaaactacagaaacaggaagtcattaaaccttggttgggtccatgagtggacggagatgaaagcgctgtttccctccacagttgatagctgtggagtacattttagctcctgtcaaactgattgctaaaatggagcttattcttttttgtttttacatttatttgtaaaaaataccaacaagactgcttaaagttttaaaaaggaaagacaattgctaaattatttattgcctctaattactaatgtagttttggcagtcttaatggtgatttatttcatctgtggatggaattaaatgttaccaaacaaggacatttaatctatacaacactggcaaaagtagtcatcaattaaaaaaaaaaaatactcccgatttcgttttttgtttatggaggattgccatacacatgaatgaaaagctaatttttttactaatctttgaaatgttaatttcttttgagaaacaactagaacctcaagttatgtttttgatgctggtttttgaggaaataaatatctttactagtattgataaaaacttaatttcatcttttatctttctacataagtatttttcatgttaaattataactgaggatcatgtaaggttttttctcattgtattccaatttcatgtgatcgtaaaatcttagaattgagagagatcttatagattgttttagaatccaaccttctgcattccatcttaggaactctttgcagttagtctgaagtaagtttatgtttgactattttataagatgacctcctcatttcctatatatggacagaaaatacttgtacttttacagtttaaataaacaattcattattgtttgtttctggcaaaaggatttctcttagaggaagtaacccttcttttattttaatttttaatgggccaacatccattaagtttttttcatggatttgagtttagttcattcatactgttgccccaagattataattctaaatattgattattgtagcctttaatatgttagtatatagctggtttatttatcagtacagaatgatacacaaagtgttcaatttaaacccccaaatgcaaaggcaaagtacggatttgtcctttaaaacttgcttgagtgaatttaggcagttaacgctggctgctctatcaagaagagtgtaagatggattgtttgtttatgttgatgtagaactgaccattttttaattctcacaagcagtaagagcttcaggttttcccagtgctgcctaaagagaattctgagtgtaagactaacatatagttttgtttcacaaataggatgttttttttatttgtttgtttgtttgtttatttgtttttacccttctggaatgcctggtatgggttttgccaattaccatggatcagtagataatgttggcttatatgtattcccagagattgccagtctctggacggacatttaaggtcactggtcatgagactgcatctgaaaatttgagtttatcttgacaccaaatttgacctaaatcctatagtgaatcaggcttgatagatagttgctttatacgttaagatttggcttagatcttttaagtaatctttgaaaaacatggttttcatattatggtacttctgtctttggatcaccaagccattcaaagttattcataaagctgtggaggagattttgttttttaattttctgggactctgggaataatatcagatgactataactatcctgtcaaaaattatcccacttattttgtagtttccaaacaaatacatgctgttagaaaagattacacagtcaaaataagagattttcttttttcaattgtttaccatctgctttgtttttattctttcagatgtaatacacattggatgacatttagcctgatgttagttttgccttgacgttgagaatgttgagccctcattccactgtcgtagtctgtatgtcagttaaatacctcacaatagataatcatactgtaatgttaaacagctccctgaaaatactgacacagatcttaagagtttaggttagaaccataagaattggttcattcagctttcagaaagcactggcaggggagtcaaatgaaattgtgaatctcagcccacacatgaaagaacgattaagattattgtcactaagaagcccagaaatggttatcagccattgataatttaagaagtgtccttgccttcttttgctgtattcacagatttgggaatatttttatgctttagtcatttaactagagaacatatgcttactataattaaacaatcaaaatgctttgttaccattttctaagactaattcatccttaaatcagtgtcatttattcgtcataaacttcaacttcattggctttacgaagtgtttgaaatggtgtttttatggaatcacacttttgattcatgtgtttaaactttgacatctgtatgtgagaattccctgtcctactcttctaatcatccataagtcgacagcagtgttgtttcttagaagttggtttattgaattggaatataaacacgaagtaaagaatgctgcttctccatgggaggggttgaacacattcattgctgtagttctcttccctctctacagttctttcatattcagtttatttattttgatgtttagggttacaaagttataagtgctgccttgtagctagtttttggaaacaattcaaaatatttattctttgactgttttcttgtggggagagtgaagggtgggaaaggggcaagaacactaagaaaattaagataaagactgctcagctgaagttttataaaaatctgacttgagtgtttttctcttcatttgctgtgcttgtgtaaacagtgtgacaccatcgccacaacaggctcgggtctgtcctccccatatgttacctgaagatggagctaatctttcctctgctcgtggcattttgtcgcttatccagtcttctactcgtagggcataccagcagatcttggatgtgctggatgaaaatcgcaggtgattggccatccgtgactcttgacagctttattgcatattttttggcctcttgtttagtggactgtggtgtctttcttttctgtttttaccttctagcctctttctaagatgcaatgatttgaaacagcttgctttactttcttttaatttgaaattattgtccaaaattcacatttcacaagattacattagctttccttctgtcagggagagtatacatagaaagtgtagtgatttttttcaaaggcttttctagcctactctaagtacttgattccacttagggatatgccaaggggccccgtcccattggattgagtgttagactgaagtttactagtcctcgttagtcttttgatttaatcatttatgctgctgatatgattggattaataaagcaaatctgaggaggtgatgtcagcgcagctgccaggacacttttttcctttcctctcagctacggatttctaggcttgttttgaaaattccaggtgctatcatctttttgataatactgatatttttcagtgttgataatttatctcacttttgaacatctccaggtaaaatcatcagtagtatacttagacttattcatacaaataatttttttgcagttatctcaagtactttttgtccttgctttattactacataatgttttaaaggaaattcagggagcttttttggcatagtgtgggaaagatagagtcaatttcatttcaactctgaacatttatctagtggcttctggtagtcagggtttgaattttcatgattatttaattgttactttttgcattttgaagaatttcacaataaattaagctatcccttctaataaatcctgtttcttaccttaggaacgaatatgacttctgacttgcactggacaaactttttcttgttgagtgcttgtagtcctcacacaggccctgggtatgtcaccatacttcgtaagcacctgtccatgctacttatcattgttgaatccagggcctttctgagccttcccagagttgacctagtgctatgcatttgggcccaaggactgaaagctgcactaagaagagcttaaaaagaaagctcatggcatgagggtgtggggaggggaattatatatacatgtatatgtatagatctgttttgtttgtttttccccaagggtttagactcccttttatgctttttgaagcttcaaagccattcttggactattgggaagctgtaagaagcagcaaggttcagaacaaaaagcatggattcagggagtcagttagaattaacccggatccaccccactacatagctgcatgatggccttgaacaaattgcttagcttcttttggcctcacttttctcatctgttgagaaatagagaggaagggtaataatatctagctttgtgaattcttgtgaggatcttctcccctcccccacctttaattataatatagggataatggcctccaattctttatttagtatggtaggagatctttcaaacgatattgcatataaagtagctggcacttaagagctaatatttacaagggcctgttttctcttccctccttaaaacagatttattgtccatcagctaacttgtttaactttttaattacaataagtccttagtggagaccagattattaggtgcgagtatatcatatcaaatgctattacatttaaaatatctgaatgagagagatatttccaaatcttgtataaaaagtaataatagctagatggcagagtcacagtacattaaaattatatgtcccaaaaagtaaaaaaagaaaaaaaattatttgtcccaattccccctcaccagcatatacacagttcattgcaataatgtggaacttataaaaatatggattttttcctccataatggaaaaaaaattgtgcctcagagtcaaatgtataaaatcaaaaatcgtattagtataaactttgtatttttttaataatgaaaaatatttttggactttcagtgaaattttatttcacttttttacattgtgatgaattgataactctaaaatcccttttctgggaaggaattctcttttctcattcatttcagtaagtttttaaaagttcatgaaggagttatattaataatgcttttctcctagatctgtagcattagttgttaccttggagcttggagggttagattctcatcagtcttattgacgctttcagtattgaaaggattttttaaagttgtattcacttaggatctcagtgttgagcaagattttatcagaattttaagtgccaaatcagtttttatttcctttgtgagaagtatctggcatgacttttcagatataagaaataggaatgtgaaatttggataatgttctacttgcatgattataaaataatactgcttataaaattttaagtgcttctatgttccttgctctgtagatcattttttcttttctattttattactcttggctattatgctaatgcaataccttatctttggtcatatgccatcacattaggtgtagttaatttaaactagaactatttggcagaaaaagaaaaaagctttctgcttgctttatcactatgaagtaatgcagattcacaattccttgacataagaactgtgttcagtttacattttaaaggacgctgtcaaaaggtttgtgtaccatatatttttttcttacaagaatgtagatgatctaaaccaaactcaacgtgaaaaccaagttaaatcctaggtacatgttagaaaagtttatttacacaggtgagtgttacgcatttggagaactgatacactgaaaatttaccaaagcaccaggtgtgtcatttgctcaggtgcagcagaaattaaaatactattatgatttggtccttaactggttagaaaatgccggtctctccctgtatctgttagagctatgtatctcattttacaatgtaaaatattcgcatcttcaaaaagaaacttagttcctgtgtaagaaccttatttaaatattgatagatgagtcatgcttagctctcatttttacgaggggcttgattatttttatgcagtttttccttaacagattgtaccagctttgagtgcatagaataagaaaccaatgtatgaataatttatatttttggcaagtatccctataaatatacagcttggaagacctagaaatccagagttgcagtggatacagcgtttgttatttataatttttctctttaaaaaagtgtataattcctgatccccaattaaactttattttctgtagcagattacatttttatagcaaagaaacacatattctgttacgtcagagtgtatttactcaaaaaatgtcagtacgcaagttaatggcggagcttggtggtagccttggatttctttcccttttgccactctacaaaacatactgttgagaagattttatgtattaaatcatacttatcgtagaaaatggtacttgaatgaagtttctaactttgccacatacctgtctaatttacttttacaatatatgtgtcaattgccagtgtgagaagacaaaatgaaatacgttgtgaaaggtaactgtattattttctggctctgcgttataaaagggaaatctctgtggtggaataggttgaatatgacagacccatttgaacatactgtgtgcattttaaaaagctttaggaagcacacagtgatggcttcatctagttaaccattttcatgttagtgcaatttaagattgtagttaaataacaggtttcctaatgccacagagtaaatatgttagtaggatgagatgagttaaagacctgtcttaagcatatgtgatttctccatgttttttagccagtaaaataaaagtcaaacatgttcccccaaaaagtctctgaatcccttatcatctaggctccagaaatttctttaagcactggtagtacctttaagacatgtagaagttaaacattagaattttcttacatgaattgaattatcagaaaataatttgtattgtagtcaaaattccacagctgtgccaacttacagaaaaaattagtgcatttggtattaaacatttaccattatataattattgtcttgatacttaaattcaggcaaaaccagatcagttacttagagaatgagatatccaaaataggatttaataattcttcaaatctttatatggatccaacactccagtctcctttctctgcttagtaaatattgctgattgttttagggggaattgaccagtgaacacttagaagcttttgttttctgattttaaaagataaaacgtattggaaaggttactgcttatcaaagtagaaagctaactgtcctctagcgccaaagtatatactgagaatgagtggaaatccccaccaagtttcccattgcaccttagtcttcatttccagcagccctgtatgtcactcctggctgtctcaagatcagactcaaattgtggattgcccttcctgtaatgtgctctagcacgtctcctgatctcagcttcagagtggaggcttgcattttcactctggagagctgagagtttgaatgagacacagctgcaacgagacatcaggcactactcaaaattaatgaggtgggagggaaggaagtgtgggaaatggagtttcttgaaatttatgaatacggtttttgagatagagctgttgatatcagatgagcaactgtggtcataccggtgcagctaaccaggtcctgatatgcttttaaaggtgctagtgattttttttttccaactggaagaaaggaattacactttttaagcagagttgtcctctgtcttaaatttcataaagtaaagcaccaagaaaattattttatatgttggtgctgttttgtcgtgtaaatatagattccctttgtttctttgatcaatagtaatgttgagtttatgaaaatgataaaatggaggacacatgagacaaggattttttaaagtagttgagagatattatattgtattgaaatatacaatataatcctatttgacatttatttgtcttgtttttgcttttattttattacttctctgtttcctgattctgtcttgtgccttctcccgcaaaaacctgccttagacctgtgttgcgtggtgggtctgctgccgccacttctaatcctcatcatgacaacgtcaggtaaattttgagacttcgtaattaccagggtaaatgcttggcggaatttgtgtgttgcagggcatgttgcatgtcgtagccatgcctgtgtttgtagctgaacttgtttctacagctttcctcgatgagtacatcttgcttctctctaagaacagtgaataatcagtcatgacatttggccaattagtatgagggaaaatgtttaataattatggtatgatgtgaacagctattttatttaagtgtagtgttaatagtttataggtggtttataataatttacatgctaaaacagaaaaaagtcttaaatcttattttatgtacatcattttaatggttgcctgaattgtgcccagcatttccttttaagttgttaattatctggaatgttacttttagtgtgtgaacaaacctgtctttgtttgtaaggcttcatcttaaattgggagaaatcagcattaacaactccacagtttgggaaggtacatatttagaaaggaaatttagttttaagcatttttatcatctgttgatttaaggccttctctcttatttttgccctttttacactttcagacacgcgtaggttgagcgttcctttcttcctgacacgcacagaggctggcagaatggcacatacaaatacatgcagttcttaagtgccaaaatccccatttagttttcctatagtctggaaaaaatcaaaaacttgttggtattcacagatgctattactgtataattttttcagtcagttttatttaagcagaaatatattgtcggtagcagtagatttaaaactggcagcatcgtttctgtgcttagaagttggtgcattcattgaagcaagagaaaagggaagcattagctgctcattaaaattgaattcatggtggaggaattgaaaagcgtgcctgtggtaatcccttaccactctgctgacttgtttctttttacaatcttagttcagttcattgtcgttttcccttatatttttctctaagtttgtgatcttttatctttctgtcagagtattttcagccagtggtctaacttagcattagagttttttagttctaataaatacggtttttgtttaaaacacaatgtaaagtaacatatttttgttttaaattgaagtatataggtaaaatcttttgtcatatccttatatttctttgcaaatcgagatttcagatatctaaaccttagttaattcaggatataaattgtgagtaatcgctttcatttgtacttcattctgtatgttcagttcagatccctttaacaattgcttctgtttgatttttttcctaattattcctctgttatgtggcctcagagaaagagaagagttttattttgaggatgaagtgaaggaaaagggaatcttctacctttattttttccactaatcatttgtaaacccatagttccagcatctactaacttagaagtttacttctctaactggtataattaccctaactgctccaggttgtttactgtgttctcatgaaataaggagacagttaatgagaaagcaggataatttagccatagaaggaatatttggagatggttgtagattatctagagtcagtacacaccatctattgtttaaggttttttgcatactttattaaagtatttttattacttttaacaatatttaaaacaaaaggattttctgagtagacttgtctttaacatgtctggatgaaaagtataattctgcttcatatccctttttgtgggtatgtactttttgtagtggggacttgctgggataggtattagaatagatgatccatttgccaattctctggactacacaggaataacttttaatttagtttatttatattctgctcatttagaaaatttactatgccattttactaaaataaccatttagggtataaaatacatgtgaggtgaattatgtggttatataagttgtatctcaatgaagctattaattaaactaaattttaaaatgtggaaatccaggcaaagaagaggaatggcgtttgtctttgtttttcagaggtttagtgtcattcacctagaaattagtgccgctttagaagtaactacattggaacaaaaagtacttttttaatatgctttctctggattttgtcttaatggtttttcagtattattttatacacagcattttattcattattgggccaattctggagctaaatgtagtggtaagatgtattcaggagattttataattgtttctgcgggagaacacagtagagcataagtaattggaaataagtaaagaataggccaggcgtggttgctcaggcctgtaatcccagcaatttaggaggctgaggtgggtggatcacctgaggtcaggactttgagaccagcctggccaaaatggtgaaaccccatctctactaaaagtacaaaaattagccgggcatggtggcaggtgcctgtaattccagctacttgggaggctgaggtaggagaatcacttgaaccccagaggtggaggttgcaatgagccgagattgtgccattgcactccagcctgggcaacaaaagtgaaactctgtctcaaaaaaataaaaagacaagaagtaaagaataaaaatggcaagacaagaggcagtgagaagaggtgatgagtctttctttttttagagttagtctactttgtgttccctgctagtgagtctgtgcctatgggcttacatatggacataagtttgtgtaagaattatattttgttctatcctaagtggcagctctcaaaccttttcagccagggaccctttttagcatcgccaatccttctggcttgagaattttctatgtgtttctttagtcaggatttttttcccattctccagtttttagtgccctttttcaatattgtagacagttgtcattttaagcttttttctttcctttattagtacaaattcaggtagtaaaatattttagtaattcatattattaagtaccaattttctgaatactactttgagcattacacaaagcatgatgtggcgtgccatttactctgagttctactttactattcatttgtatttctatctcttatctgcaggtatggcatttcaaatatagatacaaccattgaaggaacgtcagatgacctgactgttgtagatgcagcttcactaagacgacaggtatttagtgtaccaaataagatatatttctcagttatattcatacaatattttaaagtgatagttctcaacattttattattttctctcctgtgggactatcaaactagtaagccatcattgattttctcattttgattaaagatatattaaactaccatttacatgttttgatcaccgtaaaacagtattaccaagatagattaatgtaattctggccagtaacaaagaatctttagcaaaccagtacagccatcagttgcttgtttggcttttgaaatgtggaacaattactttggaacctttgttactgtgtttaataactccattttggaaaccgctccttgcagcttgcacagcatccctgcatacgtatttcctgtattctgtaataaatcctttcttagaactgcagttgcacatgcatattttttaatatgtactcccacagcctcgagtatcacacagacatacacacatgtgaagaaggcatagttggttttctcattgcgtctataccaaatagatatagagggaaattggattaaataagatatttttaggtgaagatcagtaggagaacacaagctttagcaggtggttgttcagccctgggattttcacagtaagggctaacagcaaggatggtactgtcagccagcagcatttccagcagctggggaattagccttcaggcctgaagggtttgggtgccatatcccaaggccccctacagtagattattttattggattgtctcagtaactcagaggtggacagagaaggcggttatgccaggttcaagatgaacaactgaggttgagtgacaagttcataggagaggcatagaaaggggaaggagtcccgtattctttctgctgtggtaagcctgccaaaatgcatactgagtcttttctgccagaataacagtaggtaaccgcttcctcacctcactatgtaatcaagttaggaaggaaatacacccttcctaactcagaaatctgaagaagggaaagggaaaggatgtttaagtgaatttaagctgtcatgaatgacatgtttttctatgtgtagttgtgtttattttgctccaaatgaaactttccatgtttgtaataatacttttgttgacaaattattatactacttactttataagaatctgattgccctattcattaaagcctctatattatattttttgtgtgtttgtttttcacttagataatcaaactaaatagacgtctacaacttctggaagaggagaacaaagaacgtgctaaaagagaaatggtcatgtattcaattactgtagctttctggctgcttaatagctggctctggtttcgccgctagaggtaacatcagccctcaaaaatactgtctcaacagctggaaatataaaagatttgcaaacttctttgtttctgtctctgcattgtatgccattttatagtccacaccctgaaaatgtatttcttccagaaagtctggaggaaggacctatatttgtagaagtaaaggtatattctgtcactcagctgtattcacgtctgagcagttctgcagtaacacctgcttaaaattctccctttgcatgttttgtaaataggctccagttttgttttttaaaaggaatttattttttgcctcatcagtccacccaactgattctgaatgggagagagtctgtagagaattgattcagaaaagtgtctgtgaaagaaaaacaattattttgtcctgtttctcaaacagtgttaagcagttttgttaatagacatttttgcatcgacacttcaacattaacactttcaaagtcatggtctggtgccagatttaagaaactcgaaccacctaatatttcataaccttcttcattaggtacttgtacagattaatttctaacattgcagcagtttcatatgtgtgcaatatgtgcattctttcattttagttttgcacttggttttctataaagtacgtttttactcagttcatgcgtgaacaatttaaaaaacgacagaataaggtacaaatgtagtgtatttaataaactgtcaaccaaagaagtatttgtctgttgaaggattttatttcatcatttgtgcaatcagctacattttgtatcatattaccttatgagtcttcccgtctcagagcaagtaatacaattaatgacctggtaggtagcaagaacctgctgtgcttcctttcagaccttcatcctggtggtggtggctgttggttgcattgtaggtggttttctaatttataatatctataaagtggttcaggtttaaataccttgagttgtgtatacttttttttttttgagatggagtctcgctctgttgctgatgctggagtcccgtggcatgatctcagctcactgcaacctccacctcccaggttcaagtgatccttctgcctcagcctccagagtagctgggattacaggcgctggccaccacacccaactaatttttgtatttttagtagatacagggtttcgccatgttggccaggctggtctcgaactcctgacctcaggtggtctgcctgcctcagcctcccaaagtgctgggattacagccactgcgcccagccagagttgtatatacttttttcatggcagtatttatttgctaattatatataggtgaatttaaatctcaaggctgggtgtggtggctcacgcccgtaatcctaatactttgggaggcctaggcgggtggatcacttgaagtcaggagttcgagaccagcctggccaatacagtgaaaccccatctctaccaaaaatacaaaaattagccaggtgtggtggcaggcatggtggcaatagctgtaatcccagctactcaggaggctgaggcagaagaatcacttgaacccagaaggcagaggttgcagtaagctgagatcatgccactgtactccagcctgagtgacagagccaaactccgtctcaaaaaaaaactaaaaatttaaaagtaaatctcaaaagaattaaaccaagtgaagccaagtgctagacagttttagctctcaaaacttatatttccccattttcggttcagaaatgggtagaattcagttaggtgcaacattctccacacatctttggtatctttcttccaaggcagggagtttggggaaaggcagttgaggaaattccttggatagagttagatttagcatttccgttcttgcttcttatccctctaaaataatatcaagacaaagattcttctctgtacttagaagttttctgacttttggtaatgatgcaactatattaattctagatttatgtataccagaaggtaatttctgtggttatcctccaaattgaaatcacaaaaatgaagaaaaatgatggataaggttagtatcttttgataaacagacatgaaaaggattccacaaaggtcaaaaaatgaaataaaagcaggaatactgagagagaagtgcggaagccctttttttccctcatgattcttaccaaagaatggacacttggagctttctcccttaatgattgtgcaaggggtagaagatcgacttccctacctcaggcaggcaccagctgtaacaggagactcgtgaatgaagctaagaccccaacagacggtgaatgaaaactctgtttacagtgcaaaaggggacaaccaagaaacctgccttacctgaccttgtcacatatctagaagtagaaaagcttgaatctctctaactccaaagttaggatctctattaaacacctgtgtacttcccctaaaaattgttaattactgttgaaatatattttggagttgagaagaacaaattagttcctggttagtataaccagatatttgagctgagcctttcaacaagcagagaaagaacaagaaaatattccaggtgcagatgatagagggagaaatggatacagtcaggagccaaagtcgtatcatacaactaagtatagcaaatatattgttgcactactgaaagtgcacccttctccccacttctagtaattatggttgaagtatgtgcaggttgtttacactttgaaggataacatcatggaagtagtatattttcaagagagctttcctttttccttccttcctgcatgaatgtgtgtttccagctccttaactatagtgattgcccagcccttatccaaaattctttggaccagaagtattttgaatttcagagtttttcagattttcaagtatttacatatacataatgagatatcttgaggatgggacccaagtctaaacatgaaattcatttatatttcatacataccctctacacataacctaaagataattttatacaatatttcaaattttgtgtatgaaacaaagtttgtgtatgctgaaccatcagaaagcaaaaagcaaagatgtcatagtgatatctcagccacgcatgtggacagtcgggttttttgccatcactatcattcctgactctgagtgtatatgctgccaataaacagtcattttttcttaacactttttcacacataaatacttaacattaaaaaatgacacactattaatacagtgaaaaaactgcgttcaagtaactaagcagcacaggggcatcaccagatactgcaccagctgttagacaacagccacaaccaagaacagccacggcaagtttcctgtccccactggcggtactgttggagtaaagattactggacactatttttttcagtgagaagaaacatgagaagcagttgagaggctaggaagtggatcctgtggagacgaggcattcttctcagtggctttttaaagtatttcttccagagtcatctacctcatgaacaatgtttttgtctgagaaacctctctttgcttttataaactgacgtgatttcttgttctgttttgaatacacactgctctagtccttcaagaagcccatcacgtattttcaccatataatctgtaggcactttttctgcaatgttaatgtcttcactattaggatcacctttgattcagaaccgttcagctatttcaccatgggttgatgaacaactggagacccatcatcgatgttaaaaacttcaacatccacttcttccagcttactgacggactctgaaggtatattttttacatatataaggaggtcagacatcatttttttttctcacttgacatagggattccttccaagtcaccaccttgtttatcatcatcactgaacatagttgcaggccagaggttgtgctggacattcagaactgtgtctttagtcaccgtgttctagttgttggcaacagcatatggcatccttcatgctaaacttgttttggaaaccttctgtgccatgccctgttcactgctgctaacatgctattccaataaagtttttatatttactcattgatgtaaggatactctggtcactggctgaattaatgaagtcacattttggggaaagtacatggcataaatattttggggggtgatgagaaaatttgtaagcaccattgctgacccttgttcactagagtacagtgagctgtcttatttttgttttaattacatgaccattagcagtttgacagttcattgagtaagtatcgagtcttcgctaaaagctgagtactgaagataggattcattaattcattcaactaaatgcaatgtttctgctttgtaccaggcactgtactaagtactctttataccaggagggaataaacatgttcctgtacccctggagcttatagtctaatgggggacagtgaaatttaagaagcaagcacaaaggaaaatgcaatcatcattgtgataaatgctgtaaatgaaagcatggtaaaagagtaaagggaaacctagttttcattagacgtttaggaatagcctctcagaaaaagtggtatttgtgctgaagtcaaggataaagagtgctgccagagataaggcaggtgggggtaggaatggggctggaggtggggaaatgagaggcgttgctaaggacctgaagaggtgagggctgatgaacgtggttcctgtgctcctgaatactatagtgatggacgtacaaacacatgtatgttacattatgacaggaatgataatagaggcttgggtaagtgctgacttggtttattggatcatgagcactgggaaggcttcctcaagtaggagatacttaagctaggccttaaggacaagtaagtatttgtaggggtgtaggaagaatgtttttatatagtaaatgttcagaaaaaaggcttataagctcttgatgttactaaatttatttaggcagctataatgtaggtactgcaaattatttctggaaccttaagcccaatgaacataaacaattgaaatatagaaataacattcagaaaattttagatttttagctttgctgttttacaacattttaatgtgataaatacccttgttatcctgttttttaaagattggcacatatagaaaatagcttttgaaagtcttgggtttttctaggtattgttttttaattaatgaataatgtaaacataggaaaataggagggtataatgaattgccatgtacctgtcacctaaatataacagtaaacatctccccgttgcttttggttgaagtaattttaaaacatataaatatgcatttctttttttaaaaatgaggacatttctgtatacaggttgagcatcactaatccaaaaattcaaaatccagaatgctccgagatccaaaactttttgagccagtaacgtaacaccacaagtggaaaattccatacctgacctcatgtgatgagttgcagtcaaaatgcagtcaaaattgtgtttcatgcacaaagttatttaaaatattgtgtgaaattaccttcaggccaggtgttcaaagtgtgtatgagacataaatgaattttgtggttagacttgcatcccatccccaagatgtctcattattataggcaaaattccaaaatccaaaaaaatgtgaaagccaaaacacttctgatcttaatcattttggataaggggtactcagcctttatactataaaaccattatcagacctaccaaaattaacaataatccgattcttctacatactcctcccaattatctctgacaaagtttacatgtgtttagctgaaacatgcctctattctcttaatctataacagttccctcaaaaatatttttcttttataacattttcctgttgaaaattgggccattctgtgcccgctgacccactttttggatttgtcctagtgttccctgcaagctgagaattagatctaaagacttgattgcattcaggttatgtatttattctttaaagaaatacaataaaaaggtcctgtcctttaggcgcgatggctcatgcctgtaatcgcagcactttaggaggctgaggcaggcagatcacttgagtccatgagttcgggaccagcctgggcaatatggaaaacccccatctctactaaaaatacaaaaattagcttggcatagtggcacgcacctgtagtcccagctactagggaggctgagatgggagaatcacctgagcccaggaggttgaggctgcagtaagctgagatagcaccactgtactactgtactccagccttttttgagaccctgtctcaaaaaaaaaaaaaaaaagtcctgtacttttattttcaggatgacttccgttccttctcatcctccttcccttctcctttctctacacacagtgaagaggtaaaaaatttgaatagtacaacacaaaactaattgaaaattctctccacctttcccaaatcaaccactgatatgagagtgttatgcatttacaacgtgctttctacgtgaagggttgattttttaaatcatctcaaagatgactttgaaaacaagtgtacttctcaaattaattcaaactactgatacttacattttattcccattaaactacacaatttgacttcttcgcttagagactccacacagacagccaaggaaaccgatgactatctgactgagcccaaacaggacctccagaattccaacaagcaatagacctaaaaatactgagaagtggataagcctatgtttgttttcttcagaatcgaagtggaaactagatgctctccagccactcgccatggtgtcgttactggtgggtttattgaaaccagtaggaggtgcacaagagtcattgaaaaaccactgcaagttgaaggattctggatgaatgtcactgaaaaacaaaagataaaaatcagatattcagaaatatccctgaccaaaggaaagtagcattgtgcacataaaagaatgagtgaaacgaatgtacttttgaaatatcgtgcccagaaatgacagagatcagggtttctgagcatgtgtccatatactctactagttacaaaacttttattacttatatagcccatcatttaacaagcatctctatggtacatcttctcttaggttgaacggtatgaaactgctgttttgggatgtcagaaatagttgaatgtcaacagtttttcgtggttcaacctatttattttatttattcagatactcttctacttgctagatataaaaactaaggagcctcccctaccccccgccacccccattaaatgagctcagttcttagtgcagaactacagcgtggcgtccgttcttcaaccagatgtacagtttttactgattaaatatgtctgattaaagtgatgtgcctgttcttaacggggctgtggaaaatgagaaacttttagccctaatacatctatctcaagatgattttttgtttgtttactgtagagtaaaatggaatgttcttagggagtttgcattgctggatatcagcaactgacattcaacctgggaaaacaacagtattttcagcacatggaatatgagtgttttgtgaaatgtgtagcaagccaaggatcactctcttgtaactttgctagcctagcccatctccgcaactaggctgagaatatctgagcgctgttgtctgcagagcgtagcctggtgcctggtacattgtgggctgttgtcattccctggggatttaatgtgcatagcatctgtggtagaaatctttaaccctttacttcaagtctattagcaaggagactttccttggctttgtttttgagacacagtctcactctgtcacccagactggagtgcagtggcttgatcttggctcactgcaacctccgcctcctgggttccagcaattctcccgcctcagcctcctgagtagctgggactagaggcgcgtgccaccacgcctggctcatttttgtattttcagtagtgatgcagtttcaccatgttgaccaggctgatctcaaactcctgacctcaagcgatccacctgccttggtctcccaaagtgctgggattacaggcgtgagccgctgtgcctggccttccttgggttttggttcaaaacaaatatgctacacaaaatttgagggactttcttttttaatgtagcaaggtaagggaaaaggagaaaaaattttttgtatgtaactacaaaagtaaattctggttatttgctaaactgagcaggctatacagagaggtaatggattagatagtttttttcttccagtttttacaaattgtgtctagattcagtcacagaatgatgtacttaaaagactaaaatgagccacttattaagtacatgtaactctccagtattacttgttattacatgacttaaaatttggattcattcccatgcatacagtatatttatagcatatctgtatgaatccattggttgctcttccatttaagcctacaggcaaggctctgcattttatttattgtgtttttattaaattttttaaattgtaaatgtaatatttgctcatggttgacaaatttaattagttcagaagtgtagaaagtaaatgttctcttcactctcataaagggaatcccctatttccattctccaaggatgaaagttaagtttctggtgtatatttgcataattttttaatatacatacacatatgtaactgtagatttttgaaagacaagcataagccatttgagatcaactagtccttttagacaatatctaaaagtccttttagagcattgtaaatctaatgattcctccattttgatgtggagttgtgctaactggcgttaatgtactaaaattcctaagaatccgtttgtcccggcagttgcatcaaataaaaacatggcattgttccagtactgcattaatctaatcaaactagttcaactgtgtgagacagtaagcctgtgaaaatcaagttacttacctgatgtttttcaatgaaaattcacaattggcattactgttgcttggagaattacacatgagaggaccttttaagagagcctggatggatatcagcatgcaatacagagcaccaatgactgtgatcacactgaaaagtgatgaaagaaacatctgaaaaataaaatagagccatttgcacatgttatgacatgttcttgatctgtttcaagcttcaggagcgtatacagtcttttttaaatccagtcgccctaaaatcctggatcttaagatcacagtttattaggtgtgaatgatacaaaaaggcagagggcagtctctgctatttgattacactcaataaaagatggttggggctgggcatggtggctcacacctgtaatctcagcactgtgggaggccaaggtgggtggatcacctgaggtcaggagttcaagaccagcctggccaacatggcaaaaccccctctctactaaaaatacaaaaacttagccaggcttggtggtggatgcctgtgatcccagctacttgggaggctaaggcaggagaatcgcttgaacccgggaggcagtcatccgagatcgtgccattgcactcctgctgggtgacagagcaagactctgtcaaaaaaaaaaaaaaaaaaaaaaaaaaaaaaaaaaaaaaaagatggtttggcttgtcactgtctctggaaaatctcaactttcatattcctgagtctcatctgtttcttctgaccactgagatctagttcctccctgttttatgtacttcctacttcatagaatcttgactggatcttaactacgtttatcttcatgtctggtctcttggctcgcaagcgtttggccctgatgctttaagtgaatttggccctgatgctttaagtggccagtggccagcatcccacagtgatcagtcaacagcatagagttagaacaggacttcccaacctcagcaccaatgacatttgcacacttcgctgtggggcctttcctgtgcagtgtaggatatttagcaacatcactcatctctacccactagatgccaatatcatcccccgacgccttgccacctccagcccggttctgacaaccaaaaatgtctccaggcattgccaaatatcctcttggggtggaggtgggtgggtaaaataacccgccggttgagagccactgtgttagaaagattgtacacatctttatttcgtgagtcagtcatgagagcagaagaaggcatggaatttggcataggaaactgaatgaaagttcgtgtttgtttttccaaaaataagctcttaggccaggcacagtggctcatgcctgtagtcccagcactttgggaggccaaggagggtagattgcttgagcccaggagttcgagactagcctgggcaacgtagtaagagcccatctctaaaagaaaaaaaaaagaaggaaacttttgtattgtttcagtgaagttgttagtcactgatgattatttcaaaatcagcagaaatgaagcgagggaatgcttttcctttttctttgctgggataatgcagctcccacagggtctgtgtgttgtgttcttgagacctgccttttatgagtgcagaataaggtggctacctatagagttgtgttgagggatgttgtgctctacatatatcatctcatttaattcttttcataatcccaagaggtagatactattattatttccattttatagatgagaaaactgtgtatcatggagatggacaaaacttgtcaggctctcacagctgggaaacactttaatcactattcttcttccagccaaaagttcagaatgatggatttggagtctacttcaaatcctgattcttccatgctactgtgacttgtgcagttacttaaatgtactcatcaagaagtgccatggtgtttatttttaaccatctatttttttttttttttttttttggagacggagtctcgctgtgtcgcccaggctggagtgcagtggcatgatctcggctcactgcaagctccgcctcccgggttcacgccattctcctgcctcagcctcctgagtagctgggactacaggcacccgccaccacgcccggctaattttttgtatttttagtagagatggggtttcaccctgttaaccaggatggtctccatctcctgaccttgtgatccgcccgcctcagcctcccaaagtgctgggattacaggcgtgagccaccacgcctggccgccatctattatttatatatatatatatatataattttttgtttttgagacggagcctttctttgtttcccaggatagagtgcagtggcgctatctgggctcactgtaacctctgcctcctgggttcaagaaattctcctgcctcagcctcccaagtagctgggattacagatgcccgccactacacctggctaatttttttatttttattttttgtatttttagtagagacagggtttcaccatattggccaggctggtttcaaactcctgaactcaagtgatccgcccacctcagcctcccaaagtgctgggattgcaggcgtgagccaccgcacccagccatattatctttgagttctcatccctacaaaaggcctggctttagaaagtgattccaggcatgtgtatttcccctaaaggggattcacttaaatgattcagcaaaaccattttgtattcagaagcaaaaataagaactggaaaaagggaagaagcaaagaacagttaaaataggggacaagccttggtcaaccctttcccttcctcccaagatgttgcctttgccacttgtctcatgttttggtcttatctaggcctcaaagacaccagatacgacataaaaaccagttcttagaggatacacctatcggaaaagcctatataagtgttttgatatttttgatttcaggaattcagaaatgtctcaggatgtcaagaatgttgtgaacaccacatagaaaagatacaaagtcaaattccaaattattatcgtttacaaagaaaagtgacagggaagggaaactgaaaattagtgtttattgaatacctaaaatgtattcagacaaaaatagactagaactaattagcataattattgtaatcctagataaatatcaaatgtcagaaaaagggtaatttttaaaaatatgaatcttccattatggatagaaatatctggtttgttttttttaagtagtggttctaacccctggccaaattatcttgagtgcttttgaaaaatactgatgcagaatctctggcggccacccaggcactggtatttttttaaatctctttagataattctaatatccccatctgtcttttttttttttttttttgagagagtcttactcatctgttgcccaggctgaagtgcagtgatgtgatctcggctcactgaaacctttgcctcctgggttcaagagattctcctgcatcaaccttctgagtatctgggattacaggcatgggccaccgtgcccagctaatttttgtatttttagtagagacggggtttcaccatgttggccaggctggtcttgaattctagacctcaagtgatcctcccacctcagcctcccaaagtgctgtgagccaccgtgcccagcctaatgttcccatccatctgagaaccattgctctgaaagctcaagctcagccaagcagatttactgtgactgcttgctgtcaatctaccccttccacagggaattgtgagagtccttatgttgcttaatagccatgttcatggtataaagatcatgaattgtggggtgctccagtgggtttggataaaaatccacttactagtgtgctacactggcaaattatttactttctctgagcgtccattccttcgtcaatcaaacacacttcttactttttcccacttaagggttttgagagaattaaatgaaacagcatctctgaaagtgttctgagcagagtgacactccggttaatgaatcttaatttacttttaacttcgttacgactttatacatagtgggtaggcattaaatgttttgggggaaaaaaacctggcagctcctttaatttaactggataaaggcaattgtcattctaatcctagcaaaccagtctgtcattgcatgagagaactgagtacattttccctgagtattttatatacgccacaaaaatatcacacccgagtattatgaaattgattgcagctgtgggcgtgacttaccaatctcctttctttgaaaacctttagattgaggaaaggacaatccacggaagactgaggaagggacagaaggccaactctaaatgtttgtgggacaaaaaaacccgtctcactttttctacttctatataatcatcctaaatagcatgtttcaggccaggcgcagtggctcaaacctgtaatcccagcactttgggaggccgaggcgagcagatcactcgaggtcaggagtttgagaccagcctgaccaacatgttgaaacccccatctctactaaaaatacaaaaattagctgggcgtgatggtgtgcacctgtagtcccagctattcaggaggctgaggcaggagaattgcttgatcccgggaggcagaagtttcagtgaaccgagatcgcaccactgcactccagtctcagcaacagagcaagaccctgtctctaaataaataaataaaaatagcatgtttctaaggctgtggctctgtcagtggagccccactgtgattcggtagatgcgagtgactcagtgtggctttgcttaggtagcaataactgttcatgcacttctgcttccacgccgactgcttcatacttactccagttctgttgttgcagcacgctctttttcttgctgtcaaggacattgttgttgctggaatggcctggaaatgacatcaacaggaaagatgagtattataacttctcatcagaagaaaaaatagtaatcttcaccttccgtttaccaccagttgtgggaaatcaaggctcaaagaacaaaaagggaatttggcaatatccgtggttttgtgaaccttgtcatcccagtttcaaccagaaagattaaaagtggcggcgggaacaggggaattcaagacaggagttttgaagtcttctatctacattcttagttcactctgagtcatctgcagagaattggattttaaatagattaggatgacttatttatacattatttttggaagaaatgtttctgaaagaattggctgcatcatccaaactctgttgtttgtttgtttaaagagtaggggtctcactctcttacccaggccagagtgcagtgatacgagcatagctcactgtagccttgaactcctgggctcaaataatcctcctgccttagcctcctgagtagctaggaccacaggtgtagaccaccacacctggctaattttaaaaatatttttgtagaagcaagatctcactctgttgcccagactggtcctgaactcctggcctcaagaaaacctcctgccaagaaaactaaagatgtgagccattacgcctggcccgatttcccagaaattgtatggattattctggcaaacctgcagaaaagaaattgatggttttgtttgcctggcagttgggaacaaatcattctgtcaccacccactcccactagcctttcttttcccaggatcccggctatcttgctggtttccccaaacttatatttgagaattatttttggttccacgttctcctttctcttcctatatccatgatatgtaatgatctcactttatatattgatgctcagaaatctatagatcgcattctgccttcagggaaatacacgttgccaaggaaagctgtaagaaagaacaccatattctcaggacttgggtttcaatttttagtatatctaggcagcagctacgactagaaattcttactggaaggagttttgtatcattgaagggtggaatgtaattatttccttccgcttgagaaattttaggcgtaggtttttttgccatctcagcacagctgcccttgagtggtttttctctctccttctactctcattctctaacattttcccgagctctggcgaatgccagactctgttacaggcactttacacgccttagtttattccatcctcataataatcctatgaggtaggtgctattattattcccattttaccaatgagaaaactgaggcatagaaaggacaaattactcaaattgtccttctactttcttggtagaagggttgggattcaaaactagtcatttggctgggcgcggtggctcatgtctgtaatcccagcactttaggaggccgaggtgggtggatcacgaggtcaggagatcgagaccagcctggccaacatgaggaaaccccgtctctactaaaaatacaaaaattagctgggcgaggtggtgcacacctgtagccccagctactcaggaagctgaggcagaattacttgaacctgggagacagaggttgcagttagctgagatcatgtgactgcactccggcctggcgacagagcgagactctatctcaaaaaaacaaacaacaacaacaaaaaaagctagtcatttggggtgcagagcccacatagttttttgttttgttttgtttttttgagacagggtctcactctgtcacccaggctgaagtgcggtggcatgatcacggttcactgcagcctcaacacccagggctcaagtgatcctcccacctcagcctcccgagtcgttgggactacagatgcatgccatcacgccctgttagttttaatttattctggggggcatttttttgtagagacggggattttgccatgttgcccaggctggtctcgaactcctgggctcaagtgatcgcctcggcctcctaaagcattgagattacaggtgagcctctgtgctcagccgggactcttaatccctattccacactgactcaagtcttacaattctcccctattcctacctagagtttgttcattctcatcttccctgctgccttcacccttgcccatctcattgtccttccagttactcccactctgattcatttatccaaggccacatctgcctttattcttttagcacgggtttaaagtttatgcctctttacaaggcagctttcctaacaaacctcactccatctgatgatgtactgcctccatgtcactttgtattattatcaagctttgcttacacattgccttgaacaccaccaccctccttatttagaggccacatgtgtatatggctgcctagccaccttggcgcatagctgaaagcccagaagaaaagggaaaagaaattttagctcccaaataggtatcagtattcgtgcactaaacatcttttattgtacacataagctgtactgccttttgagcttacaggacaaatcatttagaacgggaactggcaaactatggcccaccacctctttcttgtaaataaagttttattggaacacagtcacatccatgtatttacatattgtctatggctacttttgtgcaccaagagtagagttaaattgtgtggaagaggccgggcgcggtggctcacgtctgtaatcccagcacttcaggaagccaaggtgggcggatcacgagatcaggagatcgagaccatcctggccaacatggtgaaaccccatctctactaaaatacaaaaaattagccgggcttggtggcacgtgcctgtagtcccagctaccagggagcctgaggcagaggactcgcttgaacgcgggaggcagaggttgcagtgagccgagatcgcgccactgcactccagcctggtgacagagcgagactccgtctcaaaaaaaaaaaaaaaaaaatatgtggaagaggctggtttataaaccgaaaatattggctgaatatttacagtttgccagctacagatttagaaaattaatgattcttttaaaagaaagtgcaagtgtactccagcctagatgacaaagtgagaccctgtctaaaaaaaaaaaaaaaaaaaaaaaagtggattgacattacaacttaaatggataaattgttctattttccttgttgatgcaaactgaactctggtaactttcttgaagataagtttatttcagagttactaaatatttcctttcatgattcacttacaaaggggttttataaagggacaattacttacagtgtataagtcaccaccccaccgacttcaaggcgtattaacacatctttgtaatgctgttactggtgatttgacaactcgctgcggtttcaaccgctttcccattcagagctccggaaattggaggggctctttagacagacactaaaactgtgaatggtgtgtgtgtgtgtgtgtgtatgaattatatataaattttccagataatctcctgccaaaatgagtaattatgagaacacactttctcttcatttcctaagcatatttgaatgcctgagtttttgtaaaattaaaagtcttgctagtcttttgtttttaaaaaggaaagtaatattgttgattttttcttacagagccccctaattgtatttagtttgagaagttacatgattttacaaatgaagtgtggaaaaacttcagaccattaaaaatcctgtgatgaaattcagacttttgggagtcctctaagaacttgaacatgagagtaacacacaaagtcatagctcattacaaatatcaaaactatattttgcagccaggcatggtggctcatgcctgtaattctggcacttcgggaggccaagacaggaggcttgcttgaacccaggagtttgaccccaacctgggcaatatagtgagaccctatctacaaaaaaaaaaaaaaaattttgagacagagtctcactctgtcacctaggctggagtgcagtggcacaatctcggctctctgcaactcctgcctctgggtacaagtgattctcctgcctcagcctcccgagtagctgggattacaggcatgcaccaccatgcctggctaatttttgtattttttgatagaaacgggtttctccatgttggccaggctggtctcgaactcctgccctcaggtgatctacccacctcagcctctcaagatgctgggattacaggcataagccaccatacctggccaaaaaaaaatttaagataagctgggcaatagtggtgcatgcctatagtcccagctactgaggaggctgaagtgggaggatcacttgatcccaggaggttgaggatgcagtgagttgtgctcacagcactgcattctagcttgagtgacagagcatgaccttgtctcaaaaacaatgaccaaaaaaaaccaaagaaaacccacaaaagtatattttacaaatgtttgtcatgcctaatgtcttctcatctgtttaactttcaacaatttgtttttttcttttgagatggagtcttgctctgtcacctaggctggagtacagtggcgcgatctcagcttactgcgagctccacctcctgggttcacaccattcccttgccgcagcctcctgagtagctaggacaacaggagcccaccaccaagcctggctaattttttatatttttagtagagacggcgtttcaccgtgttagccaggacggtcttgatctcctgacctcgtgattcgcccgcctcggcctcccaaagtgctgggattacagacatgagccaccgtgcctggccagctttcaacaatttgttctccattaagacttcaatagttgactttgatgagttactattatctaataagtgaactcaatgaataagcatgattaagatcaggctcacaacctcatataaaataaaatggcctttctgtttatatgttttcaaggaaacattttgagatctttttaaaaatactcgaacaaataacatttgtattgatttttccatttaaagttaaagataattaagtacatcacatttttacttagtcatagttttagaagatgaaaagtccgcctccgttttaagtaagtcatgaagccataaaatgaatatatttcatgatgtaatcaataatgaattccatagtttgtataattatctacttcctgcaaaatcccatttttggtaacaatactaatttgaaacactacagtaattctggaaagatttcaagaactatgaccaaagtgcttatcacaggcagtgatttcttctctattaacttttttgtgtagttactagtatattgaaagctcagtattttgaactagtgagtattttcatggatattataaaggacatattaataaattcctttgaaaaacactttcttccacattctctatctatctgaggatcatgaaaatatacctgtagtctgagccctttttaccacccacctgtttgcttgtgggcatagcctctgtctataaagttcatattggacttttcaaagagttgtctgatgctttaatgacattctataatacagaataatagagatagtctggtgtttatatctttgataatacttactgagggtgataaagtaaacttagctgtagaacgaggaagttcagattctctgaaactgttccacgagtttctataatctttctgtgactcagtttcctggtcacttgactttatggattaatttatagattatatctttcacctctggcagccctgagacaggtgttgaggactacggtactagcactggtggaaaaacagagttttgacgtcagataaatctggaatttcacatccattaggtgaccttgttaacattcctaactttctatctgctggcctataaaattcaagtgataataaatgcacacattattatagagactaaatgagataacaaggtaatgtatgaacccagtagctggcctttggcagacggccaataaatgagcacttatgtccttctgtctgtctctgcctttctctttctcttctctccctgccacacccgccaccatcctaaaatgaagaatacaggagatgtaggtatgtgtcatcgccacctccgactcctttaatgctaatacattttttttaatctcatgggatttgtggcagagccaatttatatctaaagctgcatgtgttattctaagtggattgtcttaactcaggaacttctaggagcttcatggaaattgctatcgttaagtcatgctcagccagctgctcctggcttctggtgtaagcaaatgcaaaagaggcttctactactcaagcagagagaagccttctacagggaagaaaacagacacacggatgtacagttgcttcatgctgttgagttgcaatgtgttttctgtctctcagcctggaagagagcattcatggcagtgtgaagaaatagcccaaaactttccaaaagctttttctttaattagatctttctacctaaagcagaggaacagattctttgtgatggtaaaggaagagtgtttttgtaaatctggggataataccagcagcagtaactgatcataattcagaatcagtgattcaagtagaaaactatgtcctgaatttctttaaaaatcacctccacagccataaaaaaggaatgagatcatgacctttgcagggacatggatggagctggaggccattatccttaaactaacgcatgaacagaaaaccaaaaaccgcatgttctcacttgtaagcgggaggtaaatgatgagaacacatgagcacataaaagggaacaacacacactggtgcctgttggagggtggagagtggagggtgggaggagggagaggatcaggcaaaataaataatgggtagtaggcttaatatctggatgacgaaataatctgtacaaccagcccccaagatacacgtttacctatgtaacaaacctgcacatgtacctctgaactgaaaacttaaaaaaaaaagttaaaaaaaagtcacctccgtgttttattatctctaaaacactgataatatcagtccttacagcttactctctctctctctctctgtcttacacacacacacacacaggcacacacacacattcatttatttggcactaactaaaccccctagtggcataacaaacaaaaacaagcctcttggatgctgaattatcaacttcaacatccacatccccattttacacatatggaaacaaaaccataggataaatgatttgcttgcagtggtatatgggaggcagaaccatagctgaggtattctgccatatttgaaagccgttttccctatacaaatgcgtcctacccaggcctactgcacccagaattctcaggagaaaatccgtaaatctaactattgcaagtgcctcgggtgattcatgtcagttatatttaggagttccatcctgcactgctctgctgcagatttcaacagaggtagacctagtaacaatcaccaaactattcaacaagctcgatgtcctaggatctatataatagctgagtcaaaaattccttgaggccagagacccaggattttaagtccatgtctcttagcccaactcccttcaggtacaggcaatgcagcattcatgcctcgtaattaccatcacccaggctagtcatcatacatgggaatgtttctactcatccctattaagcaacctgtcactcctattgcattttctgtaaatacttagagactggtatggagcaatggaaagttgaaggaattaattcagaaggtccctaactctaaccacaaagcttgaaagagcagccctacctgtacagaaatgtgagagataataacccagccaacttctactaattaatttatttttttgcccagctctctatcctataccacatagtgtactttatttaaattaccattcttcactgatgaccaatataaattaatgccatactactgctccaaattttatcataagccaagacatagttaactgcaagactggaagacagcttttaggattttggtgaaataggcaggcccttcttcacatcaagtcaaataaatatcactcaccatcagacctgctcctataattcctgggaaccaccactcaaagcaagagatggggttttgagaaaattggtcttcctcaactaagctgacaattagaggtatcgcattgagaactactcctaacagcagtagaaccagcaggctgaatccattgcaggatgtccatccttcgcagcaggtcatggtcacccctggctcagaaacgttgtcaaagtggctatgcttgcatggtactatgttgccttttatcccaatcttctggttaaaatttaacgctaataaaaaatgaatagtggaaaatagttcagagtccaatagggtaggacattattatgatgactatgatgggaaatgagaaaataattccatattatgatgaggtgaaggaaggaaagcagaaaaaaaaatctatgagataaatttatgtaagaagataggcttacgataagctcctttaatatactcctttattagtatggcttctaaaaagtaaaaacaaaaatatccagctaaactatattttcctgttctatcgatattattaccagctatggaagtttcttattttgaaattgttcaacaagaaaatgaacacgtatgagatgtggagaaaggtatttcctctgctgcaaatattagagtttatttcaagccgtatgctcacatacacaaaagaaaatgtttatgtcatattattccagtgttgcagactaacccatttagagatagcccacctaagacatgtgagagctttggctaatgctaccagactgaaagatagcaataggagagagattggatgaggagattatcatattttatttaagcccttgaacacttacttggccatgtgcagtactttacatctctagactgtggttccacattgcctctccactagctggtgagctccttgagaaaagactatcagttggcataagctttaaaatacaaaagttctggccagctgcggtggctcacgcctgtaatctcagtgctttgggaggccaaagcgagaggatcacctgaggtcaggagttcgagatcagtctggccaacatggcaaaaccctcatctgtaccaaaaaaacaaaaagtagccaagcgtggtggcacatacctgtgatcccagctacttgggaggctgaggccagagaatcacttgaacctggggggtggaggttgccatgagctgagattgcaccactgcaccccagcctgggcgacagagggagactccatctcaaaaaacaaaaacaatacaaaagttcttgcttatgctgactgaccatcctgatctaaatggggtcatggtagttactgaaagacctagacttagacctagacctagactggcagaggcagcttcttgatccaggcttccacagtcacagaggcagggtacaaaaatgtggtgagccacatactggatctatatgtttctgcccagaagcgacccacatcacttctgttcacatttcattggccaaaaaagtcactcagttatgcatgagttcaagtgggtggaaatacaaaccaatatgtctaggagaaaagattgggacattaggcagctctaatctctacagcgccttccttctgcttctgtgtaatcccccgctcagcccagagcatagattcagtgagtgctgttgggaatggtgaaataatgtatgcagcggtgcagtcagtgtgggccaaaagctcaggcgtagtaggcttagagagcagcgctccaccctgcagcagtgtggggggcgcacacagcctggtacaaggggcatccctggtaatggacaccaaaacagtagctccagactagggggtccagttactggacctcagtgaaatgtgaaatcctttgtatgaaaggatttgtataaaaggattaaaaataacccacctattggctgggcatggtggctcacccctgtaatcccagcactttgggagggcgaggtgggaggatcacttgagcccaggagttcgagaccagcctggccaatatggcaaaaccctgtctctactaaaaatacaaaaaaattagctgggtgtggtggcaggtgcttgtaatcccagctactcaggagactgaggcaggagaatcacttgaacccagaaggcagtagttgcagtgagccaagatcacaccactgaactccagcctgggcaagagagtgagacgccatcttaaaacaaaaacaaaaaacacccacctatcaacacaacacacaaaacaccgagaataactgaaagaatacaactgggttgagagacaggagacacttccattgtatggtttatatacttctgcatggttgagatttctactataattatataatattctaaaaaaatatattttttattttataaaaattaataactaaaatttaccctcccactaagtcatataaattatctcattctataactatatattataatacataaattatatatttattactgacttgaatgagtgggaggtggtagttacttaccttagaatgtgggttgtgccatttcaaatctttttgctgtcttcataagatgttgaattgaagaactgtttagggaatcattttatatgtagggaactggatcggttggactccacctgactgtgagaatcaagtgtctgatttccagagtctttgccatttgaccaaaactgagtaagctgcatgcttttgctagtgggcataacatagttccactcgggtttagtactccttacatttgtggctaaaaggaagtatctgaagaattctgtaaaaatgtagaaatttaatctgtatgtgatgaaggggaagatatttcagtataaagctgaaaagagaattagcttataactgaagaggagaatgatgaccactttttagtatctgcccaacacacgtgcctgtttctgtaaaaacaaccccccgtaacttacatgcatagatcctctgtattccatttgtgttatggaactttgctcccctggccattgttgatcggaatactggtagatacagaagctatgctcttccaatctctctaggagcttggaattgaaaccaagagaaattagttattccccagtatgcatgaaatgggagggcatgtgtatctgttaagattaagcttagttgcacacaaaaagaaatttaaaataaaaatggcttaagatagaaagttattcacaaagtcagatgataagtacttgatgtggtttggacatgtccccacccaaatttcatcttgaattatagttcccatgatcctcacgtgtcgtgggagggacctggtgggaggtaattgaatcttgggggtggttacccctatgctgctgttctcctgatagtgagtgagttctcacaagatctgatggttttataaggggctttcccccttttgctcattcttctccttgctgctgccatgtgaagaagaatgtgtttgcttcctcttccaccatgattgaaagtttcctgagacctccccagccttgtggaactgtgagtcaattaaacctctttcctttataaattacccagtctcaggtatgtctttattagcagcatgagaacagactagtacagtactcaagagttggagtgggagctccacttcctcagagatcctttcagtgcatctcttcatctgatctcttcattctcacattcaaaatgtggcaaccatagctccaacaattatatctgctccccactcagaaggataaaggaagagaagaagaaaaaataaataaaacaagaaggatcaaagaagagaaaggctcaccctctttctttcaaagagccatctcattgcctagaatgtagccatgtagcagcatgggaaaggtagtatttattccaagtgatctgtgcccagttaaaactggggagaacgagaccaagggtattgggtaggcaactagaagtctctaccatatttaaattcatgagcttaaccaggcttggtggctcacacctataatcccagctacttgggaggctgaggtgggaggagtgcttggggccaggaattcaagaccagctagggcaacatagaaagaccccatccctacaaaaaataaaaataacagccaggcacggtggcttatgcctgtaatggcagtgatttgggaggttgaggtgagagaatcatctgaggtgaggagtttgagaccagcctggagaccccatgtccacaaaaatatttagccaggtatggtggcacatacctaaatccccacctactcaagaggctgaggcggaaggattgcttgagcccagaagttggaggttgtagtgagctatgatcatgccactgcactccagcctgaacgacagagtgagacccttctgtagaaaaagaaaaataaataaaaataataaaaatacaatacaatacaatgaaatcatgaacgctgctgggagaaacagagaaaccaatctatacaaacagaaggaggaggagagacagagaggagaaatatgcaggaagaggaggtaggagaccacacagctttagagggtggtagagaaagggtgactgcttggtttctcaatggcattttacgtcttaatttctaccctatgaaaactgactgcagactctgtctttgttttctatgagatgcctctatattattatcctttcatattgtttttagtgggtttctatttttctgcaaccaaaagagctaaaactaaaagttgctaaaaccaaggatggaaaagtatgcaaataacttgtcacatggcgtgccaaaacagcaaaagccttggagttcagaaaaaggaagattccatcaagaagggctgggagccaggattccacacagctttggagcgtggctagaatttggtataaaagatagaagggcgtttcatagactagtgtcagttagttgcagaaaactgaaattctagctatggaattgggaagagatgtaatgggagaatcatgtgtacaaaattgctggaagggctagaaaagcagcctctagacttatctgcagaaatgcttcgcaggtcccgactgctgaactggcccgggagatgccgctgtccctgcagtagccaaaaaggcagggaaggctgggcactgtggctcaagcctgtaatcccagcactttgggaggccaaggtgggtggatcacctgaggttaggagtttgagaccagcctggccaacatggtgaaaccccgtctctattaaaaatacaaaaattggccgggtgtgattgcagacgcctgtaatcccagctgcttgggagtctgaggcaggagaatcacttgaacctgggaggcggaggttgcagtgagccaagatcacgccactgcactccagcctgggcaacgagagcgagactctgtcaagaaaaaaggcggggacatcaagaagccacctctggaacgattaagttcacaaacaccccagtacggctgcggtccaggaaccattgccgctgttgtcatcaccactctgcacaccccgggttagtgattgaatgctacaacactgaatttacctccgcctcctgggctgaagtgattctcctgcctcagcctctcaagtagctgggattataggcacctgccaacacgcccagctaatacaaaaattggttgggtggggtggtgggtgcccagctgactacagctgcctctgcaactggttattaacttgcatgacgctatctggacccaggaacattgctgcagtgcagaaaactcaactcctccaccctaatcttccttatcagcaacaacagataaaaggtggaggaaaatgaccttcacctcatttctgccttttatacccctcaggggttgatctaattcttgcaatatccagatcccagatgcagagaattctgtgccatgtaatttctaatcatctcagcctctgctatatggaaaaaaagcaaatactagagggacatggaaatggctattgagcaagagagttcaccatagccaccactatgatctcatttaaatggtacggaggaaactttctctagaatatctagatccttttataagaatctgaaccatgtttgtgcttgtaactctagaatgacatgcaacattttaaacaacaaatcaaaactacctagttaattcaaatgagaacagtgttaatggtattagaaaaacttgtgtttggcacggtggctcacgcctgtaatcccagcactttgggaggcccagacaggtgaatcacttgagcccaggagtttgagaccagcctgggcaatgtggtgagaccctgtttctacaaaaaaatacaaaaaataagccaagcatggtagcacacatctgtggtcccagctactcaagaggctgaggtgggaggattgcttgagcctgggaagcggaagttgcagtgagccgtaatcacactactgcactccaacctgggtgacagagtgagatgctatctcaaaaagaaaaaaaaaaaagaaaaacttttctttgaagaatgatctactgcagggaccagtttcactacttccaggggaaattcatgtgatacaaatgggaattaaacacccaccagagttacctcagggtatccccttctaaacacactgcagtcaaatcagctaggagttttactagaacgtgagctttatatggtagacacagctaactgtccatgagaaatgtatgcttttccttttcatatgacaaggttgttgctggggaagtgtcagtctagctatggactggacaagaccatgtgattactgtgattacttccttttttttttttttttttttttgagacagagtctcactctgtcacccaggctggagtgcagtggcacaatcttgactcactgcaacctctgcctcccgggttcaagcaattctcctgcctcagcctcctgagtagctggggttgcaggcacgtgccaccatgcccagctaattcctttttattttttagtagagatgggggttctccaggttggccaagctgggctcgaactcctgacctcaggtgatccacccacctccgcctcccaaagtgctgggattacaggcatgagccaccaaccctggccaggaccatgtggttacttctaaccaatgacaagctgtgtcactgtcaagccacagcgcttaagaagtgttgggctatctgttcttttcttttctacctatagactggggacgcactaagccatcttagaagccatatcttgaaaatgccagtgctgtcttcagcctagatccctaaataactgagtgaagaatagctgcccgaatcctcatcccctcctgcccacctaaaactgcccaggatagttgacagcaacaagaaaagcttcgttgtagctaatattaccctaataaattccgaatatcccttgtctttcatcttacaaccttcctaaagtttgcaataagtgttgccaaacatcagcttcatcactctcacccctccctcaaaaaagacaaaaacaaatcaaaacaaacacagtgaaatacaatatttttctagtgttttattaaattatatttaggaagataagggaacactagaagctgtagccaatatatagtatacaacgaatataagcaggtaaataagcacagaatttccacatttagtaaatgttttgaaagaatggaatatattagtaatcgttatttcattccactgagctcatgaatgtaaacttttgaactttcatcaggtaagctacggcctgtttttgttgcagtgcagattataactgatgaatcatatgagattaaaggtgatttttcgtgttaacaaattttaatgcccactatagcaaaggtatatatatgtaaaagcataagatacataagagaaatcttcagagcgtgaggctggagagcctgtgagtttagttctgcgaactcaatagatctcaatagatttacatgttgttaaaactgaaaagctccttactaattcttagttcaaacttattagtttataggtgaataagcaagactctgggaggctgactgacttgtttgtggctgactgctgtggcagagcatggacttgaatttgggcttgtgacttctaatcaggtgtatttatatgaaatcacatgctgctctctcttgctctctctctctctctctctctctctctctctctctctatatatatatatatatatatatatatataaaatatatatttattatatatatgtatttttttctttgagatggagtttcactcttgttgcccaggctggagtgcaatggtgagatctcagctcattgcaacctccgcttcctgggttcaagtgattctcctgcctcagcctccagagtagctgggactacaggcattcaccaccaggcctggccaattttagtatttttagtagagacagggtttcatcatgttgtccaggctggtctcgaactcctgatctcaaatgatccacctgcctcggcctcctagaacgctggaattacaggcgtgagccacggcgcctggccaccactactcaatatttaggtgaaccagaggagatgaaagtatacaaagtctacaaatccaagcccaagaaagggcacctgcccagaggctggggtccctcctagcaacagcattgcttctggcagcagcacttctgctggcaacagcccttcccacagctgtagccacacgagctgcaggtgcggcggcagcagcagatcacgggagtgctgcagcagcctccacagcagccacggcagcaggggcagcagctggagcagcagcccacccggtagcacctgcaggtggtgcatctgccacagccaccaccacagccaccaccgcagccaccacagccaccacaacctccacaaccacagcaacccatggtgtcagtagagaggactcatcaagtaaaatcaagtaaaatcaagtaggagcaacaagtagtttcaatgtcatgccttgagccctattttagagctgtggccgaggtgccacgggccctccttcacagaggaggtctccaccgttggtgattcttcaataatcacaggagtgaacaggtgcggtggctcacgcctgtaatcccagcactttgggaggccaaggcgggtggatcacaaagtcaggagatcgagaccatcctgactaacatggtgaaactccgtctctactaaaaatacaaaaatttagctgggcatggtgacgcacgcttgtagtcccagctactcaggaggctgaggcaggagaatcacttgaacccaggaggcggagactgcagtgagccgagatcgcaccactgcactccagcctgggtgacagaatgagactctgtctcaaatataataatgataataataataataataatcacaggagtttttcatgcacccagtaccaacctcagatctaggcaagatctaggcccagccctgggacgtgcactttagtatcccacatatcacaagagtacaaaaaaaaaaatctatgtaaaaaacgcaagccctaatccacccccaccactcaggacccagagcttagcccagaagcctaaatatgtgcagctgggactggtactgctcagggacctgcttcttcgtgtctcttgccccacgacctcaaaacaagggctgccagcttctccatgccatagaggtttgtggattgattccttcaaagtgtgacaagaatttgttggaaaatacctaagtaagagaaaagatgggttaacttgtcaaatccttcttctcagcatgactaaacaatattcttgtgtaataaaatatttccagtaagtagtggcaagaatccagtttcttgctcattgcgttctgccccattgttggaggtactgacgtgctcgtgtggtatttacaaaaattgcatgccgtcactgagcaatgtttgcaccatgaaacaattcatatttttcttaggtttgtttacatgtaggtctcgatatagcatgcatgaaataggctgattctttatgttggcaataaatggacatgaaacactagacttgttaataattttactttcataatatactttcttaaatacacttacatgtttaaaggtcaataaatattgcagttccctttaaataattttatttaaaacttggatgttcattttttataatttgaattttgccttttaattatgtctttaaatttcaagaattttaaaaaattttgaagactttttttaaagaaagttaactcttaaggatgtgaaaaatacttttaattttgttacttttaacttcctttattttgttctcttaataaaaatctattcagattttttgggacgtgaccccaggcaattttattactttatccctgaacctcagttgcctcagctataagatggggataacaatggcacctatttcataattatgcagattagatacactaatgcaaggaaaacactttagtatgtgcctaccacatgctaaacactcaacaaaggttatctgtaaacgctgatgtctcaaacagggatgggatatattgaaattttatagttagaataccgttacattttgtttttaatcttttaaatcactgtcagtagaatacagattatttttaaattatttataaatatttaagaattttgctgaaatgacagtaagaaaaatattctgaaacaaataaatgatttttgaattatgtattattttattattttattattcatctgaacatcctgccccattagcagaacatctagccataatacaatagtgattaaattcagctgtctttgatattttgcccaaaaccacagatttacacactgtttttcttttcttttcttttttttttaagacagagacttgctctgtcacccaggttggaatgcaatggtgccatctcggctcactgcaacctccaatttccgggttcaaacgattctcttgtctcagcctcccgagtagctggcattacaggcgctgaccaccacgcctggctaactttcgtatttttagtaaagacgagtttttgccatgttggccaggctggtctcgagctcctgacctcaactgatccaccggccttggcctcccaaagtgttgggattgttacaggaaagcggtcccgatctagaccccaggagaaggttcttggatctcccgcaagaaagaattcagggcgagtccgcagtgcaatgtaaaaataagtttattaagagagtaaagtggtgaaagaaccagctactccatagacagagtaggacgttcttgaaagtaagaggaggtacgcgcccaccctaggtacaatactggtgtatatggggagatgtactctgctataagggtttgtgataaaggattaattttcttaattactatattttgcaagaatctataatattatctttaaagcaaaattaggaatgcttttgttctccagatattgggatatctagacactcctaagtctgggtctgttgagtaaacattattaatttgttcccttaaccataaacatctagaggctcagaatgcctaactttctgggaatgcagcccagcaagttccggcctcattttccagccctcactcaaaatggagttgctctggttcgagtgccacggacaggattacaggcatgaaccaccgtgccgggcctacacattgtttttcgtttagttgttatgaaggcgtatttgacaaggcggaaggatagaatacattttatttaaaagtcggtaacatgatctatcacttttaaatatttgaacataccgtctgtaggcttccctttgtactcaaatctcagtcctgcaaatgatagggctaggcctacgtgctaacaaaaatggagggcatccgagcccaggcatgcaatgacccagcagctcagagagcagggcatgctcaggacacacaatggtgtgatggtggacctggagcacagtggggagggaggagccctgtgatagatggggccagttaggaaggcggctcaaaagctgctctcagatgtttgtgtttgtgtttatccccgggggactgggatcactgacggcttagacaggggagaggaaatcccaatagcccatggagcaggggagctgttcttcctgcagggaagtcggttatgatgctcaaaaccacaccttctaggagggaaaccccgagatactatttcccttcagtcattggataggaggtagggtctgggtaggaccatttcaaatctaacttttggaaggaggtgccactgcccttagaaaaagggaataggctgggcgcagtgtctcacgcctataatcccagaattttgggaggccgaagggggcgggtcacttgaggttaggagttcgagaccaggctggccaatatggtgaaaccccatctctactaaaaatacaaaaattagccgggcatgacagcaggcacctgtaatcccagctacttgggagactgaggcatgagaatcacttgaactcgggaggcgggggttccagtgagccgagatgatgccgctgcactccagcctgggcaacagagcaagactgtcttgaaaaaaaaagggggggtgttgtgtggtgtggggaactgattattgtccttccccaaatcacctgaggaagaacaatattaagataaaagagagcacattctttaaaatgagatacctggtcattccttctgttgttcgtgggatgctataggtaggacactgttggggaaatgttcttgaatgtgaaattggaaggggagccatggtgaattaggaaaatgcacagcgggtgcaaagtagccccctccaggtgtttggcttgtgcaggtccctctcacttcatggcttaagaaaaacaaacaaacgaaatctccttcaggtcttgtgtctccattatgtggtcattcttttgatctgatgtcacattccacgtttcattgcctgactgaaaataaacatttattttcattcataggatgctgacttccatctgaattccacatgaatcttggcatttattatttcccatctctccaaaatgctcagctctgcccataggctcaacttgaagcaataaaagggaagtagccaagagcttactttctctaacttttttcttttttttttgagatggagtctctctgcgccgagtttggagttcagtggcatgatctcggctcactgcaacctccgcttcctgggttcaagcaattctcctgcctcagcctcccgagtaggtgagattacaggtgctcgccaccaggcccagctaatttttgaatttttagtagagacaaggtttcgccctgttggccaagctggtctcaaactccttacctcaagtgatccacctgcctccgcctcccaaagttctgggattacaggcgtgagccaccgctcccggcctctctaccttctttgtcccacaggaaaaaggaatatgcttctttgggaaggacatgaactagggcgacagcaaaaggaaagcgaatgtggggctgttttggagtcccatacactctcagcggcagagcaatattaaaacttcctagaagacatctgagcagcaattctaataatcatgtattatgtatctgcaataaataaaccatgaaccaactagcaaattgccttgcttgtttctcagcagaagttattttccatacagcttttcatctagtgaccaccattgtttagacttggatgtttgactgcagttttgtgcatgtggcagcgcatgacaatgtttgcagtgttgtttagagtcacacaaacttacaagtcagtggggggatgggttcaagtatagcttattaattcaattcattcagcaaatatttactgagagtctactatgtgataagcacttttctttcttttttttggagacagtctcactctgttgcccatgctggagtgcagtggtgtgatcttggcttactgcaacctctgcttcccaggttcaagcgattctcctgcctcagcctcctgaggagagtagctgggactccaggcacgtgccaccatgcctggctaatttttatatttgtagtagagacggggtttcaccatgttggccaggctgctctcgaactcctgacctcaaatgatctacccacctcaccctcccaaagtgctgggattacaggcctgagccaccgtgcccagacgataagcacttttctaagcatatgggatatctcactgaaaaaactcaacacaaatccctcccccttgaagcttccatgctcattgcaggaaacagaaaatcacccataaatgtgagcaaagtaaggaaaattgaaagtataaagtgtttcttttgtaatttcaaatgaaatcatatccataatgtatgctattatacagctttttataaaatgagacaaatcatatagtgcaaaagatctcaaagacaaaggaaaaggaaaaaaaaagaagttgcagaaccatataaactcatttgaatatggctgtgtgtgtgtgtgtgtgtgtgtgtgtgtgtgtgtgtgtatctgaaaagatacatagcaaacaatgtttctccaaatctcccacttacttaccatatacccactaccacaagctgcagcagacatactgaatatctcactttgtcatggtggatttttttccaagccttccttggagctctgggggccttttgcagctcggcactttctgcagatgtctctgcggcagttctgcccttgcccggcccaaggcagctgcagcatctagcttgtggcccttttccatctcttctgggagctgcctttattctgagccagctctacacttaaaggggcgtttgttctattttatcccgaattcctaaatgttttgtggagacggaaggctttttaagatatctagtctaccatatctccaggaataaaaatgatttctataaatttttaaaacctatgtaaaattaaaagtaaattaaaattgaaaacaattatatttgttcattccctatctgttcttgcatgaaatgtattgacacgaggatgccacatcatggaaagagaattctttgcatatgaaagcattaggagagacccttaggaaaacagatgaagtcctccagcgtgagaatgctgtcaggaaaaatatgccagtgccctgtaaataaatctgagtttttctttgttctaaaaatcagcacattgttgtaatgataacctatgtttttctcaactatgaaacaaaataatttttatttataattttgagtttcatttctaaagctaggattgtaaccaaaacactcctaaattatttaatctcaaactgtagttcctctttcaagccacttcaagtttttctttttttaaaacctgtaccaatgatccttggataataaagacctccagtattccttcttgaagatgaagattctgatactcaaagagtttgaatgctttcctcaaggcttccccagtggtgacttagagctgaggttttaggccaggtcttggtgatcccagggagcaggctctgtccatcccctgcataaagccagagagggcaccgcctgcacctgtggcattttgccagcccactttctattttgcttgttccactttttgtttctcagccctgtctcctgtatcttggcctcttgctccattgggccacaggacctgaggtccagttttgagtttgctttgcgggcaaaaatcctctatctcttcttcaggctccacccttcacaactccaggtgagagaccatatattagtccattctcacactgctgcaaagaaatgccttccttgcctatttaaaaaaaagataggccgggcatggtggctcatgcctataatcccagcactttgggaggccgaggtgggaggatcacctgaggtcaggagttcgagaccagcctggccaaaatggtgaaagcccatctctactaaaaatacaaaaattagctgggcatggtggcatgtgcctgtaatcccagctacttgggaggctgaggcaggagaatcacttgaacctgggaggccgaggttacagtgagccaagatcgtgccactgcactccagcctgggtgacagagtgagaactgtctcaaaataaaataaaataaaattttaaaaaataaagaaaaaacacaaataacagacactggataatttataaagaagagaggtttaattggctcacagttctgcaggcagtacagaaagtatgattctggcatctgcttagcttctggggaagcctcaggaaacttacaattatggcagaaggcaaagggtaagtaggctcatcttagatggccagagaagaaggaagagagacttttaaacagccaggtctcctgagaactctgtcacaagaacagcactagtgggatggcactaaaccattcatgagaaaccacccccatgatccgatctcctccttccaggccctgcctccaacattacggattacaattcaacaggaaatttgggcggggacacagacccaaaccatattagaacaataccctgatggggacagattggaaggggccagcctccctctgggcacacagctgacaggtgaggggcattggagatcatgtcccatatcctgcttctgtgacatcactgtgattatcttgaggctgatacctggacctggccagcttggtacctgagtcagtgggaggggttgctgttatagcctgttgtggctgcctggttccctttatcatttcctgcctatggattccattgcccatattcctgccacagatgtatcacgtgttcagtaaatgattatttaatactctattactggaaatagatgaataacctcatcattgttaatgcagttcacagtgtacttatgacaaagttttaagtacttgtgataaagttataagttacatcatttccaaactttatgttttcttaacgtgaagactgcatattatgtgtgtgttttgaggaaactagactttctgaacacatagagggtaatcaacatatggcattagaatcaaggccagtttctcatacagtgaatatagaaatgagactgaattatccataatcatgtgtatccaaatgctagggacactcaaccgttgtctatcttatccttaaaagtctcaaggactgaagcaaaagggttgcttgaagccaggagttcaacagcctgggcaacagagcgagaccctgtctttacaaaaaattaaaaaatcagctgagtgtggtgatgtgcttctggagccccagctacttaggaaagtgaggtgggaggattgcttgagcccaggaattcaaagcttcagtgagccatgattgtaatactgcactccaggctgggtgacagggtctcaagaaaaggaattatttaacctctttctgcagttaggaatttttttttctatgtgactaagctgaatgcttctataggttgaagctggtcctcctttatcttcagatttgatagaaaacatctagtaaacataagaaatcaaatagcccttcaagtgttggctgaccttttagccattattttcttttccagaacatgttattgtaagctttattattttattattatgtattattattattttgagatggagtctcactctatcacccagtctggagtgcagtggtgtgatctcggctcactgcaacttctacctcccgggttcaagcgattcttctgcctcagcctcccaagtagctgggattacaggtgtgtgccaccacgtccagctaatttttgtacttttagtagagacggggtttcaccatgttggccaggctggtcttgaacttctgacctcaagtgatccacccgcctcggcctcttaaagtgctgggattacaggcatgagccaccatgcccggccttattataagttatttatacttccttagttctgtttcatctttccagtcttgctcatttctcccatttcctgttcaattcccttccccaccttaagcccctcggtgaatttccagaacttccagaataaaatccagaccccttaggatgacttatgtggcccttcatcagtcataggtggagctgcggctttcgttgacctctgctttcaattttcccactcactcaccattttcttcctgctccggcatggccagccttctcatgctccaataaatgtatggcatgccaacagtgggggtttcacacctgtaatcccagcactttgggaggccagggtggaaggagtgcttgaagccaggagtttgagaccagcctgggcaacattggtgaaaccttgtctctacaaaaataaagaatattagccaggcatggtggcacacctacagtcccagctactcgggaggctgaggtgggaggatcgcttgagcccaggagttggaggctgcagtgagctatgattgtgcctctgcattccagcatgtgagacagaggaagaccccgtctcaaaactaaataaataaaataaaaagtattcccaccttaggactttgcacttgctgtatcagtcaggattgaaacagaaaaaaaatgcccctctagaaactgtttttgaagaaaagaagaatttaatttggagactgttatgtaaacacatgaaaggattggaaccaatggttgctgttagcctcaccagggaatcaggaacatcaggaaaatggaggaactctctgctgaggagcagagaaaccacacggccagcacaggaaacgccaagtcatgcctttgccaaagcccacacacccatctgcactgtacctgctcgcctaacacacctccacgtctcaggagcagaatgtgccctgcctccagagcactggggtatcagaagctcagattccaggattctaggccctggggtagaattctagctcctggtgcaggggagaggtggaaggggatggggggaatagactaatactcaaaattgttctttttacttcagtgctcttgccacataccttccagaagctctacccttatcatcatatccattctttccagaggtcttcagtcccatcctccttccccttgtccagatactcactaagactgtatcatctctcaccatttgttagtacctgaaataagcatatgtattcacttgcttattttctgttttatcttactatatataatcgcagtgatagcaaacccctcacatctgtagtccctgctctcacagctgtagactccgcactcacaactgtggtccctgcactcacatttgtagacattacacacatagaagcagccccgtaccaacagctgtggtccctgctttcacagatgcgttcctgaaccaacagctctggtccctgcactcagggacgcactcctgaaacaacaacggtggtccctgactcacacatgcgctcttgaaccaacagctgtggtccctgcacccacagcttttgtccctcggaacagggcctggcccatagtagaaacacaataaagatcatgtcctctcaaccctcaggtctaggagaggttgctctacttctacaggcagtaaaaatatttataagtgaattttaatgatggacaaaacataatagacctgccatcagaagagtgaattttgcgttcctccctgtatgttctcaggagattttgttcaatggtggtccacgaatgaaactttcacatacacttatggtggtcctaagaggcccacaggattatctctcaaggcctgctattatatatttctgcagagagtattacaaactattggtaggcacagaaattaagagcatggcatataacaagaactcaaaaagtgtgagctcatcttaatatcactatttctctgtattctaaagcaggggtcaggtcagtgaactacagtccacaggtcaatctgccctttgtctggtttttacctgttcctgagctcagaatggtttttatgttgttaaagggctgtgcaaaaaaaaagaaagaaagaaggaaggaaggaaggaaggaagggagggaggagggagggaagaaggaggcagggaggggggagggggagagagagagaaaaaaagaaaaagaaaaagaaaggaagaaaagaaagagaaagaaaggaagaaagaaaagaaaagaaaaagaaagagaaagaaagagaggaagaaagaaagagagggaaggaaggaaggagagaagggaaggaaggaaaagaaaagaaaaaagaaaataaaaagaggagaaagaaaaggaaaaatatgtatcagagatagtgggtagatggctgccaagtctgagatttataacctgaccctttacaggaaaagtttataactctgctctgtacgcttaacttcctttaaactgttttatggcttacttgattgattagaatgaaaactttatttcttaattaaacaaatatttactgttatcattcagggaggatttccaaaagctgatgaaaacagagatccagaagccagtggagcagctgccagccttggtgcaggggagaggtggaagcctcacctcaacgatgctgtcgttcgtcttgtcatgggcctagagtttatcctgtctgggtgtacctgggaaggtattgattagctataaatgtcttctttattttattttttttcttttttgacatggagtcttgctctgttgcccaggctggagtgcagtggcatgatctcagctcattgcaacctccacctcccgagcttaagggagtctcctgcctcagcctccaagtagctgggattacaggcgcccgccaccacgcccggctaattttttgtatttttagtagagatggggtttcaccatgttggccagactggtctggaactcctgatttcaggtgatccacccaccttggcctctcaaagttctggcctataaatagccaccgcgcctggcctataaatatcttttaattacacctctttggtaatattgtatggattgtcagctaatgattgactttggggaatttccaaggtgctatccacagcttttgctctgagcctggggtccagctctttctgaggaaaaaggagcacaggcagaagcccagcctgccttccctcttcatcctggctccttcctcatcatccccccgctctttctctcacttcttgttaggtgcttctctttgcccccatatctgctgtggtggagccttgcagctggggcaatcagatagagcagatccaccactccagattctgtcttgatcttgccagctgctacagacatttctcttgacaaacatgttcgtgttccttggaagaaaaattcttcatggcctcaagtttaatgaattgacttacccagtaataggtctttcatatagacaagtggatctcttacagagtcctgggtaaataaaactctctattttattactattattattattattattattattattattattattattttagaatgagtcttgctctgtcacccaggctggagtgcaggagcatgatctcagctcactgcaacctctgcctcccagttcaagcaagcgagtctcctgcctcagcccaaccttccgagtagctgggattataggcatgcaccaccactcccggataatttttgtattttagtagagacggggcttcgccatgttggccgggctggtctcaaactcctgacctcgggtgatccacccgcctcggcctctcgaagtgctgggattacaagcgtgagccaccatgcccggcccgaactctctattttaaatgttaactctgttcttccaaagtcctttccagtcaccccacttgagacctctctatagctttcaatcccacagcacccagcccacctccccgcttcactcctgattctgggattgctccaagaactccagtattgttgttgctgttgttgtttttctgctgctgtatttgctagaacattttagttttcccataaattttcacaataagacttctcaagatgttgagcagccaaaagttccttcaattgtataggcttcaggccgggcacggtggctaacacctggaatcccagcactttgagaggctgaggtggatggatcacttgaggtcaggagtttgagaccagcctggccaacatggtgacacccccatctccactaaaaatacaaaaattagctgggcgtggtggcacatgcctgtaatctcagctacttgggaggctgacacaggagaattgcttgaacccaggaggcggaggctgcagtgagccgagattgtgccaccactgcactccagcctgggcaacagagccagactctgtttccaaaaaaaaaaaaaaaaaatcgaaaattatatagatttcacccttcttggaagacagtcgtggttatgaagaacaaaacctatatcctggttataatggtgagaggtgttgtgaaggagaagcttatagcagaggggtcttgacctagtgtgtgggatggggaaggtgtgcttggagaacatggctaagagttgaagtctgaataggagctggccatgaaggtaggggaacaagaacattccagggaaagcctagaacaagtgcagtggagctgagggaggagggagtcctggaagtccaagaatcagaagaaagccagagcatgtgggctgtgaagacagaagggggaattgcttacaaggaggctttgggaatgagagaggcaggtcttgcccagcaatgtaggacttgcaagtaaccctggactttcccctggattgagtgactatgctttaagtgggagagtgagggcttcctttgctgcagtgtggaagggagttggaaaaggatcaacatgaagatgtggagaccggggaggaagccgctataataggcagaggggtggtgatgctggatctagatgtggcaatggaggtggaaatgtaaaccacccacagggtttactttgcctgctgcctagatagagctaattcatcaagacaggtgaattgcaatagataaacagtaattcacgcaaagccggctgagcaggagattagagttttattattactcaaatcagtctcccctagcattcgggaagcagaatttttaaggataacttggtgggtgggaggaagccagtgagccaggagtactgattggtcaggaatgaaatcatagagagtcgaagctgtcttcttgcgctgagtcagttcctaggtggggggtccagatcagatgagccagtttattgatctggatggtgccagctgatccatcaagtacaggtctgcaaaatatttcaagaactgatcctaggagcagtttagcctccagcttcatgactcctaaaccataatttctaatcttgtggctaatgttagtcccacaaggcagtctagtccctggacaaggaggaggtctgttttgggaaagagctgttaccatctttgttgaagctataaactaaatttctcccaaagttagttcagcctatgcccaggaatgaacaaggacagcttggaggttagaagcaagatggagttggttaacttagatctccttcactgtctcagtcttaattttgcaaaggtggtttcagaaagaagtgatggatttgacatatatttagaaaggacttaacaattgattggataaggaaagtgagggaggggaacaataaaaaattgctccaggttctggtctgagtgaccaggtggttagaggagcagcttggttgctgggttgtttgggttgaagcaaggttgtagcttaaggttcaatcaggtcagccgggcacggtggctcacgtctgtaatcccagcactttgggaggctgaggcaggcgaatcacttgaggtcaagagttcgagaccaggctggccaaagtggtgaaaccccgtctctactaaaattacaaaaattagccgggcgtggtggcaggcacctgtaatcccagctacttgggaggctgaggcaggagaatcgcttgaacctggaaggcagaggttgcagtgagctgagaccgtgccactgtactccagcctgggtgacaagagcaaaactccatctcaaaataaataaagaaataaatatatatttttaaaaggttcagtcaggttgaattggaagtgcctgtgagtcatctacagaattggaagtacctgtgagtcatctacatggagatgtcaaataggctgttggaaggttggccctgggacccagaaaacgaacaaggaggaggagcctcttctggagtcacaagaggtgagccagagtagtgggaggaaacccaggaagggggtggagggcaggtcagtttggactggatttagttttggtgttgtgacaggatccagactagagtggaagcaagtgacggccggttatgtttagacttctctatccacccaagaagaacccattctcatgccccagacaaagggaagtgtcttcggaatcactcggaaacgccaatcacactgatccaattgggtgcttcacaatgtaggaactagcctggagagacaactcagtgagattttatgggttttttgtttgtttgtttgtttttttgataaggagtctcgctctgtcgcccaggctggtgtgcagtggcgcaatctcggctcactgcaagctccgcctcccgggttcacgccattctcctgcctcagcctcccgagcagctgggactacaggcgcccgccaccacgcccggctaattttttgtatttttagtagagatggggtttcaccgtgttagccaggatggtcttgatctcctgacctggtgatctgcccgcctcggcctcccaaagtgctggaattacaggcgtgagtcaccgcacctggcctagattttatgtttttaatctaatctcttttacaatccaaaaccaagaaaccaagagggccctgacctttacccttagcctcaatttaatgggaaatcagaaaaaaaatgtatgaaaataatttaggtcagagcaaatcatattcctcctatgctacagttagacaaagatgaacactgctgcgatcaaagaaagaccttagaggcaagggtcagatttatttcctgctgctggaccgagtcttctttggtgtgtgatattggaataagagaagaaaaaagagggccggagccgggcgcagtggctcatgcctataatcctagcactttgggaggccaaggcgggcggatcacgaggtcaggagatcaagaccatcctggctaacacagtgaaaccccgtctctactaaaaatacaaaaaattagccgggcgtggtggtgggagcctgtagtcccagctactcgggcgggtgaggcaggagaacggtgtgaaccagggaggcggagcctgcagtgagccgagattgcgccaccacactccagcctgggcggcagagccagactccgtctcagaaaaaaaaaaaaaaaaaaaaagaggaccgggcccaatggctcacgcctgtaatcccaacagtttgggaggctgaggtgggaatatcccttgagtccagaagtttgagaccagcctaggaagaccactaggccctgtctacaaaaaaaaaaaaaaaacaaaaaaaaaaactagaagaaaaaaaggaaataaaaagagaggcttcttttagcagagatgacagagtcagacataaaaagcatgaagggatgtcagaaatgtgatgctgcaccaaatgtcccccttacttgctgatcactaatgtggtctagaggtttgccagtggagctttgctcttttgaggtaagagattatgccccattaaaaacaggatgcacctagaagaacagagggtggagacgcacacaaaagtccttagggagagctctaccactaatgcactggggactccccttaaggggagatagggaagtacaagtctcacttacttcttgagaaatggccaaaatggggttttaaaggcatactctcagcattggcactctttaggcaggaagatattggtcagggctgcttggtaaggatgttcaggttgtgcactctacagatgcacatttatcacagccagggcctcctgcagaggccctgatagcagttttcggaaggtaaggtccacctgtatgagagatagaggcataaaatgtacgtagatgaagggagtcccttcctactgggcaaagtatgtctttatctatactacctaacccagaacaatacataactaagtgttcaaaggacgatttttatagtgtcaatgtgaaagtatcttttattctagtctctttgctgtaaaaaccagtataaggctgggcatggtggctcatgcctgaaatcccagcactttgggaggccaaggcgggcggatcatgaggtcaggagatcaagaccatcctggccaacatggtgaaaccccgtctctacaaacaatacaaaaattagccgagtgtggtggcgcacgcctgtagtcccagctactagggaggctgaggcaggagaattgcttgaaccctggaggcagaggctgcagtgagccgagattgcgccactggcctccagcctgggtgacagagcaagactccatttcaaaacaaacaaacaaataacaacaacaacaaaaaaaacagcataatagaggcttgggccaccagtctcatccaggccacacttgggtcagtgactgtgggagcttcagattcaggagtttggtggactgtgccagaaacacgccttgcacctgcttacagggatggaggagcgaggactgaggggggccagagatccaaagttcttgtatctccataagaaggtgtaggagcaagccgagcagtctgaaattgtcattaagaacagaaaacctgcagatgggcatatttacacacatggcttatgtgggtgtgggtgtgtggatgggcaacatcaaagaggatatgaatggtgattcaaaagtcaataggtcaaatatgaaaatgctaggaggacatcttcatgtatctactgtatagtccaactttcggtttatggaaaatgtccagctcttttagaaggtaaacattttctgactgtgagctcttgaatatgaattttatggtaccttatacattttttaactttcaaagctctgggttgggtagttaccagtaccatcttcacaaattctggattcttctggatgttcttgactattctgggaaaattggtgcgtttgttctccctccgccttgtaccgaggtctgcaggcttaagggatgttaacaaggcttcaatttgctgtgtgcattagcaggtgctggaaactacgttgccaaatgtgtcgtagacacaagagggcgatgtgtgctcaaatgtcaacctcaccgaggaaaaggaattcatccttcaggaatttttggctgaattcccagacctaaaaaagattaacaaagtgtgtttgggaggggcaaaattcactgtgaaacctaatcaaagaggcaggatgtgatgtcagagtgtggagacagcctggcaggagcttggaggggattcttatccttgagttcagaactgggcagtactctaggctaatgatcgttataatcaagacttgtcctctgtctggatattcagaaaagacagacttcaaggctgcagagaatcagtggctgtcttggtctctgattacaaaaactttattctgagaaagcccctcattcattggaggaaaactggctgtgcacttgttacatgccaggcatgagtcttgtaggggctaagaattcagccttgagtaagacagccgaggccactgccctctggaagcatcagtgacccttggcacgtactcccatctatttgtttcttttctctctgagccagtccaaaccagcagtatctacatcatcttttcttgttctgaaagagaatgcaagtcacacatttatggctgtgggccacatttttttagagatgccatctggttccagtttttctgactgtttgtggagagtggtgattccaacaatcttctaccaaatgtaagggggtgataaaagtgttcagtgtttgccacagagatatctctagcttggcctgatctcagtgcactgctttttgggtttactcaacaaattgaacaatgctcagcccctcttccatggaaccttcccaatctctttaaccagggttacactgcgactcctctaagtctctgtacatcatagcacttttgtgggagaccactgctacttcaaatctctgccaatagcaccatgtttcctttcgttgctagctttttagaattctaaagcctacttggccattagattttttttatttttttttttttgagacagggtctcactctgttgcccaggctggagagcggtggtgcagtcacagctcactgcagcctcaacctcttgggctcaagtgatccttccacctcagtcccccaagtagctgggactacaggtgctcacaaccacacgcaactaatctttgtattttttgtagagacaggatttcgttatgttgcccgggctggtctcaaattcctgagctcaagagatcctcccattttggcctcccaaagtgctgggattacaggcatgagccattgtgcccggactagctattttttaaattggagtttgaggaaggaggaacagaaaggctgcatctgcttagtaaatgactccccgctgccaacacacatacccagcagatggcaacacccatgaaaatcctttcatcctgttgtgaatggtggattcccaaactctacaggaccctgcactagtcagcatctgctcttccctcttgagtcagggcagcctgcaaaagtctggtgtgtatcataggcatcttggggctcaccttctacagaaggtcagagggcacagcaaaaatagctttcttgctgtgacctaatacataaaccctggcacacttccgcctgtcagatgggagcacgcccctgtcctcgggctgtttttcgctgtcgcaacaggctgttctgccgttaatcctttcctgtaattcccgccgcctcgctcgatcttgcaattctcttgcccagtggcctttacagggggtcattactgggacacggggaaccaatgtgcggtaacaaatgcaagctgacagcaacacgttcctcgccaaaagtgggactcttgggttttgtgtgtgtcaactcagaagaaacgagaaaaagaccccaccatgtgttggatgaggatggaaattggatgcagtgactaaaagtgctttgattaggtgaatccgttgacagtaagaaggaagagattctcaatgtgcttggcatttcactttgtctcactttgggtgaatagtcccaattctgtcagacgtgcatctcttcgtctgtcagctccgtgtctcttgccaggatgcttctctctatctatcaggcagaattttcagatgttgtctttcctgtcaggaaaagtttaattcatcattttcctcaggccttgaaaaaatttttacaggaaaaaaatggtggtggtgggttgggggtggggggttatgacaaaaacatttacagatttttcttcacatataattttaaaattgcctatttttgctaggcacggtggttgaagcctgtaatcccagcattttgggagaccgaggcaggtggatgaccagaggtcaggagttcaagaccagcctggccaacatggtgaaaccccatctgtactaaaaatacaaaaattagctggtcatggtggtggcacactcctataatcccagctactagggaggctgaggtagaagaatctctttaacccgggaggtggaagttgcagtgagccaagatcacgccattgcactccagcctgggcaacagagcgagactccatctcaaagaaaaaaaaaattacttacttttgagtaggtaatacatacacacagtacaaaagtcaaaaggttcatacaaatggaaaaaactccatactctcttcgcctccattccccaggcacccagttcctctcaacggaggcaaccctgggtactagtggtttacatctttctagagactgtctctgtataaattagcagagatagtcttcatatgccttttgagagcatctttttaaaatttctaaatctaggtaagttctgaaaaggaatatattaaatatacattaaaatatactcaatgtggctgggcatggtggctcacacctataatctcagcacgttgggaggatgaggcgggaggatgacttgaggtcaggagtttgagacaagcctggccaacatgacaaaaccctgtccctattaaaaatacaaaattagccaggcaatgagccggacttggtggcgcatgcctgtaatcccagctacttgggaggctgaggcaggagaattgcttgaaccctggaggtggaggttgcagtgagccaagatcgtgccattgcactccagcctgggtgacagagtgagactctgtctcaaaaaaaaaaaaagtatatatatatatgtgtatatatatatatatatacacacacacatatatatacacacacacatatattcaatgtattgaatggtctgtccagttgaagccctgattctagactagataatttgttggcttcttgttagatcactcttaacagaaatgtgactggacttagaatcagtctggaagcattgtggatactctggagtctgacgtttcttgtcccttaacattcagctcgtctttcctgagttatacctcttagtcatttccctttgaaattaagagaagggcctcaaatcttaaaaatggaagaatacggccgggcacagtggctcacacctgtaatcccagcactttgggaggctgaggcaggcagatcacctaaggtcaggagttcgagactagtctagccaacatggtgaaaccccgtctctactaaaaatacaaatattagccaggcatgatggcgcacacctgtaatcccagctagtcgggaggctgaggcaggagactggcttgaacctgggaggcagaggttgcagtgagccgagatcacaccactgcactccagcctgggcgacaaagtgagattcatctcaaaaaaaaaaaaaaaaaaaaaaggagggatagaaggtcttgtgttattaagacatagaagaaaagttagttgagaatctcactggccacaccccaagaggggacatttggccactgcgggtacattgggtggtctagggaattggctgggtctgggacacacttgttaagctcctgaaacttagagttgaacagaacaacagcagctagtataacgacttgaaaggtcctttgatgaattttaatacctggacgcataaatatttgtgtttgatacttttaggcatctgaaagaagtgtctgatttccttgctaagggattggcctcaggaacagatgcataccagtgttgaaattctcctcagcctcgtgactggcagtgattcttgtgtatctgccctctgcctgtgttggagctgctaaattgtaagaatttgtaagttggtaaaatacttctaaaaaccctcagctccataaatatttttaaatttaaatttaattttgttttagagatagggtcttgctatattgcccaggctggtctcaaactcttgggctcaaagcatcctcccatgtcagcctccagagtagctggcactacgggcacatgccttgctttgctctttaattttttttttcttttttttttgagatggtctcttgctctgtcacccaggctggagtgcagtggcacaatctcagctcactgcaacctctgcttcccaggctcaagcgattctcctgcttcagcctcctgaatagttgggattacaggcatgtgccaccacacttggctaatttttgtatttttagtagagacggggtttcaccacattgggcaggctggtctcgaactcctgacctcaggtgatccactcgccttggcctcccaaagtgctgagattataggtgtgagccaccgtgcctggccagctctttaaatcttaacgtagtaacaccgttactaatttctcagctgcttttctgagtttaacaatttctgactgaatgctttatttataggttgacaattctcagtacccctagtcagccaaatgtgtctctctccacaacagagactcaccttctcgtggctgcaagctgtgcagctgaagagggattctggagaaagaaggggaatccttttgtttgggtctattaatgctacgcaatgtgcctgggttcttggagggagacatatcccattcttccttattccctcccattgactatacaggagaaactgtatggagcttacttcagaaaaactattaagtcccaaagatgtgaagtgttttgaattttattcaagtccaaccttgcagggcaacaactcaacacagccattcctgctctttcaggagaagccacaagtgtgggaagacaggcagctaagtctagggcacagacaaattagtcatactgtctgcttagatcctgagggcctgcgaaaccctcaaggtttcctggtgtcatcttaaggtgctagttattccattctggctgccttttgattcatttggttttctgcccacaggcaagcagaggcgaaaccaacctgccaactcttacctcaaacccattgagagagacctggggatttcctagggttttatttttacctattgctccccaaacagaagttccattacacagaagcatttctttttttctttttcttttctctttttctttgagacggagtcttgctctgtcacccaggctgtcatgcagtggcaccatcttggctcactgcaatatctgcctcccgggttcaagagattctcaagcctcatcctctcgagtagctgggattacaggtgtgtgccaccacatccagctaattttgtatttttagtagagacggggttttgccatcttggccagtctggtctcgaactcctgacttcaagtgatctgcccgcctcagcctcccagagtgctgggattacaggcatgagccaccgcgcccggccacacagaagcatttctcagtgcctaatctagtttgcatatcaactattatggaataaagaaaccaacaagaccttgcattgcactccctgggtgggatgacatatgcctatcaaggccagagcctcctgaaacccatctcttatttctgttggcactgctcccacccagacagaaatgagttagagtgaggcattctccctagtaaccacgggaagtaggatttctccctgcagaggagcaaaggaatagaggaatgaatatctttgactcctactcctgttcaccttatgggagtcttctctgatccccacagctaaaacaccgtcacttctaccccattcatctttatgctcttatctggctttatctttcctgtcttttcccccaccaacacttacctcccccctgccctagaatgtgagccccctgagcgcaggatctgtctgattcatttactgctgtatcctcagtgcccgaaacagtatctgtcccatttctgagtgcacaaaaaaaaaatctgttaaacaaataggggacctctactattgccaggcactgtgtcagaccctgtgcatacactatacatgtgacacaggtaggtgttagtggcatcattctacagatgaagaacccagggagtaacaaaggaggtgacataacttcctcaaggtcacacacttagtaaatagttgagcatttactgcctctagagggtctatcctctagaacttgatcccttttgtcaaatgcaagagctaaagaattgtcgagtagagtgtgtttcattcttgaaaccatctcagttttctacctaggtagaatttaggaaaacagaagggatggcaaatatatatatatataaaaacagaggaaaccttcttgagggttacaacttaaacaagcacagcccaatacaaaatactctgaactaaaatcaaacaacaattctcagtatctcagagggtttgattagtttacttaaagtttttcaatcatcccatatgcatttactgaggccctcgtatgtgccaggctctgggctaagtgctccgatactaagagaaaggcggtagacttagccctgtggaatttactgtccacctgagaacaatgaacccaagaggtgtaagagaccaggatttctgaagaatacagaagaaatactcagtgtgcttggagagcaagtgaaagagggtctggcatagactgtggggcggggagggcaggtcagggaagattggcccgaggaaatggttttagaagggaactaaacttaccctggagattatagttgtcaaagaaaagcaaatcataaacagccaggacacacaacacagacgttacagagacactgacaagaggaaatgggaaggaggcgattagattcatgggcaggagctcagaggagaggtacgggctggaactatatatttggaagtcattggcttacagaaggtaattgaaattgtaggtgtcgatgagatcatcttggaaaaaattacacagcaagaaaagaagggagtccagccctgagctttaaggaagtctaacacgtagtggctgggaaggggaggagttgccagccaagatgcccgggaaggagcgggcgagagaggcaggagggaatgtaggaattgtggccatgtgaaatccagtggagaaaagctctcaaaggaatcatgtgtgcagagccaacactgctgaggggccagagataggaggacgcagagatgaacaggtgacaatgaagtcataggtgaccctggggagaggtccttaggtggcatgatgtgagcaagagtctgatgacaggcagatgagaaagggtgggaagggagggaatggagatggtatcacccagtggtctgcaaaccaggacccacacaccaaatctggctggaggcctatttatttatttatgatgtatttatttattttgcaagggcctgtttttgtaaaggagatttcactggaacacagccatacccattcacttacatacgtattatgggctgaattttatcctcctccttgacacttaattttttaaattgtatatatttaaggtatataacatgatgttttgatatacataaacataggaaaatgatttcctttttaaaaaattttaatcaggccaaaagagagagaaaaaagaataaatattcctatagtgaaatgatttctacagtgaaatgaacacattccctcatctcatatagctacctttttgtgtgtggtagaaatacctaacaactgctcacttagcaaatttccagtatacagtacattattattataattattattattcttagagacagggtctcactctgttgcccaggctggagtgcagtgacagtcacagctcacactgccgcttcaaactcctggcctcaagcgatcctcccacctcagtgtcctgagtagccaggactacagttttgtgccaccacacctggctaatttctttttaaatttatgttataccttttgtagagacgggaatctcacaatgttgcctaggctggtctcgaacttctggcttcaagcaatcctcctgtctcagcctcccaaagtgctaggattataggtgtgagccactgtgcccggccacaatacaatattattattaactatagtgtccctcccaaactaatatgctgaagtcctaactccagtgccttagaatgtgactgtatctggagatagagatagggtctttagagaggtgaataagttaaaatgtggtcattaaggtgggccctaatcctgataaagagggggagattaggacagacagacacagaaggcaggccacgtgaagacacagggagaagatggccatctgcaagccaaggagagaggccttaggagaaaccaaccttaccaatatcttgttgtcggacttccagcgtccagaactgtgaggaaataaatttctgttgcttaaggcacctaatctgtggttctttgttatggcagccctagcagcccattggctatttttgcactacacaagttgcagagttgagtagttacaacagaagctgtatggtgagcaaggccaaaaatattcagtagctggctctccacagacattgtttgccaaggctaggcatggtagctcacctgtaatcccagcactttgggaggtcaaggttggtggatcttttgagctcaggagtttgagatcatcctgggcaacatggcaaaaccccatctctacaaaaaaatacccacgacccgcccccgccaaccaaaaaaaaaaattaggcatgctggcatgcacctgtagtcccagctacttaggagactaaggcaggaggatcacttgaaactaggaggctgagacggcagtgagccatgatcgtgccactgcactccagcctgggctacagagtgtgaccctgtctcaaaaaaaaaaaaaaaaaaaaaaaagaaagaagaaagagagagagagagagaaagaaagaaagaaagaaaaaaaaaagaaaagaaagaaagaaagaaaaagaaagagaaaaagaaatgattcgccaatccctgatacagacaattgtttcaaggtcatatacctggtacatcccagagtcaggatttgaaccccagtcagcaccagtgactcctgttccctgccctaccccctgagagcaggctgcctcccctcagccaggagggctggagctcaaacagtaaagtcagcatggttcttttcttttcttcagttcatgctctgccctgtgggcagctgttgtggggaaatgctgagtcataaataattcttacattaatgccaaggcagccggaagggaaatgtcagtaggaaatggtatttcaaataagtacaaatttcataattcagccaattttttagaccatttctcgcagcaacattttcttattttgagttttggtaaactcataatcatttataaatgtggataaaacctaccttcatttggacatgtgacccagatatatacatgatatagaatgggccaaacagatcagagcaaagagaggaacaattggtcttatgtataactggcccttgtatctttacatcacccaagacaattatagtattgtgacattcactgtttgagcttatcattgagaagctccaggaagcttcgatttctactcaacagaatggctcgttagtataattttatcctctcagaaatatattgcagaagtcagccgtcacagtcagcttcatttccttgaaggcctcttcagggtagtgcccagagacacaagggttgccaataccggtgtctgcaggtccaggagcgtgggttaaggagtgaagccagttaggcagagaaaacaccgtcctccgccccaccgcccccagcccattgtggttatgaggaaacataggccagctgttcccaaatcttctgctttttcacaagaagccggaaatccagatttgatgtgaaatttcctaatttctaaatcttggcaactaattcaaataaaaaaaaataaaaacacagatttttcttttttttttttgcctgtggtttggaccccaccataggacccctgttaatgactcctgctctggtgagactccatggccagggtgaagggcaggggtgaagggcaagggtgaaggtcgaaattagtctgaactcactggtgttcatcattcctcatggcaaaaccttgcttccaggtgtggtcttcccccgtgcgtttctgtggctgtatctgacttacccagtctcatacccagtttttctcttccctttatttctggatactgaaattcttggggttatttaagccacagctgtttaaaaatgtcagcatctgaacctcatgttcccaagcaaggaactgttgactgagttgggtcagcaggaaggaatggactagattttctgccaccctgacaatgttttctaaacctggagcgaggcttcctgactctgtctctgccacttttcacataggagttgccaaggaacagatgaagggatactaaaaatacaagctttgccatctctgtgttcttttttcttcaaatcttttctccataaatgcctcgcctcttgaatctccatttgtttttctcatttgttcaatcatttattcactcagtaaacatttatgaagcaaataatgtgtgccaagtaccaccttaggtgcggggagggccaaggcaaatcagacttggtccctgacagtgaagggcctacgtctatggtgagtgaatgtttgcgtcctcctcaaattcatacgttgacatcctaacccccaaggtgatggtattaggaggtggggactttgggaggtgattaagtcatgacggcctaacccttattaatggtattagtgccttataaaagagaccccagagagctctgttgttctctttctgccatgttgagggcatggggagaaagaggccatctatgaaccagaaatgggccctcaccagatgccaaacctactagcaccttgatcttggacctcccaacctccagaactgtgagaaatacatgtttattgtttaagccaccccattgatgatatttttgttgtacaagcctaaagggactaagacatgtaggttcctggatgatcagaactgaggcccatgtatgtctggtgaccagcactcccacatatataaccctcaccaccccctcttaggtatggtgaatttggcttgaaagagtggaagtgaacaataaatgctaaattgaaagagataccacagagttttctagaagaaaaaaaaatcatcatggtagattcctttgaaccaagcaataattttagcaaagccattactaaagtttctttttcttaatggactttattatatttttagagcagttttaggttcacagaaaaatttttttcatttatttatttttgtacatgaataagttctttagtagtgatttctgagatttaggtgcacccatcacctgagcagcatacactgtacccaaagtgtagtttttttttttccttacctgcctcctacccattcctctgagtcctcaaagtccgttgtatattcttatgcctttgtgtcctcatagcttagttccctcatggcaaaattttgaggagggtacagagagtttctgtatgccccttgccactgtacacagcctgcctcactatgaaaatcccacaccagaggatatattttttacaatcaatgaaactacattgacacgttatcacccaaagtccatagtttacattagagttcactcttggtgttgtatattctaaagatttggacaaatgtataatgacatgtatccacaattacagtatcatacagaatagtttcactgccctgaaaatcttctgtgccttccctattcggattatttttttttcactttgaaatgcttaagaacagcctcagtaaaatgtttatatcctaggcagtgaatgatttgatctctataggaatgagctggttgttatcatatcagaatttgggggtaagctacagatgctaatatagggacatagaagatttttcccctcaaaattagttaagattagcaaatagcattaaggcagttaaccttgatgaaatacctagcaagaaatgggtgatgttatcctggaactgctattctcctcccatctcttctctcagcatttgccatccaaaccatttggaagctttggtgcttgatgcattgcagtattttttttttcttttctttgagaaagatgaacttaatttctagttcaatttgaaagtccttgctgcagtgaagaacatctatatttgctgagttttaccaggaaaggaaggcatcttcagtctaacctctactggactaatgttttaggaagactcaatcattccagcccatgaagaaaaatctgctcaaaaaaatttgcaaaatattatattttaaaaatctgtgggccgggtgcagtggttcatgcctgtaatcccagcactttgggaggctgaggaaggtggatcacctaaggtcgggagttcaagaccagcctggccaacatggtgaaatcccgtctctactaaaaatacaaaaattagccgggtgtggtggtgcacgtctgtgatcccagctactcaggaagctaaggtaggagaatcgcttgaaactgggaaggcagaggttgcagtgagctgagatcacagccactgcactccagcctaggcaacagagcgaggctctgtctcaaaaaaaaaattgtatatatttaaaagtacatattaaaccaaatatttaatgtatttttatattaaagtgtttggtttcactttgctatctgtttataagttcatcaacttgtgttttattttactgtcaaaatagatatctatagaaccatagtttgctttttgttattattttattcatttatttatttatttcgagatggaatttcactcttgtcgccaaggctggagtgcaatggtgccatctcagctcactgcaacctttgcctccccggttcaagtgattctcctgcctcagcctcctgagtagctgggattacaggcatgtgccaccacaccgggctaatatatatctttttttttttttagtagagatggggtttcaccatgttggccaggctggtatttaactcctgacttcaaatgatctgctctccttggcctcccaaagttctgggattacaggcatgagccactacaccaggccaagatccatagtttgaatgggcttccaggattgggatagatagcaaaggttcagcttaggcctgttccatttgtgactattgtcacaaatgttaaatttggagtcacctgcccttgaactcacccttgacctggccagaaaaatggaagcatgtcaatggtctggggaggaaaggaccttatgtgaaattaaaagaattgtctggttaaccatgttacaccttgggtccaaataactttgagtatgggcacatttaaggacagaacctagagatgagagaactgcttcctaatggatggagtgagatgagccctactggccagggtcatcagacagccctagttactggcctggagacaaggacagtgctgaaaactgtactccagagacattcctactatagctgagacacatctggggcctccccaagacaccagaaaaaaatggagcccagaaatggaggctaaggccctgcagtagtgcagtaaaagttcagcttaggctgaaggggataatgaggtagtgaaataccgcattaacaatgactgtgacctgagttgtgcctgggccagtcaataagctgtatttctcaactccaaccttgcccctgccccaccttctgtactctgctttgtgattcgggggctgggcctctgcaaaccccattttcgctttggagctggctccctctgaagctcttcccatcttcccatggggagatgcaagagagagaccgcacagccggaggaggaggaagcccctcttctttcctgaccactttctgctcctgtgaatggcacccaggcaatgcttcattaagaagtgaaatgagcattaaccatttcatgctcagcagtagcaccagttccttcccgagtccaccactgaagccagtctgcaatattttcaatgcttgtagaactggtcccctcacagcccctcgcagacctcagctggaacgtacagtagccctccttaagaatctggtgctcagctccacacggctcttcctccaaacatctaagctttaatagtttgagcctcttcctttcgctccccaattcccactgcttcctctagtttctacctccagggtagttttgcgttatctttttgccatttatgttacctagcgcattttatgttatcagcaaatttatgcttagttaacaattaaatcctctctattcaaacaactcatgctttttttttttttttgagacggagtctctctgtcacccagactggagtgcagtggtgctatcttggctcactgcaacctccaccttccaggttcaagctattctcctgtctcaccctcccgagtagctgggactacaggcgcccaccatgtctggctaatttttgcatatatttatttttagtagagacgggttttcaccatgttggccagactggtctccaactcctgaccacaactcatctgccctcctccgcctcccaaagtgctgggattacaaggatgagccacagcgacgggccaactgttgcattttctatctccttattggaccgtgattgacacatacctaaagtttcctctgtttattcattcaggaaatacgtaatgagttcccactgtgtgccaagcactgtactgagtgccaggtcacagggaggagggaaagacaataaccaatagaatagaatctctccacacacctccacttaccagagggagagatttaaattctcaatctgggctgggcgcggtggcttacacctgtaatcccagcactttgggaggccaaggcgggcagatcacctgaggtcaggagttcgagaccagcctggccaacatggcaaacccccgtctctactaaaaatacaaaaattagccgggtttggtggcggtagtgccattgtactccagcctggtagacagagcgagactccatctcaaaaataaataaataaataaataaataaataaataaataaataaataaacaaactaactctcaatctgtaatataaatggttaatgctcatttggcgttttgttttgttttgttttagatggagttttaatcttgttgaccaggctggagtgcaatggtgagatcttggctcactgcaacctcctcctcctggcttcaagtgattctcctgcttcagcctcccaagtagctgggattacaagcgcccaccaccacgtctagccaatttttgtgtttttagtagagatgaggtttcaccatgttggccaggctggtctcaaactcctgacctcaggtgatctgcccgcctcagcctcccaaagtgctgggattacaggcgtgacccaccgcacccagcctcattttgcttcttaatgaacttatagtattgaagtagccagtgcttcccattccatcataaaacccagcgatggatgctcctatgttggagcccctcgccaaggtgagactcacactaaccaagagtcagttgtgtttgtccccagtcctgtgtatgacatttttatttatatttctgattgcattattcaatgaaatagtatgtaaaccaataaaatgtgagtgataaaaggatgagcattattttttataaaaacttaattataggaaggttcctatcaacagtaatgcaagtagataccaggtggctgagaagggcacttcacctatcttgtattctgtccccaagcccataactccagtctaatctggaaaaaatttcagataaacctatattgggagacagtctataggatacctggccaggatgtctcaagactatcaaggtcatgaaaaacaaggaaagactgagaaactgtcacagaccagaagagactgggcagatatgacaactacatgtgaggagaaaccttggattggatcctgaggcagacagataacaatgacaaaggtggcaaaggctgggcacggtggctcatgcctgtggtcccagcactttgggaggccgaggcaggcagatcacctgaggtcaggagtgtgagaccagcctggtcaacatgatgaaaccctatctctactaaaaatacaaaaattagctgagcatggtggtgggcacctgtaatcccagctactcgggaggctgaggcagaagaatcgcttgaaccagggaggcggaagttgcagtgagccaagatcacaccactgcactccagcctggcaacagagtgagattccatctcagaaaaagagaaaaaacaaaagaaaaaaaaaacggtggtaaaatactaatgaagtctagagtttagttaatgataatgtgccattgttggtttcttagttttgacgaatgtaccagagtaacgtaggtgttaataattgggaggattaggtgacgggtattcagggactctctgtactatctttgcaatttatctgtaaatctaaaattactgcaaaatgagatgtttgtttttaaaaaactaaattacatgcctcagaagatttgataataatggattgcttttaaacaatgctgttaaattaggcatgggcacgacctaactgtaaaggataagaacaatttttgaaattttgctttacacatctccttacgttcatgctccactttaaagaaaatgaaaccagaaattgtagatgatgctttatggctatagtttatgcaggaaagatgatgctgaattccaatcaacatattcaggatgatggcctaggttaaaacataggcaaaaagaatgagcatttatttatatttttacaaaaatagttcatatacatagtatatatcgcttgttatgattccctaattttgtcatctaatttttaaccgacttaccaactaccagtctcaattgcgttaaataagatggcttctaccaaaaactaaaatcagacaatcacggattgtgaagggcattctgaaagaaacaggcaggatagggtaatagagaatgacaggcaggggtgggagggcttcttggagaggtcagggaaactctgagaatatgacatttgcattgaggtcagaatatagcttagggaattttggttggcagagtgtaatgaaggagaaagtcatataaacggataagtgcagcagagggtcatgagatggatgtgctgacggagcagcaggaccaagaggcgggtgcacatttcttgctgcgggtgtcagaagaggcttcatggaagaggctgccacccagctgtgctttgaaagagaaaaacatgtttcccaggcagatgcaggagggagaagagtgatctccgacagtgggggaaatatttaaaaagcactgaagtatgaaatattggggaaccataaacagtgtgatgcaggggagtaactggtcagattcacatgtttgaaagggcggttagcagcagtctaaccttgctacttagagtgtggtccaaggactaacagcatcagcgtcacctgggagcttgttagaaatgcagaatcttgagcccctcccagaactgctgaatcaggatctgcattttaagaagaatgccagggaattcagatgcaccatatagtttaagaagcactggtgcagaggatggactggagagataaaaaattaaattatatacactttaataaaatagaattaattaaaaacaaatattttatatgtatattttattaatataatttaataaaattatattaaaaacaaagataatgaattctcaaaactcatcacttcctaattattttactattatccaagttgaagggttacttttatttactgtgtctggtggaaacaccgtacagtggcgtgattctgcacatctcttgctaactccacaatcagtgacgtcacagtagtaatttgaaatctgccacagtgtgaatatttacaccgtcacgatcagcaaatgctacaaagcagggcttaatttgttgtttttgttgattttctagatcaggagtcagcaaacttgtactataaaggacagatagtaatatttagggctttctgggccatattacgttggctatttaaccgtgctgttgaagcataaaagcagccaatgataatatgtagacaaataagtgtgcttgtgttccaataaaattttaatttgtattttttctttttttaatttattttgtttctatgctttgcttttttcttattttttcttcaatcataccccaaacctcagtacaaattttaatttgtataaattgttttcaatattattatcttaaaatatttattactattattatgtctaccagccatagtttgtcaattcctggtttagaattgtgaaagtgatggagaaagtgttaatagtacaaatgaaaatttaaagtgtttcttgtctgtagccattacatcgtgactagcataaaaaatggagaaaatattcttccaatattcaaaaatctactatctgattcagctaagaagtggctcacatcactgatgaatgagaaaagttgcaatatacatcttccttccttcatattaattattgtaaacaaaaataacaccaatattcatgttgaaaccactcatttaccagttgccccgtagaatggctagagttagaaaagttcagcagaaaacaacaaaagccttctgtgagaatcaattggcaacacggaatttacaatgcacattgttgtattcttgctgtttgattattatttataaattgtgtgccacacataaatgtatatcagtaaaattttaaatacgtttatacgcatataggtatactttttgttttctggtttgctggtcgttatacatttatcagcacgccattgctcaggtttctggtttagatgagaaggtgaatgggggtggtaggaaacaggagaggcagctttgcaaaaaaatttgggttcagttttggacacattccccaattgtaatatgttacattaaaaaggggcccaaccccacatcccacgagccaccctagtttcttaccagattttgaatggaatcaaaagattttctaaagccattaagtgtccacccatatgctattcccctgttaaaataagcgggccattgtggaaggctgttcacttccaactctgaaggtgtaatccacactgtagtccatgtgaaagcaaggtaaatattgagctcttctccctctctctaccccaacctcttttaatcatggtaaaaaaacacgtaacataaaatttatcctctcggccaggcgcagtggctcacacctgtaatcccagcactttgggaggctgaggtggacggatcacttgaggtcaggagttcgagaccagcctggccaacagggtgaaagcccatctctactaaaaacacaaaattagccaggcatggtggctcatgcctgtaatcccagctactcgggaggctgaggcaggagaatcatttgaacaggggaggcagaggttgcagtgagccaagatcatgccattgcactccagcctgggcaacaagagtgaaactccgtctcaaaaataaataaataaataaaactttaccctcttaaccattttaagtgtagagttaaaatgggccagtttggaccctagagtttgggagctccattgtgaaagtatattgcctctcagataagatttctagatagaaactctagctctgaccctcagtttgaggttagttctaaaaaagattggggaccattctcttctccttcatcactggctcactcaaccccacaaccgtttcctacttataagcatccaaattgcctgctcaaatcttttcttttctttctttttttttttttttttaatcaatgttgaccaggttggcctcgaatgtgtagccttgcctccccgaggaccagggcaaccggcctgagccacagcggctccatcaaatcttttcttctgccagccctggatggtgcttccagggtgactgccaccctatgtcctgagccctgaggaagaccctgctgtgccaaggaaaactgtgagttgttggaatgacctgcagagagagcaggctcagctgggacctggatctgttctggactcagtaaaattgactctgacactgggtttaccaaagtgcattctgcaaaataagaagggcttatgtggaaaaagtgttctgaggtcacttagattcaaaatattccaagttaagtaaagttactgataaagttaaatatattttatttatttatttatttatttatttatttatttatttttttgagacagattctcgctctgttgcccaggctggagtgcagttgtgccatctcggctcactgcaagctccacctcccgggttcacgccattctcctgcctcagcctcccgagtagctgggactacaggcgcccgccacgacacccagctaattttttgtatttttagtagagacggggtttcactgtgttagccaggatggtctcgatctcctgacctcgtgatccacccacctcggcctcccaaagtgctgggattacaggcgtgagccaccgcacccggccaaagttaaatatattttaatgatggcagaacacctcagaatcttgaatgtgccaatgtagattgtgactctcctacagcgggtagaacctgtagcatttctctacctacttgatctcagaatctctttttctgtatgtgtctatctttcatgaccacttgttacggattgaatgtttgtcccctccaaaactcatgttgaaatataattgctattgtcacagtgttaacaggtaggactttttaagatggaattaggccatgagggctttgccttcactaatgaactaatgccattaatggtgggagtgggtttgttataaaagggagggtttggcccccttttctctgtctctcactcttcactctgttgccatatgatgctcttgtggtggtacaatgcaggagaaatgccaaggcaagatgctggcaccttgatattgtacttcccagcctggagaacggtaagccaaaacatttctgttcattataaattacccagtctgtggtattctgatatagcagcacaaaacagataaaacactgttgctctctggaagacagtttgacaaacagaaccctggggccatcccaaaaggtggcaacagcagggaggaaaactggcttcttccatcagtctgggcacatctctcttcttcaaggcaaaaatgtgtattccagggttttagctcaagtagagcacttttcagcttcagaacccaggttgggtttaaaccagccctttttaccacaagataaagtcatatgtgatttgaggctagagcttgaactggcctcatattttagctggagtggttttcctatgtgtttctttccgttctcttttctttctttctttctttctttctttctttctttctttctttctttctttctttctttctctttctttcttccttccttccttcttcttttctcttctcttttcttctttctccttccttcccttccttccttccttcctttccttctttccttccttccttccttccttccttccttccttccttccttctttctttctttctttctttctttctttctttctttctttctttctttcttttctttctttctttcctttttttctttcctttttgacagagtttggctcttgttgcccaggctggagtgcaatggcattgtctcagctcattgcaaactccacctcccaggttgaagctattctcgtgcctcagcctcccaagtagctgggattacaggcgcctgccgtgacaccaagctaatttttgtatttttggtagaggcagggtttcaccatgttggccaagctggtctcgaactcctgacctcaggtgatccgcctgcctcggctttgcaaagtgctgggatgacagtcgtgagccaccgcacctggctacgtttcttgattatattctaagaaaaggatgttcccacattaagcaagtcattaaatccagactctgctaattggtaaatggtgataagggaatctacaaccttatttccacagatgctataactatccacttgtcattcaattacttagaaattcctgggagatataagttaagcaaacatagagtgttttcatctattaactatatctgtaccctgttactatacacgctgtggaaagttttaaggatactcccaggaacgtagcgggtgggggcgggagagaaacaacaaaaacattttctatttcccagaagcagaaaccacaatggaaataatctaaatatttcctcttatacaaagaatgtcccacatagcaatacatacaatgaatgacaacatcaccagatttgagaagccaaggggaaggaaatggcagaaattcgggggatagaaaagacctctgtgttccatgccaaagatgctaggattcagaatcataggatgttaggcagtttaaaggtcacttagtacaccctttcatcttgcagatgaggcaactgagccattgaaaaggggcttgtgcaaggacgtctgattaatttggtaaggccagaatgaaggaaagttgacacattttcaatttacttatctgttaagctctggcccctggatgcagcctgcagcctcaccctgccttgctaatatgagtcggtctaaatgcgtgtgttggtcacaattgcttctacttgtactcatagccttttactgctgaggtttgagagccaatttctatggtatttgctgacccttgctgctcacctttcttcagtgctctggtaatgcattgtaaaggcatcagaatctcttcaccacacgaaacagtccactttacaatacctctgttgagtcgagttaatatctgagctacagtgagatgcagaacaactggaatcctattatttaagatcagaaatggctgtagtcctagtttttcatttcctttgaagcagccaacatacttttcttgttgtttcttttttatttttatataatacaaaatatagggatgattttgtgttggagagttcttttattggcaagaagaggttttttgatagaaaatatttgcagctctttaaaaaagatttttaattctttttaagatttgcatagaaacctacaagcttggttgcagactgcttaaaatagatgagataaaatgatatgtaatggagagagtgagcttgttataatccatcgacaatctgcttaatttcatgcatcagtttaggcaattaatcaataaaaaatataaaaccgtacacataaaaaccataaagttacttcatatgacttattacttgagtagctacttcacaaaagtagctgacttctaaaagtcagctttgtatatcaatgcatggttacaaacaataaaatgtatgcatttaagttcaatggcctttgatacatgttgcactcatgcaaccattgtaaccatcaccacaaggaagacatagaacattttcatcagccaaaaggttatctcgtgctcatctatgagtaaaccataggtatgatgaccttttactgcctaaatatttcatattatacttcctaaaaccatgaattctctcatatgaccacaggacaatttacaaaatcaagaaatgaggccgggtgcagtggctcacacctgtaatcccagcactttgggaggctgaggagggaggatcacttgaggtcaggagctcaagaccagcctgaccaacatgttgaaacccattactactaaaaatacaaaaaaattagccgggcttggtggtgcatgcctgtaatctcagctacttaggaggctgaggcagaagaatcacttgaagctgggaggcagaggttgcagtgagctgagattgcaacattgcactccagcctgggcaacaagaacaaaactctatctcaaaaaagaaagaaagaaagaaagaaattaactctgaaacaatgctactatctaatctacagaccttattaagatttttccagctgtctcaccaatgtctttcacagcaaaaacaatctaaaatttgaatttgaattcagtcgtcttgtctctttagtctcctgggatatggaataattttctgagtctatttttctttctcatgacattggcatttttgaagagtacaggagtacagagtacaggacagttattttgtagattgttcttcaattaactcaggcttgtgggtgtttcctcatgactatgttcaggttatgaacttttggcaggaataccagaggagtagtgctgcgttgttctcagtgaatcttatcaggagttacatgctgtttactagtgatgttgctgcaagagtacctttggtcatttggttaaggtagtgcctgccatctttccgcaccttaaagttgctcttttccccttcataattgtattagtccattttgcattgccataaaggaatacctgaaactgggtaatttataaagaaaaaagggttatttggctcacagttctataggctgtacaaacatggcatcagcatctgctcagcttctggtgaggccttaggaaggttttactcatggcaaaaggcatgggggagcaggcatgtcatggtgagagaggaagtaagagagagaggagaaggttccaggctcttttaaacaaccaactctcatgtgaactaatagagtgagaactcactcattactgttgaggacagcatgaagccattcattgaggaatccactcccatgatccaaacactcctaccaggccccaaatccaacattagcaatcacatttcaacatatttggaggggatgaaacatccaaaccatatcattccccccctggtccttcaaatattatgttcttcccatgtttcaaaatacagtcatcccttctcaatagtccccaaaagtcttaactagttccagtatcaactcagtcaaaagtcttaactagttccagcatcaactcaatcaaaagtcttaactagttccagcatcaactcaatcaaaagttgtaactagttccaacatcagctcaatcaaaagtcgaaagtctcacctgaggctcaaggaaaatttcttctacctatgagcctctaaaataaaaaacgagttccaagatacaatggctgtacaggcattgggtaaacattcctattccaaaagggaaattggccaaaagaaagggacaataggccccacacaagtccaaagcccagcaggaaagacattaaactttaaagctccagaataatccttgactccatgtcccacaaccagggtacactggtgtgaggagtgggctcccaatgccttggccagttccacccctgtggctttgtagggtacagcccccatggctgctctcatgggttggaattgaatgcctgcagctttccaggcttagggtgcaagccgctggtggctctaccactcttgggtctggcagacagcaacctccttcccacaactgcactaggaagtgccccagtgaggactctctgtgggggctccaactacacatttccccttgtattgacctagtagaggctttctgtatgggctctacccatgaggcaggcttctgcctggacaaccaagctttcccagagatcctctaaaatctaaggggaagctgccaaacctcttttactcttgcattatgtgtgcctgcagacttgccaccacatagaaactgccaaggcttaaggcttgtgatctccaaagcagcagccagttctatgcatagggccctttgaggcatgctggacctggggctggagcagccaggacgtgggcagcagcctctcctgagtgacacagagaagtggggccctgagcctgatccccgtaaccattgttggttttttttttttgagacagagtctcgctctgtcgcccaggctggagtgcagtggtgcgatcttggctcactgcaagctccgcctcctgggttcacgccattctcctgcctcagcctcctgagtagctgggactacaggcgcccaccaccatgcccagctaattttttgtatttttagtagagatggggtttcatcaaaccaggatgatctcgatctcctgatcttgtgatctgcccaccccggcctcccataaccattcttttctcctaggcctttgagtctgtaatggaagggactgtcctgaaaacttctgaaatgccttctgaaaagtacttggctcccttttagtcatgcaaattactctagcaagtggttgctttgcagcccacctcaattcctctcctgaaaacactctttccttttctaccacatggcagatgcagattatctaaattagcagattatctaaatttttatgttctgcttttccttataagttccaactttatgtgtttccttttctcccaaatcgatcataggttattaaaaacagccacatcatttcttaaacaccttgctgcttagaaatttcttttgccagataacctacatcattgctcttaagttcaacctttcataagtgcctagggcatggacacattgcagccaagctctttgctaaggcataacacatgtgatttttagtccagctcccaacaaatttctcatttccatctgagtcctcattagccgggccttcactatccatatttgtatccacattttggtcacattcatttaaccagtctctaagaagttctaaactttcccttattttcctgtcttctgagctctccaaactctttaaacttctgcatattacccagttccaaagatgcttccacatgttcaggtaactttatagcaacaaacaccccactcctggtaccaattttctgtattactccattttatgtcgctataaaggaatatctaagacaaggtagtttattttaaaaaaaggttatttggctcatggttctgcaggctgtacaaacatggcaccagcatctatttggcttttggtgaggtctcaggaagcttttacctgtggtggatgccacagagggagcaggcatgtcacatggtgacagagaaagcaagaaggtgggtggaggggggtgtgttccagacttctttaaacaaccagctctcatgtgagctaacagagcaagaactcattcattaccatggggactgcactgagccactcatgaggaatccatcttcatgacccaaacacctcccaccaggccccaccttcaacatttgggatcacatttcttttttttttttttttttttttcttttgagacagagtttcactcttgttgcccaggctggagtgcaatggcgcaatctcggctcactgcaacatccatctcctgggttccagtgatcctcctgcctcagcctcctaagtacctgggattacaggcatgcaccacaatgcctggctacttttttgtatttagaaaagacagggtttcaccatgttggtcaggctggtcttgaactcttgacctcaagtgatccacccgcctcagcctcccaaagtgctgggattacaggtgtgagccaccacacccagctgggatcacatttcaacatgagatttggaagggacaaaaaacacccaaaccatatcaataattcggtagtatttctggtaatattcattgagatccactatattcttcaacatttatactcatgaacatttttctcttaagatgagagaatctcaattggccagaatcaattaagtagaagttgtcttttgctaaccttttttttgcaccctacaacctggtgaaaggagagaacttaaaacatgttttagagctcacatcaggaatttatctcactaaaagaactttgtagggtccacctgaagttctgaatactggtttacaacactggcatctattgtagttgcccattatcactggacgtttagatacctcagtcttaagggttaactcaactgtgatgattcttcggtgaagaagtcatatataaatgtataagtcaaatatattaatgtataaatatctaagtcagaaaagcttatgtattttagaaagagtttcaacaactgatgttaaagtgctaaaataaatttccccatttcctatttacatttgaataaatgctttcagattagttgaagttttctagcatataatgaaatcctattccatctttgacaaatatatttctaacaaatgcaatattgtttgtttctatcattattgactggctgtgttttattccatatttaatattttatgcctttccacacactgtgacattacactgatgaactctttaccacaataatttcccttgtcatttaaccttctgggctgttttcaaatgaacattcctggcctcaaatcatctggtaattaatggggaggaattatgttcattctctaaaatcatcttctagaatatttatttcttttgttgtttctttagaagaagtgtgggaaaatgtgctacaaacatttctcaaaacgaggctgttaccccttaaaaacaaaggtcagattctaaatgcatgcttactcattgctggaaaagcttttacatctttacatttactgaagcacagggccctctgttatcagatgccttcattttatgttttattaaataagaaatttagactttagggggcacatatttgaacattaaatatgactgagagtctagcttcctgttcatttacatgcactgatagaccagtggaagcagaggtaaggcctcctgttgtctttttcaaataaaataaaatgtggagaacagagaagcaacagtgaatttcggaggttgggtatatctggatgcttatttggtgtctcatcctttgtttccttccctgactcccacattggccatgaattgctctcttctgggtcctcccccattgatcataccattgaatatggctgtgctgttgctcccactaaacctgggactctttcctatatgtatttgtatccagggcacctagatgagttcctgagacctgttgggtggttgaatggataatgaaatgcttcagaggtttgattaatatcatataatattttatagctagaaagagacttaaaatgatctaaaacaacacaactttttatcgaagaggaaagcaactttgagtggttaaacacctggtcaatgtcacccactctttagttggtagaacaggactaaaaattacctggttcttttttcatggcagcatgtatttaacaatttttgattcttacaggactggacaaaaacaaatttggctgggagtggtggctcatgcctgtaatctcagcactttgggaggctgaagtgggcggatcacctgaggtcaggagttcaaaaccagcctggccaacatggtgaaacctcgtctctactaaagatacaaaaatgaggcaggcatggtgatgcacacctgtagtcccagctacttgggaggctgaggtgggagaattgcttgaagccaggagatgggtgttgcagtgagctgagatggtgccactgcactccagcctgggtaacagagggagactccttctcaaaaaacaaaacacaaaaacaacaacaacaacaaaaaacaaattagagagaatgtagagtctaatttcccccttgttctttacttactgttgacatagctgatgtctctgaaagaattcactttgggagtaacagccttgaagatcagagtcaatggctagtgatggataacctctgtcaacctttatatcaaagcaatgttcccagaggattaactggaacctactccatttaatgacatttttcattctggaatccattgcatagatgacgctaaggtcatatcacttctaaactcttgttcctaatagtccttccacttagaatacatttttttattaacaatgttaaagacataaatggatctgggagtttaaaaaatgttgagtgaataaaaaagtcgcagaaagatgaatatagtatggcaacagtcatgtaactttttttctccatttttagtcatacacagtaaaagtcactttttggtgtacagttctgtgagttttgagaaatgcatacggttgtgtaactaccaccgcaatcaagacacagaacagttgcatcacatacaccctcaaatttccttgtgctgtgtctttatagtcaaagctcacccttctttcagaccccctcttctctctggcaatcattgatctgtagtatgttactatacccttttccaaaatgtcgtataaatggaatcatatgggatgctacctttttacactgatttttttttttttttactcaacataatgttcttgagatccatccaagttgttacataaatcaatagttctgtttttattcttaagaaatattacattttgccatagaccacagtttgttgggagactgttcagttttttacaattatgaataaagttgctataaacatttgcatacaagttttggtataaacatagattttcgtttcacttgggtaaaaatgtagaagtgggatcactaagttgtaggttaaatgttgtttaactttgtaagaaactgccaggctttttccgtagtgactgaatgagagttccaattgctccacatcctcgccagtacatggcattgtcaggtttttattctatttttagccattttggttggtacacagtggtatttcattgcagtttattttttatttatttatttatttattttgagatggagtctcgctcttgtcacccaggctggagtgcagtgggcacgatctcgactcactgcaacctccacctcctgaattcaagtgattctcttgcctcagcctcccaagtagggaagactgaaattacaggcgctcgccaccacgcccagctaattttcgtatttttagtagaggtggggtttcaccatgttggccaggctggtcttgagtccctgacctcaagtggtcctcccacctcagcctcccaaagtgctgggattataggcatgagccaccacgcccggcctcattgtagtttaattacaatttttctaattatgaataatttgaagatcttttcatatgattatttgccatgtgtgtatcttctgtggtgaagcacttgctcaaatatttttcccattttaaaaatattgttttcttactgttgaattttgagagttctttatatagtctatctagaagtcccgtgtcagatatgtgacttgcaaatactttctcttttttctctttcttgtgaatttcttaaaggtgtctttcacagagcaaaaatttctaatgttgataaagtctaatttgtcaatttttttatatgaagcattgctatttataccacatctgagaacactttgactaacaatgtttcttttaaaagttttagagctttggctgggcatggtggctcatgcctgacccagcactttgggaggacaaggaggttggatcacttgaggtcaggagttcgagaccagcctggccaacatggtgaaaccccatctctaccaaaaaattcaaaaattagccaggcatggtggtgcatgcctgtagtcccagctattcaggaggctgaggtgggagaatcgtttgaacctgggaggtggttgcagtgagctgagatcacaccactgcactccagcctgggtgatagagtgagaccctgtctcaaaataaaaagttttacagttttatgttttacgtttaggctaatggtccattttggattaatttttgtttaagatgtgatataccaatttgaagccacaaaaatcactatatataatgtacagtcatgtatgtgtgcaattaaatttaaaacaaacatggatgatggatggatacacggggtgggagggagtacccatgagtttgggtaaaattggcaaagaagtcttcaacagcaacgataacattttattccctttaaaataatcaatcttggagttatgggaagatgacatacaagtaacatcctctattctttttgctaagtacaactaaaaagcctgggtattatatataagacataagactctgagaagtggaggaaaaaggcatattaactagcgatttaggggcctaaggaatgacacagtggtgagttccctgggtcttctttctgtctcatttatattccagacttggaattgaggaagctggcaacccagaaactccagatgatgcatatggaaaaaaatcctcaacaagccttctcactccagccaaaggatcaggaaggaggcagtgtagtaagacaaaatacttgtagacaatacctgctatactgcagtcaaaatccacagaaaaaaaaagtggcccccaactccacccatgtcagcaaagattcaatactacttcggtctgaaagtttgtggccccttaaaattcatatgttgaaatctcaaggtgatgatattaagaggtggggatctttatgagatgattaaatcatgagtgcagactgttcatgaatgggattagtgcccttatgaaagagacctcagagagctgttttccctcttccactaggtgaggacttggtgaggaggagccatctatgaggaagaggttattctctgacactgaatcccatagtgctttgatttggactttccagcctccagaagtatgagaaataaatgtttgctgtttataagccactcagcccagttcatggtatttgtgttatggcagtctgaatggactaagacaagttgggagctgagacttctactcttgtgagactgtaacaatgcgtgtcagcaccgcactgcaacggtgtcaagagaaggccaagcaaggagccaggacttgcataccaggcagctggcaattggcccccatcccatgatgtgtcattggagaccacgtgaggagccagaactcccacccttgaccagcagtaacaaggaaccaccccttcaggtgtcagcttaggcaatgttgggaacctggactgctactatcacctggcagtaatgaggcagcacgttccccttactcagccagccagctgaaaaagaagggtttttttttgagacagagtttggcttttgtcaccaaggatggagtgcaatggcactgtatcagctcactgaaacacctgcctcctgggttcaagcaattctcctgcctcagcctcttgagtagctgggattacaggcacccaccaccacgcctggctaatttttgtatttttagtagaaacagggtttcaccatgttggccatgctagtcttgaattcctgacctcaggtgatccaccctccttggcctcccaaagtgctgggattacaggtgtgagccactgcacccagccagaaaaaggtttcaataaacatccagagtctcataacataatatgaaaatcagcagatggagaactaaataccactgataaccaacaggatctaatcatttagagaataccccacttaagaacatcagaaggccaggcgcagtggctcacgcctgtaatcccagcactttgggaggccgaggcaggtggatcacctgaggtcgggagttcgagactggcctgaccaacatggagaaaccctgtctctattaaaattacaaaattagctgggcatggtggcgcatgcctgtaatcccagctactcgggaggctgaggcaggagaactgcttgaacctgggaggtggaggttgcagtgagccaagatcgtgccattgcactccagcctgggcaacaagagtgaaactctgtctcaaaaaaaaaaaaaagtacattagaatacacattctttccgagtgcccatggaatatatgccaaaatagactgcattctaagccccaaaacagacctcaaaaaatgtaaaatagttgaagtcatagagtgtattttctgaacacgatggaataaagttagaaatcaaaaataaaaagataacatagaaatctccaaacacttggaaactaagtaacacacttttaaataatccatgggtcaaagaggatgtatcagaggaaataaaaaatacattgagattaattaaaatgaagatatattaaaatgtgttcccatgaccatgacataattgtctgcataaaagatagcaaggaagaaacaacagcaacaaaaagtttctagaataagtgagttcagcgaagtcataggatacgtaataaacttacagcaatcaattatatttccatatactagcaatgaacaaacactgagatttagcatacaattctactcacagttgctttaaaaataaaatgtttagatgttaatctaacaaaatatatacaggacttgtatgttgaaaactataccatgctaattaaaggaatcaaagacgatctaaataaattgagagacacgttatgttcatggattggaatactcaatgtaatgatgatgtcaatactccccaaatttaaatacaattttagcacagtttttatcaaaacccatgcaagggcttggcacggtggctcacgcctgtaatccccgcactttgggaggctgaggcgggtggatcactaggtcaggagatcgagaccaccctggctaacacggtgaaacccccgtctctactaaaaatacaaaaacttagccgggtgtggtggtgggtgcctgtagtcccagctactcgggaggctgaggcaggagaatggcatgaacccaggaagcggagcttgcagtgagccgagatcgcaccactgcactccagcctgggcaagacagtgaggctctgtctcaaaaaaaaaacaaaaaacaaaaaacaaaaacaaaaacaaaacgaaacaaaaaaaccatgcaagattttttagatataggcaagattattctaaaatttctatggaaagggaaaagaattagaatagccaaaacaattttggaaaagaagaatcaagtggaaggaatcagtctgcctgatttcaagactaattctatagctgtgactgttatgactgtgtggtattggtggagggatagacacatagatcaatacaacagaatacagaactccgaaatagaaccacacaaatatccctaactactttgtgacaaaggtgcaaaaacaacgcaatggagaaaatatagtcatctgcaggtgctggcaggggactggttccaggaaccctggagataccgaaatccatgatgctcaagtcccacagcaggccctgaggattccacgggtgcaaaaagttagccttcggtacctatgagttttgttttgttttgttttgtttttttgagacggagtctcactccgtcgcccaggctggagtgcagtggcacgatctcagttcactgcaaactccgcctcctggattcaagtgattctcctgccttggcctcccgggagtagctgggactataggtgtgcgccaccatgcctaatttgtgtatttttagtagaggcagggtttcaccatgttggccaggctggtcttgaactcccgacctcaggtgatctgcccacctctgcctcccaatgtgctgggattacaggtgtgagccaccacccccgacctgtatctgtgaattttgcatcccacaaatactgtatttttttttttaatcttcagttgagtctaagcaaaaggaacccatgggtacataaagccttttcaacaaatgtcactacagtacatcaacaaccagccattggtgaaaatatgagtcccaacctaagtctcaaatctcacaaaaatattaacccaaattgaattacagacataaatgtaaagcataaagctatgtattttttctttttttgagacagggtcttgactcactgcaacctccacatcctgggctcaaacgatcctcttgcttcagtctcccaagtagctgggactacagacatgtgccaccatgcctggctaatttttgtatttttagtagagacagggttttgccatgttggccaggctggtctcaaactcctggtctcaagagatccacctgcctctgcttcccaaggtgctgggattacaggcatgagccactgaacctggccagaacagggacattaaagctactgtttcactttaaccagccaaatacagtcatgtactgcataacattttggtcaacaacagaccgcatatacgacggtggtcccaaagggtataatactgtatttttactgtaccttttctatgtttaggtgcacaaacacttgccattgtgttacagttgcctacagttattcagtgcagtaacatactgcataggtttgtagcttgtgaacaataggctataccatctaggctaggtgtgtagtaggctgcaacatctaggtttgtgtaaaagcactctatgatggtcacacaatgacgaaatcacctaaccatgcatttctcagaatgtattcctgttgttaagtgatgcatagctgtattttgtcttgctcccaagaataccttatagaagttttccccttggcccccttggtggaaccccacctgcttgcagttggtgttgcctgattcctgaatcacagtctgctcaaataaactaaaatgttcacgtgcttcagttcatcttttaacacttataatacatgttattctacagttatttcaaaatgaaaagtttaaaaatggaactgaaacaaaaatgctagtatttataaaagcgtttggtggttacattagtgtgtattatataattttctgtactttttataagttattttattaaaaaaaaatacttcagccaggcatggtggcttatgcctgtaatcccagcactttgggaggcggagttgggtggatcacctgaggtcagaagtttgagacccgcctgtctaacatggcaaaaccctgtctctactacaaatacaaaaattagccaagcatggtggctggcacctgtaatcccagctactcaggaggctgaggcaggagaatcgcatgaacctgggagatggaggttgcagtgagctgagatcacaccactgcactccagcctgggcaacacagtgagaatccatctcaaaaataaaaaataaaaaaaatacttcaagacttaggtcaaatgtctcctccacttaaggctattgtcagatagaatgacattagctgctcttcctccatgattccatgggggtaaaatcagaataagagcatcttgtcatttttctttctttacaccgcttcccataactcccatatttaatccactgccttgaatgcaatggttattcttactgatacaccattatttttgtgtatttagctgtgtctaagggatctaaattagaaagaaaccaaaaaagcccacacaatttgagtcttcattccacaaagaaaaaatccagccaaaataaatgcaccataagttacagcaattcaaagaaatcataaggaagggtattgaaaaggacccacagtgtgcttttttccaaagcggttcttttgcccaaggggacaaatgtcttttgtggagtggaaattttgttttggttcctttgatgcccacttctctatcttcgtggtgtttagaatgcttctggtgtcgagtaacagacattgaacttcaccggctgaaacactgagtaactgtcttggctctcagagcgggagagtgttgatagggcatgatcagggtcatcagaatccagaggctccagttccgtttcctggggctctgcattcccctgtgggctgatttcatttgtagcttaatattggcaagttctaggcctcatatcctcacatgatgatatccagaggaagagaaagaccctctcttcatcttgctttctccttagcctgaggagacgcccccaggatgccccaggaaacctctccttgcattattggctcacatgcccattgctgagccagttgctggcagcggggatggaatccccccagaccagccgggcctcttgcccatcctgaaggctccctgccctggaggacctgagggctgtctgggagaagggtggctactttcatgcgtgtccgtgtgaagagaccaccaaataggctttgtgtgagcaataaagctttcaatcacctgggtgcaggcgggctgagtctgaaaagagagtcagcgaagggagataggggtggggccattttataagatttgggtaggtaaaggaaaattacagtcaaagggggtttgttctctggcgggcaggagtggaggtcgcaaggtgctcagtgggggagctttttgagccaggatgagccaggaaaaggactttcacaaggtaatgtcatcacttaaggcaaggcctggccattttcacttcttttgtggtggaatgtcatcagttaaggcggggcagggcattttcacttcttttgtgattcttcagttacttcaggccatctgggtgtataagtgcaagtcacaggggatgtgatggcttggcttgggctcagaggcctgacagttacctgaacatgttacaggaaaggggtcccgatacagaccccaagagagggttcttggatattgcgcaggaaagaattcaggcgagtcctcagtgcaaagtaaaagcaagtttattaagaaagtaaagcagggccgggcacggtggctcacacctgtaatcccagcactttgggaggcagaggcgggtggatcacgaggtcaggagttcaagaccagcttggccaagatggtgaaaccccatctctactaaaaactaccaaaaaaaaaaaaatagctgggtgcggtggcaggcacctgtaatcccagctactcgggaggctgaggcaagagaatcgcttgaacccaggcagcagaggttgcagtgagccgagatcgcaccactgcactccagcctgggcaacagagtaagactccgtctcaaaaaaaaaaaaaagaaagaaagaaagtaaagcagtgaaagaatagcaactccacagacagagcaggacattcccaaaagtaagaggaggaacgtgcccaccctaggtacgatgcttgtttatatacaggataaaaaaagatcttggggagatgggctctgctacgagggtctgtgataagggattaattttcttaattattatattttgcaaaaattgatattatatttaaagcaaaattaggaatgcctttgttctccagatattgggatatctggatactcccaagtctgggtctgttgagtaaacattattaatttgttcccttaaccataaacatctagaggttcagaatgcttaactctctgggaatgcagcccagcaggtcccagcctcattttccagccctcattcaaaatggagttgctctggtttgaacgcctctgagaaacaggcttggggttctggagtggtgacggaggctaacaagaaagtccatcctaatctccctgtcagcccttggtcaagctatggcttttattcatgcctctctctttctgcaaatttattcagctttgcttctttgcatcaggtggtactggggtttaatattcctggctgacctgaacagagaaacttagccagcgtgatggcccacacctgtagtcccagctactctggaggctgagatgggaggatcacttgagccccggaagtggaggctgcagtgagccaagacagtgccactgcactctagcctgggcaacagaacaagaccctgtctcaaaaacaaacaaaaacaaacaaacaaacaaaaacagagagaaaagagaaactttcttccacatgttttctgtccatgataatatatgctaaaaggcctcaggccagagccaggtggggagtgttacttattaaaaaaaattctgggcctacattacaaggagagatgtacaggcttggggagagatgacccaggcggatctctaagtccaggtggatggaaagacagacagtgcccagtaggtgacaggatgacagggacctgtcgccaggcccctcagtggcttgggtgatgtggtaggtctccctaaaagaagattgaaggccagaataaaccgacagagaacctggggggcacacccagacacaggagtgtgttcccagtatgtgtttaaaaaacaaagattaagggtatgtctaggaagaacaggaaatgagccaggaagacaggccaggggactgttacattccatttgggatttagagggaatagtgagggtacagtatcttgaagcaacaaggtattcaaagatacaggaccaccacattcaggtctgtggtccactaatgaatacgctagtcctacagcttccatggatttacaggatcaatgttagtttaagcccccagttaatttcagtaaatgaaggctatttttttaaattaaaaaaaagcttcaaaattcaaaatgaactcaagaacttgaattaaaagcacataaacataaaaagaaaccactgaagtctggaaaaaacgttatttaaaatctgccactactggtaatcacaatctctttctctaatcatctctctaacttatttggaatcgtttttgagatatttatgggtctggcctggtaaagatttagtgatgatagatagtactgtgcgctctggggagagagaaggaaaaaaaagaaattggagcacagaaaaaaataattttcctctattctcctttctgaaaaatcctaggagaacacatgaggaactattaatagtgcttacttctgagcaatgggactttgggttgaacaggtagggaaaggaagtcttacatttaccaccattctgtgtggtaggcattttttttttcatacatcatgagctcatataactactgtcattttttttttttttttagacgaggtttcgctcttgttgcccaggctggagtgcaatgctgcgatcttgggatctcggctcactgcaacctccacctcccgggttcaaacaattctcttgcctcagcctcccaagtagctgggattacaggcatgtaccaccacgccccgctaatttcttatatttagtagagatggggtttcaccatgttagtcaggctggtctcgaactgctgacctcaggcgatctgcccgcctcagcctcccaaactgctgggattacaggtgtgcaccactgtggccggccgactattgtaatctttacaagtaaaacaaaactaaggaaaaagtgtattaaatatatctccagttaggacctgatgcatcgattcttagttctgctaatgttcagtgcaactgtcttccctgtgatgaatttgtgtttgaggtgtccttggaagcctcattcagtagggaaggaatgtgagtgactaagtttaacaacaataaacgatgaacattctcaactgtatgctttgtacagatgcttcacatactaaatatcaccacggagtctccactaagccttagctgcacccttctcataaataccctgagaaatgcccaaagatcaggcacggctcattaggaaatgtaacggagtcgtgactgaacacaagtgacagattttaattcagattagctcaacagtgcagtaaagtccaatcttgattctgtcgggggtggggagggagcagaaacaaaagaatgtcataatcaaggccagacttcaaggaagggataactctccaataggctgaagagtaaatgtattcaatgtttcaagtatacaagcattattcctataatgatatcaacacattattaaaaaaccgtatttaacaaggattctcagcggatccagcttgcttcccatactttcaaaatgtctgctctaacctggaattaatgggtaacaaccttgtggtctttgaaaatattaatttaggttagattcacaaaactacaaacttgaagcaagcaaaaatatgatgacgtgataaccttaagcctattgtttgtaattgctgcttgctttttcgatgctagtattttggtaacagttcataaagcacactgccctatccattttcctcctgacatttagcattgaaatctatattatagatgacaccaaggccagtgccagattccacaaaaagttggggatggaacaaccactcaggaagcttctgttagccaaagtccttccaaacctgcaggaaaaaaaaaaaaaaaaatatgccctagcctttcctttcctcttcccttcctttcccctcttcccttccctttcttttctccctctccttgcctttttctttaaccttctcttattgtatcactccattcaccgtatattcttttttcctaagaaattgaattctcccctttaaaaaatggagagtataatttggggtgggggtacctcttgaatattcttgagatatttgtttgctatgaaaagtttttcacttttaactctttgactttgcttgactctgctctgcctatacaaacttgaatatgtagaaacaagaatacaagcttctgattaacaacagggccctaatgattgaggcaagcagtttttttcccttctacatttaatggcttttttccttgggtttctcgaaagttatttggttaatctggagtcttactaaactcaacacaatcctaattttagaataactagaaaatataattttgtttctctgtgtgattgttaatgcttgcttatcttgggactaaaaaatataattaataggctgggcacggtggctcgcgcctgtaatcccagcacttcggggggccgaggtgggtggatcacctgaggtcaggagtttgagaccagcctggccaacatggtgaaaacccatctctactaaaaatacaaaaattagccgggtgtggtggtgcacgcctgtagccccagctacttaggaggctgaggcagaagaattgcttcaacctgggaggcagaggttgcagtgacccgagatcgtgccactgcactctagtttgagcaacagagcgagactccatctcaaaaaaaaaaaaaaaagaaagaaagaaagaaagaaagaaagaaatagaattagtaaaaattgtgtttgaaacggtttatttcaaaatagtgtgtgctcctcagagtcatttaatcagtcaagtaatctgctttgtttggggcagtgaatagataagcagcaggaaaaaaaaaaagcttaggaaaagacctaaattggggttttttaacgttggcaccattgacatttcaggctggataactctttgtcgtggggttgtactgggaactgtaggaggtttggcagccttcctggcctctacccaaccagtagcaacccctttccttgatatgtgacaatcaaaaaaagtctccagatattgctaaatatccccagggggtcaaaattgcccccagttgagaactactaacctaaattcagcagtgaaactgttttatgaactgtgtctctctgagatttatttcagaaactttcaaaaattaaaaactgggacagagcctgcctaaaattttacgtggctctaaattttcctccgtcatttgcctaagacagcatgtcacaggctctctctggagacctgggcctgctccaggtctttgatgatctaatagatcttcttttctgtctcagtattctggacaatgacagcataatcaatgcgctgatgctgaaaacatgctgagaaaacaatgggaacagggtcaaatcgtcctgaagaaagattcttttttagtagcatggaccagacataacattgtgatatacatttttcataaagcagaaaactccatgattcaaggagaagtaaaaatcattctttttattgtattcaagtccagtatacatccatgcatggatggagttaagatatagtgacaaaaggagaaatctcgaaatatgctaccaggtggcttaaaaatcacagctgaatctatacggtcaacttggcagtaaaacacgttacttatttcctgtttgggaaaaataccgcactatgcttcctagattcaactgaattatgaaatgcagaaattgaaatgggtacaaaaagtatactatttttttatccctcccccccccccccgtttcctttcttctttccttccttttttttctgacagcattcacacatagaagaaaagttgattcaatgcatctggattgtgaaataaagcataaggtgtggacaggcagtacaagtattgcatactgttaatgtttaattaaatatttgaaatcaaacagttgacttagcaagtgctataaagaagagagtgtagattttactagcttctccatagcttggaaaaaaattcagattgtaccaaccaaggacaggttttcagtcgtaaaagctaaacattattccatggatggctcctagtgggtgactttggctccctggctgcactgcccatgtgactttacagatcagaaaacatcttctactaggcgagttaagagggggtcagaccaatgagtggctaatttgtaaggatttcacttaactgaaagacacccttctgagtgctttctaaaccccattaacagaaattagtgttaaaagttaaaaaccagtaataatctgaccttcaagcatgctatactataaactgaactctctattttctggctactgcattttccactaccagccctagcccaggttgcttcctctgcctgagatgttctttcctcccagcgccatgtgcactccaaatcctgcccatcttaactgctacttcctccaagaagtctcccttcccttatccttcaagactgagggactcatgccttcctgtgaactgccttagtgaattatctcacccctcttgtgacacttcactttctgtcttgttttaagatcttttgtgtttccttttttattccattttattatataaaagtcctttgtggaaaggacttgcacctggttccttgttccattccccacaccacatggctcgggactttgtacactgtttagcagataacaatttaaatgaatgacccattagatatcatgttggtgtctgatatttgttctacccagagtgagtccatctggagggtgagataatgtcgttcagctcctttccaaccccatcagcagtcctaggtgaagaaaggcaaaggcctgttatagatcaactccctggactaatgttgcaatcattctctttgcaaacatgtgtcagcgtttctgcttccatatctttctacatatccgcagtgaacaaactccctaagaaacactggcttattgaaatggggcatgttactaaatacacagcattctttttatctcccttctctgctgtataacacaccaacctccacttgcacattcagaaatataaaaatgattacattatgtaaatccaacccctttgtagggatcactgccagagagatgttaaaatgacattacacctgacctttctgaaaaggataatgctccagaagtaaattcttacaaatgaggatggacaacacttggagttctttttttttttcttttttttttttctttggagtctcactctgtcacccaggcttgagtgcaatggtgtaatcttggctcactgcaacctctgcctcctgggttcaagtgattgtcctgcctcagcctcctgagtagctgggattacaggcgcctgccaccatgcccagataattttttctatttttagtagaaatgaggtttcaccatgttggccaggctggtcttgaactcctgacctcaggtgacccacctgccttggccacccaaagtgctgggattacaggcatgagccaccatgcctggccaacattcagaggttttttttttttttcttttttttttaaagaaacccctattggcttgttattttatataaataagcattttgattaaaagaactatttgaactgaatattttctcccacagaatgggaattagatttctttaacttagcctggcttagggtctctctgtcttcctttttttgaagatctgaaactctggcaaaacaatgtcatattttctgctaatttgtggttattgtccttttgcaggatttgaatcttatatgaagtttattttgtcaccaggactatataccagaatttgagtctcagctggtatcggtgggggaaggccatggtggtctactggacagcacctggaaaaagatggcatttgagtttgggctatgccactactggcagtttggtttggggaaagccaagtcttcgcctctcagtctcctatctgaaaaattgagacaataacaatacatatttcccagaatttttgtgagattttaatgagataatgcatgagaaaatgcactgtatacaatactatacaaataccaacccttcttcctatatcaccagactctgccacattcattgaaatcagcacttggtgtttacgaacatcttctccatatgagatgcagaggacagaaatttaagagatgctgaccttgcctttgcagagtatttaaccttttttttttttttttttttttgagatggagtcttgctctgtcacctaggctctgtcacctagccaagatcacgcgatcttggctcactgcaacctctgcctccctggctcaagcaattctcctgcctcagtctcccgagtagctgggattacaggcacctgccactatgcccggctaatttttccatttttagtagagacagggttttaccatgttggccaggctggtctcaaactcttgacctcaagtggtccgcccacctcagcctcccaaagtgctgggattacaggcatgagccacaccaggccttaacctttaagtttccttccttccttctttttttttttttccaggcagagacttactgtgtcacccaggctggagtgcagtggtgcaatctcggctcactgcaacctctgctcctggggttcaagtgattctcctgcctcagcctcccgagcagctgggattacaggcacgtgcccccatgcctggctaatttttgtatttttagtagagacggggtttcaccatgttggccaggttggtcttgaactcctgacctcaagtgatctgcccgccttggcttcccaaagtgctggaattacaggtgtgagccactgcacatggccttttaagttacgtttaaaaataagtttaattatgtttgctttgtgaatctaaaaaagtggcttttcttctgtgagtattggtttcctcatctgtaaaatggaagtagtaataactatttttcgagaacaaaggaggtaatacacatgaagcattggcatagtacctgtcacgtctagttgctcagtaaatggtaccttttcaaagaataagaaaagtgcccacctagtattataaggcttcaaattaataagcaagaaccattatgtctagttcgaaaagtctggaaaggctttatagaagatttagaatctgagcagaggctcaatgtacaaacagatttctgcatttgaagataatagcagcaatggccaatatttgccacacactgttcaaagcactttacatgtattaactcatttaataccaaaacgcagttggtattttcatccccattttgcaaatgagaagactgaggtaccagagttgaagagactaacccatagtctcacagatgatttgggggagagcaaggaccagacctaaacagtctggttcctgagcctcagctcataaccaccacttagaaggggcagtggggaccaatgcagtggctcatgcctataatcccagcactttgggaggtggaggcaggagaattgcttgagcctaggaattcaagaccagcctgggcaacatagaaagactccatctcttaaaaaaaaatagctgggtgtgagggtgtgggcctgtagtcctagctactagggaggctgaggtgtgaggatggcttgtgcccaggagatcaaggctacggtgagctatgattactccactgcattccagcttgggggacagtgcaagactctgtgtccaaaaaaataaaaataaataaacagaatgggacagtgagctggagggtgagagggatggaggagacaggcaaccaaaagcattataggtgcagagatgatgaatgaaaaccctagggtcttcccctcctgagagaaagtagtgtgaataggtcagaggcacagtgggaaaggagccctgtgtgatggaaaaactggggagacaaaaggccagagggagagtgttgtcactgagttgcagagaggtggcctcaccactgagcccagttcatacctgttgattatgaaggcagcaagaaggagagttccagattttgcaagtccaggccagatgtaaacataaggccagtgttttcttaggaggctacctggtccaagagggcaaggtaatcccctcctctgtccacaaaatgctgctgacctttgacttttgccagaaaagctttcatctggtgtcacctctcaccaggtcctggcaattatgtacatttcttaaaaaggttagactagcaatttttcaagcttgcacagtagaatgtcattgtgtgcatgtttaattaatcaagctggcatctagactgtgaaaagcaagtctgcaaagcaccttgaagaaaataataaacatccttcagtctttaaaacacaaactgcaacaaaaatgaacactttccttaagaatcatgaggactcaatggatgccaagtttgcatgttattctgcatgaaatttcctcctctctctctcaaattcagagttttatagacaatttcatcaggccagaagtgtcagactttctcttcgatggaatcatgatgtctttatatggccaaatattgttagcatttagattcaaggttacttcctctgcaaaagttaattggatgggatgatggttattcaatgataatacattacactgtcttactgtgacccctgggcctgtcatttcattaacagtccagagagcatgtctcactaaggctttttggctcctaaacacatgaggtcacctctgcatgcaaaatgagtccctaaaaggtagttagcataaattactttatcactcaaccacaaaagcaactttcttttgcaaaatgtttccgacttttaagtaacttccttgtacgtgcatttttgcttcctatactcatcattcaatgaagcaaaacctaatgttctattagaataatctaggcaactgtttttttttgccaggaagacccaaggaactgctataatcgtctttggttaattttttttatttaaaaaattactactcttaaaataaattactgtgtaaactctgctagtggttttgtcaattttgctcccattaaaataggtaaattacatcaattaatatatactaaggagagagttaaatgatacctattatgtgttcacactttctagtctgtttccctcccatttccttacttcagaaaccccctagaggtgatgttcttgctactaatcagcagttaaccagaacaatggctttattcatttatttattcattcaaccatttattcatcaaatactaactgagcacctattatgtgcctagcactattcaaggaacttggaatacattaatgaaaaagcaggaagagattcctgccctcctggggcttaaagtctcataagggatagttagataataaataataaacataacaaatacaagaactatatagtatattgaaagttcacaagtgatctggaaaaaataaaaaatggcaccaggggagtggagaactggtatacgcagcagggaggaaggggcagactgccatattaaatagggtaatcatggacaggcctggctgagaaatagggatggagagaagtgaaggagttaaccaagccgatacctggcttaaagcagaggcaacagctagagtaaaggccccaggcaggagcttggcctgttcccaatgtggcaagaaggtctgagtggctggaatgaatgggagagaagaaagagctttgtgggacaggaggtcaggggtgctgggggacagggtggacactgcaggaatttgagtagcaacatgatctgactcagtgtttaaaaggattcccctttagggccttttagggcatggtggcttatgcctgtaatcccagcactttggggaggccaaggtagggggattgcttgagcccaggggttgagaccagcctaggcaatacagtaatacccttgtctctacataaacaaacaaacaaacaaacaaaggaccccgctagtactgggttgagaatggacagtggagggggctcagtgtggaagcaggaagaccaaattactatattctacagtcacattagaaaatactaaaaaccctttttggtttacattgttgtaaaccagacttagaactagaaacaaacaaacaaaaaaacttcctgttcagtcaccttcttggactacatcccttgcatagaaacttcagcaccctcctggaggaaggtacattcctagccccctggcttttctacgttggaggagcatcagacccgcttaagctaacttggtagtgccctgtgggggcggtgcaattacgtcacagaagacagtcatcaagtcaaggggcacagaggcaaacacaagggtgggaagttccagaagtagttccagaatgcttgcttggtgatgcaaaccaggactggaatcagggaaggggggccagcaggtgctctatgctcactgtgtctcactgatgctaaagacagagtgcatgttctttgatatttagagtaacaagatgcaaaatagcaaaccttacctcactctgtttttgcctttgaactgtcatgatgcagcttagacttgtatcagtctatttacttttctttttttttttttgagatggcgtcttgctccgtcacgtaggctggagagcagtggtgcgatctccgctcactgcaacctctgcctcccaggttcaagcgattctcccgcctcagcctcctgagtagctgggattacaggagtgagccaccacacctggctaattttttttttttttttttttagtaagatgggttttcactatgttggccaggctggtctcgaactcctgacctcaagtgatctgcccgcccttggcctcccaaactgctaagactactggcgtgagccaccgtgcctggcctttttttccccccttttccaaagtctaatattagggatatagtccactgagagaacaatcaccgatacataaaagggcatcacaaaatggagacccaagatcgaagggcaataatgagattgaattttatgcttctgaggacctgccttcatagtctgtgaaaaaataagttagaagcaagaatacttggggctttcttaattatttcacatgactgagaatgcaggagtacagctattagaagaaatcctaggagagattactgccctagaaagagaggtctctgggcctctgctgaatcaagtaaagccatcagaaagttcaaatgagactacagggaactatcacaagagactggaagcaatgtgggaaggtcatctagccacagagtggcaaacagggtacagatctcacagccaactgggatcattagcagcatcttctggagcagagagttagttgcaagggattccaaggctacacgtggtattagctagaaatggtgtaatgaacatgagtgatgccggctccacgtgaaagaggcaggagtggtgtatagttaacattcttgatgggtcggttctcttgccttcttatctgtctacattcagaccatcttagaaagatgagatgctaattctatttttaagaagctttggccaggcacggtggcttatggcctgtaatcccaacactttgggaggccaagccggacagatcacctgaagtcaggagttcgagaccagcctggccaacatggcgaaaccctgtctctattaaaaatacaaacattagccaggtgtggtggtacatgcctgtattcccagctacttgggaggctgaggcagaagaatcgcttgaacccgggaggcggaggttgcagtgagccgagatcgcatcactgcatgccagcctgggcaacagagtgagactgtctcaaaaaaaaaaaaaaaaaaaaaaaagcatgaagaggacatgatatataatcctttcagaaatgcaaagattaaaatgaattcttcttcttttatccgaggtgggactgctttaatgtaaatctggtttctgttgtcctggcctttgtggagaatggaggagtaccatgtccaggaatccatctgtgtctatggtctagatcgggggtgtccaatcttttggcttccctgggccacactggaagaagaagaattgtcttgggccacacataaaatacactaatactaacgatagctgatgagctgttaaaaaaaaatcacagaaaacctcatagtgtttaaagaaagtttatgaatttgtgttgggccgcattcaaagctgtcctgtgccccgtgcggcccacaggcggtgggtcggacaaacttagtctacctgttagacactctccttcctctggcccatcctccttaaatccagggttcccctccctctgttcccaccccctgacctttgttgcccctgtagacaaactggagacttcagattcagacagagggaacctcagggagacgatgcattgtggagaatctgggttcctgttttggttctgccatcagatccctcgttttccttagtagaatgagggggattttaaccttgggcacgggatcagcctgagatgatattttacgtgtctggtgcatagttaaggaaaggggagtggtatcttttatctgattctcaaaaggggctctaactctaaacctgttgagtcattggtctaagtgatttctttttcttttcttttctgtttttttctttttttgagacggagtctcgctctgtcgcccaggctggagtgcagtggcgcgatcttggctcactgcaagctctgcctcccgggttcatgccattctcctgcctcagcctcgtgagtagctgggactacaggcgccggccatcgcacctgtctaattttttgtatttttagtagagacggggtttcaccgtgttaggcaggatggtctcaatctcctaacctcgtgatccgcccgcctcggcctcccaatctaagtgatttctaatattctttccatttgaaactttgcatgtgaagatccattttcactggggccgtggctcacacctgtaatctcagcactctgggaggctaaggtgggtggatcacttgaggtcaggagtttgagaccagcctggccaacagggtgaaaccccgtctctactaaaaatacaaaaattagctgggtggggtggtgcatgcctgtaatcccagttattcgggaggctgaggtgggaggatagcttgaacccaggaggcagagaccacaatgagctgagatctcaccactgcactccagcctgggttatagagtgagactccatctaaaaaaaaaaaaaaaaaaaaaagaaggtatcttttcatgcaatcatataccctatgtatgatgctcacagctggaagatgcagcaaaatactcttcaaatggcaacttctagatcttatagagaatggacccatatttatcagatttgaagatgtttaaaatagaccaaaaatgtaacctgtataaaaaaggagaaataggggttgttaaaatttccctgaaagcccatgtgtaataaaaatgagtcattattctagagggtttcctgccttttaagggctgtaaatcagaagcaatgcttatgggagacaaggccacgctccccaggtctcctgggggcggcggcagcagcaccctcgtcctggctgtggtccacggtgcctggctgcgactaaggctgcagaatgttgagttgctgttctgcggttttgccacattcatcaaatgtggttattgtcaactagataaagtatagtacggtgattatgagcacagtttctgaatcagactgtccaatcctggatctcccctgggagcttgagcaagcaacttaatttttctgtgcctcagtttctttacctgtaaaatagaaataatcctatcacctacttcataaagttcctatgaggataaagtgatttaatgtatgaacagcacttagaacagtgtctggcagatagtaagcattctatgtacttggatagtaatagcattccaaatattacttatccaatccatagtattggatatgtaaaagcatagaaaaaaggtctggaaaggtaacgatgtgctgcgactgctggacgaggcgatgtgaatgggagagtgtgagctgtgggctggggaacttttggctttactggctgtgttagcttcccagggcttctgtaacaaactgtcacaagctaggtggttgaaaataacagggatttatgctcacaattctttatgctacaggtgaggaatcaaggaatcagcaggtccaaaggctctagggaagaatccttccttgcctcttccagtttctggtggtcctaggtgttcctcggctcgtggcagcatgactcccacctctgcctccatcatcacatggccttcctccccgtatgtctgtatgtgtcctctcttcttctcatagagacactagtcattggatttagggcccactctaaatcagaatgatttcatcttgagttctccaatgaatcacatcttcaaaggtcctatttctaaataaggtcacatcctgaggttctggttgaatgtgaagttttaggagatgcttcaactcactataccagcattgttttgttttgttttgctttcttttaaaaatgagattatattcatgtattacttaggatttttttttttttttttttttttttgagacagagtttcactctgttgcccaggctggagtgcaatggtgcagtctcggctcaccgcaaactctgcctcccgggttcaagcaattctcctgcctcagcctcccgagtagctgggattacaagtgtgcgccaccatgcctggctaattttgtatttttagtagagatgggtttctccatgttggtcaggctggtctcgaacccccagtcttgggtgatccacccacctcagcctcccaaagagctgggattacaggcatgagccactgtgcctggccctacttaggatattaaacaacaaaatgaaacaagaaaatatatatataaaatataatatacattatactatgggaagctaatgtatacatgtatacacttgcttattctgtctaggttgtagaggaggttgttgatgggaaaagagggaaatacaatgattgctaacacttgtagaatgcttactatctgccagacattgttttaagtgcttttcgtatattaaatcacttaatcctcattggaaccttatgaagtaggtggtatgatcatttctattttataggtgaagaaactgaagcacagaaaagttaagttgcttgctcaagctcccaggggagatccaggcttggacagtctgattcagaaactttgctgataccaccatgctgtactgtccttcatgtatgggcacacataggcgatacaggtctgagtcaagaaaatttgacatcacttcctaaacacacacactctcctttttctccccaaataaagcatctataaatgaatgttgtttctgtggttagatgtgtttggagaattttatctgcagaatcttccaaactgaacattgtctgatatttacttagaagaaataaaaacttccatgaactgagtgaaaaatagttgttcatgtatatcactgattgctgttcagatcacttagagcacaatggatttcaaccagtcaaagtgcagcaatgctctgagcaaagggtagccgcacacaaggtggttcacttaacggcagcttctggcaaattgcagctaaactgcagttccagttgacttggtaacttacaaacagcacacgctgaatggaaaaggaattggtataccatatttaaaacaatgagaataatgatagcagtgcttccattaatgccagatgctgtgctgagtacattttcttactctgttcttactgtaaccttctgaatcattaatgccccagaggtggggtggtgactaatgataaactgataagggtatccttatggtaaaaatggccatgaccttgttcctgtaaagttgctccagggacttccccactcataagcggacttggaattttcgccgtaagtcctttgctataagttctacgcacattcaacagggacacctctgtgtagcaagttacctaaatgaatattcaggctgttttcactctgggaacttggtatgtgtaaattttcaggtaatttccctcatttgaataacttcttgagtgaaaacaggtccttcaagtgcacatcctggagccccggggctggcatagcatccttataaagcagaaacctcaggctaacagagcccagttatgtcctgggatgtttgtattcctagagcccagctcgagaccaggaagtgcctcctaggttttcctgtttccatgtggccttggtttggattcacaagaaaaggattcaacagagtacagtgctgactgtaccggttaaattatggcctctaaagtccaaccactggccttccaatcccagctccatcacttcccagctatgtgaccttggcaagccctcaactcgggagccttagtttcttcatctgtaaaatggatataacaataaaatctatgtccaaaggctgctgtgagtattaactgggtgcttagtcaaccgggaaacattagtcactggtattgggggatcaacggtggagctctatgcaatcgattctcttctcaggggatggggtatgatggcaacatcagtcaactgggctcaagggaattactttgcactcagttcagcacatgctgtctaatgagccattgcctatctgccagcatttgttgagaaatacaaaaagaaagagaggaggtttttttagagacccacttttaaaatacccccatctgaccccttcaaaatggagggctgatgggtagcgtccattttccttttctgtaggcccagcaagccccactaatgtttcttttctgataactaaagcaggtttctctccccacaggggcctctttctttcccctgaaccagaagggaagatcccctttctcttttcagtaatgggcaagaacaaagttccattgacaacgtgaatggagcatttcttaccctggactctcttcgcactgcagaggcagggaccttttctctcccgcttggcttctgaagattatgattcaagtcctctacaggcgactagggcagcccaggaatcctgattctggcacgaactgaccaagggagggaggctgcttggttgcagagcctccatgcacagaagtccacttacctgtgacttctgatatgtgcaaccccgagaatttcccctgcttcgcctactctgggcctcccctaaccacccagtagcatcctctcctttcacatgctattaccttaccctgcttcattttcctttagagcacttagcatcacctggtccattatattaatttgtttgtctgttctccctcccaacggaacataaaccccaggaaagtagatgttgtcttgttcattgctgaatccccagtgtctggcacagtgcctggtaaagagtagatactcagtaaatattcactgaatgaatgaagaaaggcaggctgaaagctacttctggtttccctctaaaataaaaaaaaaatgtctttctgataaatggataactaaagtcaggttgcaatggttttgggcttttagaatggcctgagtttggatcagtcaatcaactgatgcaatttatgagcgatcttttatagcccagcaaagtagagacacagaaggatatgacctggtccctgctctctgagtgcacaaaattcagctcacaaatgacagtggaaaatgaaccgaggtaaaagaaaaagtctccaacaacacggacagctggagggcaggtctgcagtttctctgtttttcctggcatctctaaggaaagagaagccaggtatccacctgtcagtgccacagccactggtggtaagggatgtgtgccattcaggtgtctagcttctacatccctggtgctctctgtagagtatgcccagaaaccacactggtatttccaggaagtatacaccaagtgctgttctctgtaggttttgccccttctttcttttctatcatgctacttcttacaaattaaaaagcaagtcaggaagcaatgttaaaaataatcaaaccacagctaaaggaaggtaccttcaaaagaagaaacgggggaaaaaaattgagtcgactattattccacagtgctttatacttgaggccctgtgattattcactctgtgaaacccagtggaacctgggggagttaatggggccaatgttacttttcttttgcattacttatgtgggctgtaaaaatgagctttggctccatggccaaaagcggaaaatgtcacaccatggggagcgaagaatgtgaatcaaaatgcaaaacctacagctccagttttcctacattgtaaatgcttattgctatcaggtaactcctctccgtaatccaaagcagctccgggcaccgcaggggcaggggaagggaagatctgaagactctaagtatggacagtattgaggccagacacagttgctcacacctgtaatagcagcactttgggaagccaaggcaacaagatcgcttgaggccaggagttcgagatcagcctgggcaacacagcaagaccctggtctctacaaaaaatattaaaaacaataattagaagggcatgttggtgcatgcctgtagtcctagctactctggaggatcacttgagctcagaagtcgaaggctgcagtgagccatgattaggctgctgcactgtattcctgggtgacacagcaagatcttgtctcaaaaaaaaaaaaaaaaaaaaagaatgaacaatattgagggtccccagccacccagagctacctgactgaaactgagtgtttaagagaggatttaggggcttctgagagaggctctgtgctctaagacttggggctagggaaagccgatcagcaacgtgggggcttggggaagaaggtagcttgctttgtgaccagttcaatttttttgagggtcccagaatattaaaacatgaagagatgtcaaaacagggcctccccaaactgtggcatattctaaaataattaaacttaaccaatatattgtttaatattaaactaatattaaacaatatacaagtaaacaaagaaaacacggtaattgcactattcacaatgtaggtccaagacttactaaaaatatgagtgcaatgcaggtggcaagaatggcatgggacatgactggcaacatcttttttctattctgtcaatggatctttctgacactgcagtaactcagagatattgtcaaaagtctaaacctaagtcaggcgcggcagctcatgcctgtaatcccagcactttgggaggctgaggtgacaggatcactggaggtcaggagtttgagaccagcctggccaacatggcaaaaacctgtctctactaaaaaaaagaaaacaaaaaaacatgcacacacacacaaattagccaggcatggtggctcatacctgtaatcccagctacttgggaggctgaggcaggagaatcgcttgaacccaagaggtggaggttgcagcaagccaagatggtgccactgcactccagcctgggcaatagagcaagactctgtcacaaaaaaaaaaaaaaaaaagaaaagtcttaattgaggtcctttatgaatggaaagccctccagggacaaagccaccactggccattccatgatgttggttattgctagtcctgctttgctctcaagcaaacaggaggcctcctcttggggccttgcctgcaggcatggagggtggagcagtctaagatgacctggcagcttgctgctggctccctggctccctggggcctctccaaacaccagggtttgtcggggatatagtctctgactcaccactagtgataagacaggccaagaacctttaagcaagtcagacagcattcagggaggttttagattcttaccactggaagtctgatttcagaatttgcaagttccttaacaaaaccgttgtagctttgacagaactgtagtcattctgggagccaaaacagcagagacaacaatacacagaatgctgaacctgctgcatcaaagtgaggaaagctttatctctgcctcctcattgctgcatctatttattcatccaaccaatatttactgagccctttctaagtgccaagtctcacagtgagtgctggagaaagagtagtggacaaacacagacttggtcccttcccggaggaggcctgcagtgtatggggctggggggaaggaagaggggccctaactgaaaatcacaaagcaatgtaagtagccacagcagcaaatgctataaaggagaggcccatggggctatgagtacatataatgaggtctgacatgtttaggcatgtcaggaaaggatctctgaaaaacagatattaagctggatctgttatggttgagaagggaaagtggagatggaagaccatttttaccaacaaaaatagtgtgtgcaaaggccctgtggtgggagccaggagaatgtaaagaactgagaggaagtagggctggagcagagtggtggggacttagaatggtgcccaaggcactggggcacggggcagaggccagggggcggcggagggcaggtgggcgctgctgggggatgctgggctaggctgggagagacctagggtgagcaggaaggaggctgcctgtgcagggcgtctgagcctctgaggttttctttcatcctaagagcaatgcaaaagcttaagtagggggagggaactggggacatctgaatcacatttggattttgaagagattactctggctgcagtgttaacatctctaaaggtaatttctgctttgcaagtccaataagcaggatcagtcttcagtcactggaagcagaagctggtgccttggcagccagatctgggtttgaatcctggcttcatgcctcacttctggcatggccttgggcaggccagcctttcagagccttagtttcctcatatataaaacagcggtaataatacctctttctgcgttgttatgaaagttacggaaattaaagtaaataagtagtcttgcttgatacacagcaaactctccttgggatattttaaagtagaaaccaactttgatactatgtatggcatgaaacagctaacatccaaaagggttgtataaactttcagcttgaggaaaacattcgccttcctacaggtctatagtttggaaatactgcacctacatttgtctctctctctctcttttttttttttgagacagggtctcgctctgtcactcagcctgcagtgcggtagcactcgctctgtcactcagcctgcagtgcggtagcacgaccatggctcacagcagcctcaacctgctgggctcaggcaatcctctggctttagccacctgagtagctggaactataggcacatgccaccacactcagctaatcaattttttttttctttttgtagagacaaggtcttactatgttgcccaggctggtcttaaactcctgggcttaagcaatcctcctgccttggcctcccaaagtgctgggattacaggcatgagccactgtgcccagccttactcctgtctctttaaaacaactaaaacacaataatcaaccaaccactcattccactgtttgcatacataaggtgctacagccatgccttctgattttggaatttatcagatgatagaccatggagagatgagcaaccagagaacaaacaaatgacaaaggagcactgcaaatatagaaacaaataagccactggctgtggcgtgagggcatttgttggttatgaataagagactgctgggtgtcatatttagccagcatggggctggtcagtaagccttctgtttggatcagtcaagaattcaacattgctttcatctcttgaatggcccggggccctgtcagaatataactccagggccagtctcaatggctcatgcctataatcccagcactttgggaggctgaggctggtggatcacttgaggtcaaaagttggagaccagcctggccaacatgctgaaacctcatctctcctaaaaatacaaaaattagtcgggtgtggtgtcgggggcatctgtaatccccgttacttgggaggccaaggcaggagaatcacttgaatacaggagacagggctgagattgcaccactgcactccagcttgggcaacagagtgagactccatctcaacaacaacaacaaaaacttcagttgacttcaggattaagtcaagggtcttgtcaaaatactcaaaagccagctttcagtggttcccactggccaatgatgagacaatgtgagcactggggatgtaaaatatattaaatacatttaaatccttgagtttgtaatagcactttaaaaatattgatcgcctagcctgggcaacatagcgacagcttgtctctacaacaaatacaaaagttagccgggagtggtggtcctagcttcttgagggggtgtgccgaggcaggaggaacacttgagcccaggagttcgaggctgtagtgagctatgattgtaccattgtactccagcctgggtgactgagtgagaccctgtctccaaaatataaatatagatatatctatatatctctgtctatatatattgatcaccactggaaggtgaaatgaagccaatacattattttgaaaatttgtgaataaaggaaaggaatcaaatatttatcctgcctttctgacatgtactataccaaataaaatggtagatgaggggaaattttttctttatagaaaatttgagctgataaatgaaggaatggtagaattagttttatttatttatttatttttattttttatttttttgagacagagtctcattctgtcacccaggctggagtgcagtggtgggatctcagctcactgcaacctccacctcctgggttcaagcaattctcctgccccagcctcccgagtagctgggattacaggtgcctgccaccatgctcagctaatttttgtatttttagtagagacggggtttcgccatgttggccaggctggtctcgaactcctgaccttagatgatcctcctgccccagcctcccaaagttgctgggattacaggcgtgagtcaccgcacccagccagaatggcagaattagaatatcagtattttctaatcattaatgaattaatgaatctagacattaatcatcaatggttaccaacatcatgaaaaagatatcctctcctcaattatgtccctcttgatggaagaacacaatgaaatgaatgcctgccccgcaaaaatactgaactggatactagtgaactagatctaactaccaatttttaggaaatagaacagagggacatgttaaatgatacagattatgagaaactctacagaataaagtgcccaattactaaaacaaatgaattataattaaaaaaaaagagatggtggagagacccaaagaaaccttatgagacatattacccagttgcaaggagtgggttcaaacaaactgtaaaaatctcattaaaatattgataattgccaacttaaacactagtgcgatatttgatgatctttaggagttattaacttttttttttttgaggcggagtcttgctctattgcccaggttggagtgcagtggcacaatcttggctcactgccacctctgcctcccaggttcaagtgattctcctgcctcagcttcccaagtagctgggactacaagtgcatgccaccatgcctggctaattttcatatttttagtagagacccggtttcgccatgtaggccaggctggtcctgaactcctgacctcaggtaatccacctgccttggcctcccacagtgctgggattacaggtgtgcgccatcgtgcccagcctattgttaactttttagatatgctaacggtatcatggctaagtttgaaagagataaagtttttattttttagggatacaaatggaactatgtaccatttagatgaatggtacgaaacctagaatttgctttaaaataataggagaggggatggagggttgaggtatttataaagcaagattagccatgggcttaatcattgctgaaagtggtccatgggctcatggtagtttgatattttccataatagaaaagtttaaaaacattcattggccaatctatctgtccatttcttttaatattaaaaacattaattattattagtagtattatattaatatgaagtctcactttgttgattcacccaatccctttcatgagagatgtggaggttggtcttggctgttaggaaacgtagattctaatccattcaacagcccagtgatttgagaacttcagctctctgggtctccctgtactcctttggaaaacgagagacgaagttgattgttgcagtggggatttgggtcctgcagtctggctgtctgggttggaattgagcttcgccataggtacccttgggtaaatttacttaatccctcagggtttcatcttcctgttttgtaaaatgtaaataacaataacgctcacctcgaagggttgttgtgaagattacatgaacgatttcatgtattcattccgtcaacattgaacacctagtctccagctctgcgaggggaatggggtggagtggcacagaaaatacgggggccaggctgtttagcgcctaaagggagagtccagatcacccatggtaaacacgaaataagatgcagtatttcaaatagctagaactgagacgaaaatacaacgcagcaatttgatggagagcaacttcgagaaaggtgagctgcaacattaactcggctgatctgggacagtctggcgggggaggtgacatctgagccccacctgacttagaggatgtcagctatggatgatccgggtttccacacgcagcagttctcaagccaggtgactgcaccgccctaaagttccctccacttttggcaatgtctggggatttttggttgccagcaatgggaattggggggtttgttcttgtatctagtgggtataggctaggaacgccgcccagtatcctacagtgcacaggacaccccaagcccccccaaattagctggcccaaagataaagagagaagagcaagggcaaaggtcctgcaggagtcagaaaggagcttgctgtgttcagaaaactcaaaatccagtgtggctgagtgaggacgacgaagaatgaggtagactgggctagactatggagcactttttacggcacggtgaggaatttggaattatactcaaagcagtggaaagcccttgaagagttttaaacagaaggggaaggtaacccatgtgaaacgctttgcatatataagcgctcaataaatactgtctattattaatattattatcaccattgtgtctaccctacttggctccagacccggcccatgcctcagcgaggccgcagtgactcctcctggccagcagagggcgccagcggacacttggctaccggccgcccagggcgggcctcctcttgccgtccccttcctcgtcttttcccctcaggagaagtcgggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggcggccagcgcgaagcggaagcaggaggagaagcacctgaagatgctgcgggacatgaccggcctcccgcacaaccgaaagtgcttcgactgcgaccagcgcggccccacctacgttaacatgacggtcggctccttcgtgtgtacctcctgctccggcagcctgtgagtgcggggcggccgggcgggtgtcgggcccttcccgggaggtgggggagcgggcggcgggaccgggacccttccggggctgggaaagagccgggtgccgtgggaggcggtcgggggcggccgttgggcgccggctggcgggcgcggcgtgggaggctgcgggctggatgcgcagggcccgggcagccgggctggggatgcgttttcggttttgccgggcgagggtttacgttctgggcagccttcgtgggtgggacgtgggcggggttggggtcagggagggggcgaccggggcgagcgtccctggtctccgtcgagcctgcggccgccgccctcgctctccagctacccggggcgccgggctgtggggggtgggggaagacgctaggaggccgggggggaggtccatgcgggtcctttgtgtgccccgcctctcagcggcccgggagccgcggtgcggagcgaggcacctgctgggcgctcctgctgggggtcggggagaagctggggtgggagggagggacgcctgcctcgcccgtgccttttttctgggtcgagagtacctacgtaactgggaggaagcaggcacttaggaatagtagcaggatgaaagcatcttgatggcagatgtgaatcccctgggaaaagttcgaaaggattaattgcgggagggggaggcagaggagcagatttgaagctgtgggattttagttttatggtccgaagagagtgttgaggagttgggggaaagttttaatggcaataaggtacccactaggagctgtgtgattctaaatatgatggagttatctgtgagatttatctgtatctcgctatcaatacccgagtgccctggctgtacacagaaatgaggagagctagcaagtcaccatgatttcagaaagacactaccgtcctgagttactgggatgatttgtgtttgttgttctttgcttcattaagctttattttgataaagatttttattgccgtgcaatttcattcggaaaatttgcaggtggttttggaattgataaaatgcttttatattattatcttgtatttaaagttactaacaacgtggcagttactaagtatttttaaaacctttgcttgtaagattaatacaaagcacataatactttatgtgggaaaattgatttcttaaaacttagaaaatgcagaacatgtctagtatgtactatttgctttttaaagttgggcaaagaggcattattagtattacatgagtgttatttcttcagcagacattttttttggtgcctattaggttgtgtaaggccctggggtgtgccagtaaatatagcaaagtcttgttctcttggttcttacagtccagtggggatgcaaaagtaagaaaaatgtcttgggcaagtactatgctgaacatgaaaattgtttgataggagagtgctcatggttacttttaggctgtgtggccagggagacactctgagaagttgccagttaataatattctcgaattactacagaatcacagagctaggtgatatcaaggaggtagcctggttcatgcatttcatttacagaaaaaggagttaagctagaaagttgttacttacgttggacaatattggttccaaaatgaagccaatagaacaattgtaattgtatttgatttttattacatggttaagatgtatgtcctgcttttactaaacacaggtcctttaatccatgtaaagtatttgatttggaaaaaatacatatatttacacttccggatttctgacatttctgtgtagtccctgtaagtacagcagcaaatgtgtaatatcaaggacatattttcaaatttcttcctagataccacatttcagaaacattgtgcataaaaggatatctcagtataatgacaattatttatcttaatggaacttaatctgtggcagataggacttcatttctctattgagtcattccacaaatatttattgcctacttgtcctgtgtcataagttacctggatcttaactgttctatggagcgtgccttgtaagtatgtaaacgtagagttacaatatattgtagtatttcctttctgtgaatgagatagccaggaaatatgtaaatgatacagcttctctgggagttgatgcctgagcaaagacctttaacgagaaattctgcttcatatgtttgaaagatcaagtacttatgagctaggtacacatggctttgaatcctgactccaagtattagttatacggtattgagaatgtcactcaatctatttgagcttgatttttctcttatatgaaacagtgaggataagatttcccttgtaagttttggatgtagatttgttttcagtattaaaaataatgtatgttaaacatctcacgtaatgcctggtatatagcaagtgccctatagatgagaagcatcaaggaagaggacatgccatgagtaagggaacagtactgtatgtgaaagatattaaataagaaatatcctaataaaaatctgtcactttggattttatggttgtaactcaaaaccggaatctaattggtttaaaaatatgaagggtttattgattgattttaaagtaaaactatacagtggcttaataatattgcctagattttcctcattcgagcatggttgtccccagctcctgggtatactgccttaattatgtcgttggtccaatactttcagaagttctgcatttccctctgattgggttagcttagatcatgccacaactggacacatgttctaacctgacttcattgtcacaaggatccccaaatagagttcccaaatctgaaatctagaattcttgggatgtagggaatgaagactagagtggcaaccatcaaatgtctactgcagaacgttggagggacaatagcttctgaagatttttttctttgacaagcaatagtgcaggaaaataatttaggaagaataatataactcttgggtttaataattatgtatctgatgtttagatgacatggtataattgaaagaatatgaattttgaagtcagattttgacaatgctactagcttcgtggcttagggcaaggtgttatgctaggccactacatgcagattggcccagatccatccttgtagcctcagtttctttatttatgttaagaagatatcatatagctcagggttgttaagaggattcaatgatacacatcgttactgtatttacttattgagcacataccgtatttgaggatagggctaagcactggagttacaaatattgaaataaggcatgctagctgccgttccttgatttacctggaaaatatgaatacatagcaaatagtatccactatcatgaattctaaattttaggatagtgacataccttctatcatttatactaatacctttttttaaaataaattgaactagcatcttgttgttaatgttactagacttggagctaatctttcttgtttcttttttttcagatgactgtcctatatgcttgaatgatgttcattcagagtgtaactgaatttagattgtaaaactttaaaatgaacttcagagttagatgcagttaaactatttgttactgaggcagaatgatgaaggcatcctaactgattggtttgtcactatctttcactgtctttctggttgtatttatggaaatccctaaaattctgaatggacacttcagacatttaaaatatagccaacagtaaaaatggccttcatgttaaataacttctagttgatttaaagactagttttagactaaattatttgttttatggagactataaacattagtataattgatatgtaatataaaagattgtcctagccttaaaaagtgatccataaatttttcagtgagggtttagataaaataaaaaataacatttgagaaagaggttgccactttaataccatctattttatgtggacagtgcatttaagcttgaaatttcacaggtaataaatgtagctggatagtaacttatattctgttgattctgtgtacattgactcttgagatgaatgttacaagaattttaattttttttagatgacagatgaaaagaggtatttaatgtttttatacaattagtagcattaggatggattgcaaatcagatgctcttttggagctctgtgtataatattcaggaccttgtgaggtcacagtgagcagggatttatattcttaattccttttttactttttttggatactctgatatggccacattcagttaagtatttagagtaagtggccaaaatattttatactttctctctctctcttttttttttttttttgagacatagtctcactccgtcacccaggctggagtgcagtggtacgatcacggctcactgcaacctctgtctcccgggttcaagccattctcctgcctcagcctcccaagtagctgggattacaggcgcccgccaccatgcccggctagtttttgtatttatagtagagactgggtttcgccatgttggccaggctcgtcttaaactcctgacctcaggtgatccaccgccttggcctctcaaagtgctggaattacaggcatgagccacctcgcctggcctagatactttttcaattgtgaaggacaaattttttattttaagcaaatatttattaagtgccagatactagcccatgtgctggagatacaacagttaaagtatttattgaaaaaaaagaaaaaactattgagtgctagctgtgtgacagacattctagtaacagtgatgtgaggaaggtactattatccaagctcaactttaagttgtaaaattagtgcacactcttagtgttttgctgttataacctgctagaagttgggatctggaactgatgctgattccaccaccaaagaatgtatggttaccatggttaccgtaaattgttgtgaattctatattttggggatttaaatggtagattttacttcattgtgtttcaaatggcagaaaaaagactttttcttttttttgtttttattttttgagacggagtttcactcgtcacccaggctggagtgcagtggtgcgatctcacctcactgcaacctccacctcccaggttcaagcgactctcctgcctcagcctcccaagcagctgggattacaggcatgcaccaccatgcctggctaaattttttttgtatttttagtagagatggggtttcaccatgttggccaggctggtcttgaacttctgacctcaggtgatccacctacctcggcctcccaaagtgcttggattacaagcatgagccaccatgcccagcccagaatagatattttatgatgcatcataaatgtttgttttatggctgtgtcatgctttttattatttttagggaacttcttagctccaaaatgtgtgttcttatttttgagtttcattgagaaaatactgttgtgtattctgaaatcaatgggaatgatggtgccgttccaacagcgattcttttcaatttggcatgtgcatactaccatgtgccgtaattctcgtgctattttttatatttgaattctaattagaacccctcattgtatgcagtcaagtttgatagtggataagtttatcaaaaaattcagttaaagcaagcaatcagtaaaaaaaaaaaaatacatacatgcacacatacatatacatgtatctattatatatacatatataatatatatatttagcaagcataggtttttttgtttgtttgggttttgttgttggtttgagacagggtctcactctgtcgcccaggctggagtgcagtggcattatcatggttcactgcagccttgacctccccaggcttaggtgatcctccgacctcagcttcccaggtacctgggactacaggcgcgtgccaccatgcccagctaatttttgtagagatggggtttcgccatgttgcccaggctgatctccaactcctggctcaagcaatcctcctaccttggtcttccaaattgtggggattacaggcgtgaattaccatgccctgcctcaagcttaggtttttaaattttaacatacaactgttaatttgctggcacataaggctttgaatatgggtccactgattagattctttgtcccctaatataacccagactcatgctgtactatttatgatttttagcattttaatgtacttataaaacagtttgaatgctgaattcttctagatttttatgatttttctctcagtcttttacagttcttttccatggtcaaataacagcttatcctagtgacttgttttagtctctaaaaatacttagtttacatggaaataattcttctcactcatgccattgttttacatgacattcacttaaactatatacttaccaagtactgtaccaactatattaccaaatactataccagacaaattttgataagcataaaactcactctctcctgagagaggagcaggagaaagtggccttctagccatgaatgttcattgtgcagtaggcattaactttaggtttctcagagggaaggagaaacatagatttaaccagcaaattggataagaaggactcttctgtatagtgctgtgggtaccttttatactgggaaaactccagcattcaggttgtggtgacatcatttgaccataactgagtataaaggcattattgccatgttaagcctttttctgttccctattcattcatccatcatttttggcatgtgatttttaaacactggcttttagtttcaaagtggataaaatacagtttagattaaatttacattaaattttataatattagtgcattataaatgaaaagaattaagacattgttttaaaagaacttgccgacctctggatctcaatttgaaaatcattgtctttttagaaacctctgtatctgttccaatagcattctttggaaaacaggcaaatctccttatttgatattttccttcttttctgtgcagcgtgcatgatgttcacatttgtgagaaactcctatggaaatattcgggactaggttttactactccccctcattttttcccccacttgaatgtgttttctaattcaaatcaaagtgatgattgtctagggaaatacaacttggatacctttaatgtatgtaaaaacgttttaaaatcagttataactttgagtacttacattaatagcatgttccttgtgacattttttacaaccttacacacgagaactattgctaaagacacctgattgaacattagaatgaaattcatgagctattcagtggggacaggaaacttatttgagttgtttgaaatacagagaattaatttttgtttgtgttagaacatactttgctcaaagacttctgactaagatagcaatctttttgattgacaccatacatgttttgtagaggtcataattataccttacttttattctggttgcttgttttaagaggaatgttaacaaactggagcatgctccaaggaatctgatcaagatggtaaggaagtttgaaactatgtattagaggaacatttgcaggaaccaaaaatgctactagcttaaagaagaaaagattagacagtgggggagctgtacacatgatcactgtcattgggtaatttaaggcattgggagaggtaatacatttatttttacgactctagggggagatgcaacaccagtgtttgtaagttatggagaaacagtgtatgttcagaaaaggaaagaggaattttccttgtaattgtcagattccaaaaattcttgtctttccatatttcttattttattttattttatttttgagatggagtctcactccatctcccaggctggagtgcagtggcgccaactcagctcactacaactttcatctgtcaggttcaggtgattctcctgcctcagcctccctggtagctgggattacaggcatgagctgcaatgaacttccttcaatatgatcagatgcatcagctactttttttttttttttaactgtttctgggtacttttataatcttctgctctggaaatgctgctgtctaggcctgctgtgcggctctcataccagaacttttcttctatcttcattctggaaattcccttcacttgtaacctatgttagatgctctgtttccaggacccccaacatttccgttagcctcctgatgaaaggtgaatgagaggtcatttttgaaagccacaaagctgaaaatgttttattctgccttctttttaaaaattagtttgcctacattcacaaaggtgaaaatactttacccttggaactttcaatatattgcttagttgtcttcaaaccttcagtgttgctgttgagaagtctgatgctattcttattactgagtctttctgacccacttcttttcttccctcttttggagtatgtaagatcttcttttcttcctgctgttcagaacctcatattgaagtattttggtgtaggtcttttgttcagtgttttaggcttttttttttttttttttttttttgaatttgtttggaaactcacgctttttatagtgcagacatattttctccaatcttcttttttggggaatataaaagcctgtgatgccactgttctgggaaccaagttgagggaggtgactgtcattctgtgtgtttgatcttagataatcctccagctttccacatggtccctaacaagagtcttcagcagtgtcttgagtttgaagtctctgtggtataacctctttaaaactttccttcagacttcccacctagggctggtgggagtatgcttttggctgttaaggaactggagagtctaatgatttctgaccccactttaagccctcacctgtatccagttccttcagtaaatcttgatatgtcctgtggtgggaatcagtttccagttggcttctcccacctttgcagaagcttctgttttggctttctccataaagtcacttactgctggtattttgtttttaaatcttccaaattttgttattcaagaactgtcgtgtgcttttggactcttctcttgttctctgacgctctgtttattttaatttttgtgggcacatagtaggtgtatgtatttatgaggtacacaagataggagttttgatacaggcatgcagtatgagataaacacatcatggtaaccctctgtctcttgtgggttaataccttcttattcctttactgtcatttcgttgtgggtttgggcatgtgaagagatttagattttgtccactacttttttttttttttttttttttgagacagagtctcgctgttgcccaggttggagtgcaggggcgcgatctctgctcactgcaagctctgcctcccgggttcacgccattttcctgcctcagcctcccacgtagctgggactacaggcgcccgccaccttgccccgctaattttttgtatttttagtaaagacggggtttcaccatgtcagccaggatggtctcgatctcctgacctcgtgatctgcccgcttcggcctcccaaagtgctgagattacaggcgtgagccaccgcacccagccttgtccactacttttaactagaatgccttaattaggtttaagtcataacttgaatattattttttagatgcttgctctaagtgttacaaggaccttatggtgtagtatttgtggctttcccagaaactcagaataacaatagggatttatatcatgcttattattatatatagaaagctaaatatattcagttttttaatgttggactctggatagacgaatattttggactagccaacatatacggtgtcttggcatcaatagtttgtagatttgataacctactaaaggcaccttccttccatctgttctagattttaaatgtataattttatgctatgaaacatatgtaatatttttagtaaataactaggatgggctagatctaaatgtcaactttattactttctgccagtattattggcaactacataaacttccacaggttattaaaaatatttttaccagcttctcccacagcaggagaaaaacaattaataaaactaactaaataagctttcctacttactcatccagcacagattgttatttgaattgaacaaatggttatttgcaagattgtttgaggcctagttaagagcagcacactgatggacatatggaatgagccacaccatctggttacagtcatacctgggtggtggtcattaaaactaaatctcctggggatctgcagatgtcttaattatactacaaaaatgtattgggctgcaccagtaggctactttgaacttcttgaaaccagttaacttgcaaacatgttttcaagatatcaaaactgcagttattgagtcttttttttttttttttttgcacaaaactgaagacttaaaatgtgtatttgaggatctggaatgggtggtacttcagtattggccccatgaaagtaatgtggtttacttacccaacactttcatccaatagttatgactaatatgacagaaaagtgttttataaaccctgaattcaccctgtagctagaagggctttagcaaaaaagggaagtgacctcaggttcacatcttaaaaatacttgttttgattcactgcaggattttattcacttaaatgatcaaatttggtaggtgaagatagtctgctaatgataaatttaattactctaaaaattgtggttactatagatactaacacgaaatcaggactacagtttttttatttcttgacatacgttataattttttggtatgcagttctgtgaatcttaacatatgtatagattcatatagccaccactcaaattagaacatgcaagttttccatcaccccaaaaaacttttagcccttgtttttactgtactcctggcaattactgatctgttctccaacactgcaggttttgtctttccaagaatgttgtgtaaatggactcataacttttctagattgccttttttcactcaacatattatctttaagattaatccaagttagttgttgtttatcttaatagtttgttcctccttgttgctaagtagtattccattgcttgtttgtttttccattttctgtttgaggagtttctagtttttgatatatatgaatggaaatgctgtaaatgtttatgctcaagtttttgggtgaacgtaagttttcatttcacttgggtaaatatctagggctaggttgtatggcacatgcatgtttaattaaaaaattggccaagtttttttggttttgttttgatttttcccttttacttgtggaattccgttttcttttttttattatactttaagttttggggtacatgtgcacaacgtgcaggtttgttacatatatatacacatgccatgttggtgtgctgcacccattaacattaggtatatctcctaatgctatccctcccccctacccccaccctccattttcttttatggtcacaattgaaattgtactattgatattaacattccagagttaatcagtattttaatcttctgttaatacaaggtctttaaaaatacaaagtagtttcatttaagtggtgtttctttttttttgagacggagttttactctgtggcccaggctggagtgcagtggcgtgatctcggctcactgcaacctctgcctcccaggttcaagtgattctgctgcctcagactcctgagtagctgggattgaggactgccaccacacctggctaatttttctatttttagtagagatggagttttaaccatgttggccaggctgctctcgaactcctgatcacaagtgatccacccgcctgctgggattaagattacaggtgtgagccaccgcgcctggctcatttaagtgttattgttggtaaacatattatttgtcccttttttccttctgttagttggatgttactgtaataagatgatatttgtttagatttgccagtttacagtttgcttaccccttagcatctcaagactttcttgggtcatttttcttcttaaagtatatacagtataagcttctttaatgaagatctcttagttttttttttgtttttttttttttttttttttttttttttttttgagatggagtctcactctgttacccaggctggagtgcagtggtacgatcttggctcactgtaacctctgcctcctgggttcaagtgatcttcctgcctcagcctccccagtagctgggattacaagtgtgcgccaacatgcccggctaatttttgtatttttgttgttagtagagatggggtttcaccatgttagccaggctggtctcgaactcctgagctcaggtgatctgcccaccttggcctcctaaagtgctgggattacacacataagccaccgtacctagcctagtgggtttttttgttttgttttttatctgaagatactgttattttgatcttatacttcaaacatagctttgctggattcacaagttattttttcttaccacttgaagataatattccatggtcttctcccttccattgagaagtctactacgagccaaattttgttccctatattttcattccagttgcttttaagatcttctctgtctttgaagtttcaccgaatcgtttctttttttttttttttttttgagacagagtctcgctcaggctagagtgcaatggcgtgatcttagctcactgcaacctccaactcccaggttcaagtgattctcctgcctaagcctcctgagtagctaggattacaggcacccgccaccatgcccagctaatttttttttttttttttttccagtagagatggggtttcaccaggttggccaggaactcctgacctcaggtgatccacctgcctcagcctcccaaagtactgggattacaggtgtgagccaccgcacccagcccaaattgtttttaaattggattttatttatccagattttgatgagctgtgctttttatatctgtagatgcatgacttttattggatctgaaaaaaatctcagtcattatcacttcagtgttaccttccagttcattaattctctctagttatgtctaatctgctctctacctgatttggtgaatttttaatttccacatttataatttttcatttctgaaaattctgatttttaaatttgcctcattctgataattacatatttcctgctcatttttactccatctttcatttaatgtttcctatatactatatttcgtaactggtaattcagatagctagtcttggagggaggtggtgttaatcttttgcatttactgactcaagctcattggtttgtttcatttttgtgcgataatttttactgcagcctcatattttattgaacttaatatttggaaatcttgatagcttaaattgaaaatgcattcctttagagagaatttgcgtgttcatgggatcctaggatcctatgtaacctgaaggtattttatttcccatccagggtcttaggtttaacttaagagagatatctgaggttgagctctctcatctcgccttggctattgttggcacttgctttctgaacaacattgcttcttgtgtataacatgggacacatttctggtttcagcttaatttttaattttttgtctttcttttctgtggggtgggggatccttagagatttccctttctgaaaagttcaatagtatgttaatagtcgtagggttttcggggggtaatttatggactatcatattgtagtagaggagccttttcagtttgccatactgttggaagtagaaattaatgagattaaatatgtaaagtgccagtctagatactgtatacatattaatttcctactgccttattaacttacattttgccaaccagttcatataagagtgctttatattatatagtttatttttggttatttgttgtggacactttccttagtctgttttctaacttaaattttaatatatattctatatggattttaaacatgtatgtttactttgttgtttattgtttcagagagagaaatatttattctgttttctgttgttctgaaaagaaagttatgcaagattgaaccttggtagagtttatatcttagtagagagccaaagaacttccatgaatttcttttgcttggtaatttacatatttattatatttagagcagtggttctcaactgcaggggttttaccctgtgggggatatttggcagtgtctggaaacatttttgattgtcactgtttgatgaagggtgctactgacatttagtgagtagagccaggaatgcagatgctgctcaacatcgtacaatgcataggacacccctccacaataaagaattatccaacccaaaatgtcaatagtgtcaaagttaagaagccttgatttagagaaatcaagataaggtgttgatgctggtgggtatcacaggatttgcgagggaaggttttccaggttttagaaaaatggaaagaaagccttagaatggaaaaccgccctccttctgttaatttctttttctaattcttcagcatagacgttcacattcataaagccaagactaaaaatctaaatttttggaatactactgctagtcacttggactttccattatttcttaccctttttttctactgcagagtaagttatctttattatagaaaacttggagagaatagaaaattatgaatagaaaaaaattcattcgatctcgtcacttatatacaagacctgttaacattttggagtatttggtttgtctgttttttttttgctgattaaaaaaattagctctgagaatactatataatttttatcttaaaaagttaaagcacaattgtaagtgcataatgtcatactttttaaaattgttatttgtttaaccatttcctctttggtgtgaagtgtttctgatgttttcctattatgaataatgtttggtgaacatcttgtacataggtggtcagctctatttccaattctttttttagaattgattcccaaaagtggcatagctgggtcaaatgggagtaatgaggttcttaataaaaattggtgagtttatcccacaatcagtgtttgagactactcatgttttggcacacgggtgggtagggtggggtgtgggtggtataggggcgagactactcattttcattgcaactcatcactctgaatgctacttaagacattgatggaatcagtcttcagctttttctcagactcttataagcatgtaaaatccatgtacaaagcttttgaaggctaaaaaatgaaaaatccatgtacagccttgcactgagatacagttaatatccctgaataaatggaatataaaagagcaattagagaaagcaacatgaacacataaaatttcctcatgcttactcaatttatgtaataagtgtagccttgtaaaattgtctgccattttgtaaattgaatctcattttgagtgtactgagagagctcatttgaataaatcctgtaacgagtaacaaatcctgtaatagatttcacttggaaaaaatgtcctttccacatttggttatgagtacattctggttgtacttgtttcataagttcaaaatgttcacttatttaggtaatatgaataccttctttgtgcattaatataccctgtgatatgatagggcctgggatatatttacacactgtactgcatttgtgagattacatatgtgtgacgtaacttaaaaagagttagggtcagctttatgaattgttgtttcctcattgaacagtttgagaagtatacgggtatagttgtttgctccaaaatttccaaaacatacatccttttaatagtgtttgatatgtcctcatcagaaagttactcctttgccttttccatttttaaaaggagatattaccagtaggtggaaaggttaaggcttgtctggaacaaggaggagatattacagaataaggagagacaaagttgcaaagtgagaaggaaggagtagaggcatttgagagaacaataagatgttaattcctttgcgaattgttttggggcaaggtagaatgtattttatcataaatgattaaaccctccctgaaaggggtggattagtgttctcataatactgatgagttggaaacaaagtgttgtgccctaagtgagtaataatgacttttctaaattttcacttttggaaatttatttacttatttatttatttatttgagagtctagctctgttgcccatgctggactgcagtggtgcaatcttggctcactgcaccctctgcctcccaggttcaggtgattctgctgcctcagcctcccgagtagctgggactacaggcgtgcgacaccatgcccagataatttttgtagtttttagtagagacagggtttcaacatgttggccaggctgatctcgaactcctgacctcaagtgatctttccaccttggcctcccaaagtactgggattacaggcatgagccactgtgcccggccacttttggaaatttgaaactagtctttagagccttattttatgattgcaagctttaaaggtacttgcaagttactactgaggttgtttcttcagagttagttttgagagtttttttttttttttttttttttttgagacggagtctcagtctgctgcccaggatggaatgcagtggcgcaatctcagctcactgcaacttccgcctcctggggtcaagcgattctcctgcctcagcctcctaagtagctggcaagcgccaccacacctgcctaattttcgtatttttagtagagatggggtttcaccatgttggccaggctggtctcaaacttctgacctcaagtgatatgcccaccttggcctcccaaagtactgagattacaggtgtgagccaccacacctggccaagtttgagagttttaccagaataaaatttcggttacttagttcttcttgttcagcctttatttccctattttatgacaacagaaggaaaaaatgagtataaaatttaaagcaaaacaaaacaacaaccaaacccaagttaacttttccctactttgaaattcgaaacaaatgaagtgtaacttgtcttaattcagatcatgatctgaaagatgacatttatctgtgacaagggggagggagaaaaagaagcagtgaattgaggagcttctcctttgtgttttgacaagcaaaaatacttttttttttttttgagacagaatcttgctctgttttccaggatggagtgcagtggcacgatcttggctcactgcaacctctgcctcctgggttcaagcaattttcatgcctcagcctcccgagtagctgagattacaggtgcatgccaccacgcccagcttatttttgtatttttagtaaagacagggttttgccatgttgcccaggctggtcttgaactcctgacctcaggtgagctcgtcgtctcggccccccaaagtgctggggttacagatgtgaaccacagcacccagcccaaaaataccgtgaatttctagaatgttacgcaccatatttaattattcaaaatgttcccaaaatattttttaaaaacttctggtacatttattattttatatcattgttaaatatcctatttaattagtgtgaatgattacaaattgactgacaaattctttaaaaatattactgcagttggccgggcgtggtcgctcacgcctgtaatcccagcactttgggaggccgaggcaggtggatcacgaggtcaggagattgagaacatcctggctaacacggtgaaaccctgtctctactaaaaatacaaaaaattagccggacgtggtggcgggtacctgtagtcccagctactcaggagactgaggcaggagaatggcgtgaacccgggaggtggagcttgcagtgagccgagactgcgccactgcactccagcctgggcgacagagcgagactccgtctcaaaaaaaaaaaaaaaaattactgcagtaattgctgtagaacctagagttcaaatgagacctttgtcagagaacatgaccccaaagtagttctgtggaactttgcgtaggttacttggtattttgcatagattattgggccattattcttgtgggtggacctgcccacaagatagttggacaacatgtaaatagttattaaatctgtttgagtgcatttccactcggtttttcatgtgcgtgttcaaacatcaaggtaaagtccttttaaggccatccatacagaaaaggcttcagggttctaaaggaccttaaaaattgttaaatcatgcatgcagcaatttttttgaatctcttccgtatgtccctgcagtttcctcttgtacacactgtcttttgaggtgactgaaaatgttctttattataaattcttacttgaattgatggcaagataggactttactaattggtttattacctcaattcatgatattacttgtaatatagttttctaaattagtcttaagcttatttaaagctaacagctgtttgataaggatatttgtatagctctggtcttattatatcattgtttcttaggaaatatgaaatatttaaagaattttaataattctttcatagagttcttcatatgtatagtcttttcatcagaaacacactaaagcactatttgcatttcctagaaactcatgtgtcacagttactttgtgtttttaactaggtggttaattgaatttattgttaagtctattatttaatgagtctaaccaaaccttaatatctattattaagtttaatagtttaaaataatttaaaaatactttgagtttatggaatgaaaacactgtttcaagtttgtgtgttggttagaaatattttgaattactagatgtgtcattttaaaaatgtggtatgtactagtaaattttgtaaaatattttatcttttaggcgaggattaaatccaccacacagggtgaaatctatctccatgacaacattcacacaacaggaaattgaattcttacaaaaacatggaaatgaagtaagtggtttttttttttttttgcaatttttgacttttttgttggcagtcattttaatgagatttaataagttatttaaaacgttgaatttcacggtctaaataagttatttttgtattttatatttagatattttaaaatgtactcatttaataatgtatttggaattaatgtttactacataaacactttaccgtaaatctgaggtgaaatgtgtgtatttaaaagtcatcagtcttgaatataaaaggcgtttcggaggacacccattattacagttattgttagtcttcgcttcaaaagtcaaaaaagaggaagagaattcattttgtgatgttgtgttaaacttgttagagtgttgtgtgatcagctttcacttgaagtcctctatttttcgtaaatttttaactttggacgtgtaggtgatgtgtaatgtttagcaggtgctcagtagggaggaggttagtagttctcagtggcagctaagtgtcatggggagccagatggtataaagatttggatggaagctttttttcttcttgcctttaatgggcttccagtaattctattctgtttgcttgtttgcttttagctctgtgttttgctattagtaaaagtttttaaaatttttctaatatttttaaaattaataaaattaacaaagagagtgggcatttttttataatcctgcaataaggatgagccagttaacccaagctgattaataatagctattattatttgacagaaaagtctccttttctagaaaggataagtagtactttagtggtactcttctggttgcatctttgatatccttaataaacataaagtaagttaaatattaaaattttattagttttaatcttctccttggacccttagaaaatatatgcaagcattttacactctgcctttcttcctaatactctgaaagtaataccttaaaattgtttgcctacttgtgatgtccacttgcttttggttctaaaatagtgaggaaatataaattcacagctatgaaatatttttaaatatttcatattaaattatttaaagaagagagcacattttgaagtctccagattttgccgatgacaaattattttgagtattcagattccagactaatgtgagtacattataagaacatgtaaagctggatgaaaaggtaggaggcttttaatgaagagtaagcatagaataatatatatattgattaaaatacaatttgaactacttgtgtaaagtttacaagtaggattaacttaacattgcacacttgaagttactttcttagaatgttggcttagtgtgcaaaattttggaaattagaatggaatcagaaataaagaatattattctatctttagattaaaaatatgacagtaggtaaaaacagagtagcaaaactgtgataacagcagtcaattgaagaagtgaaaatataacaatatgtgagataaggttaggtggagactggtccaaaacaataccaagattgaaggagtatatatttttttaattgtggtgggaacattgatctaccctcttaacaaatttttagatgtgcagtattctatggttaattatagacatagtgctgtatagcagatctctagaaattaatcatcttgtataactgaaactttataccagttgaattacagctcctcattttatcttctgcccctgttgccccgattctactctctgcttctatgggtttgactattttagatacctcatataaatggaattacacaatatttgtacttctgtgattggcatatttagtgtaatgtcctcaagattcatccttattgtcatgtatggcaggatttctgaaggaatattttttaaggctatagcattatggtaaatttagagtatataaaaagaattagttaatttttaggaactcactgtatcaaaaagtagaagcaaaatgtaaatgttataagtgactgaaatgtatttatgaatcttaagtcctacaaagaggtttgcaagttgatagaccactcaaagcacttaccatgacaatcactgtcactgtgctgggtattagggatgtggttatagatgtgttacaccggcttagtggacaaagggctcacagttggtgtgacagatacataacagataattgcaacatggtattagataaataatgataagaataagaagtatcagcagtagtatggaaaaagggaatcagtattttggtggaaaggagaggattgggaagacccgacagaacagataacacatttgttggtttttgagggtaactagaacctaagctggtagtggaagtcactgaagatggagcaaacagtacaaaaagaaaaagggaaacttgcaataggttgctaggaaatatactaaccttgtaaatgcttgttaaggaagacaaacataccttcttatagtataccaaagaacatcttagaaccaaaataatggacaggtatgtttggttctttacagtattaacagtatctgtgttcttaaaattttgagaggtgtgtagagggtgatgaagatacgaagtgtgggacagttggtacagctttataaccaaatctttatggatttcacgtgcaagtgttctattatcagtttatcttttttaaacctttaaatggtaaatatcacttgcatagggaatagtaccagaacgtaagtttacatttcaaaataagttgccatattctctcgtcaccttttaatagtttggaaagggccatattcagtcacataagttttggattaaaaaggctctatcatacatcttgtgcatgaatgagttcatgcctgaagatgagtatttccaaaattaaaagatcagaaagtatattggctttggcagcagccttggatctttgatccccaccagggagttttagtgagctgtggggcatgtttggttgttgtcactattggaagatgttgctggcttaagcaggcaagcaccatgaatgatgaatgacttgtaatgtgttgaacagaattaacctgcatgccatatgctatgaatgttcctccagacatttatatgtgggaaacatctgtgtatggtcttctgcatatataatttaattctgtcttaatacttgcattgtagttgaacatcctattgccaaagaaagtcatgctccaagcccagaatcagagtgagaggggctaccaagttacagggcaaagggcatggatacaatcacacaactgatggcaatacgaattgtattttagtcatcaataaagtatatctgtattggtagctgtggtaagcaaataatgttattactatttatagatatgcatagagaccatacttacagagtagatcattagtttctacagatgtggtttacaaatttcttgactattactttagtgtttatagacttctacagtgtgtttggtggaggagatatgtatatcattaagttacagcacataatatgccagatgctagtaaaatatttcgcattggagcactttgtatttatttgctgaagtaatttttgtcatttttttcagaaccagaatatttcacaaaaagtttccatgtatttcttttgtatcatacagttactttaaaaaaaaacctgtagtgatcttggcactgtagctcccctgtaatcccagcactttgggaggtggaggtgggaggatcccttgaggccaggaattcgagatcaacctaggcaacaaagcgagatcccatctctccaaaaatttaaaaattagccaggcgtggtggtacacatctgtagtcccggctacccaggaggctgaggtgggagcattgcttgagccctggagttcaaggctgcagtaagtcatgatcatgcaactgcacaccagcctcggtgaccaagcgagatactgtctcaaaaaaaaaaaaaaaaaaatctatagtgattttctgtatgtcctcatttgtgatgtcatgggcaaattatggttttctagttaaaggaagttggattaacttctgattataaagttaacggaaggtggactggtgaacactgctgtaagtagataattcaatggagaagaaaatttagaaataattttattttgaaatatgtatagtttatgttttctagttgtaagttaaccttcctaatatgtttgaagactaaaagtaaaagcattactactggccaagtgcagtggctcatgcttgtaatcccagctgtttgggaggctgaggcgaatggatcagttgaggccaggagttcaagaccagcctggccaacgtggcgaaactctgtctctactaaaaatatatatatattaaaaaaaaaaattagccaggcatggtggtgtgtgcctgtaatcccaggtacttgggagactgaggtgggagaatcgcttgaacctgggaggtggaggttacagtgagattgtgccactgcacttcagcctgggcaacagagtgagactgtctcaaaaaaaaaaaaaagaaaaaaaaagaagacattattattaatgctccacaggcatggtctatgtgtaggagtaaaatcaggcattgcatgccagtatttgattatctctatactggattaaaaacaaaacaaaatgattgctttgaaaacccatgcaataacgtacacttttcccttgttaacattcatgattgattcatttttgaagcagagatttattaataaattacctactgtgggagaatggcgtgaacctgggtggtggagcttgcagtgagccgagattgcgccactgcactccagcttgggcgatagagcgagactccgtctcaaaaaaaaaaaataaataaaatagcctgctgtgtgccaggaactgtccttaggtcctagggatacaaaaagggagatgattcctgtcctccccttgcagtcttctacatgcaggagacataataaaagtacagtggtcttgtgctgaaagctcagatttggactatgcaggttgtgaaccttgggcaagaagctttttagccttaatttctattggtagtaactataatacctatgtataaaaatgctaggattttttgaattaggccaacttgtgaaaattcccagcgtatttcttgtcagatagtatttatttattgaatctgaatctaaagtggtagaagttataagaagaattatcaatttttattttcattcctggtttggatggtttctgtagggggatttttcagttttcatagcatactgtcatgtcatttacattaatattcgggttatgtatttaaactcttggagcattttaacttcgattttctgctgagtttaataataatgaaaattgatagttattttagtaacaacatattgccatgtagagtggcagagttaagttatatactcattaattcaggatttacagctattctgttgcctatggcaggggttggcaaactgcttgtagtggccagatagtaaatattgtaggctttgtgggccacctgtattctctgttgcatatccttgtttgaaattcaccccctcttccccccccaccccacacacacaattctttagtgtaaaaaccatctttagattaaggcagtataaaaacaggctagtgatgacccagtttggtctgcagattgaagatgtatagaactcttaacgtttcagcttgcaatgtaaatctttttatgacctgacttcttaatgtaatgacgttattgccagcagaaatgttttaactacaatgatctttgttttgttttccacatgtgctatctgtattctaattttcttgccattttaccaatgctggcttttatttttgcttgacttttctcttctaatcccatcagtctttcaggagtttttatacctcagatactaacacccccatatgtattttaaactgtttaaaaaataacattcactgtaagatttacaaaaaaaaattttttttgttattgctcttagtttcttctgtattggtcttactgccctcaagacattatagacatctctgtggcataatcttgcatacgtcttaattatacctaaagcagtgaaaatgcacaagcatatatagccaaatgagtttctttcttgttttgttttttttttttttttttttttttttggggacggagtcttactctgtcgcctaggctggagtgcagtggtgcaatcttggctcactgcaacctccacctcccagattcaagtgattctcctgcctcagcctcccaagtagctgggattacaggcatgtaccaccatgcctggctaatttgctaggactcaaaaaaatccgtggtttagtttgattaccactaatttatgaaccttgttaccttggggaaaccacttttccctgaccttcattttcctttgtaatctgtgggaaatatctgttttgcctatttcatgaggttgatttgaaggtagtatataggaaaacattttgaaaattgatgtattatatagatgtaagatcatggttttattttattttttaaaattaaaaaaaaatttttttccccaggtttggtaacttgcccaagatcgtgcttttatgggcaaagatacttttccagttgattcctaaacacagaaaataagtatcacataggaacatggcatgctttgaattgaatttagggtggagataaatttttgcagaatttcagtcagtatgatggtattaataaatgaaaacattcactaataatacattgaaaaacattttaaactacaaaattaattatttgagggaatagcttcctagagggatatctcaggtttaaaaccatccaattaaaatattaaagcacactattgttattatttaagggatatttatttagtgtctgcatatttatgcacgtctggccttttaagcattttgaaaggaaggtatggtgctatggctcttctaaatattagctgaatctagtcagtagtaacttagtaaagttgaaaatatttagagtatattatttgatgttaactgttggctttcagagaaatacactaacaaaaatgtagaaaatgtagacatgtctttgtgttgaacatatcataatccgtgggtctttttgaatgacagaaaacccagagatttatagaagaagctagatgttgtttgtaactactctgagagtttacttaactttttttacattacatattccaggttacagtgtatttctttctagctgtttgccttaccattctagcttcctgtaatctcttagcttgtttttttcttgccattgtgtgttatcttctaaaaaatcttacttgactcgaattaaaacaatataaatcattagatgcttttgtttcttttttaaagagtttttttgtggagttattcatgcctttagacaagtagataatgtaacaaacttccatcaacacatggctgtctttttattatttttaagcaaatgcgagacataaaatttcatctgtaaactcaactctcatgttatctgtaaatttcaaggactttaaaatatatatggcaacagtgctatttttgtccctatgacaattaacagtaatctagtcatctggtcagtgttttaagttttctgttgttcatcagtatcttacttttcttttttttttcttaatggtttgtttgaatgaggatccaggtaatatccacacatcgagtggttaaaatgggctttaaaactttgtattgcttataaaggattggaggcttggctgggcaccatgcctcatgtttgtaatcccagcactttgggaggctgaggcaggcagatcacttgaggccaggagttcgagtctagcttgggcaacatggcaaaaccccatctctactaaaaatacaaaaatttgctgggcgtggtggcgtgtgcctgtaatcccaactactctggaggccaaggcacaagaatcacttgaacccagcaggcagaggttgtagtgagccaagatggcaccactgtactccagcctgggtgacagagtgagactctgtctcaaaaaaaaaaaaaaggaagaaaaaaagggattggaggctagatggatcacagtgacacctacaaagattggactggaatggacctgtattagtagtatgtggcatagattcaggcagaggtttgtgttaggggcctcaggccaggtagttattctggagctggataatctataacctggggcccctgccggcttaaagtccctgggaaacatagcagctcaggtgacttcagtgccttatgggacacggacgcagcccgagtgctacctggtacacatctgagttgtagtccttttcctgtgtctttttcattgctctggcatcagctgctactcagtctccttaaaattgatgttgggttcttactgcaggacaagaagcctgtttgtctgtcaggacggcagctgacattcattttggcaacagagtatgccatgtggttatggggtacgttatgagctggtaagaagaaaacaaacaggccctccagcctcataggtttttgaggaattggtaatgatgtttaaggtttgggtagtagtagccaaaggccatgcctgcaagaacttcttgttgatttgggtgatattttttggtcagtctcttactggaccatgactcccactacttccccaaggacaatctcatactggcctgtgatcctaggttctttccaaggatggagtgtctgtgagcagttatcttttgataggagaacttgtcctgctttgtgccatctaatggcagcatagtgtcataggtcttatggcaggtgagcagtggttcaccagcttgtctgcctgcagggagcctggtttggctatctgctacattgtctctcagaacctgctgtcctaggtagctacagcaagactctggacttgggtagagaatgctcagagccatagcacaatggccagatctgcctgttttcgtcccctcctccaacattattatggaaaattccaaatacataaaagttgaaaaattatacaggtacaataaacattgtgctatatttgcctcagcagatatctgtatccattcatcagtccatctgatatttcaaagtaagctcaaaacattagttcacattacttgtataaactgcaatatatctatcttttttatttttaaattaaattaaattaaaaaaaaaattttttttttgagacagagtttcgctcttgttgcccaggctggagtgcagtggcatgatcttggctcactgcaaccactgcctcccaggttcaagtgattctcctgccttagcctcctgagtagctgggattacaggcgctcgccaccacgcccagctaattttttgtgtttttagtagagacgagggttcatcatattggccaggctggtcttgaactcctgatctcaggtgatccacctacctcagcctctcaaagtgctgggattacaggcgtgagccaccgtgcccagcctaattttttttgacagagtcttggtcttgtcgctcaggctggagtagtgtgatcttggctaactgcaacttccacctcctggattcaagagattctcctgcttcagcctccagagtagctggggctacaggcacccaccaccttgctgggctagtttttgtatttttagtagagatggggttttgccatgttggccaggatggtcttgaactcctgacctcaggtgatctgtccaccttggcctcctaaagtgttgggattataggcatgagccattgggcctaacccagtatatctatcattaattagaattcagtattcgttcaattttttgaggtataatttacatacagtgaaacttaagaatcttaagtgtacttttggatgagttttgatcattgcttccaatttggtaatccaaagccctatacaaatatacacataaacatcattacagacagtcactggacacttcttcctattcagtccttccctgaattttttgagacagggtctcaacttctgtcactcccaggctggagtgcagtggctggatcacggcttactgcagccttgacttcctgggctcaggtgattcttccacctcagcctcctgagcagctgggaccataggcatacaccaccacgcgtggcccatttttttatttttagtagagacggagtctacttctgaggcactgttttgtttttttattcacattcatataaagtaagttaaaatgtgatttttaaaataaccctccttccttttttattttttttgaggtaggttcttactctgttgtccaggctggagtgcagtggtgcgattacagctcactgcagccttgaccacctgtgcttaagcagttctcccaccttaacctcccaagtagctgggactacaggtgcgtgccaccatgcctggctaatactgtttatttttgtagagacgagatctcactgtgttgcccaagttggtctcaaactcctgactaaagcgatccacctgtcttggcctcccaaagtgcgaggattacaggcctgagccacagtgcccaaccaaagtaaaccttcttttgagagttatgcacgtggatgcttgtactttttcctgtttattaccaagtattggcttctattctatgaataaattataatttgttcattcttctttgtcagatatatccttagtaaatattttctcccagtctgtggttttttgttttttgtttttaattttttgagacagagtctcactctgttgcccagactggagtacagtgacgcgatcttggctcactgcaacctccgccttctgggttcagttggttcttgtgccccagcctcccgagtagctaggaccacaagcgcacaccaccagtcccagctaattttttgtaatttagtagagatgaggatttgccatgtaggccaggcagatctggaactcctgacctcaggtgatccacctgcctcggcctcccaaagtgctgggattacaggcatgagccaccatgcctggccctcatttattttctttttgatatcttttggcaagcggaagttttgtcattttgatgaaatacaatttattagttttttgttttatagtgaatggttcctcttctctgtcttaaaaaatctgcttcctctcaaatcatgaggataatcttatttattttagaagctttacatttacatctgtgatccatctcaaattaattttagtgtatggtgtgatagggattgagtttcatatttttacatgaatatatacacttctagctctattgttgaaaacacttttctttcctcggtgttgctttggagtctttgtcaaaaatgaaatgaccaggcagggcatggtggttcacgtctgtaatcctagcactttgggaggcagaggtgggcagatggcttgagcccaggagttcaagaccaacctgggcaacatggtgagaccctgtctctacaaaaaatacaaaagttagccaggcatggtggtgtgcacctgtattcccagctagttgggaggctgaggtggggggatcacctgagctttggggaggttttaggctgcagtgagctgtgattgcaccactgcattctagcctgggcaacaaagtgagaagttgtctcaattaaaaaaaaaaaaaaaagaaatgaccgtataattacgggttatatgctctctattatatagtgtcatttgtgtatttgttaacccttatgccatacaacactgtcttttggttactctgctttcctagtaaatcttgaagtcaggtagtacaaatccttcagttttctgtttttaaagattgcgttagatattctgggtcaggggttgaccaactaaagcctgtgggccaaatttggcctgttgcctgtttttatatggtctacctgattgagctaccattgtgagacatggagaccaagctggattttctctcccttccttcctcatttctccctccactgttggcagctttgggcaccaagtggtggaatctgggagttgatgactcagtcacctttgaccagctgcccaaattgagatgactgggctctttgggaagttggaaaggcacaccaggatctgagtgtcactgtggtggagagtgaaaatgaccacagtgcagattatctgtttgtcatattggttttgataaattgtacttttcagggaatttgctcatttcatctaagttgtcatatttattgacataaagttattcataatagtcttgttctcttaatgtgtatgggatctataattactttgctcttttattatttccttctgtttactctgggttatttcctcatttttagcttactaaaggtgggacctgaggtcattgattctacagcttgctctttgaatacagagttagaggaaagataatgttattaagacattaataaagaagggaaaatgtatttactgtttattaagtggaagtagattgtgttcagtaggctgaggaggaggaagaggaggagggagggactggtcttgctgtcttggagataacagactggagaggtggaggggaggcggaagaggcagggacacttggtgtaaattttttttttttttttttgagatagggtctcaacttccgtcactcccgggctggagtgcggtggctggatcatggcttactgcagccttgacttcctgggctcaggtgactctcccacctcagcctcccaagcacctgggaccacaggcatacaccaccacgcctggctcatttttgtattttgagtagagatagagcttcactatgttgcccaggctggtctctaacttttgggcccaaatgatccgcctgccttggcctcccagagtgctggggttatgggcttgagccactgtgcccagccaacttggtgtaacttttattgaaaaaatttgtgtttaagcggacatgcacagttcaaactcatattgtcaactattaacattttaaagtgatcattttccctctaagctctacttaactgtgctatacaaatgttgatgtattttatcatttggttcaaaatgttttctaattgcccttgtgggccttctttgacccattgatttatttagaagtagtggtttaatttttacatatttgaggttttcctaggtccttttctgtaattgattgctgagttaattctgtatcatcagtgaacatttttgatatattttcactgctttcctttttattgagatctctttatggtccagcacgtgttctgtcttggtgagtgtacagtgtgtacttgaaaggagtgtgttttctgaagttgttgggtgtagtgttctataaatgacaattatagctctgtgattgatggtgtttagatgttgtggatccacgttactgatttcgtctagttaagcaactgcagatagaattggacagctggtgtggatttacatatttttttctgtaataaatacatcattttttgctgcatgtattttgaaactttattattggtgctgttatataattattatgtcttcttgattatgccaccattatgtaatatcttttttatgtttgataatactcttttttgaaatttactttatctcatacttatattgttttttctttgtagtgatgggtagttgtgaaacactttatttttgttttcagaatgtgactgtgatgcacctggatatgctttgtgtatgtgtatgtatttatcctacttgtggttgatgatgatcttgaatctgtacatttttcatttaccaaattgggaaaattttatcattttccttccaaatattttttctgcctcattctctctcagctctccttctgagattccaattgcatggatgttaggcattttgatactgttctgcagtttccagaggctcttaatttttttccctccatctttttactttccagattggacaatttctctcttatcctaagctcactcttctgttatctctaagctctaatttttaactttagatattgtcttttccatctctagcatttgtattttttctgttatttctagagtttccatttctctgctcagattttgttcatttttatttattgcaaggatgttttcttatatgatatggtctttttattttgttttttttgtttgtttgtttgtttttgagacggagtcttattctgtcgtccaggctggagtgcagtggcacaatcttggctcagtgcaacctccgcctcccaggttcaagtgattctctgcctcagcctcccgagtagctgggattacaggcacccgccaccatgcctggctaatttttgtatttttagtagagacagggtttcagtttcactgtcttggccaggctggtcttgaactcctaatctcgtgatccacctgccttggccttccaaaatgctgggattacaggcatgagccactgcacccagcctgtaatatgtttttgaatataagtatactagctattttaagttattgcctgcttattctaaaatctttatcattgcagaatctgtcgctgtttgatttttcttttgattatgggtcataatttcctgtttctttgtatatgtagtgcctctggattctgttttgttccttcataaactattggttttaattgttttgttttttactttagcaaattctgctgctcccatgatgagtgccagctgaaatctgctcagttctttaattgaactgtttgaagtcagccccatgcacacataggtcaggagtgagccagagacttgggaaaagtggatatgcaagttttgtggtacctattttctttctctggccatctctcttctgggatttagccctcactttccagttgctatggctgtggtgaacctcttgtcttcttgtactttaagctttaaggcttgtgtatttctgtttgagttttagcagccctgcatgactgctttcaagtgatgttccttaaaaaaaaaaaaaaaaaaaaagcacataggcacatacctagtgctgtttctttcctcttcagcttgtttgtggttgctctgtagtgtcttaatagactttgtccagagtttatagttgttatctgctggagagttggggttttaacctgaggctttttgccactactggtggaaatctacactgctcgcccttttaagtctttttttatcctctaagtttcctctccagtcactcattcttattctctgccctcctgctaaccaagtcatttattccaccttctggattttgctaatgccatccacgtagtgtcaacgttcctctgttctcccagttacctataaaccggtggttggctgtagtagtttcttaagattcaggcttaatttcaggaatgggaaagatccactatttcataggttgtgtggtgtttttttaatcaaaaaccactttaaaagttttaatttttggtcatgttagcagctaatgctcagtgcctacatccactaattagcaattgtaaaatggtgatagtctaactcagtagttttccaagtacagtttgggacttgtaagggatccttgagaccttttcagaggttctttaaagttaaaaaaaaaaatttaataatactgagactcagtttgctgtttttttactcctgttttcatgggtatacagagttttccagaagctacataacataaaaatgcggaagcagatgagaaatcagctggctcctacctaacaaggcattaatgaagtttacaaaaattacaacagtaatcccagcacttttgggaggccgaggcaggtggatccacgaggtcaggagatcgagaccatcttggctaacatggtgaaatcctgtctctactaaaaatactaacaaattagctgggcgtggtggcacatgcctgtagtcccagctgcttgggaggctgaggcaggagaatggcatgaacccgggaggcggagcttgcagtgagccgagatggcgccactgcactgcagcctggacgacagagcgagactctgtctcaaaaaaaaaaaaaaaaaaaaaaaagcgccttttcactaattttttttgttttggaaaaagctgtttttataaataaaagttatttacattaagatgcaatagttttattcttcttttaagaacattaaaactatttataaatatcagtagatatggtgcaccaccatttgtggtcttcaatattgaactcttcaaaatagtttcataacatttccaacagcaagcaattaggttttttttaaattactatgaatttatttatttgatatgtttcactcagttattcttgctgatgcccaaattttcccctctttgttcaatgaggtaatctgtttttgaaacctatttaaaacttctgcaaatcttgtttttacctagaagagctttgcctgaatgttcctttttttttttttaattaacctgtgagccacccgtgtattcagaaatgttgaaagaaaactgtttcttccccacctcttggtttatttacatagaatattgtacaaatgtggtttacttcaggggcttgttttgaatttgtgctaattctctctgttccttggccaatgactacattctaaacctcggtcagctgcctcacaaatgcatgccttcagtcaccaggacaacaagacaatagagtatcagtacaaatagatcactatgattgagtcctagattgaactaaataatggatgagtgtatttgttttaagaggtggctggtattgatgatatccttaaaccatagataatccacaaacaattcttacttcatatcaagacaaaatataaagttcttaatcatttctgaaggttatatgaccaaacaagctagccctcttctgctactcccttgctcaactccttgtttgttccaggtgtattctggaaaatgtaaaaaatgtaaagctttttctgtgtgtacatctatatgtgaggtagggaggcaagaacacacctttggttaatttttccttgaaaccttgcatatcagattcataatatctttgggagtgagaatgctttgctttaagaggcgtcacaaagtaagtttagaacaattggaatggaaacactgttgggatttttttttttttctttttaggaaataattctaaagctcatccaaaagaacagaaaagtaaaactagttgggaataatttgtaaaattatttactgtttgtaaatagtcaataattaaagcaacctgaaactagtgcaaggataggcacggatctgtagattagatcctgagatatactgtaaccttcatatattataaatgtggatgatcttgtaaaacaaaagaatttcagcattcagtgtggaagttggttattcaatgaatggaaaattaactagaatgttacctgacatgatacaccaaaatttcagaaaaattttagcattaaaatgtaagtcataaaggaagccataaacatgtagaaaacagtctcaaaagatctacctgcaaaatgtttattaatcccaagggggacaaacagtgactttaaatggataaagatacattttaaccaaataatccaagtatacaccagtactgggacaaattgatgttgtgtatctttcttcataatgatacactgggaaggacacgtcacttacatagtatcttccccaaaatacgtaactttaatttaatcatgaggaagcccagaggaagagacataccaccaaacagctggcctgtactcttcaaagatatcatagtcatgaaagacagaaagagtaaagaatgttccacattaaaagagacaagacagttaatggattctggacaaggaaaaccttttctttttgctataaaggccattattaagattactgactaatctttagatcagataatataaaatattaatgtcttgattttgataattgtgctatggttatgtaaaagaacgtacttatttttaggaaatatacatttaggggtaaaaggcttgttatgtcaccaatttaaatggttcattaaaaaaattatttttctcaagagaatgataaagcaaatgttaccgttggagacttggtaaagggtatgtgggatgtgtttccactatcaacttttctgtaaaataaattattttgtaattaaaaaaccaagcagaactaaattgtaatgtttaaggatgtatacatggtgggggtgggtaacagtaaaacacaaagagtgattactatagaaaatacagccaaatagccaactacatatttagcatttgaatgcagaagaactttatagactgaaagcaatggaagaagtcacaaagtaaaaactgatatatttaactagataaaacaaggaaactcgtgaaaggcagagtaaataaaattaaaaggcagagcccttgttctgtgccaggcaccataccatacagggtaatttacttatgttatcttagtttgagatagttgggcagatgataatcttccttgaaactactatgacttcactaataataagtcttaaatttataaagctctttgtaatttacaaagttcattcataaataacctgtgtgttgaggggggtagggaggggtgcttactgtactcatgctccttactgaaagaagagaaggcttattgccctgggaaaaccacgaaacacagcaccacacatacacacacacacatgcacacgcacacacatccacacccctgattgtaccaggaatggacacctaaccctggggctagtgacttatcaggtcctgtttcttcagaaattgaattaaggttcacagaggctgtattcaaaacaacgagtcatctgaactgaaaaattgtatgtagtgggctctgtgcaggctgacaagtaaacaaacaaaaagtagtactttagagaagcaagagtggagacaagacatagtatgagaagcaaaatgataaactatgtcttggtggaggggtgagttgagagggggcttaggagataggcactcagactgcccaggtcccagatagtttcctgtttgcattcctggttcccatgaagtatttgttttattttggtggagtgctttggtgtatgctgtctgcaaatctgtttttctccaagctaatatagctgggtttcgattcttttcatcctatctagaacacagttctgatgttagagaccttaagtgaaataaggtatgggtatgtgagctgtgtgtgctgccctttactaagtccttatggtagatgtctgaattagagttgttgctctccttcacaacgcagatacttgcaagtaagttttcttactatccattgcattatatttctctctagtattctaaatatttgcttcttttttttcctttgtgagatttcctaatcccttttcaaatgttttatcatttctgtttctttgtacttagtagttacttagaaaacaagtgttaaatacctattaatctttcaccaaaacttattctggtactttttctcctatattatcaagtgaatcagtatgtataataaattggctctcagatagtccttgctgttgggaagttcttcctccaggggaaagtttttgcccatctctctatgttattccctgtgcacattctaatatgtttttgtttgtgcaggcatcattcagtttatgtattgtttagatatgcctctaaaacaggtttttattatcctatttaaattgttactagtcttggatgctgggatggtagcatagtccatggttgtaggtatgttaggggttggcacactttttctgtgagagtcagatagtaaatattttaggctttatgggtgccataaggtctttgttgcagttaatgctgatgttgtagctgaaagtagtcatagacaatacgtaagcaagtgggtgtgactgtgttctaagaaaactttatctacacacataggccccagatttagcccagtttgctgatccctggctgtatatgacgtgagaatttggatcagtgaatttattatttctacctaaataagttggggaactaaatgttctaggtcagtgtgtatattttagatggaacaaaagaaaaaagagaatttctattgtgcatacatttgagggctgttaaggaagttgctttcactcatacaccaggtattaagtgcttactgtgtgtcaggtaccaagcatacaaatagtgttgaatcagagaggaggttcctgcctcatgacatagcatttaaaaattatgagataaaggtagtgaaaataatgtgagagtgcgtatctgcgatttggtagagggattattgtccctttggattgggtggttagggaagactttctgaggaggccagtaggctggaaagagtttagaaattagtttggagggctaatcaggggtcacattctgttaagcctaataggctgtgatgaagaatttgatttttacgttaaggaagctgttataaggtagtttgtgcttaaataaattacttttaaagaaaccctaggacaaaataaacaagtcggatttcatatcgcctaagtctgatactaccttacctgtccatttatgtggctggttcacaaaggcactatgcctcagagatctcacatacagcttgtgtgtgcctatttttagttactcagttgcataagttctaattcttgctagcacattttataaaaccaaatgttaagatagagtatactgtaaagttcctaaaaaagatgtatgtaaatgcaaaaccatcagtttctcttgtataaagcacatgtggatagtgtttttgtttgtgcaggcatcattcagtttatgtattgtttagatatgtgtcagtcagaaatactaatcagctggtggtctagcaatacagtcaaagtaatgtaggctggatccgtgtaggaaatgttaataatgtacttaataatgtacttgtttttccagtattttacttgagtcatggcatatatttgagattatttctctgagtatggactttttctccctcgtttattccttttagggcaaaataatatgttggtaatagaattttgtataggtccacggtacctgtttagagagcttctaatggtatttactgtttgttaatatttatttttgttcagtttttctacttccaaaaagtggatattgattacttgttcatcaaattttcagtttttaaactattctgttatttgttcctgtgttttatgggcagaattattaagtgctgtgattatatcttacatacaaaaggaggcaggattacctagaggattactccatctctactaatagagaaaggacaaaaaagaaagtatgaaatctagttggatgtatgtagattggcttagtgaaaaaagattctctaaattccagatcctctgtcctttccttattcttttatctttctatatagaggttataagcagagtcatgccatgtggtttattctttttatcctttttatgaaaataaggttttctccaaataaaggtgaatatccatttcaacaagtttccactccaatttgctgtccccctcaaggattactgatataatactgattcttacctttccttttatatatgagtaattgggaatgagtatggaggtttcctatttttggtattcataactgagtttgttaaattgctagccctgtatatatttattatcatgagttggctgctgtgctggatagctgctatctgcacttctcactccagtcttttccctgctctggctccaagcagctggtctgtctggatatacaaatgggcttcttgtccctgctttctagttgggttcagctggtggggaacattttcagctgattgaaggaaaggaggagagagaggttaggatttttacttttcatgacttcttcctgtgggatttctgtagcctggccgcatccttccattgaagtttccagttcctatcaggcagctgacatttttctttcttcccctgctttactgccaatgggtagtgatatgccctgctgttactaaccctgggatataacactctcacttgtgatttccttacaacccacctatgcttcgtaacagtctccttattaaacttccttcaaattatccaaattgactgtgccatccatttctatagtaactgactgataaaatatgctttaacatgttttagattctgtcagtgtctgttatgattccaattatagagtggattaggactaagggaaaaaattatcaattttatgaatttattctgttgtctggtgtgattttatttttagttcttccataatatctggctttgagtattgccagtttattgaacacttaatatggcacagcccattatttgaagcattatggggaatccaaaagtaaatgagacacatgctccgtgattctactactaggcagtttggaatgagtttcctgtgagagctacaaaatgctagaagttcagaggagggagagtgctctgtcaagaccactatgattgtgtctgcagcaggaatgaagggagatctacagcttcctgtattttcctggtaagaccacccttcccagtcattgcttatttcatcactccatagcccatcactgcaaaccacttaagagaccaggcccaaaagtaatataactaatacaattttttttgttgttttttgagacagtcttgctctgtcacccaggctggagtacagtggcacgatctcagctcactgcaccttctgcctcccgggctcaagcaattctcctgcctcagccttctgagtagctggaattacaggtgcatgccaccatgcccggcttatttttttgtgtgtgttcttagtagagacggggtttcaccatttcgtccaggctggtctttacctcctgaccccgcaaagtgctgggattatagacgtgagccactgcacctggccaaactaatactatttaaagtttatatacctgttcccagtacaaaacatatattaatttacttaactctaaacctccctatgaaataggttatattattatttgcattttacagataaatgttaacttgctcaagtcaaatagcagcatacagagttggaattcaaactcatgcagtctgattcccttgtccaagctcattaactaccataaccatcacattattctacaattagaattgattattcacctcccccaaaagagaccatcaaaaccaattccattgttgcatataattccttgttttaggtgtcattcttgctcctcagtgctgtttttagcccctcacccccacttttaatgtcaatagattttatcacttgctgcatcttcttgttgcagtcataccagtcggtctccctcattcagtatttatttatttatttagagacagggtctcactgtatgacacccaggatggagtagagtggtatgatcaagggtgactgcaacctctacttgccaggctcaggtgattctctcacctcagcctcccgagtagctgggactacacatgcaccaccatgctcagtgaatttttatattttttgtagagactgtattttgccatgttgcccaggctggtcttgaattcctgggctcaagcaatccatccgtttgggcctcgcaaagtgctgggattacaggagtgagccatcgtattcagccccctcattcattttaggtactgtttttattctcactagtgttaatcattttggcaattccagtatccacgtagatatctgcatggccctctgaattccttgacctccagtgatccttcatactactttagaccttttattgattgataactgtatcacctcccagatttcagtttcaagcatccagctctctgaccaccactgattctctcttcctggcttactctaatactggagccaacaattttgggacaatcatcagcatctctattccttcatttcactaaatccctttgttatccgtcttcctcctgatgtctttatttttcttagcttagattccatggtctgttaatataatcacctttttccaacttctgtcatattctgcttgattaaaccaatattctacctacttttacctaaatagccagataaagctggagaaaaaaagccttcggactagtttcactttatatattgatggccacaagtcttcagtgcttcctagttagttcattctctcccttttttcccaaccttgaaacccccttttttcagttgatggtgtttattttagtaaaaaaccaaaacaagcagaaaagagactttatactctatcagcaaatctagatgcctgaaatagcaatgttagtagaatgttgggagcagaatgcaacctttcagggactaaactgtgagtaggtcataaggaattagagattgatgttttcccaggtgtgtcactgaaacactgtctgtgttaaatgaatcttaccccgtaataggcttactggctaaatttgggagatgctgaaagctgtgtatagtttgaatctctctttccctctctctctggtgttctgatacagaggcaaggaaagatgaataaaattacaggtagaaagtaagtttccatctggtggcctagatgttactaaagcattggttttcaaactttagcccacttcagaataacctggaggacttgataaaacagattgctgggttctacctagagggactgatttcacatgtcttgggttgctcctgaaaatttgcatttccaacaagttcttagttgacactgatgttgcttgctgatttacggaactgggaatcacatattgagagttacttcacttgagtaagaattcaactgtcaagagtgttaagattggttaggattttgatctataaatataggaaatagctgctgtggggcaatataataggaaattagagccgattaataactttgagggactttgacagtgagacagtttgaatttgtagaggactcaagcagctatttttaatgacttttttctctagcagtgtgaccttccagagagcaggaacagaaccacagcagttagtaaacaattttgagggaatcctgcaggctgcttatgtcaaatagtttatcatcaagcactccatctttgctttgcgttacgagtgccaagatggcagctctatgatctgtctgcccttagcccatctgcttcattttatttatttatttgtatgcttattatttattcatttattgattttagttttaaaagtggtatgtggcagaggttttggaatatagtaaagtgtccatcaaatacagtcaatagtttcatggctttgggtaaataactaccctgtctcttgttttctcatttgggaagttttaaaatagaagaatgaaaaacttccaggcctccctttatgaatgtaactgataaatctttaaaaatcttaaagaattacattttgggagaatcattagttaggtttctgcctgaggagagtcccatgtagttctttgtaagtggctaaatattggacaagctgggtctcttaaaggtctgtagtatttctggcagtaagttgtactaatgttcctggatgtctgtacttctcaggcgttgccagtgaaatgttttcataatggattgtgccttactctagttctcactcgttttaactgtcacttcctaaatgactttatagtatctgtactgagcctggaataggaaggaaccacaagaaatatatatatagacagacagacacggagtctcactctgtcatcaggctggagtgcagtggcgcaatctcggctcactgcaacctctgactcccgggttcaagcgattctcctgcttcagcttctggagtagctggggttacaggcatgcgccaccatgcccagctatttgttttttctgtatttttagtagaggtggggtttcaccatgttggccatgatggtctcgatctcctgacctcatgatccgcctgccttggcctcccatagtgctgggattacaggcgtgagccaccacgcccgacccacaagaaatgttttgaaacagatttggggacatgataggaaaggagaagggcaagtcctttctcctaacctttctcttatttctcccatacccagttcagtgagcaggtaagattgagaagtacgcttttccttccctgatttcttaaatacttgtcagggtttttgaaaccagatactatgctcttttcatagtgtcgtaattgcttattctttagaataatgtattttggaaactcgtggacttgtttttgataattttgctgaggaatagttgataacttggatatttaaactgataacgtgtacatacttaaagtgtacaatttgatgagttttgacatttgtatgtatcatgaaaccactaccacaataacaagatagcatatattttcattgtgcaaccctttgtaatgaatccactgatctgcttttcatcgctgtagactggtttacattaaaaatttaaatgaatggaaatatgcagtatatacgttttggtgggggggtgcacatgtttctttcagcataatcttgaggtttattcatgtttcttgtattaatggttttctccttttaattgctgaataatgttcttctttggatattctcccatttgtttattcacttgtttatgaacaattgggtgatttccagtttggggttattatcagtaaagctgctacaaatatttatgtacagtctgagtgtggaaaagtgcttttatttttcttgaataaatacctagaagtagaatggctacatcatatgctaggtctatgtttaactcttgagaaactgccaaatgttttccaaagtgcttacaccattttacattctaaagaattccggttgttccacattgttaccaacacatgatgcagtcacactttgttttcggcttttctagtagtatatgcatgtctgtcttgtggagtctcagtgtctttttttttttttttttttttttaaagacagagttttgctcttgtcgcccaggctggagtgcaatgacatgatcttggctcactgcaacctccccttcctgggttcaagccattcttctgactcagcctcctgagtagctgggattacaggcatgcaccactacgcctggctaatttttttgtatttttagtagagatggggtttcaccattttggccagtctagtcccgaactcctgacctcaggtgatccgcctgcacccggcctcagtgtcattttaatttgcattttatgcatgactaatgatagtgggctgctgatatctttggtgaagtgtttgttcagaccttttgcccccgctttaaacaagtgttggctgggcatggtggctcgcgcctgtaatcccagcactttgggaggctgaggcgggcagatcgcttgagctcatgagttcgagaccagcctgggcaacatggtgaaacaccatctctacaaaaaatacaaaaaattagccacctgtggtgctgcactcctgtagtcccagcttactcaggaggctgaagtgggaggatggcttgagcctgggaggcaataagctgagattgcaccactgcactccatcctgggtgatagagacagaccttttctcaaacaaacaaaaaccaaaacaagtgttgggttatctgtcttttataattgagttgtaggaattctttatatattccagtttcaagttcttatacattttacaaatacttttgatcagttggtgtcttgatttttgtactttttaagtttttttgaagaatagttttttattttgatgaagtctgctttatcagtttttctctttatagttctttttgtgctattttatttcatttctcttttggtttttctgaaagttaaatatctcagattctcattttttagctattggaccaaaaatgcataggagacagctataaagctaatagtgtgtttgccttatatttgtgtttattgttacaattttaaagtgtttatgattctagtatttttgtttgttctttttggttttttagacttgctaaagggcctgtgaaatagccattggttcagttcctttgttttgtaagggaactgagcaggttacatgactttgctaatggtgaagtttatgattatgccaagactgaaaagaccccaggtcctctgaaatcccacttcactcttcatttcccctttttaatgattttgttgctaaaattttactgcatactgcaacatattaaaaataaatttagttcctgtttattagtatcctcattgaaagcatattattaaaattattatgtagattagcttcctgaaagaatcatagtatccccttaaaatttcattaagtgaagatgttgaatttaacatatatttttttaattctttccaaaggtctgtaaacagatttggctaggattatttgatgatagatcttcagcaattccagacttcagggatccacaaaaagtgaaagagtttctacaagaaaagtatgaaaagaaaagatggtgagtgaagagtttgtatgtagaataaagcctccccaaatcacatattaactatgggtaaggttagtctgacacaatgaaggataaaagacagacagtgagaactagataggtatataattcattatcccttggctttttgttggtttggtttctgaaaacctttacttctactttatcttaactcatctgttcctggcagcaggctttttgttgtaataattaccaggaaagttagggattcttccttctaatcattccctatctctgttagcttctttaaatatgttttgccctacaaagcctccgttcttaaaaatcattaatttagcaagtatttactgagtcatatctttttttaatttattgagtttcatcttctgtatactaggcactatgctaaagctctggtgtagtaatccatctacttaattgtctgttgtagcctttgctcaaaatattttttcttttgacctaagaaatcagtttactttctggttaagaagggagcatttacttttccctaactaaatctatcagatgttaatttttaaaaattaattccaacaggttgtacatatagctagtaagccccttgctatggaatagggactatatctataaagctagtgttcagctactgagggttcttcatttttagctatatgagcacaatttaagttactaagactcattaactatgaacttttggttatttctttaatagtattgcatagtggatactttcatcttgggaggttaacaagatggggcagagagtcaaaatagagggaataaataatggggaagtaacgagcttcttgtttgcttgaggaactctgtttcaacccaagagaatctgttcagagcctgttttggtcctgagggaacatttgttgtggtttacagcagaggtctttaccttcattcaggagcacattagctctgacttgcatgctctatcaaaatttgtattcttactactttccaaaatagactacatttttcttttttttttggagactgagttttgcttttgtcacctaggctggagtgcaatggtgcgatctcggctcactgcaacccccgcctcctgggttcaagcaattctcatgcctcagcctcccaagtagctgggattacaggcacccaccaccacgcctggctaattttttgcatttttagtagagacagggtttcgccatgttggccaggctggtcttgaactcctgacctcaggtgatccacctgcctcagcctcccaaagtgctgggattacagttgtgagccactgtgcccggcctaaaatagactactttttgcaaggcaagattagtcagggctatattcagctgtactagaagacatcaagtatgaaaatagattaaaatacaccagtaaaatttaagttcaggaaagaagaaaatactagaaggtgggttggtagtaaaaatatggtagcataaatgattcttttaaaatgaaaggtataattatccttttatcattttggttctgaatttcctagacattctaccctgtaggaaagactgttctccttacatagccctaacctagttttgttttctcagccgtgttacttttaccaattcagaaagtgagtttggttagggattagtttatggtcagctctagctatcaacagaaaagtgagtgtgagtaacagttggtagaattaaaatcatagatccttacccccacatttataacagtaatgtattattcattcaaactataacgcaaatacctagaaacctcaaataattacagtttatgttattttttttctttcctgagaaacaggataataagagttatacaaatagagacttcaagtggtgggacaggtgaccatcattaagagggccaggacctgtatgtttttaatccagactgctgcacacctgtaacatacagctagcaagcagtgaaattggtttctaacatggaataagcactatccagatgcagcatctctaaaaatactcactgtaactatacttaaaacagtgatgatggtgttatccaaagggattttgaaactgttcttttgaccagttctcaaaatcactttctgtgttatactagaagacatcaggtatgaaaatagattaaaatacaccagtaaaatttaagttcaggaaagaagaaaatcctagaaggtgggttgatagtaaaaatatggtagcatattactttgccaggtgagtcttttgaaccaataactatcatttgattttatcctttgataagacttggctatactgaagaatttgtattagtagtatgctaaattatgggaaaatataacttcttgtattcattctcatacatcttttatctctcccatttacttgaaagcagttgtttgtgattattatgtagtttagtgacagtgaacacttagttaacacgtataccaggaattgttctcagtgctttacaaatgttaacttgtttaaacctaggcaactctgcctctccattttataaatgaaaaaaatggaagcacaaagagttgaagtattaatagtttgcccaaggtttcacagccatttagtggtagagctgggatttgaactcttgtctctggaacaggtgctcttaagcatggttttccttctttcctcacctacttcatatggggaataagaaggagggtaggacaaaacccagaattacaaagagcaaaagctctcacataatcccacacctagaggtcaggattgcctatgtttggacattattatatccttgctacctctcctttcttgactcgcctcctcacataaatcatgtgtttatatgactggaatcaaatctgaaagacctgtgaagtttcctctttccatgtcaaagcagagtagctatgagtattgtattatcgtaaattttttttccttgatagatgttgggtttgtttcccagtttttgtgaaattataaagagaggactgtggttaacatccatgtgtacatgcatctgtatacacttaccaattcttaaggatgtttctggaagtggcacttctggtgcacaaagcacacctatttatatattttagtaggtagcaataaaaaattgtaaagttcacacttagctcataggtgaataaaaccttaatttgcatttttgtcaggttaaaagtgttttcatttttgtgtctcctgtcttctgtgaattgcttcttttgttcatttaaaatgggatgatcttattcttacagatgtaataagcctttatattttaggctgttaactgtaatattacaaatgttttcctacctcatctttcttcaaatgttatttagatcttaagataattttaaaaattatagtatgaactattcatggtgatgactaattgtaggtcctctgtttaaaaaaagcagttatttcttatattgtacttaatatcttagaaaaaccataaataagtaattgaaacaagttttgtggttagtcttctcttttctctgagtatttcaaatatttaatgggtgtagtcttaagctgtcgttccttttttaaaaaatatgcaaagttattctgtgtgagagggttttcagataagattaatggtgaaacaatcttgtacaaagttagaattaagcttatcattttttgatatagaattacctacatttttttttagttaactgttttttacatgttttaggtatgtcccgccagaacaagccaaagtcgtggcatcagttcatgcatctatttcagggtcctctgccagtagcacaagcagcacacctgaggtcaaaccactgaaatctcttttaggggattctgcaccaacactgcacttaaataagggcacacctagtcaggtgagtagtctttgaatctttgtagggaattcgacttaaagagggcttgagtatcaagaatttgagaattgtttaagacagcagcataatcttgtatgccagtagcattatgttccaatggtttgttatacattaagaaattgttggttaagtggttgaaatgtatatatacttgttctttttgctattgctaatatgagtttctttgacttctctgcaactttgtaaaggtgagttatacaggaatgttgctatagctatatatatgtgtgtgtgtgtatacatgtatatatcatgtgttatacaatttgtaaaacatgaatctatggtgaccatcagagttagaatgtatagtctctttgatacacttttctaggaagggatttctttagtagtagagttttcccacatgtgtgattgtgaagcatgttgatcattgaaacacaagggactttgcattataccttattcttaaaaatgaacaaaatggaatattttcataagttgctacctaaagtttgtcttctacactttattatagttgatggggctgtgacagatctgttactgtgtggcattgcagcctctatcctatacaagaatggttcagaggcgtagtactgtggattaaatcctgccctttttgatgacacatactaagacatttagataaatttctctgttttcacaaaagattgagtgaaaaatgagaaaggttaactcagcatactgtaactcttcgtatgtataagtgtgttttaagtttgcagatagttttgtataaagattttgcagatccgactggaatatctttatagttaatatgtggtttgtagtccccagttgtaggtcgttctcaagggcagcagcaggagaagaagcaatttgaccttttaagtgatctcggctcagacatctttgctgctccagctcctcagtcaacagctacagccaattttgctaactttgcacatttcaacagtcatgcaggtaagtgttttttcccaacagcttttgctggggatgcatataaaacaccaagaaacatcaattctttatcacactttgaggatcagtaaacattttttgttgaaaatgttttgtcacttgtaactgttgagctgtaatatgtaaccatataattgtgttgctttttaatcacagaagagattatatttaatgtcggttggcatgacctctttccgtggaaaaatggggaaaggatgtaatgtctattttttattctttatgaaattgaaaatattcaaaagtaattggatactctaacgtttatgtgctaatcactcatggctaatcttgtttcatttgtcattccagtcactgtcatattattttgaagcaaattttagacatagtattagtttatccttaaatattgtgtatatcaatctataaaacatactttttttgttaaatataaccatattagtagcatcattccctaaataatagtagtaataataattcattaggattcaaatgttcattatagttcagatttttccatacacatacatacgtacatatgtacatacatgcatatatacatacatacagtttgtttgaatcagattttcaacaaggtccacagactgcagttgtgagacatgtctcttaggtctcttagttcataagatttttcctgtattccttctttttcctcctctgtaattagtgaagaaatttgcttatttgtcctatacagttttcagtagtctgaattagttgattgcaccactatggtgccctgtaacaagttcctatgttctatttcttgttattaggttgttggatccagagacttaatcagttacaggttcttcctattaggaggatgggtggctggggatattcttactacttgggatttaagaggcatgtaattttggattgtgtttttataatgttagctcttggtgctcagtacccgagtccattgcataaaaataatgatgttctgaatttattccttcacttattagctgaaatactatttaaaaatctttatctggtggcatgatttgtttaggaaagtcagaatacatgattcttttccatcagatatcagaataatgagttgatttcctagcattttataatggtgacttttttctttagtatcattatgacttcatagattaaaacatttgctacatctcagtttgctgtcattattatccttagtagtactcaaattagcccaccttaggagtaggaacattgtgaggttggttcctatagatacaactcattcattcattcatttatttgaggtggagtctcgctctctcgccgaggctggagtgcagtggtacaatcttactgcgacctccgccacctgggtttaagctattctctcacctcagcctcccaggtagctgggattacaagcgtgtgccacagcacccgaaattatatacaaatgtaaaattttgtattttagtaatacaaaatactaattttttatttttaatggagatggggtttcaccatgttggccaggctggtctcgaactcctgaccttaagtgatctacccaccttggcctcccaaagtgctgggattacaggcatgagccactgtgcccagcctctttttttttttttttttttttgagatggagtctcactcccttgttcacactggtgtgcagtggcacaatcttggcttaccgcaacctctgcctcccgggttcagccaattctcctgcctcagcctcctgagtaactgggatcacaggcgcccgccaccactcccggctgttttttgtgttttttagtaaagatggggtttcaccatgttgaccaggctggtctcgaactcctgacctcaggtgttccacctgccttggcctcccaaagtactgggattacaggtgtgagccactctgcccggccctaaagatacttttttgatagaactcttgtggtctttgaatggccttttctcccttccttattctcagatttaacatatttgttacaaacatgtttaatgcatgtcaccagaaattgggatttatggagttttattttgttaacaagcatgcaaaccttgcagaggtacttaggttaggtaatatttaaaaattgattattgaagtatagatttggtcacttgtatctctccttaattgtaatagcaatagtctgatagggaagtggcataatgtagtgaaaagaacctgggctttggagttgggacaacctgggttcagatgctggctttcttgcttattatctgtgtaactttgggcaaattacctaacatttctaagttttctattctataaattgtctttgataagtggcaaggttcaagtgagatgatgcatttaagtggtttaccatctaaaaggtacaataaacattgtttgtcttctctcttttatacacacttcatatatatgtacatacgtatacacatatacacttatgtatgtatgtttgtatgtttacatgcatttaagaaaaaggatcatactttatgacaagtttttatgctgttttaatgtttcagtcttagttaagattccacaaatggtttagattcatttcctaacagcttggtgatttcttgagtctttacagttgcttctttatgcttaaacagtgtaaaagcatacatagtatttgtgttggaaatgcgtatggaatctattttggatgccagtaagctgtgatgtttatatcatggaaagtttaccagtctgcattttgagtgattaaataagtatcaaaccaaatgtagaacattaatttaggaatttagtcattttatagctttattttgataatttaaaactttgctttatattattttggcacatgtgtatgaggtattggctaaagcttactcttttatttgtcatagattatgtaagttaaattatggacaagaaaaattcaagactgtatctttgtaaaagatgtatttcacaattttatgagcataacagaatccagtgctgatagaatggacttcctgtttgtattttagaacttactttgccttattttacttacctgtgagattgtgatggtttttcgttttctttcaatttgatgacctggcttctttttggataatgataatatgaagtatattatacataatcacactccaaaatatgctgtttgggatagtttgaaaaattgtagaaaaacttctctccagccacatttctttctagcaagcaataagggaaccttttgttttaaatattaataaaaacattttctaaggacatgctttagaaggaaactggcgtaatttttatatgtctcatttgtgtatttgctttaaaaaggagtcctaggatgacatggatctcttttttcaggaaaggttgtactgagaaggataagaaattttgggtttcttttgcttaagttgttggagttgtggtagatttcccttctcctgtgttacctgagctgcaaaatcccagaaaacatggagaacctctttccccgtaaccctccagataagaagcgatttcccccctgaccagataaggaccccaactctcttttttcacctcttgcgtttgagtgctggtaaaaagagttggtgggagagccaataaatagagtaaaacttgtgtaatttatgaatatattctggttttatctccattttaggattattgaaatgtaatgcaaaattactgataaccaccaaattcttttgtaaatttgcaacttatttcttgttccctttgtttttctctctttaaatgcagtttgtgagtcttcacaggtaatgttggacttttctttgtagccctattggccaaaaatggttagacaagtcactgcaactctacagactaatttgtaccatggttgcactaatactttcaacagctcccttaaaatgcactttgaaaacaatagccatcatttaattgtaggatatgcagtaaaggaaaagaatcttatattttgatcagattgatagaaagtggttaatcttaactgttttgttccttgtctgaagaaagaatgaaatagctacatgtaggctgtgagtcaggctgcctgagaggagttgttttttagtctgaagttcttaattacaaatgactgctcagattaccttttttttctttactttatttgacttttggtttcattacaggagaataaaatgtatatgcctgttacaagaagaaactactgaattactcatttatttttccttctactatggttgataccatcttttgacgttttgccttggagtagtttttagttaaatactaggtcatggtttaactgaaatgtctttttccagagcctttccaagcattcagaatccttagttttccatatatagttcagaaagtcattgattgccaatttcttctcatcctgatattcttgttaattttaaaaaaaattaggtgaaaattttatcctgaacagtttgatacgactgatggaaccattaatggcaaatgataattattcacatatgccagtctggttcattagcattgttttgtagggaaactttttcttttgtagataatttagtgtgacttaaaagccagaagcctttagtcttcatgtgagcattcaggctgaggtatagtatttgtggatgtgtgttgctgggtggggtcattattgggttcagaaaaagtcatcttctacagaaagacgcatgaagctagaaataaaattcacctactgaatttggttattttgcctgatgataaacatcatatcccaaaacctgtgcactgtaaactgtaattgatttttgtcacattctatactgtaggatctaaacccaactgccttgcaactcaggtaacacaaatgagtagtataatgttgtgtttaaagaactatggtgccctttttaaaggggatgttctaatctgttaccacatggaaataggggtttaggatactagatatattgattttttttttttaataagagaagctagaagtctttttgtttattgtgaagtgccctctttttaaatgttgggaattcatgggaaataatgttaaatactatacagatgaaacaaagcatatctgtcagatgaatttgctgagggctgctagtttgcgtcctatgatctatcttcctgtctcatgaatatgtgtttttctttgaagaggaatgacaactattagcaagactcaggctcattaatttggggtcttaagttccacactaagttgactcctttgtactttttgaaatacgattattcaagaaacagctttaccattgtgttacattctgcttagcttggatttctttgtacagagattgcctgagtgtccagacagtaatttttgtattactgaatttattagtgttgaatttgcaaagttgtgttttccaaagtttcattctgcagcacttataatcgattgttgaagatagtgaatagatcagtacctagaagtaaaaatggatacaagtactacaaagtcctgtcttgcctatttaataggtattctattaatgtttggggctctgaattatatgctataatttctatgctagcattcattgtttcttaaattttaatgagtttaaaattgcaggcttctaatagaatatgaatatcttcaatttatttggtgatcttgtcctttttttaaatttttatatatgaccatggtgagacatttgtaaacttaaaaaaagctctattaattaaaccatttttgtattattattttaagtatttcagttattattcagattcacatagttgattaccatttttaatcagtgaatttttccaggatgttttctacatctttgtctgctttcctataactcagtactgtaactcagtactctgaaatagtttcctttgttaatagagtcacttttatagtactgtgcttgaggtcatatacagagtattgtgtccaaatttatcattgcacaaagtgtttttggaaattcttggttactccttagtaaattacctgtaattgggttacatgctggtagggtttaaaatctgattgctaagtgaattctctataaagtgagttttgatacatagaaacttttcatataattcttaaactcatgtgtcatgtattttcatttatagttttcatattcattaacatatgttgttccttaccatttacagctcagaattctgcaaatgcagattttgcaaactttgatgcatttggacagtctagtggttcgagtaattttggaggtttccccacagcaagtcactctccttttcagccccaaactacaggtagagcttctccagcattgtgcttaaatgtttactttacaaaacaaaactctctaaatgtagttttgaaaaattagtctaaacttaaattctgtaattatctgactttaaaatggttctatcttcaaaagctctggggaaacctgaactctttatttttttctatgttcatttgtttttctgcattatttggtatattgtctgtttgacaacatccattctcctccttttcctgcgcatgaatcttccttatatctaccatgcacacaggacagaggcatgacactactataagtatttctctctctctgtctctttttttttttttttggcaatcctcctgcctcaggatggaatacaggcacatgccaccactcccagctaaattttttttttttttttggtagcagctgggtctcactatgttgcccaggctggtcttgaactcctggcctcaagttatcctcctgccttgacctcccacagtgctgggattacaggtgtgagccactgtgcccagccagtactataagttttttaaggttcatagaatccattgatttaggctgacattatacctcttaataaaggaagctggttgcttctgtagagctaaaaatgtaagtaattttcggggcaacaagcctgagaaaaatttttatatgtttattagacaagagtagattaatgatcacttcagtcaaacttggaaatagttttctgtgcaggaattggtgtttaaacattgaatactctttccataaattgtgctgttttcgtaaactcatggaacccttatttagatttttggctgattacttttctttcaacttttaactctgtgtattgtcttaaagccttttctttcaattttcttttttgttttttctttaactttcatcatttacataatttctggctgtccagcatttagaatgctttcatctagctgcagttttggtgaatttacttcagcttttcctcttcaggctacccacagtaagttctgttgtcaagtaggcatcttatactaatttgtatatttttgctatacttcaagggtttttccagttatagattgttaataattctttagtgataatccttcataaaaatctcttccaactctatttattaaactcagagttagagaacacaatagtagacaatcaaagagttacttggtttaataataatttgaaataatattctttatataaattttgaaagtttagtatgtactttgtttgccagctccttgtaacaggtcacaatattttacatacaaacatatattacttacctttaattgaaaccaccatgatttaactcttgaaagaaatttgatcagtgtatattttttttagaatgtataaaaacctgcttgatagaaagtgttcgtgtttttttaatagaagttcatgcattctgttttaaaattatctgtagttgtcttttctatcactttaatatataactgtgtatatatactgttttgatttctgaaactaaagtttagaaataaagaactaatatcccaaaaatgtaggatcaaaagcatagaatgaaatatactggttttagtcttttgatagtactttaaggaggtctctataatagagaacagattttaaagatgtaacaggatatatataatagtggccattaggtgaattgtggtttataaagtcaaaaattgctataatgtattatgtactgtaattttaatgccttgaactatatggtacggcatgattttacagtggacatcttgatattgtatacacattaaactattatgtggaattaaatagtagctcttcaagtgaagtaagtataaatgtcaacgaccatcttttaaggaattttggatcaccgtaacacattttacacattgttaatcgctacccctgggattgtttaaactgtttcgtcatggagccacaaaagtttgaaatcctcctagtaagatactttgcatcttgtttgcagtctgttcagggagaactagtgaaaggctgtagtatatttggactagaaagtaactgaatctcaaaccaggtagtgtggagatacccctccatgaattacattcttcattccagggtaggtaatacacagaaacatgttactttacctgttgccaaggcctttgaaaaatctacttttacaaaattggaaaacgtcacttgtagtcaaaagccattgccagtcattgattttaatgttgtaagattgcttataggacatttaatttaggaagaaatgatcatacagtctatgagagggtactaggaaaagcttagaaatttcaagtgctctgtttattctgttacaggtggaagtgctgcatcagtaaatgctaattttgctcattttgataacttccccaaatcctccagtgctgattttggaaccttcaatacttcccagagtcatcaaacagcatcagctgttagtaaagtttcaacgaacaaagctggtttacagactgcagacaaatatgcagcacttgctaatttagacaatatcttcagtgccgggcaaggtatcaagctttaagcaaaacaaatacaaatttgtgttaaacagtgctcttaatttggttgtatttattaaaatctgaacatgctacacttttctcagttgttgtatagaaattttgtctgcactgtcattttgagtaaaatgttcacttgacacattttagacctgaaatatcaactacaaaactgaagacatagggactgatttgtaaactttcagtcttactagttgagaaaaattttattttgtcctagaaggcgtgctttacttttctttggctataaagagccaagaaaccccattggcagagctgaatggaggattatttggtggtttctgtaatatatttacttcgaacaattttccgttaacatcttggtgggttttttatatttaaaaaaaaaaattcatgaattttacagtatagtcttgtatccagttttatcttaaggctagtagcctctacaaatgcatgtggcactggtgaatagcaggtgtgtgttgctaaatggaattctccattctgatctctgggcctgttttcctcctctccaaaatgaggataattctaagcattaaactcatggagttgtgttctaagtattattgcatgttaaggcatatagaacagtgcctagcacatagtaagtcctcaataaatgtttcccgttattaccatctctaatttttttgtggagaatgctggggaaatgatgctattgatagactgttcacattaggtctagcattatatgaatttatatgttcatgtgaacaagatccacccgtcttggagatgttaacgtaagagcacttgagagtttctttcttatgcataatccagacaaatttttttggtacagagtgttaatttttgttaagagacatattctgtctttatcacagtggtatgtataacaactaatcctgtccagtatggtccaggttatttattagattaatgatttggaatcctgcttaactctaaatccattttaagtttacctgtgtttcatggcaaatgtggttgataagttgaaagtgtaactttaaatttttggtgtaacttgattttgttcgttcccaggtggtgatcagggaagtggctttgggaccacaggtaaagctcctgttggttctgtggtttcagttcccagtcagtcaagtgcatcttcagacaagtatgcagctctggcagaactagacagcgttttcagttctgcagccacctccagtaatgcgtatacttccacaagtaatgctagcaggtaccttgtcttagctagccctcctgctttgtgttttatcttttttttccaactttgaataatcaattaaaaaatgactgtttcaaggtataattttaaaattcttggatatttttgtaaatttgaggaatttgaatttaaatgctaattaaaatataatccttgaataattgccataattttatcttttcattgaatcagacgttttgttatgttctgtccttgaacactaaaccgtatttgagagcatgtacacatctcaaaatggacagttccttacagattgtactcagcagagaatccatttagtagtcaaataatatactttaaaaatagtttttagtcatgatgattaaacagtgaaagtcccatattataggcttagttgtaaatacagatttttagaagtgtttgcaccaaagcccaaaatcaattctgtatctcttcagtgtcatcctcatatttacaaataagcacatctgctgttatgttcatatatatctgttagaattcttggcagtaggaagtctaacacattttaggacattacacttgtaaaaaacttttctagtctttattttagagttgcggaaatagtctcagaaatacaagagatttacctataacaatgttttattcatctctgttttccaatcctgtggattgtatttactaatttctttagttatcctggtagcttattttcctttagcatcttttctagaaagaaatgttaggattgtaacacttccggaaacataaagtctggaaacatactttatatataatacatgatttattgatattacattacagtacatcaggggttcacaaactgtggtccatggaatgtttggggtacctgagaccctttcatggggtctgtgaggttaaaactttctttataataattctgagagattgtttaccttttcattaattgatatttgcattgatggtgtgaaaacaatggcaagtaaaacttgctggtgtctttttatttttttttaatactttaagttctagggtacatgtgcacaacgtgcaggtttgttacataggtatacatgtgccatgttggtttgctgcacccatcaactcatcatttacattaggtatttctcctaatgctatccctcccccagccccccacccccgacaggcccccaagtgtgatgtttcccaccctgtgtccatgtgttgttcttgttgttcaactcacacctatgagtgaaaacatgcagtgtttggttttctgtccttgtgatatagtttgcttagaataatggtttttgctggtgttttaacatgaatattaagatagtggcaccaaactgtactagtcgttacaatagtcatattccttcccactacacattcagttttacttgtattttttatttttttatgatgattcttaatgaagcagtaacaattgtttattttattacatctttacacttaaatgtcttaattttctttgtgttgatactgatgctgtgatacacgatatgttcattattttatggctaccctgtaaatcgttactttcttttttttttaagaaaaaaaatgaactctttcaatatttgttctcagcaatgtttttggaacagtgccagtggttgcttctgcacagacacagcctgcttcatcaagtgtgcctgctccatttggaggtatgtgcttctggtatatacactggtttttacaaagaacccaaatatatattgtgtagcattttcttaggagtcaaagcaatgatttgttatcagaatccttgagttttctgtcttgataaatatagtgaaataatttaaatcttaaatacaaaatgtattaggattttatagtgtattttataattttttaaagctacgccttccacaaatccatttgttgctgctgctggtccttctgtggcatcttctacaaacccatttcagaccaatgccagaggagcaacaggtaagaaaaagagacagtggaacagtaagttttggggaagacatttatcaacaaagacaccatgtgaagaacaccagaaaatggggcctctttcttagtgaagtgaatggcaatggatagaagagtttgtccataaagacaaattctagctgaaagttcataaaatcctggaatttaacagttgagagggaccttagaaattatctagtgtctgccctttccagttaaagctttcatttttcaggtagggaagcccagacatggagatgagactccacagaacgtttatgacagagataggacttgaacagagcaatttagatgtatttggtggtctggtttcagaattactggttgtcactcatgcagtcttaatggaaccattttatgagaagtttttattttccctatgagattgcatcagatgactttactacatgaattcttaattattaggtctttttctagtgaatatctctttcaggtgttaacattttttaagttgtggaaacttgattcagtcgtgggtataatactgaatattttctcttttgataattttttcccttaattctctttgttgtctccattttattttttgattcatactgtaagccattcacatctttctcatgttatacctctgatttttgtcgtattaccttaaacaccagagatatttgccagtatcttggaatgtcagcaggtgcatttggtatggctgggtatccattaaatctagagtttgtatgctttgtttttgtgtatatgtcacaataatttagaactaaagcctaaactccagttatagcaaatgttgatatgaactcttgagagattaggtacttgtaacattttaatcaaaccattaagaattactagtttttagtaaatctctttgtcattgacaagattaagaatcacagtattaggagtttgagctgtaactattttcttttcacataaatgtcttcacttatactctgttggtaagtagcataatagatgtttgataagtattggaatttcacacaaaatttaactttaaaaaaagtttaattcaagtgtacctaatgaatgattgttttaaatttccatttgtacaatttatcaggtgtgtgatatgtgcagtgtttctgtttcttagcatactgttttgattttgtggactgagtttgtaaaatgtctcatgatacaatgggtttttgtacattgcctcatttaatccactcagctgtcatcaaataaatattttaattgtgtgacagctgagggaacaggcccagaaaagttaattgaacatattttgagtacagccagccaaacttgtgttcgaattctgatttatagttacttgcaggttgaccataagaaagccttttgaattttgttcttttaatgaatggggtaagaatgatagggggatgttcaaacatttattgtgataaagttgttcacaagatgctattgagatatttatagatattataacttcacttaagaactgatgaatggaaactcaaattatgttttgactgagcctaatcatgttgacctgacttctctgagccttcatgttgtccctctctatagaatgtgaacaatattctcttgctggcaggtttgttgtaaaattagatgatgcacatttaccctgtatggtctttgcgttacagcatatgctcagtaaatcagacctattattttcctttcatgattgtacctctgagttggttctatcattagagttaagggcctttttttgcttattttatttagagtatgcaagttttgtaaaagttgaagttctacataggatataaaataatataaaatgtacaacgtatgtgcagatgatataagataattctagtattaagtaacaaaaatttattagaaaggtaaaacgacagtgtccacaaatgtttatttcaaggtaatacattttttccattataagtcattttgaatttatcacgttggtcacctttattagattattattgaattgaccaaatcacaagcattaactgcatatgtttctattgaagctgaaatataaacaatacttcgacagatgcactacgcttaagaatttccagtgttttataccatcaaagttaatattatttaagaattttttgttgccttcaaatacattaacactggccaggcacagtggctcatgcctgtaatcccagcactttgggaggccaaggcgggtggatcacctgaggccaagagtttgagaccagcctggccaacatggtaagaccctgtctctactaaaaatgcaaaaattagccaggtgcggtggtacgtgcctgtagtcccagctacttgggaggctgaggcaggagaatcgcttgaaccagggaaatggagtttgcagtgagctgagatcatgccactggactccagcctgggcgacagagcaagactctgtctcaaaaaaaacaaaaaacacatgttaacactgtgaaattatattttgaggtaccctttgatcctagcactttgggatgccgaggtaggtgggttgcttgaagcccaggagttttgagagcagcctgggcaacatggcgaaccccgtttctacaaaaaataaatggtggcagacacctggagtccttcctagctactcaggaggctgaggtgggaggattacctgagcctaggaggtcgaaattacagtgaactgtgattgcgccaccacacttcagcctagctgacagagtgagactctagctcacaaaaaaaaaaaaaaaaaaaaaaggaggtacccttattgcataatagttctatgtgaaattcggaaagttttatcagtatatttctctttttgtttgttggtttgttttagacagattctcactctgtcacccagactggagtgcagtggcttaatctttgctcactgcagcctctacctcccggattcaagcgattctcatgactcagcctcctgagtagctgggattacaggtgcgtgccaccatacccggctaatttttgtatttttagtagagatggggttttgccatgttgaccagactggtcttgaactcctggcctcaaatgatctgcctgcctcggcctcccaaagtgctgggattacaggtgtgagcgactgcacttggatcattcttaaaatgatgtttaaataatcattttttctggatttataaaactttggggctttagttttttttttttttactttaagttctagagtacatgtgcataacatgcaggtttgttacatatgtatacatgtaccatgttggtgtgctgcacccattaactcgtcatttacattaggtatgtctcctaatggtatccctcccccactctacccgaccccaagacaggcgccggtgtgtgatgttccccaccttgtgtccaagtgttctcattgttcagttcccacctatgagttagaacatgtggtgtttggttttctgtccttgcgatagtttgctcagaatgatggtttccagcttcatccgtgtgcctacaaaggacatgaactcatccttttttatggctgcatagtattccatggtgtatatgtaccacattttcttaatccagtctgtcattgatggacatttgggttggttccacgtctttgctatcgtgaatagtgccgcagtaaacgtacgtgtgcatgtgtctttatagcagcatgatttataatcctttgggtatatacccagtaatgggatggttgggtcaaatggtatttctagttctagatccctggggaatcgccacactgtcttccacaatggttgaactagtttacactcccaccagcagtgtaaaagtgttcctgtttctccacatcctctccagcatctgttgtttcctgactttttaatgatcaccattctaacttgtgtgagatagtatctcattgtagttttggtttgcatttctctgatggccagtgatgaagagcatttcttcatgtgtctgttggctgcataaatgttgtcttttgagaagtgtctgttcatatccttcgcccactttttgatagggttgtttgattttttttcttgtaaatttaagttctttgtagattctggatattagccctttgtcagatgggtagattgcagaaattttctcccattctgtaggttgcctgttcactctgatggtggtttcttttgctgtgcagaagctctttggtttaattagatctcatttgtctattttggcttttgttgccattgcttttggtgttttagtcacgaagtccttgcccattcctgtgtcctgaatggtattgcctaggtattcttctagggtttttatggttttaggtctaacacttaagtctttaatccatcttgaattaatttttgtacaaggtgtaaggaagggatccaatttcagctttctacatgtggctagccagttttcccagcaccgtttcttaaatagtgaatccttttcccatttcttgtttttgtcaggtttgtcaaatatcagatggttgtagatgtgtggtattatttctgagggctctgttctgttccattggtctatatatttgttttggtaccagtaccatgctgttttggttactgtagccttgtagtatagttttaaagtcaggtagcgtgatgtctccaactttgttctttttgcttaggattgtcttggcaatgcaggctcttttttggttccatatgaactttcaagtagttttttccaattctgtgaagaaagtcattggtagcttgatggggatggcattgaatctataaattaccttgggcagtatggccattttcacgatattgattcttcctatccatgagcatggaatgttcttccatttgtttgtgtcctcttttatttcattgagcagtggtttgtagttctccttgaagaggtccttcacatcccttgtaagttagattcctaagtattttattctctttgtagcaattgtgaatgggagttcactcatgatttggctctctgtctgttattggtgtataggaatacttgtgatttttgcacattgattttgtatcctgagactttgggctgagatgagggggttttcgaaatatacaatcatgtcatctgcaaacagggacaatttgacttcctcttttcctaattgaatacccgttatttttttctcttgcctgattgccctggccagaagttccaacactatgttgaataggagtggtgagagagggcatacctgtcatgtgccagttttcaaagggaatgcttccagtttttgcccattcagtatgatattggctgtgggttcgtcataaatagctcttattattttgaggtatgttccatcaatacctagtttattgggagtttttagcatgaagggctgttgaattttgtcaaaggccttttctgcatctattgagatactcgtggttttagcctttggttctgtgtatatgatggattatgtttattgatttgcatatgttgaaccagccttgcatcccaggggtgaagccagcttgatcatggtggataagctttttgatgtgctgctggatttggtttgccagtattttattgaggatttttacatcgatgttcatcagggatattggtctaaaattctctttttttgttgtgcctttgccaggctttggtatcaggatgatgctggcctcataaaatgagttagggaggattccctctttttctattgattggaagtttcagaaggaatggaaccagctcctctttgtacctctggtagaatttggctgtcaatctgtctggtcctggactttttttggttggtagactgctattgcctcaatttcagagcctgttattggtctattcagggattcaacttcatcctggtttagtcttgagagggtgttgtatgtgtccaggaatttatccatttcttctagattttctagtttatttgcatagaggtgtttatagtattctctgatggtagtttgtatttccgtgggatcagtggtgataccccctttatcattttttattgcatctatttgattcttctctcttttcttctttattagtcttgctagcggtctgtcaattttgttgatcttttcaaaaaaccagctcctggattcatggatttttttgagggttttttgtgtctctctctccttcaattctgctgtgatcttagttatttcttatcttctgctgccttttgaatatgtttgctcttgcttctctagttcttttaattgtgatgttagggtgttaattttatatctttcctgctttctcgtgggcatttagtgctataaattttcctctacacactgctttaaatctgtcccagagattctggtatgttgtgtctttgttctcattggtctcaaataacatctttatttctgccttcatttcattattcacccagtagtcattcaggagcaggttgttcagtttccatgtagttttgcggttttgattgagtttcttaatcctgagttctaatttgattgcactgtggtctgagagacagtttgttatgatttctgttattttgcatttgctgaagagtgctttacttccaattatgtggtcaattttggaataagtgagatgtggtgctaagaggaatgtatattctgttgatttgggatgaagagttctgtagatgtctattaggtctgcttggtgcagagcagagtccaagtcctggatatccttgttaaatttctgtctcattgatctgtctgatgttgacagtggggtgttaaagtctcccattattattgtgtgggagtctaagtctctttgtaggtctctaaggacttgctttttaaatctgggttctcctgtattgggtgcatatatatttaggatagttagctcttcttgttgaattgatcctcttcttgttgaattgatccctttaccattatgtaatggtcttctttgtctcttttgatctttgttggtttaaagtctgttttatcagagactaggattgcaacctctgcttttttttgttttctatttgcttggtagatcttcctccatccctttattttgagcctatgtatgtctctgcacgtgagatgggtttcctgaatacagcacgctgataggtcttgactctttatccaatttgccattctgtgtcttttttttttttttttttttttttttgagacggagtctcgctttgtcacccagcctggagtgcagtggcgcgatcttggctcactgcaggctccgcctcctgggttcacgccattctcctgcctcagccttcccagtagcttggactacaggcacccaccaccacacccggctaattttttgtatttttagtagagacgggatttcaccttgttagccaggatggtgtcgatctcctgacctcgtcatctgcctgtcttggcctcccaaagtcagtctgtgtcttttaattggggcatttagcccatttacatttaaggttaatattgttatgtgtgaatttgatcctgtcattatgatgttagctggttattttgctcattagttgatgcagtttcttcctagcatcgatggtctttacagtttggcatgtttttgcagtgactggtaccggttgttctttctatgtttagtacttccttcaggagctcttgtaaggcaggcctggtggtgacagaatctctcagcatttgcttgtctgtaaaggattttatttctccttcacttatgaagcttagtttggctggatatgaaattctgggttgaaaattcttttttttaagaatgttgaatattggccaccactcttttctggcttgtagagtttctgctgagagatcccctgttagtctaatgggcttccttttgtgggtagcccgacctttctctctggctgcccttaacattttttccttcatttcaagcttggtgaatctgacaattatgtatcttggcgttgctgttctcagggattatctttgtggtgttctctgtatttcctgaatttgaaggttggcttgccttgctatattggggaagttctcctggataatatcctgcagagtgttttccaacttggttccattctccccgtcactttcaggtataccaatcagacgtagatttggtcttttcacatagtcccgtagttcttggaggctttgtttgtttctttttactcttttttctctaaacgtctcttctcactttatttcattcatttgatgttcagtcactggtaccctttcttccacttgattgaatcagctactgaagcttgtgtatgcttcacatagttcttgtgccatggttttcagctccatcaggtcatttaagatcttccctacgctgtttattttggtttgccattcgtctaatctttcttcaaggtttttagcttccttgcgataggtttgaacatcctcctttagctcggagaagtttgttattaccgatcttctcaagcctacttctgtcagttcgtctaaagtcattctctgtccagctttgttccattgctggcgaggagctgcagtcctttggaggagaagaggcactctggtttttagaattttcagcctttctgctctggtttctccccatctttgtggttttatctacctttggtctttgatgatggtgacctacagatggggttttggtgtgggtgtccttttttttgatgttgatgctactcctttctttttgttacttttccttcaaacagtcaggaccctcagctgcaggtctgttggagtttgctggtggtccactccagaccctgtttgcctgggtatcaccagcggaggctgcagaacagcaaatattgcaaaacagcaaatgttgctgcctgatccttcctctggaagcttcgtctcagaggggcacctggctgtatgaggtgtcaatcggcccctactgggaggtgtctcccagttaggctactgcgggggtcagggacccacttgaggaggcagtctggccattctcagatctcagactccatgctgggagaaccattgctctctacaaagctgtcagacagagacgtttaagtctccagaagtttctgctgccttttttcagctatgccctgcccccagtggtggagtctatagaggcaggcaggccttgttgagctgcagtgggttccacctagttcaagcttcctggccactttgtttaccaagtcaagcctcagtaatggcgggcgcccctcccccagccttgctgccgcctcgcagttcaatcaagactgctgtgctagcagtgagcaaggctccatgggtgtgggacctgctgagccaggcgcgggatataatcttctggtgtgccgtttgctaagacctttggcaaagtgcagtattagggcgggagtgtcccgattttccaggtaccgtctgtcacagcttctgttggctaggaaagggaattccctgaccccttgcacttcccgggtgaggtgatgccccgccttgcttcggctcacactccgtgggctacacccactgtccaaccagtcccagtgagatgaacccagtacctcagttggaaatgcagaaatcacccttcttctgcgtcactcacgctgggagctgtagactggagccgttcctattctgccatcttggaactcccttctggggctgtagctttttaaaaaactgtaatattacatagtaactctcattaggagattagcctattgtggcctaattttcagattctatgatatttagtgtttttcccccctcagagcccttaaatctaattaatagaggttaaaataatttttaaatagtaggaaatttttataactcttaggtctctcctttgtcactgaatggatagtcattatttcctaccatttattttaatgaatgaatggtttcaaagattttttttccctaaggaaaggtacttaccaaaatgcagagcttattggatggcatctggccctcagatctttgtttattacctaggtggaaaccaatttgctaagattaatgaatttgccttaaaggttcaaaattcagtaatggctgatctgatattaatacccagaatgcttctgaaccaacactgtttttgttccagtacagttgcctccatatttatacttcagtttcacattgatgaaacatacacaaattaacattatgcactattccttatatctaaatacttagtaggctcacttcacttgcctagcatactcaggaagtgaggattaatacaaaaaagggttggaggtagctgagcaaaagcaaagaaaaaaccctaagtagaaagttaccttgggctgtgaaggatatattttgtttatagaattgctgctgatttgctctccttgtgctctttccctctcaatttactcttaatatttggacatctctaatatttaataatctacaattggtattttaaaaaggagccagaaatgaaaattgttgccaatgtggtaatcaaaacaagaaagacaggaaagttgtaaaaattaacacaacagaaaaattaagcttaatagcagtctggagaaaatatttgcaaatcctacatctgataagggacttgtattcagaatgtgcaaagaactcgtaacgactaaataataaaaagacaccccaattaaaaagtgagcaaaatatttgaatagacatttctctaagaaggtatacagatggccaataaaagaaaagacagtgatgaacaatgtaaggaggtagagaaaatagaaacctcgtatattgcttgtgggaatataaaatggtacaaccccttggaaaacattttggcagttcctcaaaatggtcatcatggagttaccatataacctaacagagtgccactattaggaatataccaaagaggaatgaaaacatagatctgcacaaaaatttgtacacaaatgttcataccatcagtatttatcatcgctaagaagtagaaacaacccaagtgcccgtcaactgatgaaaccaaatgtcgaatagtcatacaatgacaaattacttgataataaaaagtgatgaagcattgatacatgctacaacatggatgaaccttgaaaacattctgctgagcagaagaaactcgtcacaaaaggccacatatttgtggtggccatttgtatgaaatgtccagaattggaaagaaaaagtagatcaatgattgccagggggtagggttttagtagtggtggggcagcatgggaagtgacagctgataggtatcacatttcttttgagggggatgaaaatattctaaaattagattctgatggtggttgtacatccctgtgaatatatttaaagaatcattgaattctgtaagtgaatgaattgtgtgtagtatgtgaactatatttcagaaagctgtaaaaagtctaaaaaaagtttagagcagttcaggaccagagcttggggggcatctttgttgcagactgaggtatagtgattaatattggttaacagtcactgttggctaaaagtcagtttttgccagtgcgttttgtgaaacatgtctcctgtaatgttgttagcaaaattctgtggaaaagtgttctatgtctaaatacatatgagaaatgctggaataaacacagtttaatcaatgtcattaatgcaagactgctctgagcctgtaaagtgctttaagataaagtagataaggccgggtgcagtggctcacgcctgtaatcccagcactttgggaggccgaggcaggcggatcacgaggtcaggagatcgagaccatcctggctaacacggtgaaaccccgtctctactaaaaatacaaaaaattagctgggcatggtggtgggcacctgtagtcccagctacttgggaggctgaggcaggagaatggcgtgaacccgggaggtggagcttgcagtgagccgagatcacaccactgcactccatcctgggcgacagagcgagactccgtctcaaaaagaaaaaaaagaaagtagataaatataagggccacattaatttttcacaggcccttctccctcagttaacctttttttttttgtatttggaacacagtgacacttttttaagttagcaagaaagttacattcattgagtatttattgcaaagcactctaattcgttgttacatttattcttcacagcagctttgtgaagtatagatactattgtctctatccctccacctcatttgcaaatgaggaaactgaagcttataaaataaagtaacatcatgcagccagaaaatgacagaaccacaactcagaaccattcaattttttaatcattcttatgccaatttaaaaagtattctaattttaaatccatggaaatatattttagacacaatcttcagattgttaaaccgaacaaacaaaaggtactagtatttaacaatttaagtttactttctattaactttatatgtaacctgtctgtcctcaaacatgccaggtgagtaagatctgtacaagatgcctttttcttttttctctcttcttttcagccattgtattttaacctgtaaataccgcttacctttctcttgaactagaatatttaataatttttcccttgtaatacttaattagttcatttgagttatttgtgtatttctagttaatgtgctgatttgtaaataaaacaatctagcattgttcatgcactctctcccaagacttggttttgatcctaaatgtagatgctggataatctcatatgatcctatgaatagcgtatttagatgtagcttatgatgcctacaaagcattttttaatgactgtaaaaaagttgatgcctatttgtttaaaaaattgatttcatcactgtttcttaatttgttatttattattctaatctcccctttattttaaacagtataaatattacaggtcatgaagatggttgaaattaaaagtcttattttgtgaatgtgtttttgttatgtattatgctacccccttagcaacagtacactcgaattttataactttttaatgaaacaagtatacttttattttaacaatagttatctataaattaattgacgttggtctctttatggctttccataaggcctttctggagcaatgcattctcaagtgtttcctcacgctcattttggtaggtggccacaattaatatctagatttgtgtggcaatttgtctacctgcttgtggaagcttctgctagtgttctggatccctgcatgtggaattaagtttttttccatgttttaaaatggagtgggcatggatgtgtggcattgggattacattgtatttaaaattacatggaaatgtttttagtgatttatgtgtaaatgctgaaaagcattactgcttacctacatggtcatattagaatgttaatagccattttgattctttttcttgagtttgaattcatggtactttgagtgacgcctttttgatataccaaaccattttactgcattattccatggagtttggttttgcttaactgtattcaagttttgcttttaagtgctctcttaaagtgatttgtcaaagttacgtcggtgcattgtcgtctgttatgaagccctcctgttacccttgcagtgtgcttattattctttaattcacctgcttcccaatggcctgtttttcctttttttcgcatcagtaataaaaaagtaattttttaatattctaattaggttcattgagcagaattgcattgttacaaacatacgactacagggattactttgggcaacatctattacttgtttttcagctttttaaaaataaaagacattccgtgtaatattttttagtatttaatttctgtgccttaaatcaatgaacaaattggtaaatttgttaaaatcaggaaatttagtgaattttcatggtattttgattgcatcatgctaagaatatttcattatgtaattactaatagtctatattcaaagcaacattattggctcttattttactgagacccttcctaaaacacatagttggaggttttgtttttaatattcactagtaataaataacatactgtaagtgaatagtaaagagggaaatgatggcagcattccacatatgtagcagttgttcacacacatttctcccgatgtggtaatactctgtccaccaagtaataccagcgaggcatggcaagccaaggaagaatacagtagcattgaacactttggccatttattctgcattcttctaggaatgcttatttcacttctaatctttatggatttcacactaatttcgatagctcagttgccctaaccttccttcagtctcgcaaagctgtcttcatttaccttccataagagggtgggagtcgtgtgtgtgtgtgtgtatggaattgatttaataggaaaatatccttttaattgtgttagtgttgttaagagaatctctcttctctggctgtagttacaaagctgcataggttctgagtggtctgcctgtaactaactatttgtcctataagtcctgttctttttagcgaactattcttcagcggtttaaaatttttttttgcaggaacacatattatgttatgacagatacttcaggagataaaattttggctgttattttactgcatataacaaaacaaaactaaaaacaaaaatgtatactagtatacatattaattgcatgatctttaaaacacaagactactgtttagacttgaatttataatttgagaaattgtcttgggatttcaaacaacagctttagtagttagtttcattctggtcattgtgttttagaagaataaaatttctacaagttacgttaaactgtgtagcactaaaactcattaactttgttggaattttggaattaaccctgcctttaatgtacatcttagtatttttcaaggtaaatgatgtctttttacatttacaatgttgtgagaaactaaacatatcctgttgtatgtaactgatcagcccttctcttctgtcagcggcaacctttggcactgcatccatgagcatgcccacaggattcggcactcctgctccctacagtcttcccaccagctttagtggcagctttcagcagcctgcctttccagcccaagcagctttccctcaacagacagctttttctcaacagcccaatggtaagatctaacatttggcgagctgtaagttcattttatgtatcctttttatatcataatgttgtgtgcttgggcaggaagacttttctaaagaatactatagtattatctactgagtgtttacacaaaaataaaagcctttggtgatttggacctcagaaagctaagtgattttacaagtttttgtgagcaggttacaatttatgggaaatcagtgactatgtaaagagcatcccgtcattctcagaatttctattgcctttttctgattatttcgtcttacatgttctaatatacctcttgattttaaaaggagaatttatagacctagaatgttgggatttttttttcctttcaggacagaaatgtgtacctttttgtgtgtgaaatagactacttttctaatttggtaactatactgtagttagagtttgttatttgattttagaaagagacaagaagattaactcgacatttttacgtatttcatttgcttcagtttgaagtgcatagatttgaagattcttgaatcacaactatgtggtttcttttttctttttttttttttttaagtaagtggttatttaaaaatctgaaatatgggctgggcgtggtggcttacgcctgtaatcccagcactttgggaggctgaagtgggcggatcatctgagctcgggagttcaggaccagcctgaccaacatagagaaaccccgtctctactaaaaatacaaaattagccaggcgtggtggcacatgcctgtaatcccagctgttcaggaaggccgaggcaggagaattgcttgaacccgggaggcggaggttgtggtgagccgagatcgccattgcactccagcttgggtgacaagagtgaaattccatctcaaaaaaaaaaaaaaaaaaaaatctgaaatatggaccctggaagagccataaataataaaaatatttcctacaaaatactgtgatgtttacatagaaatcattgtgttgtctgcacagcctgttccaaatagtcacaagctcgtctagtaatgaaattctataaattttagttattgagacaagttagaatgaaagagctgaatgaaagttctcttggccaggtgtgatggctcacgcctataatcccagccctttgggaggccaagacaggtggatcagtcgagtccaggagattgagaccagcctgggcaatgtagtgaaaccctgtctacaaaaaatacaaaaattagctgggcgtgctggcgtgtgcctgtagttccagctactcgggaaactgaggtggaaggatcacctgagccctggaggttgaggctgcagtgagccatgatcatgctactggactctggcctgggtaatagagtgagatcatgtctcaaaaaaaaaaaaaaaaaggttattttaagacatgctacagtaagtttgtctttggtatctgaaagagcttgaggcctaacaacttaactttaacattttatttttgctgctctggtaggaatgtctctgaaagttattatgaggctttataagcatcagattgtctcttgaaggtatgggttataattggtggttctattttaacaaggtgcaggttttgcagcatttggacaaacaaagccagtagtaaccccttttggtcaagttgcagctgctggagtatctagtaatccttttatggtaagcaaaatttaaaattaaatactttataagttgttaaatcttattttaaaattaggaatagcaggatgttaatattcctagatggtatttggtgttatattgatatgagtgacatcataagattgtacaaattgacacagagccattatgtgtgatccttttctgaccttttaaaaaattagttgcaaatcaaagcattgatagtttttaaaaaattagttgcaaatcaaagcattgacagtagatcagctattttataatatgaaacttatctgctttcttgtcaaaataacactttatgagaggccctaggaattagtgaacataaaagagaggtcttaagagtcagaagttttgtttgaatcacacgtgcttttctaagaccattctaagattcttcttagaatctattacaagaactgtttgaagtactggatatgaaagacgtagcacagttcatgacacatagtagtttgatatagcttattgccaataacaaatattattgccaataatttaaaaaataattcttaaccaaaaagtctaattaaaaaaattaaattcagtttaatgtttttatattttgtacatgcactacttttgtctctttatttatttgtcttatgttttcctttagactggtgcaccaacaggacaatttccaacaggaagctcatcaaccaatcctttcttatagccttatatagacaatttactggaacgaacttttatgtggtcacattacatctctccacctcttgcactgttgtcttgtttcactgatcttagctttaaacacaagagaagtctttaaaaagcctgcattgtgtattaaacaccaggtaatatgtgcaaaaccgagggctccagtaacaccttctaacctgtgaattggcagaaaagggtagcggtatcatgtatattaaaattggctaatattaagttattgcagataccacattcattatgctgcagtactgtacatatttttcttagaaattagctatttgtgcatatcagtatttgtaactttaacacattgttatgtgagaaatgttactggggaaatagatcagccacttttaaggtgctgtcatatatcttggaatgaatgacctaaaatcattttaaccattgctactggaaagtaacagagtcaaaattggaaggttttattcattcttgaatttttcctttctaaagagctcttctatttatacatgcctaaattcttttaaaatgtagagggatacctgtctgcataataaagctgatcatgttttgctacagtttgcaggtgaaaaaaaataaatattataaaatatgctattgtttttgtgttcttgctgcaatgcctttaccaaagtggccttaaatatgagtagtgaattgagaacatcttgaattcttaaaagacttcttagtgactttttataaaaaggccatgtagaaaatttattaaaactactatgactgctacattcaggaatatgccagtggtaaagcatttaaatgtagcttgtcagatttaccataatcctactaatttctttgcagcttattaattttgtgaaatttgtatatatgaagaatttgcatgtatgtgtatttacaaatttttctaagtatcttgaattctcagactgcaaaaggcctattttaactattgattttttttaaaaaaaattgtctttgaatgtattggaagtagacatgcattaactgtgacattattgcacctcagtttttttctttctttttttgggcaaactgatattatctataggatatttgtttatgtttgttttttgggggaaagaaactggaactcagtgttaccttaaagttacggaatactttgttttaaaggaaaagataataagtttagttatatctttttgttaatattcaaatgaacttgtttaagtatctatgtacagtaatgcctcattcatctagaggtaatctggcagtcttgtgaaaaccgaacacaactcagaaacttggaatcgttttttttaaaaatgcctctgagcaacccatataagtcacaaagtctgtgtgttagagcttatgcatttgtttttatgagagattttaataaatttaattatttgcttgtccagactatagcatattagctgtttagaagggatggcttgaaaggaaggagactgaaaaacactctgagagcatacactgtccaaggccattagtgtaaggaccgctacccagcctagaggacatcactatactacatcatctgatgattattctttattatgcctctaggtaattaagtaaaggtgaaattgcatacacagatatgtagtacatattttaaaagttttatcttaaattgattaaaactttttaaaaagctttggtattaaaagaggtaaacatcagtttcctcaaacattttattcatgttgaatgcctttttgcaatgatgactgagttgttatcatagtattttaaaacctgtatagtgttttagacttgttaaaacattgctgtctagtgtacatctagctaaaagtgtggtttatctaaaccgttttaataagcaagatgactgggaaatctctgccccttttctgagcagtatgcctcttcttttagaattaaatgaatgctgcacaggtccagatgtgtgttgatgtagacttgaaatgtctccacattttggaggacttcctcagcccttttcattgagggaaaatatatttgaatttctgttttagattgtatcgggtcccagttgattcatgtgtacaaagttatgctacctaattacagaccattacccaaatatcctaccaggctttccatctgaatagtaaattaaacagttgttatcaaaatgattttaaagactatttctttttctgggtaactattgaagtttgtaattaaatgggggctcttactgactttaaattagcgcttataaaataaaaatgtttagttcaagaagagacccaagctgggtatggtggtgtgagagcctgtgagtcctagctacctggaggtgaggtgggaacatcacttgagcccaggagttggaggctgcagtgcgctacgatcacaccactgcacaccagcctggggatagagtgagatcccatctctaaaaaatgaaaaaaagaagagaggtagctttaaagtggtttttctcatgatattcactgtttattattaaagaaaatcagctttcgttagacttttacatttagatttattctagttttatatagaccatcaaaattatgttgagtactaaaaaggagaaaaaatcctggaaggtaacaaggctgaagaccttcaaatttcctggcttactggtttagtcacatcatttttcctgttcaggtatctgcagatatccctgttcaggaaagatcttttttcaggatggcaaacttttgacatagtttaaagacattttttccccattttttgaaatagagaatattttattatttttgtgaaaatagagttttggtaatcactttcttcctcaaaataagtccttctgttaatttgtaaaagcacattagtgctttacctgtgaaattccccgcccccctgcacacacacccactttagtacagttcctgtcaattggcaacatggagagggtgacctggctgctggtttaccactgtaccaacatctctggagcattttagtttcagaaccttaacactccccaacagctttgttgatgtagcttgtatctctgagaatttattgtattaaaattaatactgagatatttttaaaacatgtttatttatttaagtataacagtaataaactaataacttgctaacataaataccatttttgataaaaataacttttccaaaacaaaaactaatgagaacaggaacattgttttacattttatgcatttaaatctggcttaataaaagcagtgagattttcatgctgcttttgcattccaacttaaaaattacacagcatacacacgctggaaaactccactgtgcacttgtgagatcaggagaatgaaaactatgtaatatctcagtagtacaatgaaaatagtttgacttttcacagcctttcaaagaaagggttgtagggaccattaagggtctccagactctttgagaaccactatactttaaatttgtgtatttctagaacagtatttacttgcagggcaaacataactattccctgggttttttttgtttgctagtgagaactgaaattgcagactttttaacactacttcaaggtaataatagcagtggtattatgggctgtgtatgagatagtcatttgtaaaacaattttcatatttcatctcttacaatccctgcagtggacctatacttttaggatgaaagaagcaaagcatagagaggttaagctagtggcagctttttgctctggggaacagatttggattaaatgctatcacatttatatatgaatgcattctttcttaatattttgaaattctgaacaagttaacgttcttgtcttgtatatctaaaaaaactttaatcacttgaattcctttcataatttgatgaaatcagtacagtttattcttggtttttttttttaactttagaagtaaattaatatggtaactagtggagcgtgctttagattgaagactcatctgaagtatcacagactcctattttgtaaagcattccacctttattgatacagtttgtggcctatacacttttaaaatttattttttaaaaggtgatattaaaatttgtatttaacctgttgtattcatcctcattagttaagtttttctttttatgttttaaaacttagtgacattaaacttttcacgtggttgtttgtgaacagatgaatatataaccacgatgtaatccagtgttgtgctgctgaatgtttaacaaccatctttcatgaaagaaaaaaggccctgttttgtagcatttactaatatttatggtataaatactgtcttcatggtgattttacctgccaatctgatgtcattaaatgcagtttgatgaaagagatagccaaccagtggctttcccaagccttggcaaaccagcttcagcacagcaaaggacatacaattccacaactcattaattaaatgtattggtcatttgatgattatatccagtatttggagagcttttatattgttaattcatttagcaagcatttgaacacttgtttatttttagagatatactgggcactgaggtatttaatctgcaaagacccaagtatcgtgaaccttggttttaaaaagtccaattattgtgctcttataggggttgcacattcaaggcttacactgaattctgtctgcagttctgttttgtgtgaccagcacagtgttttaaaacgttgcattctgaatccatctttttgaaatggggcatgtactcttaaggtggccactagcttaccattcccaatttttcttagtctcaaacattcacatgtttttcaaggccttggagttggcaaatcctgaatatatagtgaaggtaggaaatagctcttcttatgccacatcttagtctgattttgaagtcagttgtgtaagtttgggctgacagtggtattttccagtgaagactatcgccaagaatgcatatcattctgcttattttattctagtggataaaaattcaacgtatatttaagtgtatttttgacatctgtgcttgtccaacacagggctgtagggactgatgaaaagagaatgttgtgatttgagcttttataaaaaaagataagtgatcctagataaaatattttagatggtgattaaaatgcccatagattaattttttaatcggttctctgaaatcttgagatgttatccaagttacaatttaagcaatgagagtaaaatttgaattctaaattctcagcatcttccctcattcttgagtggagagacagaggaagcaaacgccaaggagccttctaattttgactatatgatcattaactaaaggcagcaagggattgtaaactaatcttacatagtcaatgtttcatagaatgctttggttacaatcaggttttttaaagactttaaaggttttttgtatgctataatatatgcttatgatttctaaaaattatgcagtatacacaaagggcataaagtcaaaaagtgtgtctccctctgtgactttattctcataccccagaggcatataatttcttgtattcttgtgtagtctttaagaaatgttatcgtttattttatatatggctctctctctgtatgcctcttcctgttcttattttaaatgttcaagtttgtgacttggttcttgtttaacttggttgtctttccatattgccaccttccagctctaacattaatgtctccaggattccattatatggatgtccctttgggagaacatttgtttatagacttttctactaaaaatattgttataatgataatatccttatgcatatatgaagattactcttgattctgcctgactggaaactttattaataaagtagacattattctattttgaggctcaccagctgtgtaggtatgatcttgtgcttccatttaagaaattcttccatttaaagaagaaaaaaaatctctctgactatctgaagatatatgaaaaagcctatgcttttaaattaaactgttaagacagtccattgaaagattgtggaagttcacatctattttgcaccttaattttttcattgtccctactcatgactctaaaaagtgcatggcttggggctatactttgttttgcagtttgttggtatcgtgcctttccttatctacattagcttagactataccttatttttaagaagagaaagtggaaattaactgtggcaaaacctattttggcacaaccacatttgttcattatacaaaattagcttcctatgctttagaaaaaatgtgagttattactctgaaagttgtgattctgattcctcatggtttggagctcagaaatttcttaacatgtctttgctgttagtcaagcacaggatttgttttctgcaaaagtttattttcaatgaagaatacttgtcctaatagctcataaaaagtacctttgcactttaaatcctaggaatagggaacaaggaaacttactgggaagttcaaaagaaagaataacaggaccttctagtcagcagggcatgtttggaaaatgttaatacgccatgatttttgaagaccaattttagttcaggaggtggttttaaatattggatgaaaacttacaggctgttttcaatattcatttctgaaatactttagtatgatagataaatttggttaagttcttgttcattgtgaaatactgttggaagaatttttttcaaaataaagacttctgaatttgtgtaccatttgggaatagcctctttcatttaaatgagtgtcaaatctggaaaattggaagaatatttgttcctttcatcactcacattatgcatttctgtaaagcagctcatgcatttacttccagcttaacgtgttttccattaattaataagttttgccatttttttctgtatttttcaattaaaaagtcttcatttttaaaaagcaggatctatttgttacttaatttgcaatatttttttttcaaagatggatttttttttttctggagtacacattgatggaagttggttttaagaaagcattgtaatgggaatttacctaccttactactgttgaagtttagaaggtaaatgctgaactgtgtttgtcacatccctaatcttatttctctgtagtggtcactgactattatttgttatgagtccatcttgattattctgtacatcttgtttaaattattttcactaaccatcaccagaacacagaagaaaattttgtttccttagaatcaatgagtatttccaccacctgagggtgggggacaaggaggagagaactaatgtttgttttagcctctttaatgagaaactattcaaattatttttcttcattttttttctcaaatggtatgctaatgatttttgctgacctcaagatttggggctctgtgaaaagtactataccagagttaaattgcctgtgttcttttctgccattaactggctttgggttgggaaattcagataattccacttttccaactttaaaatgagatctcattcaaaacaaaattgcccacaaccatttggaatatgtgtttaaattagacagtaatgctttggaaagtggaattaaacatttcagaataatagctgttaggccgggctcaatggctcacgcctgtagggaggctgaggcaggtggatcacctgaggtcaggagttcgagaccagcctggccaacatgttaaaaccctatctctattaaaaatacaaaaatgaggcatggttggcaggtgcccgttgtcccagctacttaggaggctgaggcaggagaattgcttgaaccagggaggtggaggttgcagtaagctgagattgcgccagtgcactctaacttgggcaacaagagtgagattctgtctcaaaaaataataataattaaaaaataatagttgttagattgaacatagaaaacacgtttttgtagataaaaattgccaagtgtcagcaactttgacaatttttaaatcaccaacttgtgccatttacctcatctaattgatcccatttaatggacacaaaaaccctttaaggcagtatttgtcagaagaaaacacaagtgttcgcttgaccaggattgcacagctaattagtaagtggcaggagtagaattctgtctgactttaaaattaatcttcctgtcaatattgtattcctgctttgaagctcctcattctagcagttttaatgagtatggatatttaaaaaaaaaaaaaaaaacacctgtttcacaagcactgttggaaactgtaaggactactcacagccttcctaccccaaatttggagttttttccttccacatttgcttcctgccaatgtgaaatattttgttgtgatcataaccagttaatttttaacccatttatgcctagtgttccattattggaatgctaagcttgtgggaattatttatatcctactgctcaaggtcattgccaaggtctaatttttcacaaaaaaatttgcaacttccagcataaatggattaatgttgaatttttcctacatacgagttttcttccaaacaaaatacatttacatttgttattttttctgatggtgaaaatacataattattgtaaggaatttgaaaatagagaaaagtttgtaatcttgtgcaggtataagtatgtctggattgtgttttatggataagtataaagacttcttacagaatggcatcatattatgcttactattttgtaaccttttcctcaatatatcatggttttctttcagtgtcaaatatagaaccagattctcttccaatgaagtttcattatatggagttctcataattaatctctatgacaaatgttaatattgtttccaattttcaacatcaggaattttacctgtgtttttatttttattttacctgtacacatgatttggagtcatgttttcttagaaattgaattgccgagtgaacagtgtacatcttaagaacattgatacgtctcctcttctgtactgcaatgtagattttgtggtcatttgtcatttttcataatgttaattgaatacctctaacttttcatttggattatgtctgggaattaaatatttgtaaatcacactattggcttataaggattaacatcctctcaacttaattactatttaaagagattgttttaatttatggaataccaaaaaaggcacgtgggccatttttactccagttctttttaatgattgctgatttcaggggattcttcatttttttcttttttttgattactagtgagttggattttttttcatgattttctacttgcattttctcatttatgaattgtgttaaaagtttaaggcattaattggatcaactaaatttacgtttttattcatttatctcattttgggatttcagaggcacaaactgggactttcgtattgctaatgatgtcatttaacttttaggctgaataacttaatctgtaatctagagattgaaaaatctagataactgctaaacttccttctagtttcataattttttaaaaatcagagaaggataacttattcagatcctctggttgaactggttgttatgcagacttaaaagcttatttcttcaccctaccctacatctagaacacatagaaatggctgttgtatttttttgtttttgttttttttgtttgtttttttggtgtgtgttagtttcactgtgatgtgtctgaatgtggatgttttatttttgtgttgtgcgtgggatttgatatgcttgaatctgtattgggtgggtgggtgggtgggtgggagggtgtgtgtgtgtgtgtgtgtgtgtgtgtgtgtgtgtgtgttgctaccagctctgcaagtttctcagccatcctgtactcaagtattaattgccctattttctgcattaacttttaaggtttttaaacgttttaaagaaggaactaagtaaaattctttggaatccttgaagggttttaagcatttaaaatgtttatggttatcagtatcgattcagactaaatttctataaagttatcaaagaagaatataaatttagaatacataagtcataatatgattttagaacaatactgtttcagcctttctattttagttgctaactgtatttgggtaggtctcccaaataaggagagaagagaggaattgccaggccttccagataagatttccagtattctaaactatggaaatgttagagaaacttgcaaattctagcaggccagagacattgaatgttttttttcttattaagaaataatactttaaaatgcagaacaattttgacttcagtgatgtttgagaactgctcatgtaaaagaaatcacactaaatgctgtatgtccttgtcgtagtagcttccatttagtaggtgttatatttggtgccactttgctaagtgatttttaaaataatatttcctataattttcacaatcttatatgtaggtatgatttctattttaccagacaaaacaggcgtagaaatgatggtttacttgctcaagtaaagtaagtagcagaactgagctttgaatccagctcaagagtaggtatgcagaaccactccaccacagtgccttgaaggaactggtcttctagaagggagtatggtgtatatgtaagtccacaccaagggcagggaagtggggctgtgggagagtaaagacatctcaatccgacctaatacagatttatgaaggagcagtagatggaagactaaggggggaagagaaaaggaagcaggaagaaaagaggcctgtatattggggttatgctgtattggggtccaaaatacattggacaggttttctcttcagggcatttgattaaagggtggtaggtgtgggtatgggtgtgggggtatatgtgtgtgtgtgtgtgtgtctgactgttggtgaaagtacttaatgcaaaataattcctttccagatctctctggcatgaagaacatggaacaaggtataacagttaataatagttgtgtttaaaattagtgtgaagtagtattcgattggaattctgtatagcatatattatttcacctaaggcattaaagatgattacagtcatttactactaaaaatgtggtctgaggacctacagcctggatgtagtcaccttgaagcttgttaatcatgcagaatctcaggccccatcccagggtaataaatcagaatctgcattttaacaaaatccctaggtgatttgtatgcaaattcaagaaaaagaggcactgatttaggctctgtctatgttacgtaaatcatttttgtatatagcttttaatttgttatactaaaatcactctggagaatcttaaaaaggagattgagaaaaaaattctgtgaaagtacatttgaattaagttccttgtggtgtgtgtgtagttttatacatgtgttgctaggagtcaggagttcgtgcagtgagtgatttatttatttaaaaagtagagaaatatgctggtatcagcgtcacacaggtaaagtcattaggcgatgccgtgcaatgaagataaatgcaaaggcagtagacttcctctggaagatattgtggaagaggaaaattggaagagcacaggttttgctatcaccatgaagtcagtcactggaagaggaaggaagctctgcagatgacaaaagcacctgaggacacccgaaatatctcttggtgctggtgcacatttgagcagtagctcagaggagtggcatcattgaggaggaggatacatgtgttaagcaccctgctggccaaggtatggcccggatgttggaaactggctgtagagccgcagtggttcctgatattaaagaaatgttgtttaaagctgtttttcttacaccctatttgcctttgaaattttaaaagcattcactttacacatctgttttgcctttttacaaaactttttttaaagagagccctctgccaccaaaatatgcttgacctcatcatcctgagatcactgctatcaaaatatttggtgtatattttttccctagctaatttgtgtgtgtatatacattctatataattgttttattgtgtacaatttgtgtaactattatctgctttaaaggtttaacagtacctttttctgtcattaaatagtgtgcaaaagcatgtgtagtaactgcactatatgactgtctctggtcagagcataaatttcttcactggtctcctgtacagcggtctgcaaacttttaagtggctagctaatacatatttttagactttgctggtgatatggtctctgtcctaactactggactctgtttttttagaacaaaaacagccgcagctgtaagcaaaaaaaaaaagtgagctcagctttgtcccagtgaaatttttcttgcaaaaaccaggcctgcaggtcatagtttgtcctcctttgtctaatggaaccttaggttgttgacgttgtttctggtcatgagctgccttttaacatctttgcccaacactagtttccacataaatcaatccctacagtggatgtttcttttaattcatatagtcctccagaaagtttttccaactttgggttcttgtaagtttttgaggatgtttattcctctggaatattgataacactggttatttttaattatcaatttgatatgtcgaaggtgataacgagtatttcatgtttcttgaattactagtgaggttggtcatcttttcatgctttgtgaattaccttttcatgagatttactcttccctagtatactcatgtttaaaaaattgtttttagaccttgtaggaaaaccatgttatgtatttttcatgtttcaatttactgttttgatttttacataagttttatatttgtgtaaagtcacagctgtccatcttttctataattttttttcatttatttggtaccaaaggcaatcttttctgtaatttgcaagtttgatcatgcttaagaaaccctttactaaaccactgttatgaaaatagaaacctgtgtgttctcatagtatttctgtggtttagttttgtatcaatattggaggttgatacaattttttaacttttggggaaagttattaggagtaatactagagagaaagtccagtgtttataggataatacacatttctcatggaaatttagaagtcaaggatatgaagcttgtatcaaaagcctaaacgggctgggcatggtggcacatgactgtagtcccagctacttgggaggctgaggtgggagggtcgcttgagcccaggaggctgaggttgcggtgagccgaaatcacaccactgcactccagcctgggtgacagagtgagaccctgtcttcaaaaaaaaggtgggggtgctaaacaacagtggtatgatctcttgcagcataggatgatttcagcttcaaaatttcaaaaattcacaaaagacaaaggacaactagaaggaagttagatgggtatatgtattttaaaagggacaggggagctcttataatgaagaggtggtgatagaggggtagtaggatgggtggaagatagactgagtggggggcgggcggggtgggggaagggataggccaagagtagcctatttgtgggcagacaagacaccaaaaatgccagtattctagaatgcttatactgtccaaacagcctctcctggagaagcactttgttattgctaatctgaaatttagtcatctatgtgagggaactgcagggattaaaatgctaattcactggatgagctggatgatttagttggaagtttttataaggaagagccagaaagagttgcccatttgatagctttagaaaaatcctcaagaaagtgtgttacgatcccatgcatggtgccgtgtcttagctacaagggtttgatcctggattcaccataggttattaagaaagtaatcatttattttttaaaggcagcaaatacttcctgagaatagacaactcataaagcatataagggataaagagaagcataaagggcctgcccaaaaggagattatgacttattttaaaagaataacacatgccaagcgcagtggctcacgccggtagtcccagcacgttgggaggccgaggcgggaggatcacttgaagtcaggagttcgagaccatcctggccaacatggtaaaaccccgtctactaaaaatacaaaaattagctgggcatggtggtgcatgcctgtaatcccagctaggaggctgaggcaggagaatcacttgaaccaggaagttggaggttgcagtgagctgagattgcgccactgcactccagcctggtgacagagcgagactgtcttaaaaaaaaaaaaacacatatacacatggagggataattaaaaataagttccattttttccccattttcctcgtattctagaatcattaaaaggaataatgacatgttttattgtaaaactaatacactttcatgctggatcagaggtcagtaaactagtgtactgtctgctggctaaatctggctagtcacctaacaaagttttattggaacatagtcacgctcatttctttacatattgtctatgttgctcttgccttacaacaagaggtgtagttatgatagagacctatggcccacgaaatctgaagtatgcctttacagaaaaactttgctgacctctgctttagataattaggcaaatgcagaaagtataaaaattttaaattgtccataatttcactttttgttagtttatgtatgaacatcttatgcaccaaaatgtaaaatggtttgtatggttgtatatgcatttttaaccacatattgtgtcattaaatattgggaaaacaagatttttaatgcctgaatagtataacggatatacagtaatttaaacattaccatttctagtctgcactagtacacatgatattttaataaataccattctacataaatttgtgtgtgtgtgcatatatatatatatatatatatatatatatatatatatagtgttgctttttgtgaaaggttttcaggtgtagacttactagaattaatattttcaagatttttttatcttatgccaaattgccctccaaagacattttaccaagtttatgctcccaccattagagaatatgaaagttcattttcctcaacttttactgttgtggaatttatttatttatttatttattttggagacagagtctcgctctgtcacccaggctggagtgtagtggcccaatctcggcttactgcaacctccgcctcccgggttcaagcaattctcctgcctcagcctcccgattagctgggattacgggcatgtgccaccaagcctggctaattttttttgtatttttagtagacacgggggtttcaccatgttggccaggctggtctcggactcctcaccttgtgatccacccacctcaacctcccaaagtgctgggattacaggcgtgagccaccgcgcccggcccctcagttgtggaatttttaagtagccttaggcattactttaagcaaaaacagtgtctcattgtcattaaattgctagagaagctatttttccaaatgttaatttgcttgttctagatccactttttggatttgcctatttatgccctgagcacatttaattgcttgtgtaaatgcaatattttttctgcttggaaactcttacattccccagtgttaattccaaatgtaattttattaccatcagctgttatttctagttacttattcatgcttctgctttagtatgatatttataattcatttattcatttgcttccaaattaggctgtgaactcttccatggcagtagctctgtcagttacctctggattactgtgaccaccactggactaggcacgtgctaaacactcaatagatgtaggttgaatgaatgaatggcttttggatgaacccgtggcaagatgagagttggcactggtaatataacagttctgaaaagagttatcacttcataccgtttgaaaatgttatcttcagcacatcaagtatatgctatgaaccaagagccaggttcggtcctgggatttaacagtaaataatacacagtggctgtcccgagttctagtggaaaacttgaaattgtaagttacggtgtagtgagagatataaacacaagtgctcaataaaataactatgatagaagctcaggcactgtgaatacacataggagaggcatccaacctaaactgcagcattgagaggtttcctataaaaggaaatactgagttaaggcttgaaaaatgaggaagaattatctagttcagtgtcaaaagaaatgcaggcattgaaatcacctagtgcaaaaatctagggcttgcaggaaatgaggctttagaggaatttcaaagtagggaagaatgtaaggaagctgggggcaaaatgatgagagaccaggctgcacagatagaagtcagatcttgaaagactgctgtttctttttaggagtcttggcttgttttagagcagagtgaaggacgagtgattaagcattgaagggtttaagcagttgaatatgatcagatttgcagtttagaaatgactttggatttgctgcagagcggagaatggatttgctacaggaataagactggaggcaaggagacacttggtttatagaagaacttccagcttcaggtaatggaggagtaattcctttctgaccaggcctcccgtaactcattctcaattctggaaaaatactgaaagtaaaagcactggagagcaaccaataacaggcagaaactggagggggagttgacactggaaaaaaatagcactgagtgttctgtctttatagcttgttgcctgaacacaggccccagttaacttcatgtgaaacaactaaagcttgacaaaaaataaataactgtaattgaactctacttgtatatttgactgaatttggtatacacaaggcagactccaagcagcccagccaaggctgaaagaaagaaacacagatttctcctgatgttaatctcaggaatgatagtttggacttttgagtccagcaaagtttactgcttggtaaaacaatagttttcagaggaatataatagaatccagagtcttggcaacaaattaacacaatgtttaagattgaataagaaactaggtgtaccagaggccgatctgaacaaaaaaatgttcagataagtattttaggtgttacaagtattttaggcctctggtgcaactgctcaactctgccattgtagaataaatacagccatgtataatatgtaaacgaatgggcatgactgtatcccaataaaactttattaaaatgaaccacatactggatttggccagcaggtcagtttgccaacccctcaagtatacaaagaaataggaaaatttgagccatactcaagagaaaaggtaatgaatagagaccaacacagaaataacccagacaaggattttaaagcagcaaacacaattatgcttaagcatgtaaaggaaatataaacaatgaataaaaagatagggggaggccaaggtgggcagatcacaatgtcaggagttagagaccatcctggctaacacggtgaaaccccatctctactaaaaatacaaaaaattagccagacatggtggtgggtgcctatagtcccagctactcgggaggctgaggcaggagaatagcgtgaacctgagaggtggagcttgcactccagcctgggcaacagtgtgagactctgtctcaaaaaaaaaaagggggggtgggggtggggcgtgaaattttagagaaactaccagaggggtaaatgggaatgattaagccaaaaaatagtcactgaaattacaaaaaaagaaaaacaaacaaacaaaaaaacactacttgatggatttaacagtagatttgagatgacaaagagtctggggccttgaagatagatcaacagaaattatccatgaaaggaaaaagatttaaaagaaaacaaaaagcctgagtcagccatgaaataataccaaaagatctcatttatatgtaattaagttctaggaagaaaaaagagtgggatgacagaagaaaaaatatttgatgaaataatggctaaaaatttgccctcctgaaaactatagatatgagtccaaaaaggttcggaatcccaaaaagaagaaaaatctatttggcaaaactatggagacagtaaaaggatcagtggttgccaggagttacctgggggaaaagggtgaatcgagggcacaggttattttctagtcttttgatacaagaaattgtacagtggaaaagtattataaacatagagtatcatgcaacaaaaatgatggacaaattcctatgcaattaagacttaaggccataaagtatagcactactaagtccttgagagtgtaatttttgtccgatagtacatgcagaaaagacaagaacttggattaatctagggttggagttttgctgggcatgtgcaagaaaaggatagtggaggatattggaaaggaaatgattgtcctaggaatgaaagatgaatgaggaaagaataaagaactaaagggatgcattgagccaaaaatagagggttcaaatggataggagctcttctaatggtatggaagaacagatgaatatctgaatggaaggacttaaaaggataaaagttatctggggaagtatgtttggacttgaaattttaatgtaattctaagtgatgacaagtttaagatctgaccttgatgattaagtagctaaaattcagtgggggtgtggtctgttaaggatattaaggaagtacggttagggtgcctgatggattttacgtgaagatataggggatctactgctcatcagcctcaatgatggtggtggagttgggaggtgataatcaccattgaattggaggattaccagaggttaatagatgacagaagagagagaaggtagaaattttatatgaggaataaaatctggcaggggcaatggggaaaggaacacccatcctggataaatgcagtgtgaggacatgatcagtttccactggagaagacagtagggtcagattccacttgaaccctgcggagggttgggggtggagggcagtgtgaaggtggagtataggctccatggaatataggctgggagcatccctgaagtcctgagcatgtaatggacttgagcctggaaagcagattctagaggtcagcaataaaggtttaacaaaagagaagtggtgcaaggttaggtctgggagggagcacttggaacagtaaggagacaagaatattacaggtggaataacttgagaagttttcatccagtaatgtgaggtatggttgaaactggccacatttcccaaaaaatgagtcccagcagggaggggcaggagaggatgggacctttcctctaagaccaaattgattgcatttccaaaggaggcctagtttgcatgcagagcacccatagattttggtgagagggactcttgccatgggtcctgagttttaaggggcttaattctgatcctcttcttccattcatgtgcccatattggggaaggaatccatgaaatgaccccctccctggcttgtctttcttgtagaccatgccccaggcaacgaggaacccagggatctcagctctaacagccccaagcccacttccaggtgtttgtagctcatctagatccaaagcatagcctagtagctgctgcttgccaggaggtaggggctgatacgtggccagagccttcttttccttttgggaaaatttatgataaaatatggaatacccagtttactttgaatttcagaaaaacaataaacagaagtatgttccatacagtattttggacatgcttataccaaaaatttctttattgtttatttgaaattcgaatttaactgggcatcctgcatttttatttgctaaatctaacaactctacttcctcttgtttttcacaggaaataaaaagaacacataaactaacatgagaatgtatttatataaacaacttttaggctgtgtcaattatggctgcactaccatatagtgagaagtcatgtttatatgtcaggggtaggataattggtagttgctctttcaaatgtagatttttgtgcccagtggtgaattctgctcccacatgttaccaaggactctacttgcatgggttccagcacacacggactgggctcttggccgcttctccccaggaccctcagtacacataggtaagaatgctctgttctttcagcttgtcccccaccccctttcaggcttccagctttacatttatttattcactcaacaaatatttgctgaagatataccgtgtatctatattgtaccacaggctaggataaacaacagtgaagacaaaaagcaagacccctacctttatggaacttagtcctagtgagggagaggttttccatccgctattatcttcaccgtaccctttagtttagcacacgagttagtttctcttggctttgattttggcctccatctagccatgttgtccttggtttagtgcattctcaacaactcttggggtgactctcgtctcactctgacaaggccctgaaatgaatgtccctgttcatcctagtgagcagcccctgtcttacctggtctggcctcacttgggagccaggacctggagagtatatatgcagaaacacccaatcattgggagtaattcagaattatctatagggttaaatataaaaatccatttgaggtggtagagaaaaaagtaccattttaaaactttgaaatcatttctgctaagactccaagatagctcaatatctcaaagattgaaagctatactggaagaagatgttccatcttaaaaatgaaatagtttacgttcctgatgagctattataataaatacgcataacatttgtcttggcatcttgagaaaagagtgttattgaaattgactcgacaaagatttgtgatcaaattataagaagactcattaatcaagtattgatggctgctaaacatctaattgcttatcactggaaaagttatgtggacagtctacaaagagcttaatagataactcaatatcatggctgttgagaaattgcttattcttctgtattgaaatctaaatatatttgtcactttttttttttttttactatctgtctcattttttatttgtaaagattttagcacatcttctttttgagacggagtcttgctctgtcacctaggctggagtgcagtggcacaatctcagctcactgcatcctccacctcccgggttcaagcaattctcctgcctcagcctcccgagtagctgggattacaagtgtgtaccaccatgcccggctaatttttgtatatttagtagagacagggtttcactatgttggcctggctggtctcgaactcctgacttcaagtgatccgcccaccttagcctcccaaaatgctgggattacaggcatgagccgctgtgcctggcctgagattttagcacttcttatgtcttttttataataactgtgaatggagcccaatttcctaaataccaatttataaattatccaaattgtaagacaaggatgttatgcttatatattagttttaagcctgtatttgaaacttgggttaatataatgtgtaatatattcctttttatacctttgtatggagtaacttttaccacttaacaataaaaagacaaccaaactaaaaaaaaaaaaaaaaatgaacaaaggatatgaatagacatttcctgaaaaagatatacaaatggccaagaagcccttgaggaaatgttcaacatcatgagtcattagtgaagtacaaatcaaaaatgagataccacttcacaccaactgggatggctgtcatcaaaaagatggacaacaacaagtgttaacaaggatgtggagaaattggactcctcatacattgctgttgaggatgcaaaatgatgcagcagctttagagaatggctggcagctcctcaaaaagttaaatacagagttgccatatgacccagcaattccactgttaggtatatacccaagaggaataaaaacatatgttgatacagaaacttgtatgtacaagtgttcatttataggagccaaaaagtgggaacaacccaaatgtacatccactgataaatggtgtagccatacgatggaatatcattcagcctataactgatgctgcatcatggatgaaccttgaaaacaagtgaatgaagccaaatgcaaatggccacatatttatgtttccatttgtatgaagtgttcagaataggcaaatccaaagagacaaaatgtagagcagtggtttccagggcctgtggggagggaggaataggagatggctactaatgggtacaagatttctttatgggatgatagaaatattctgaaattaaatagggaattttgcaaatttatgaaaaaccattgaattgtacactaaagaatcgtatgtgtggataaaaatattcaaatacttattctcctttactgaacaatggggatttatctaaacttctggcacaaagccagcaggttgtaggcactctctctctctcccctttttttctttttccttttatttatttatttttagcaatttaacaagtgaatgaatgagtgaactaaatgcagatatcctaaataaaattcctttgactctcttcccaggggtgataaaattgggtccctatgactcatgtcccagcgctgatgtctgttctccctgttggtggttctaccactttccttcctaaaatggcttttgccatgccatcagccacttacccagtacgatccacttgttcaagtgatgtgagcagcctcgtcatcatgataatgttccagcactttgttgatgatgattctagggtttcatatagaacagcaggataacatggatcaagaaaccagatggaatgtttttgtcatgaaagaatccaacttcttacatcaaaggttgggggaggaagagaagatacaaatggcagtgagaaaagaaagggggcgacgactagccaaggtacaaatggaaaatcatcctcccctaatttagaacctggtgtgtgtttctctgctactttttatgtaatagtaagctgacacagctcaaatcaagaatttagttgtctttcaaatatttcctgacaagttgattctccttatccaaaaagaatgaacaatgctagtagttactgctaaaatatacacaggtgcctagtcgtccccaccctgtcatttgcccttgtttatccaggaacccactgtttctgtaactctgctggtgtttacagtacaggaacaaagagtgtgagctgtaaaatctctctaatcttgattcaaattccagctccatacctctgaagacttgcacttttggcagcttatttagtttccctgaatttcagtttttctagttgtaaaatttggatcatgataacgatttcatggttgtcatcagagttaaattagatcgatgtatgtatgccctcaataaatgttaactattattcaattattaaccatttaactattcctacctgtcaacataggctttattttcaagttcagagtctaaatttcttttaggtctagactgacttttaagagtaagattggggcctatatgcttaaattagtttacattgtaattctagcattatctgcttaacctctctccatgaaaagaaatttgactaaaatcattttgtacattagttgtatgtatcaagggcataaaaatgaaaatttcaacccagatcaaataaaaataaccccttctcccctctttagacaaatctccttaataagcatatatccagggaatactttttagttaacatggatcattctgtattattattgaactcaagaatttaagagctagaaagaacccttgggagagtctgacctccagtgtttacaagggaagaaatggagacagacttattagaaatggagatttggtgacttattgatgagaagatagctgcacagtaatatggacaaaacccgagcatactgcctcccactcccattccatgttcattccaaggcaccagctcctgtattaagaaaaagataaatagtgagacaggtcacttgcccttaaggctctatattatgtgacccttcaatgccctgtctgtacactcaagtacacatcacctatctcatatctttctgacccatcctggttcattggccttacaacacccaggctcttttctgacctcaaattcaaaaggcttcttagagctgccggtggtaattatggcctcccacacagtgttcccacagtctaatgaacaattacagagctggttatttctgggcaaaagtgctcagcctcatatcccatggctctcattgagaaatatttgatgaagattttggtaccacctgctggctcctagtgggttggcaatgttgcccagacacctgcattttatgttcccttaaatggctcttagtttctaattctttattccattttgtgtcagaataactcagagggaaaagaatatccattaacgtcctccttgaaaaatagtcaaaagccattttgaagaccttgggtcccaggaaagagtgtgtctctttgttcttgctttggtcttgctggcaaaacattttaccccaggatcaagaggctggtggttgaactgaacaaaggagctccaggctggtcacaggatgggcatcatttgccagtgctggcttggtgggaggcaactggcggacaagtctctctggagggtgagtttccagactattgaaaacctattgaggcagttaaatggagggcattatgaagtatccacgtagattagacattttaggcacttcattgcgaaggttttcttttcattgcccacatatttggcctggtttttgtttggttttgtaactcagttttgcttgtatctaattatagtttttttgggtaacaagcaataaaaattacagtaacaacaaatactctaaatgaattggggaatcaacttaatggttttcttttttttttaagcatcagcatgatcttatgatagcaggaattataagaaggagtatctgctttcaagatgactttattattgagtttccatcacccgttatgttgacctactggaaccttggtagactcccagaggtcacttagacatcggttttgaaaactattgattttattttgaatgaaattcattgtattgttattatgagccctgcttttctctgatgttttagacactgtgcctttttttaagaaagttttaactcaaaatattcctgtaagattcaattgtgcttttggtttgtagctttgcagctttgctgctttgttttgggagttttctgtgtagaatgtcttaggccataaacttagtgacacagctgtattttgtgctttagtgagaagggaagtgttaggtcttctgtctctggcccatataccttacataatacactgttcgatacccatcatcactggccttgtaaatggctttaaatggattcttggtgatgtgaccacctgatgtcatcctctggaaagagggtgaagtcattcactcatcaaatatttattgatgccatatactgtgaaaggacctgggaattcaaaaaaaaacacatggtttcttccctcaagaacttcaaggtcttgtaaataggcatgtgtgttacagtcccaatgtggcaggaagattagctataccattttacattcctactaacaatgtatgagtgatcgacccagtttgtctgcatcctcaccaaaatttggtgttgtcactatgttttaaattttagcctttctgatagctgtgtggtggtatctcattgtggttttaatttgcatttccctaacatctaatgatgtcagacaacttttcatgtgcttatttgccagcaatatgtcctctttgtaatcattttctcacagtctgtagtttatcttctcatcccctcaacagggtctttcacaaaataaacatttttaattttggtaagatccattctatcgatttttcctgttatggttcttgcttttggtgttaagtctaagaaccactcacctagccctagatcccaaatattttcttctttgtttttttgtctaaagattttctagttttatatttaaatccatgatcaattttcagttaatttttgtataagtgtgaggtttaggttgagattctttttttttgcctatggatgtccaattgctccaacattgtctgttgaaaagacaatccttcttctattgaattgtttttgttcctttggtaaaaaaaaaaaaaaaagggaaaaatattatctgagcacatttgtgttggtctgtttctagagtctttattctgttccactgatctctgtgcctgtccctcttcttatccatactgtcttgatcactgtatgtgaatgataatcctggactaaggtagagtgattcttctcatttattatttctttttcgaaaatagttttagctatttttgaaaggaaggtcctgtgccttcccatacaagttttagaataaacttgtctatgtctacaaaaactcttgctagaaattgggaattgcattaaacctgtagatcaatctggggaggactgatatcttcactatgttgagtcttccccgacccatgaatgtgatacagctctgcatttattgaggtcttctttgatttatttcatctgtgttttgtgatttttaggatacagattatgtttttgttttgttagacttacacttaagtatttcattttttttggagcaattgtaagtattattggtttacatttgtttctgtgtgtttgttgttagtatgcagttcatttttagtgctcctttcttttttcaaccttttcttaggtggaagattgtaccttttttatgaatgtaaaacactaagagaattgctagtcccaaaattgtgatttttcaaacatgattcaaatcctaaatttctggaatcttcatctgggtaaggattagaatacctctgcatccatgggagcccgtgatatttggttgtggttcattgtgagtttgtgtgtgttggggaagagggaccatggcctctagagaaagagattttgttgtttttcatgcagccacactactctctgagttaggtatttttggctcttctgatgtgtctagaatgagacagctggcctaaaagaactttcatgcaagctatatatctttctaagcttttttacattctctataaaaaaaaggactgaatgtacttactctaagaacatgctttattttttttacttattaatttaagaactgatgacaaggtaagtaattttggggttatcaacactgatcattgaggataggaccagtgtgcaatttaccagcagctgtgaagccaagaattgttcttgcatttcttattgtataattgactgacatcattagaagagtgttcaatgcctggagttgttagagtaaacatacttccaaaccccgaattgggcattatagttgagaaaatgagatctgagttattatttgttcatattaaaattgcatatatgttatgtgttcagatatgagcctatagtcctttcctaattccactgaaagctaaaaaaaaattgggcttgtcagattgatatggttttggtatttgtcctctccaaatctcatgttgaagtgtgacctccaatgttggaggtgaggcctagtgggagatgtttggaatgtgggggctgatccctcataaatggcttggtgccttccccatggtaatgagttcagatgagatctaattgttaaaaagagaaagagagaaagaaagagactgggccctccctctctctcttgctgtctctctcaccatgtgacatggctgctccccctatgccttccaccatggataaaagctttctgagacctcaccaaaagagaagcagatgatggtgccatgcttgtatagcctacagaactgtgagccaagtgcttttgtttataaataccagtcccaggtattccattatagcaatgcaaaatggactaacacagaaaattggtaccaggagcagggtgttgcaataaagatacctaaaggtgtgcaagaagctttggaactgggtaatgggcagaggttagaagaattagcaggctcagaaaaaggcaggaagataaggaaaagtttgaaatgtcttagagactggttaagtggttgtccaaaatgctgatagaaatatggatagtgaaggccaggctgatgagctctcaggtggaaatgaggaattcactggggactggagtaaaagatcacccttgttatgtcttagcaaagcacttggctgcattgtatccatgccctagtgatttgtgagaggttgaacttaggtgtgataacgtaggatatctgatggaattaatttctaagcagcagagcactcaagaggtggcctggctgcttctaacaacctatgatcagatgtggaaacaaatgaatgactttaagttggaacttaaaagagaagcagagtgtaaaattttggaaaatttgcagcctagctgtgtggtaaaaaaggaaaaattattttcagattttcaggagaggaattcaggcagaccatggagcaaccatttgctagagagattttcatgactaaaaggtagccaggtgctaatagccaagacaatgagaaaaaggccttgaagacatgtcagaagtctttgaggcagctcctcccatcataggcccagaggctaggaggaaagaatggtttcaggggtcagtcctggggctccactgccctgttcagccttgggacactgcttcccgaatcctggcagctctggctccagcctcagctcaaagggtaaatggtacagctctggccaccactgcagatggcacaaactgtaagccttagtgtcctttgcgtggtgttaagcctgcaggcatgcagaatgcagaggtttggcagcttccacctagatttcagaggatgtatgaaaaagcctaagttcccaggcagaagcctgctgcaggggcagagccctcacagagaggctctactagggcaatgctgatgggaaaattagagttggagccccatattaggctattgcatcactgtaaagaaaacctgagactgggtaatttataaaggacagtagtttaattggctcacagttctgcaggctgtacaagcatggcactggcatctgtgtggcttctggggagtcctcagaaagcttttactcatggcaataggcaaagtgggagcaggcatgtcacactgcaaaagcaggagcaagagacagagttggagggggaggtgccacacatttttaaacgactagatctcacaggaactcactcactgtcacaagaacagcaccaagccatgaaggatctgcactcatgatccaatcacttcccacaatgccccacctccaacattgcagattacatttcaacatgagatttgggtggaacaagtatctaaaccacatcaagcccccacacagagtccccggcagggcactgcctagtggagctgtgggaagggggccaccaccctccagaccccagaatggtagtgctaccagcagcttacaccctgagcctagaaaagccacagagtcaattatgacccatgagaatagccatgggggctgcactctgcaaagccacagcggtggagctgcccaagccttgggagcccaccccttgcaccagtgtgcccaggatatgaggagacctggagtcaaacattattttggagctttaaagtttaatgcctgcttgctgtgttttgaatttgtgtctggcctgttgccactttctttttgccagtttctctcttttggaatggggatatttacccaatgcctgtaccactattatgtcttgaaagtaaataatttgattttggtcttacaagctcataggaggaaggaacttgccttaagtctcaaatgagactttggaattctgaactgttgctagaatgagttaacacttttggggactcttgggaagggatgactgtattttgcattgtgagaaggacatgagatttaggaggcaaagggcagaatgatatggtttgcgtatttgttccctccaaatctcatgttgaagtgtgacctccagtgttggaggggggcctagtgcaacgtgtttggatcatggaggcggatccctcatgaatggcttggtgccttccctacagtaatgagttcacacgagatctggttgttaaaaacaccagactgtcccaggtctataaagggttttgttgagcagatctttagatgttgttctttggtctacagaggacaagaggaaacacaaaagcagggaagatttcaatcatgtgtatggaagacttttaagtggaggataatagtacattgaaatgggctagcaatagagggcatggattttctgtacctggactccttctaaagagaacaggcaccctttatcctgaattttttagaaattctcctgtctaaaggtaaatgattaagttattaaaatgtaggatatatcacaaaatcagtgtagattaattctttccaatttctaagtctactaggtgttgccattgaattcttcagttatgtagatgttttctttctgtttaatttttctaacttactatttatttttctttttttgagacagggtctcactgtgtcacctaggctggagtgcagtggcatgttctcaactcactgcaacctcacctccccgggttcaagcgactctcctgcctcagacatccaagtagctaggattacaggtgtgcgccaccaagcctggctaatttttatacttttagtagagatggggtttcaccatgttgcccaggctagtcttgaacttttgagttcaagtgatccacccgcctctgctcccaaagtgctgggattataggcatgagccactgtgccaggcctctgtttaacttatattctgttagttacacatgaggagcaacttcctgggtcatgaacaatcaggtacttatattatattcttagtttggattggctaagtgtaatttcagtttttatttgcatgttgcagagagactttaaaaaatcttcatgcccttgcacgtgaatgcatgtaaatagtacggtggatccttgatcaacatcttaggtccattttgtacttttgctttgttctcctcatgggaatgaggtgaagaattgctcttagaaactggcaaatataaaattaagccattatcaccatttctaagattaatgctagagtaaaaacaaagagattgaaacctctacttcttcagggtgggcctaacctgggctcattagactttgtcagtacctgcatgcacatctgctcccaatacgtctcaacccatcccagcacagagccaattctgcatgaggcagatatctgctggcctgacctggttgtggcctcttctgaaaatccttctctgtgataagtattttgtatccaaggtcatatacttccttttttttatttttattttttttgagtcggaattttgctctgtcacccaggctggagggcagtggtgcgatcttggcttactgcaacctccagctcctaggttcaagcaatcctcctgagtagctgggattacaggcacctgccaccatgcccacctaatttttctatttttagtagagatgtgatttcaccatgttggccgggctggtctcaaactcctgacttcaggtgattcacccacctcggcctcccaaagttttgggattataggcgtgagccattgtgcccagccctaaggtcatatacttctaattgggattagaaaaggaaagatttaaggcagatttgaaaatgtattacatttgttttaaggttatcattttcagggatgggttaggctgatttggggtaaagcacctgctattcttttggcatgtcagcaacccaaattgggttcatgctcctttgacctgacccaatgagtggaagtgagatgtaggcaatttgggagtaaattacattaacattgactccaaagaaatgactgtcacaaacagtgagacagggaaattgaaattgggtaaataaggcttccctgagacctgctccacatgcgaagtatttctgccctggatattgagcccataatgcattttagcacaagtttgatcataaaagaaatgaatctcacagtagaggaaattcttcccaacagggttcctttatttaacttgcgtgaatttatacagcacaaaaggtccttttatagcaagacaataagtaaaagagatggttagccatcaatatatggtacattattctgtgcatttagtttttagcagtacagaactgctggatatgagaatagagtagaaatagcatgtagtttacagcacagtgaaaagaaggcaggcactgaagtttgtgttaaggaatttcagaaaaacataaaagttagtaactatgatttcattttccatttcttcaaccgtgaattgtttgcaggagctgggctgtcccttgctttcatagttttcattgttcacatgaatatcactcaatattttgaaattatagatttgtgatgtgacagagaggagggtatcaaatctacagcccttgtgtgactcccagtcacatgtgtgactcccagtgatggaaagagaaccagggcgaggttgggggaaggcttgcaatgggcaagcaagatgcagcaaactcttccagagtcaggtgccctgcctagcagcagcattgcttttggcagcaggatttctgttggcaacagcccttcccacagccgcagccacacgagctgcaggtacggcggcagcagcagatcacgggagtgctgcagcagcctccacagcagccgcggcagcaggggcagcagctggagcagcagcccacccggtagcacctgcaggtggtgcagctgccacagccaccaccgcagccaccaccgcagccaccacctcagccaccactgcagccacaacttccacaaccacagcaacccatggtgtcagtagagaggactcaggtgaagtgaggagggaggatgtgagaggtgacgaggtctgatgtttgcctctgcaagggacccttaaatactgctgctggggcttggcacatgactatagtcacttccttgttgttttggccactttccgtggcaaacttttgtttcctgtttattacttcctcaggggtgtacacaacttgattttttatttcaattttagataaattcacttctatttcaaaaacggaatcagaactgacatttttttcagaaaacactgcattgtttcaatctgtctacctgagggtaaaattattttgatagtagtcaatggtctaagccaaagagatccagccgttcctcgtctttcgcaaatcagtaatagctgcccagaggaaagagtcctcttcaaaatgtatctgtcttttactctaagtatatacattttatgtgtattatccttaatcaccctttataaaaaccccaacacattaggtatatagagtctttattaaaatgagttttgtcatcaaagaagcccaggaaatgttgcatattgtttccatttgggaaattcacattaatatattaaaggtaataggaagtcctggaggaaaagggagtctcaaaaatcaatattcaacataaagagatttcatatcaaatagaaaatgtagttaaaaaattactttttgaatgggtttactcaaaacaaggatttagagaatccatttgaaatagcaacaaaaataaaattaaagtatgatatatgactccaatgacatgcaggatcttgatggaaaaaatttttaaattctactgagggacataaaagaagaaagaaatagaggtttgtggatggaacatctcaactgacatctaaaagatgtcaatcctttccaaataaattaataaattcattgcaattctattaaaaacactaagagatgtacaaacttttcttgttttgatttaacttgacagctgcccccaaaatacatttgacaaaacaaaaggtcaataatatcaaatacatgttttaagaggaatgagaaggacagtttgccctatcagatgttgggactccttctaaggccatggtcattaaaacagtgagaaattttgttgctgagagagatagactaatggagaggaatagagagcccagaaatggaatcacatagattttggaatttgatatatggcagaacagttacaaatcagaagaaaatattgactattcaatattagtactgaaataacaggttatccgtatggataaaaataacactagcatccttcttcacaccatacataaaagaaagttccagatgatttttgagatctaaaaatgaaaagcaaagcttgatattttaagaagacacaataaattatttttcttttttttaacttttaggttcaggagtacatgtgcaggtttgttataggtaaactcatgtcatgagggtttggtttacagattatttcattacctgggtgctaaacttagtactcaatagttattttttctgatccccttcctcctcccagcttccaccctcaagtagactccagtgtctgctgttcttctattcatatccatatgttctcataatttagctcccccttataagtgagaaaaagcggtatttggttttctgttcctgcattagcttgctaaggataatcacctccagctccatccatgcccctgcatgatcttgttcttttttatggctgcataatattccataatagtagactggataaagaaatttctaaatggataaatttcattatccagtctaccactgatgggcatttaggttgattccatgtctttgctatagtgaatagtgctgcaatgaacatgtgtgtaagtatctttatggtagaatgatttatattcctttgggtatatacccagtaatgggattgctgggtcaaatggtagttttgtttttagctctttgaggaatcaccagactactttccacaatggttgaactaatttacactccaaccaacagtatataagcatttcctttcctctgcatcctcaccagcatctgttacattttgactttttgataatagccattctgacttgtgagacagtatctcattgtaatttcgatttgcatttctctaatgattagtgatactgagcttttcttcatatgcttgttggctgcatatatgacttcttttgaaacgtgtccattcatttcctttgcccactttttaatgaggttgttttttgcttgtacatttgttcaagttccttacagatgctggatatttgacctttgttagatgcatagtttgcaaataatttctctcattctgtaggttttctatttactctgttgatagtttcttttgttgcatggaacctctttagtttaattagatcccatttgtcaatttttgcttttgtcacaattgcttttggcatcttcggcatgaaatctttgcccatgcagatgtcctgaaaggtactgcctagattttcttctagggtttttatagttttgggtttcacatttaagtctttaatccatcttgagttgattttgttgatttttgtatatggtgtaaggtaggggtccagtttcaatcttctgcatatggctagccagttatcccagcaccatttattgaatagggagtcctttctctgttgcttgtttttgtcagctttgtcaaagatcagatggttgtaggtgagcagcattatttctgggctctctattcggtttcattggtctatgtgtctgttttagtgccagtaccattctgttttggttactgtagccttgtagtatagtttgaagttaggtaacatgttgcctccagcttctttcttttcgcttaggattactttggctgttcagacacttttttggttctatgtgaattttaaaataattttttctagttctgtaaagaatgtcattggtagtttgataggaaagaattgaatctgtaaattgctttgggcagtatggccattttaatgattttgattcttcctatctatgagcataagatgtttttccatttgtttgtgtcatctctgatttctttgaggagtgctttgtaattctcattgtagaactctttcacctccctggttaactgtattcctaagtattttattctttttgttgcaattgtgaatgggattgcattcctgacttggctctcagcttgactgttgttggtgtataggaatgctgctgatttttgttcattgatttttgtatcctaaagctttgctgaaattgtttatcagcttaaggagctttggggcagagactgtggggttttctagatgtaggattatgttatctgcaaacagggatagtttgacttcctctctttctattttgatgccctttatttatctttttattattattttttgagatgtagtttcactcctgttgcccaggctggagtgcaatggcacgatctcggctcactgcaacctccacctcccaggttcaagcgattctcctgtctcaacctcccaagtagctgggattacaggcattcaccaccatgcctggctaattttgtatttttaatagagatggggtttctccatgttgatcaggctggtcttgaactcctgacctcaggtgctctgcccacctaggcctcccaaagtgctgggttgcctttatttatttctcttgcctgattgctctgtccagaacttgcaatactatgttgaataggaatggtgagagagggcatccttgtcttttgccagttttgaaggggaatacttccagcttttgcccattcagtataatattggctgtgggtttgtcttagatgactcttattattttgagatatgtttcttcaatacctagtttattgagagtttttaatgtgaaaggatgttgaattttattaatagccttttctgcatctattgggataatcaagtggtttttgtctttagttttgtttatgtgatgaatcccatttattgatttgcatgtgttgaaccaacattttatcccagggataaagcctacttgatcatggtggataagctttttgatgtgctgtgggatttggtttgcagtattttgttgagcatttctgcatctatgttcatcaaggataaattatttcttagaatagagaaatccaaacaataaagaaaaatatgaattaaatagaaaatacttcaaatgaaagagaagaaaacattttcacataaaaacatgctgaaaattggctgggtgcagtggctcatgcctgtaatcccagcactttgggaggctgaggtgggcagatcacctgaggtcaggtgggcagatcacctgaggtcaggagttcgagactagcctgactaacatgctgaaaccccgtttctactaaaaatacaaaaaattagccgggtgtggtggcacatacctgtaatcccagctactcgggcatctgaggcaggagaatcacttgaacccgggaggcagaggtttcagtgagccaagatcgtgccattgcactccaacctggccaacaagagcaaaactccgtctcaaacaaaaacaaaaacaaaaaacaaaccaaaaaaatgctgaaaataaagattaaaataaactttagcctaaagaacaattaattttaaaaagaaaacaaattattagaaaagtgaatgaagaatatgaattgaggagttatagaagacaaaattcaacacagaaagatgctcaacctcactggtaatcagaaaagtgcaaattaaaaccacaccatggttttaattttatacccacctgattatcaaaatgttcaagtctgacaataccaaatattggtgagaatgtcaaacaattggaattctcatactttgttgggtgggagtgtaaattgctataaccaattctgagagcaattaagcaacgtctggctaggtcaaagatatgcattctcctgtttaatcatttatatcaatattggctgatcgaaccctattctattcattgagttataaatctgttactgtcattattctgatgctcaagttgtcccaaattttgccattggtagcaccttcaagctggtctgtggttttaaaaaatatctccataatttttgaagtactaacttaaattctggcacaagatgttcaaggtcccatttcatccttttcctgtcccagatctggaatcagcctgttctccaaggattctggttccttttattggatagtgatatttagaatccaagatctgggtactaactgcactcattgctaggatttgttttctgcacctacagtcagttcttctataacacaacatatgtgctcctaaaaatcatgagactgtacaaaattgtgcaataaaagcataggactcatggctaacactgagctttgggaacagcactcaaaaaacttcatcagtgactcattaaagaaaagatggagaacttagtaaaaagggtgcacagttctatacataacatgtgtgtatatatgtgtgtgtgtgtgtattacaggatatacatatatcatgtaataaatgtggcattttacctgaagtttgcttatggaagtgggcataagaagggttgcagcttgtggtattgtcaagtgataggaagggagtggtatctgaaatgaaacagaaagttgtaactgttatgtgcagaagggtttcattcacagcacattggtgagcaggtagctagtaggtagttgtttgaagtatgcatgcgtgcattttagctgggtgcagttttctgtatctacttggtatttctctaggacaaaatcacatataagcaaatgcaaaatttgccttatgttccagttgtttctcaatacatcagcctccttggaacacatttacattttcaaaaacaagtgttataccagaactgactgtattacatattaggaaccgtgctaggcattgggaatttgaataattgatcccctgtatgttttccacttggctttctgtttcagggcttttcatattttcttatggtttgcttttgtgtttgtcttatttgatggaccttacatgcttctttagggccagtttcatctctcattcatcttactctcccaagtgctacacagtgtctgaaatgtataacagtattattaaacttttgataaattgataccagtaaggataatgtatagttcctcctttcaaagaactacagtctggaattgttccgtccaatatggcagccacttacaatgtaggctaattcagttcaaattaatcaaaattaaataaagtaaacaattttgttcttcagcttcattagctacatttacgtactcaatagacacatgtggtaagtggctaccatattggtcagctcagaatagaacatttccatctttccagaaagtccaactgggcagctctggtccagatccaagtggatggagaattacagctgccttattattcagatcactatcggaagacctggtgatgacctgcctcctgtccccacagaaagaaaaagtgaccctacatgtaggaagatataattgaaaatatttgagactggaggtcttctgaaaaatcagaattttaaaaaggtagatccatgtaataaagcctaaagtattcaacaaagaagtcaatgagatctaaagaaagtgaaattctcccaaagacataacaaggaagacttacttaccaagtttcaaacctcccagagtcattttctgcaaagtggactggagaagaataacagaagtagtaggagaaaaacaaggaattttgtctcataaaagtcaacagatgagaatgtgttaagaaagatttgtcaactgcatagtgctgagaagtcatcttgcaacactgtcaaagagcatattgtggactccgccgcagtggaggtcacgggggatttgagttagagcatttcacatgcaggggttgtctagggagaagtggggaagttttggaggatttttggtgaagattcttattttttatagtaagtgaaaaaacaataactcaatatatgtaccataatccccaattttgtttttaagtagtgcagatgggtggacataaaattctggaagaaaaataaaaagtgaagaatggttatttccataaggtgtgattgtggataatttttttcttcatatttctgtgtatttttcaattttctgcaataagcatgtataactttcatagtagaaaaatatcactaattatacttaaatagaattataggtaatattttgtttcttcatattttttatattttaaaagacatgtcaacacattttattatgtataatcttttaaaagtttttttatttattctttctaagagaagcagtcttgctattttgcccagactgacctaaaattcctgggctaaagggattctccagcctcagcctttcaaatagcttggactacagacatgctccactgtgcctggctttttgtgtataatctttgagacggagttgtgctctgttgcccaggttggagtgcagtggtgtgatcttggcttactgcaacctccaccttccaagttcaagccattctcctgcctcatcttcccaagtagctgggactacaggtgtgtgccaccatgcctggctaatttttgtatttttggtagagacagagtttcgccatgttggccaggctggcctcgaactcctggcctcaagtgatctgcccgccttggcctcccaaagtgttgggattacaggcgtgagccactgcacctggccgctgtatataatcctatgcgtactttgctgactcctcatcccacattcctgcttcctcacccaacacctattttttagtgtcactgttcccctgcctatcatctagagggaggtttttttttgttgttgttttcttggctttttttggacaatgctctctgcaagtgtggctgtcaaggggaggagagacaaaggcagtagctggaggggcactggactcaacagtgtgctttttttgcttgaagggaggagaaatgccacttacaaggttttgatgtggatggaagaatctggaaggttgggggagtgttgattgctgtgtttgtagtgtctaggatgggtggcacttcacagatgctcagcaaatacccgtggagtgagggaatgagaggaagagatgcctgagaaaggagatttagaaagccagatggaggtggtttcaagtgcacaggtgcaggggccagtcttggatggtgggagtgggatccacacccacctcctcctccatggttaaccgaagaagaggaggactgactggattccagcacttttttgcacagtatggtaggaagtgccttcttggagtgaaggggtcggagaaggcatccaacatctgaagaaaggggagaagataggaagtagtcattgtaggaagagggcaggccagctgatgggagaaggggagaacctggaggagggcaggcagctccctctgctgccatctgtggtggtgatgacagatcccagccccctctttattctcctgcctccacaccgttgcctcctcattttcccactgttgctctcccttcttttgttataatttcgtggagatatgaccaaaacagaagggggagaaaaagagacagctaagtttcaattggggtgattggggattgatgacatttgaactgtgtctttgaggaatgcttgggacgtccctgctggaagagggccctttaaattaaggcacagccacaagggaggtgggggaggaggcaagttcaagttatggtgatgcggctggcatgtttcttgtgtgaaagcaaagggtctgtgtcagaggagcaacctggtgcctgccctgcatttgctcccttactcccaagtgtcctttgctttgttggtttcgttcctgtcctttggtgaatcttgcccccttcattgttcttgtctctgtcttatttctaagagtgtggtacagtgttgaacacgtggtacctgcactgtagatattaacttctactagtagtcatgatgttaattacaaacttgcccttctcatgtagccttgggctactctagagcctcagacaggagattaagctgcaaagataaattgaagctagattatttattattattattattattatttgagatggagtctcgctctgtcacccaggctggagcacaatggcgtgatcttggctcactgcaacctctgcctcccaggctcaagcgattctcctgccttagcctctcgactagctgggactacaggactgcaccaccacgcagggctaatttttgtatttttggtagagacggggtttcaccatgttggccaggctggtctcaaactcctgtctttaagtgatccacctgcctcggcctcccaaagtgttaggattacaggcatgagccaccgcacctggcctgaagctggattgttgagggcattttaatgccatactagtgagtctgaattgttgagtaggaaagaaatgttgaacattagaatatagagcagcacaagatagcttttaaaatacagaagcacaaaaatttcataaaattgtgttaacatcattataccatatactgaccatgtataaggatttatacttcatgaggtcatagttaataatagggactattttaaagtagtttgtttcctcaaggaccaaaatctttccaagtctctgctctggcagtcttcaaagtgtgatctaaggacctctggaggccctgagcttattaagatactcctcctttttccaactgcatatctgtgtcaggctggatttttactccagccaaaacactgtaggataatagattcatcaaagaaggagaatgagaatccagctgtctttgatcaagacagacattaaagagattggcaaaaatataaaataatggccactgtactcattaattcttttttattttggaaaatggagttttttttccaaaatgtattatgtatgtgatcatgtaatgggcttatattatttaaaaatgaattaataaactttttaaaagtctcagtgttaatttagaatgcaataagtatctatagatttaagccatataacaaggacaatttggagttctcaatactttttaggagcatagggatcccgagagtaataagtttgagaaccactgctccaacctttctcttctctttggtcaatgtgtgaatgtgcttttccaaatccaccgttaaaatctgaacgtaggacgtcctgggactccacacctgagaagtaaatgaaagccttgctttccagactgaaaggaagttcggggcggggtgaggggtgcggagtgcggtactccccctcccacttagagagtcacagagcacgtgacaaaggcaagccactgaggacagagtcaaaaagcctgtctggctttatttaaattcattatttctcaaaaatagtcaaaccttttttgtgtgttgccttttaatgtcctgtggaacgaatcttctaccaaatgtgttttgggaagcctgacattgattagtccccttcgtcctgagttctgaggagcattgcaaggccagatgagggcatctctggggacagtggagcttcctggggcctctggacccttactttggggttgccttgctgccagctctgtcattaaggtgggacctacaaagtgtgactcatgcgagaagaattcattaggaggaagaaacccgaggaccagaaggtactgaagccggatctgagggctgtgggcttctctaatgaggctgatcttgataattccctaaatgagctcactgtgtgtgctgagggctctcccaggtagaataatcagacatagccactaacctagatgcaggtggcctctttgaattgtgacttccagaccagtgatagaaaatagcaaagattgggaacttcctttatgttagcttctgtgttctccttctactcaagtaaaccctaggaattttttttggagagatgtcaagggaaatatatgattctcctgggaaaatattagtaagcaaggaaaccatcaatgacagatatatctctctggctcatctattcaagactggctgtatttgaaaatagggataggtccttggctgaatattcccactggatggaacagaggttaatttagctgaactgaagataaatgacttaatgagatgaaaggtgcctaatagggacataaacaggaggtttccctgtggaaactgaaataaacaataacaaggaagtggtcatgtgtcttccctctcctctccccagagttggtacataagggcctcccccagcagaaggaggcatcagacctcctcacctctcctgagtcctcctcacttcacctgagtcctctctactgacaccatgggttgctgtggttgtggaggttgtggtggctgcggtggccgctgtggtggctgcggtggtggctgtggtggtggctgtggtggtggctgcggtggtggctgtggtggtggctgtggtggtggctgcggtggtggctgcggtggtggctgtggtggtagctgtggcagctgcaccacctgcaggtgctaccgggtgggctgctgctccagctgctgcccctgctgccgtggctgctgtggaggctgctgcagcactcccgtgatctgttgctgccgccgcacctgccactcatgtggctgtggctgtgggaagggctgttgccagcagaaatgctgctgccagaagcaatgctgctgctaggtggccggcctggttccacccctgcccaggagctgtgggaaccctcactgtctcctgctggcaaggctctgcttaaccccattctgtctaatcctttttctaacctatctgtcaccagcagatccccttggcttctgcctcatgtgccttgtgctttgtccttctgggatcttcctttgcccacacacggcaccaacttgcccagaccacacaatgtgaaacaaacgggcaaccgagcagccggtgataaccagataaagtcagagccaaccaggaaacttagtactttattattttgtaatgttcaatctttcctaaatagtcagtcctggatttcaccatttttctgttcactgtctgtgtgcaatcttttccattgcttttgtctatatttgctctttaaaatttcccagtaaaatgacttggtatgtcacaaaaatctcttcattagtcattttttttttaatcggttccttcgtcggcttatccatccctgtgctgtgagtccagttctggccctcacactcctgcaacctcctgaagctggccatgggcccagccgctgaacttgtagctgttgatcagagaggcacagagctccctgtgctgctgctctgacatgatgtcttacctgtggggtctgtgtactcggactctcccaaggattttctagggtgggatgagggtggtgtgaattgatggtggtgataggtctctgtttctccttgaaatttatctaggaggctgggtgtagtggctcatgtctgtagtcccagcactttgggagcccaagatgggtggatcccttgagacccgttgttcgagaccagcctgggcaatataggagacctcatctctgaaaaaaaacccaaaatgttagctgggtatggtgaagtgctcctatagtatcagctacttcggaggctgaggcaggaggatcgcttgatctcaggaggctgaggctgcaatgaactgtgacaacatcactgcactccagcctgggtgacagagtgagacactatctaaaacaaattatgtaggaaatgaaaaatgagccccaaaggaggggggaatggatgtagcctctaccttgctgtgctcagtggtttctgaaaagactggaaagtgtttgccaggacaaggaggttgagcactgtggggggtggggcagttccatgtagctcatgtccttgctggtgttctcggcatggcctccgagaccactactaggcatcagtagtcgtaaagacttgtaaataaataagaaagttggggctgggtgtggtggctcatgcctgtaatcccagcactttgggaggctgaggtgggagaatcacctgagtccaggagtttgagaccagcctgggcaatatagtgagaccctatctttacaaataatcaaaaattagccaagcatagtggtgcacacctgtagtcctagctacttgggaggctgaggcaggagaattacttgagcccaggaagtcgaggctatagtgagccatgatcaccagcagtcagcttgagcaacagagtgagaccctgtctctaaataaataggaaagtcattctaaccctggttatggcaatgaaacagattccacttaggagggaggttggctacaaaagcttagagaagtgtcatgctcattcaaggtgggagaaagaacaaactcgccaaactcgtattagattggagctcaccacagtgtaccaggcccaaggcagtttgcttgcactcaaaaatctttttttgactaaatgttcttcatgatctagactacgctttggcaattttttctgtgaagtatcagatgtaaatattttcagccttgcaggccacatgatttgttgtaacttgtcaactcagccattctacctttaaaacagccactgacaacaattaaatgtgtaagtggctgtgttccaagaaaatattgtgtacaaaagcaggtggcaggccaaaagtgggcatcagtttgttgacccctggtcttgacattgaacggtgaagatgagtgcaatgttgcacagtggttaagagggctggctctgaggtcagcctgcctgggcctgttttccaactctccaatttaacagtatatgctttgcaaagttatttcaagaattaaatcaaatgatacatgtaaaatacctagaattgtgcccgcaacattagaagagctcaaaaagatttctacagagaaccagaaaggtttaagcattgtggaagtactcgtaatatagatttgactttcttagcgactgggggaacatgttctctgtgctccaatgtcctggtagaccctgatcttggcaggaccacgtggggcgccagagctctttcagggagttggttctcctctccttcctcagggttcagctcagatctcatttccctccatagacagggcctgcgactgctctcccagtgaccaatgggcccctcacatatctttagcaaaactttttcgccgggcgcggtggctcacgcctgtaatcccagcactttgggaggccgaggtgggtggatcacaaggtcaggagatcgagaccatcctggctcacacggtgaaactccctctctactaaaaatacaaaaaattagccaggggtagtagcgggcgcctgtagtcccagctactcgggaggctgaggcaggagaatggcgtgaacccgggaggcggagctggcagtgagccgagatcgcgccactgcactccagcctgggtgacagagcgagactccgtctcaaaaaaacaaaaaaacaaacaaaaaaaaacctgtttgacgttggactaggaacatctgctcagtctgccctcagcctatgagaaccatttcctttttccgtttcctcgtttcccatctttatcttcccgagttcatgcacacacgtgccgctttgaggctgtctcagtcaccttcgtagatcatccctctcactcccacccatgcccagcgcccagcacaacacctggcaaagaagcgtgcagcacggtgtgattgttctgtcggcaaagaataacagggcacatgttcagcttgtgtttctgttgttgactgtaatcgctttggggaattatctttattgtatccattactgtaatatagtacgatgaacaagaatttcaagaagactgttggcatttgagaatttttaatgggaatgaagttctctaaagccatctaactgacccatctctaggttttcttttttaatttgatcctacaagctgctgtcagatatatcttcctgaaatgctatatattcattttttattgtgctatataattcacttgcaaaagaaacatcaaagtcttcacagtctaaagttcataactactctcaaattttatttccagcttaaatatctattaacttcattggataaactttctactgtaggtaaattgctttccttcctgtttcctgaataagtcttctattttcccttaacaacgtgtagcctacgttaaaattctaataataactaacatttattgagtgattactatgtcccaagccctattctatgtgttttatatgtgttatcacatttccatttcatagtaaccctatgatatacatactatttttccatcagggaattcaggtataaaaagatcaggtcacatctttctagaagcagaggatcagtttacataggataatcccagactgcactgcaccataccctctaccctctgcttctccttcctctccacctattcaagtccagttttccattcaagaaggctctgccttcttcataaaacctccctttcttctatctaattggaagtaatttgtctcttctcttgtaagttttgatattcaccagcaactactttgagacaactcttattgggctattagttaaatcttttttcttccttacttttcccaattatttcttctcatctctcttttttatgtatttatttgagactgagtttcactcttgttgcccaggctggagtgcaatggagttttactcttgccgcccaggctggagtacaataatgcaatctcggttcactgcaacctctgcctccccagttcaagtgatcctcctgccttagcctcacgagtagctgggtttataggcacccacttgtatttttagtagagacggggtttcatcacattggccagactggtcttgaactcctgacctcaggtgatccaccccccttggcctcccaaagtgctgggattacatgcatgagccaccatgcccgctatcatctctcttattaatttgaagtaatttagacatatatatctttatatcacctgtattgccttgcacattacaaggtttcagcaaatgcttgttgattaggtttgattttgctcaaatgtttatctttcacaataggattacaagcaggaagttaatggatagatgcactgaatagcatcctctatttaggacagcaacacctggttatatttaactggcatgcttatgcacttgagccatgctttatgtaggaacttatgctactgactaataggtcacatatttgaatcccctgtggtttccaatgacctggattttacaggttggctgattggggcttgggaccactgtgtatccccaagaagccgagcagagctgcctgcctgtatgtaggtgaatctgaatgcaaatacactttgaatgagttctagttattgcccaatataattttttttctaattttggtttaaaagttcaagaaaagcaaagaacctattagatggtatctgtgatctgtgtaggagtctagtctagtctttgggtaattagtctttgggattcctcttataatggaaggcattattgttagtattaaatacggtggtgggcaatatatccatgcaacaaacctacacatgtaccccctacatctaaaattaaaaatatgtgcatggggctgaggcaggagaatcgcttgaacctgggaggcggaggttgcagtgagccaagattgtgccattgcgctccagcctgggcaacaagagcaaaaatctgtccatatatatatatatacacacacacacacacacagacacacacacagacacacacatatatatacacacacacatatacatatatatgtgtgtatatatatgtatatacacgcatatttatacaacatataacatatatattatatatgtatatatgtgtggtggtccaggattcaccagaatgttggagtgccctgagtccagatttcttcaacctctgtctaccttttctcaacttaacccatccaatccatcatctctttggctctgtgaagtgtccctaatggacatccttttgccacatccattgatgtttatttttcctctagggcagtgtagcagtgtacagaacccttctttcctttcctataagaaggaaagggaagcagattacttttttttcttaaataagcgtgctctcccactacttacaaaatatagaaaaagtacacagttacaatgttcaaggtacaaacaaataattcaattttgtttacagaaaacaagaaactttaaattgttgttaatccattcgatattaattcagtcaagagcagagcctctgaatggcaatttccacattactgtgatacttgttcatacctcattaattatctgaatacctagtttgaaagttggctgtgggggtggggaaacctaatgaaacaattctcgctacttgacttgtaataaatacactttctagcacgttcactgcatgtagaaatttacattttgacctaattgtattgagcattggtaggaaaacagtgagcagttgcaagtaggtgattcccgactactcctcatatttccctgtctccaatctttttttttttttgagatggagtttcgcctaggctggagtgcaatggcacaatcttggctctctgcaacctctgcctcctgggttcaactgattctcctgcctcagcctcccaagtaactgggattacaggtgcctgccaccacgcttggctattttttgtatttttagtagagacaggattttgccatgttggccatgctggtctcaaaccctgacctcaggtgatctgcctgccttggcctcccaaagtgctgggattatgggcgtgagacaccgtgcccagccccctgtctccaatctttactgaagccctttcctgtgatagacagtccctgtcagagttcctcccattccccttctcccacagacactcagacttgatttatttttccccacacatctaagaaagtcattcggtagggttcttgttgcaggtgcttttattggaatctcttttcatgcatttcttatcagaccgggagcttgtggattcatcttgttaagtcctcacagtgtgccctgcggagccactttctcctaagaggaggacaatccaacaactgtttgttaaattgactacactgctccctgcaagtttatatgatgggaaagtattacggtgcatcaaagtagaggttcatgggcctctttaagtaaaaacagacaaatcctggagattagaacgttggaaagaaatgtataccaggtgaaggcatggaagaaatgcttgtttaatgtgtattttacaatatggttattgaagcaatttaactgttctgtctttaatctggaatattggaaaaaattaccaaacattggcaggaaattattacattccaaaatttgagggaaaaatatgaaccaaaaactaactattttacacaggggctcatccttgaaacgtggtacctgaagccaactaagtataggcaggacttagagggctgtacaacagaaccacagtattgaaccacttcattatctttctggattgaaaagtagtacgcagttgcactctcgaaaaagtaatctttaagacttcttgtacagtaactaaaaattaatctgaagaaaggccagtgttaaagatctagctcatatggctgagtgcggtggctcatgcctgtaatcctagcactctgggaggctgaggtgggcggattgtctaagctcaggagttcaagaccagcctgggcaacacgctgaaaccccatctctactaaagtacaaaaaattagccaggtgtggtggcacgtgcctgtattcccagctacctgggaggctgaggcatgagaattgcttgaacatgagaggcagagattgcagtgagccaagatcacaccactgcactccagccccagtgacagagcaagactccaacttaaaaaaaaagaaaagatccagatcatattattccagggtattattattcagagttctcctgagaaacggaaccagtaggaaacatgaatagataaatgagatttattatgggaattggctcatgtgattatggatgccaagaagtcccatgatctgctctctgccaggaaagccagtggtgcaattcagtccaaatcagaagggctgagaacaagggcagccaatgctgtaagtcccaatcagagtccaattgaaactcaagaaccagggtgctgatgtctgagagcaggagatggatgttctagcttaagaggagggagagagaattcccctcactctatcttttgttctatttgggcccttaatggactggatgatgccttagtccattttttttgttgctataacagaatacctgagactgggtaatttataaagaacagaaatttattctcttacagtttggctgggaagtccaagattaaagcactggcatctggtgaggcctttctgcagcttcgcatgatagaaggcaaaagggcaagagagagataaactatgtgtcctctcttggcagaagagcagaagagggtgaactcactctcacaggcccccctttttttttctttttgagatggagtctggctctgtcacccaggctggagtgtgatctgggctcactgcaacctccaactcccaggttcaagtgattctcctgactcagcctcctgagtagctattacaggcacccaccaccatgcctggctaatttttgtactgttagtagagatgggggtttcaccatgttggccaggctggtctcgaactcctgacctaaagtgatccacccaccttggcctcccaaagtgttaggattacaggcatgagccaccacacacggcctcacaggcctctgtttatagtggtattagttccttcatgagggcagagtcctcacgatctaaacacctcccattaggccccaccttccaacactattgcattggaattatttccaacacgtgacttttggggagcacgttcagaccatagcaatgcccacggtgaaggtgatcttctttactcagtccactgattcaaatgctaatatcttttagaaataccctaacagacatatccagaaataatgtttaccagctatctggacatctcttaacccagtcaggttgacacataaaatttaccatcatgcaggggaatcagagttcctccaactctggggcctgcggggacctgagaggactcttgggttctccttgtcttgtgctccttggcatggcctggggtgagtgataagagcactatattctgagaacagatacgcagggctagaacctgtagatttcattgatggccttcactattctatttttcattttcatttttcctttgacaggaaagagtagtctgcatagggatggccaattggaactaatcatttcaagtcagcattccatgggggactggtccaggatcaaccaggctccaggggactgccagaaacatgccttcagcattatcctcctttcttaacaggctgatgataacagaagcctctttgagtttggaaagtgacttggaaacgttctgctcaggatatgcttttatcatctgcacaacacgaaggatgccctgtcataacccttgataatgcaggatcccctcttctctgaatcagagagtcctgactcatgttacagggctagcaaatggccgaggagctctgcctggggaagacaaaataacataacctgagaccactctttccttttccatattcaaagtgctctcctccatctaaagggatgttttgcaaattaataaatagttacaaataacgtaggaatgaaaaaatctttgtcctgggctgatacaatggagatatgtacaatagctaagggaaattgtaaccccactctgacttttccaatcaccaaaaaaaaaaaaaaaaaaaaaaaagggagttgttagatgtttactattctatattatagatggctttaaaaaaacaagtgaaagctaaatttagcaaatttttgaagtcagaaggacccattaaggaagtgtacaaaaggccatgtgagattctgctttggatatttgccaaagggaagtggcaacaacagagaagtggcattgagtcttaggtcaatattctcccccagagttagtatataagctccacccccagcagaaagaggcatcgtatctccctcacctctcctgagtcctctcttctcacttcacctgagatttctctactgacgccatgggttgctgtggttgtggtggctgcggtggccgctgcagtggtggctgtggtggtggctgtggtggtggctgcggtggtggctgcggtggtggctgtggtggctgtggtggtggctgtggcagctacaccacctgcaggtagtaccgggtgggctgctgctccagctgctgcccctgctgccgcggctgctgtgggggctgctgcagcacacctgtgatctgctgctgccgccgcacctgccgctcatgtggctgcggctgtgggaagagctgttgccagcagaagtgctgctgccagaagcaatgctgctgttaggtgggctggcctggcctccgtcctgtggcaggatatgctggggactttccttcaccccattcacctgccttacccatcctctgggtatcctagcacttatgctcttggactgtaactttgctcctgtattctgggttcgtgtattttctgctttgggtgtttccagtctgcctacgtgaaaagtttcctctctaatatcaagcagccaaaacaaagacacaaggacaacctacctcttcaggaagagtccacatcactgagctcaatcaaagaggatcatgattcccaacagactttttgatgtatatgatcatttcatttccattagtgtgcttttctctgctccttttctatcttgtattcctatttgtcaatagctactttctaaatttcctaataaaataaaaatatattattaaaagtttatctttgcattttttttttggtttgaacatatctcacattctagaaaatcttaatctctcttagaaagcctttggtggatgcgcagtgatcgtggagcaagttaaagaccctgagagtagcttcctgcctctgttgtttgtgccctctagttaccaaacagaatacttgaatgtccagcttctctctacagttcgtattcaattttgagatgtgaggttcctttaaaaatagacaagctgggccaggcgcagtggctcacatctgtaatcctagcactttgggaggtcgaggcgggcagatcacctgaggttgggagttcaagaccagcctggccaacatggcaaaaccccatctctactaaaaatacaaaaaaattagccgggcgtggtggcgcacacctgtaatcccagctactcaggaggctgaggcaggagaatcgcttgaactctggagacagaggttgtagtgagccgagattgtgctactgcactccagcctgggccacagagcgagactctgtaaaaaaaaaaaaaaaaaaaaaaaaaaagacaagcttcctgaatgcattcaaaatcctgttttatttacaaagaactaattcaaacaaattctcagaaacacacctattttcaaaatgcaggtgattacatttgctttagttttccatctgctggggccatttactccttgcctggagggcagagtcccatcctttcttagaagcctaatttttaccaccccccaccacaccataagttcagccaacagtgcacatttagaactgtggtattatcgatttcactttcacatttccccaaccacagaattaatgccatcaggttgtactgaatgtgtaggcattgatgaacattggatttgggatttatcttagccctcctggatttcttgtatccaccttcggctccacttcttattttcaagtcaattgctatttgcttttctgtctaaattaatttaactgtgattggagtattgttaaggcttatggtttctttctaattcatttcagatattacttaataacaaactgtgatttaagtttttgttcatttcttctatttttttttttgaattcataagcctaaggggccttgagattagaataatctaatctgtgtccttttgccaggcgagtgagtccatttctgatagaaaaaccatttttgtgtgtataggatctatggtgttttttatatctagagagaaacgtagataataattagataatcctcaataatcatattcacttggaaggtataaattgaaaggcaaatgatgttttatgactcagactatgagtagtctataaaagcattaacaatttttagaagagacttctttctgtcgaccaatgctcatcaagagactcctagatataggctgggcctggtggctcacacctgtaatcccagcactttgggaggctgaggcgggcggatcacttgaagtcaagagtttgagaccagcctggccaacatggtgaaacctcatctctactaaaaatataaaaattggccagtcatggtggcacgtgcctttaatcccagctacttgggaggctgaggcacaagaatcacttgaacccaggaggtggaggttgcagtgagctgagatcacgccgctgcagtccagcctgggcaatggagcgagactctgtctcaaaaaaataaaataaaataaagaaactcctagatataaaggcaggtttaagggggtaagaccagttcagagatggagcaagtcctgctgtggactgtctttgggatgggatgcattgtgcacaaagaattataatcctaggcaaagagtggtatttgccatggtatccctgtcagaggtgggaagctagttcccctgaaaccatctagaatggctccagagcaccgaatcttgtggcttcttgttctctgtggacttttcattacatgctccctccctcacacttggtctgtttagggcagtgctggagagagtttcggctgaagcctctgcagttggatggcagaggccatggcccgcagggtgaatgaaggtcagcccgcatgtctgtacggtaagtttcctcatccctgggtcccaaggctctagtttctcagatggacttaatactgaaaaaagaaaaaaagatagtcagaatttaaagaagatatttctgtagttcgattgtgcccaacaaattgttttcatttttcaatctgctagtattctcacttgctttgcaaatccctataagccctgcctataaattcccctacagtaggggatagttgactacatttgtgctaattattcagacagcctaaagcaagactccaactcacaattggattacagggaggtacctacagccactcctctgcgggggtgagatgcagacaggtgcccccagtgcactgcattgtaagttttgcgcatctctcccaggtgagccccagcgtggtatgtttagcccctgccacaggttcacctccctgtcctcccctgactgagacccagtaacattcagatgcactgatggacacccctgcacctcttgctcatatattccaccctgacacccgtgagcaagcctatgggtcctttctccctgtctgcctggctgagaccactcccccggtgctgcctcccatgtgaccccctcttggcatgcagtgactccatctctttaggacctgtgatgggaatacactgttttcctgaacctatcctttgtctcttctttttatttatttatttatttaatttttgagataaagtctcactctgttgcccagtggcacgatcttggctcactgcaacctccacctcacgggttcaagtaattctctgtctcagcttcccgagtagttgggactacaggcacatgccactgtgcccagctaatttttgtatatatatttttagtagagttggggtttcaccatattggtcaggctggtcttgaactactgacctcaggtgatccaaccacctcggcctcacaaagtgctacgattacaagcatgagccaccgtgcccagccgcctttgcctcttcttgtggccgcgcctgacagaccatctgactatctcataatatatgtacatatatacacacacaacacaaaccccataccaggccacctgggttcttttttcacaaatctatgtcaacatgagtattgagacccagcaaatcctggcagacagccacatcttctatttacgctgactggaaacaaactcacattttcagcgagtgggacaggaggagcaagtgcctaagaagtgttgggtcttggtggctggaaaaaccacatgtcccagaattctgcccattaggttggtcaacattactgggaaaagcgacttgaggggtcctccctcagtggggaaaagcggatgccacttgccttagcgtaagatggatgaactggcacttctctcctgaccccgctcttccagctgagaaccatcacaagggagggggcagttctacaggtgaagcctgggagggaagaatgagtgagagggtggagccccagaggtaattcctaaaggctgagagtaagtaagggcctttgggtagcctgagggtattagaggctcagggctgttggagctggaaagggaatagagacagagccagatgagtgcccaaaaccaccttgtcaacttagacttcagagggctcatctcgcacctgcctccaaaccctctcttctgaatttcaaggtggaaggaaaactgtctttctgtgacagcatcttcccctctttggaaatcttatttgacatggttatttgactcatgttccctttggttataacattcatttggtcagttcaacctgtttaagcttctgtccagagccaaactgtgcttagagtaacaaggacacaccctaagtggtcctcgtggggctggtgcaagaaccagcttctccgggagacacacccaaggagcttggcttccctcagcccccgccccactgctcacccaagctgggattccccgctctctgccttgtttccttctcactttgctgctaaactagccacaataaatcaagaatctgaagtctgcaaagaaaaggatcagggaatctctatgaaaaattagcaaaatgggtgtttggggacattttttattgtgcatggggacactctcagtagggtgtatcattattttgattctaatgctgatagtctcacattacaactgaaagctaattttgtagtttgaagtggttgataccacagacttccatgatacctaacatggctaagagccaaatttcatcattgcccaaaagtggtcaggctcctgaatgatcatatgaccatttggagtctgaacaggtatttatgagtccagacttctgtttctaagactctatcaagagagagatttggggaaagttttggtttatgataatgaagtatcaggctgagtatgtgccccccaagtcccttccttctttacaaacccacagtgaattaatcatccacgaatctatgtgtctagtgtaaagaattcatctagttttttattctttgatttatcttttgggataaaactcatttttccccatggacagacagtttagagactggaaagaacaaaagagatagctctttgagaatgatttagtataatttattaagataagtgttgctttgtgtatacaaatatacccaggcagcggtaaaaacagcacagaaatgaaggcaaccttagaggcatttcaaggtctaactatcttcactccattttgttgaggtcatgacttgagttgtaatcaacatagaaggctgcatggttgttatttttgttggtgatgatgattaaatgcaggcagaatcacaaaaaaactatagaaatgtgaaatactcacgggcaggtgacaggttcaggtcatgcttgtgtcctattagtcagtggcagccagaaggggaaagcttacctacagcagttacctgcagcagctgccagaggctgagggccctacctaacagcagcattgcttctggcagcagcacttctgctggcaacagcccttcctacagccacagccacatgagcggcaggtgcggcggcagcagcagatcacaggtgtgctgcaacagcctccacagcagccgcggcagcaggggcagcagctggagcagcagcccacccggtagcacctgcaggtggtgcagctgccacagacaccaccacagccaccaccgcagccaccaccgcagccaccaccgcagccaccacagccaccaccacagccaccacaacttccacaaccacagcagcccatggtgtcagtagagaggatgcggatgaagtgaagaaggaggactcaggagaggtgaggaggtctgatgcctccttctcctgggggaggcccttatataccaactctggagacaggagagggaaggcacatgaccacttccttgttgtcatttgacttgatgtacatggaagaatccctccatctcatattgactttcctttcagacatctttgtcttcactacatttttggttttgtttatttttttcataaaactatatgccagtataagttaaaaaggcctaaaagttctagggaagcattctgggagctgacgtgtggtgaggctgtccttagtaatgacagccttctccttcttcctaagatgccctgggaatacgcgccatgtgcataggtccatgagttgttagcagggcttacaaaccccacacagcaccaggcagtccctgcactgaacaatctgagagcttctcagcgataggtacagtgatattgaaggcacagtccctgacttcaaagggcttgcaatagtaagtaacaacgcaagctgggaggtgtaaatggccacagattcaaaggtcactgccaaagtcagatgccatcatcccatttattgaccagtgaaggcactggggctgctccctccctcctcatttgaagcacatcattgtgatttgtcttctgcacaccaggtcttaatgattatttcaaaagcagaaatcaatcctcttaggagtctgcattttggtgatgtaattcttggtctggttcactgtaaactccacctcccggttttaagcgattctcctgcctcagcctcccgagtagctgggattacaggcatgtgccaccatgcctggctgatttttgtatttttagtagagacagagtttcaccatgttggccaggctggtctcgaactcctgagttcaagcaatcctcctgccttggcctcccaaagtgctgggattacaggcacgaggcactgcgcccggccaggaattcatttttgtccttgattaggtgatgtcaattgatggctgagagaaaaaagtctgtgctaaatagcctggcctgggctccctagagagcaggctcttgggctattgggagagcgcagggtgggaacatcgagggacacatggtccagaggtcagagaagcttgctgagctgaatgaaggcccagcatggggaggaaaggagtttatggctccaaggagaagcctgtggctgtggatcatggtggagtgtgagaatttgtgaccaacaagaagcctgtaaaaaaggcaagaaaaatatgagtgcaagcagggtcttctccatgcatgctgaggtagaggcttctggcgatcagtcagtgctcagcagacagcagtcagcatctctgctgcagacgagatcatcctccaactcattttgtaacaggctcgctgcccaaagcctgttttcccaacttggtaaaattgttcttcagaaatttgagcaagagaaagtgctgccacgtccctgtggctgattagagttgtttattaatgacctcaagctgtctctgtggtatatggactaaacagagcattttcaacttgtcagggagttgcttgaactggggtcgcggggacagtggagctagagagacgtgaataggtttgaagttattaacgaggcagaagcaacagaatttggtgaaagactagaaatggaactaagagaaaagaaagattcaaagataatttttaacatggattcatatcttgatggatacggagcagtggagggaacacacagttttattttggtggctagttggtgatcaggcagggagaattatgacttgagtctggagcatgtgacattggaggtgtccctgaaactccaaggggagaaggtggaatggagagtggctattgatggattttgtagtccgcaggagagtctgagctggaggcaccccatggagaaactaaccagggaatacgcatatggaaatctacacatgggtgtgaatgtcagcactctgggaggcaggacggagtgagaagggaagggagtgttgcttcaagccttatcatagacaattgtgagcggaaacaaaacagaaaaaagagtcatttactataaagatcccttcagaaatatagttggcaagtgagcatttttgcaaaaatgacatgttttatttggatgctcttatttactcttttgcatctcgggaatttccatgaaagcagggtgatttcctggagagaagccatggcagagagatggaaaagcagctggcagccaccttgggttccggcttaacccgaagtctcaaggattcaagtggtttctgagtaaatgaagatcctctcctacatgttagcatctcttggcttgcttttaatctggttttaacagagacaagtgaaaattagcaaatgttttgggtcaaatatagtccataaggatgtaaacaaggaatagtcctagataaccttatcatggaaactgcagtagcaacaacaaggaagtgaccactggtcatgtgtcctgggtcactccctcttcctttccccaagatggtacataagggtgtcccccagcagaaggaggcatcagacctcctcacctctcctgagtcctctctgctcacttcacctgagtcctctactgacaccatgggttgctgtggttgtggaagttgtggtggctgtggtggccgctgcggtggtggctgtggtggtggctgcagtggtggctgcggtggtggctgcggtggtggctgtggtggtggctgtggcagctgcaccacctgcaggtgctaccgggtgggctgctgctccagctgctgcccctgctgccgcggctgctgtggaggctgctgcagcactcccgtgatctgctgctgccgccgcacctgcggctcgtgtggctgtggctatgggaagggctgttgccaacagaaatgctgctgccagaagcaatgctgctgctaggcgggcccccggcctctgggcaggggctgcaggtatctgccctgtaggtaagactcccatccttcccatcctgtctggtctccccctcctctgtggtcttgaactctgttgctgtttttctttggtgtttcatgtctttccgtctgaaaagcttccaaactaataggaacgatctcatggaaaaatatgagaacagcacagcagctgtgaaactgtccaggtcactgacctcagggaaatgaaatcacaactcctcgtgtttggtctgatggacatgctcatggctatgcagctccgtcttagttccacttttcccatcggcatgcgatgcttcttttgtttctttgcttttgtgttcttagttatcacataacattgtccaaatttcctaacaaaataaactaagtgcccataaaaacttctctttttgcctttcttccacttgatcacactgaattctggtttgtctgttcagaaactggagagatgttttatcttttttatcttggaacaaagcctttgaaacacttgtgccctggctcatccctgtaatcccatcactttaggaggccaaggcaggagagtccaggagttcaagaccaacctgggcaacatggtgagttcccccgtctctacaaaaaatacaaaaattagccaggtgtggtggtgcgtgcctgtagtctcagctactcgggaggctggggcaggaggatcacttgagcctaggaggttgaggctgcagtgagccgagatcatgccactgcactacagtctgggggacccagcaagaccctgacacacacacacacacacacacacacacacacacactaaacaataaccaaaaaaaaaaaaaaaggaaaaagatgaaaaacacttgctatggcagcaatgcagcaaaggatcatgtaagaagctgtggccgggcctctggggaccagccttgctcagtgacacattatgttgcctcagaacaagcctgcagtgtgtcttcctccctggagatccagggtccctgtttttgtttttgtttttttttgagatagagtctcactctgctcctcaggctggagtgtagtggcgtgatctcggctcactgcaacctctgcctcccgggttcaagtgattatcctgcctcagcctcctgagtagctgggactataggcatgagccaccacgcccagctgatttttgtatttttagtacagacaaggtttcgccatgctggccagactggtctcgaactactgacctcaagtgatccacccgcctcagcctcccaaggtgctgggattataggcatgagccacaggacccggcctggggcccctgttttattgatgtaagacgacacagcccttcagtgatagacccacatgccaagctcaggtgttgcaatcaagaacaaatatggaatttaatggtggggtaagctcagctgggtttcgctgggtttcgttcattcatatgtttcatattcttctttcttcttcctccctttctcctgtgtgtgaggttttcttcttttcctttttttccatacactgcaacatttcgtggaagacatttgaaaccttttatttatttatttattttgagacagagtcttgctttgtcgctcaggctggagtgcaatggcgtgatcttggctcactgcaacctccgcctcccagggtcaagcgattctcctgcctcagcctcctgagtagctgggattagaggcgcctgcccccgtacctggctaatatttgttgaaacattttaaaaccaaatacattcgattgtggaaaaattctcccagtgacaccgtcttctttactacctttagtaaaagcaagaaatgaaatcagggcctaataaaagaaagccggtgggaagggggttttcaaacttctttgaaggaggaagtctttttttcagtgcttcaatttaacgaagagcatgttgctctttcctttcccttccttttttcttgttgattattttctctagcttccacactttttctgactgttgagattctatggttctgtttgctgaagagacttcaggctaaggagatttgggatcaagatggtttcatgtgttcacacattgatgcggcctctgctcaaaacaggaaaaagaaagtttgtttttgtgttatatacacaggatagatatgtgtatataacatataaaaataaaataacaacatagctgaactcaaaaacaagacatctatctctgtggatcacagactgaaaatataaaatgcagggctggagctgtgggcttgctgggttctgggtcacaggcatgacgtgcgtaggatacaagagaggccaaatacctcatgagagtgggggatcagagccagtctcacttttgaagataggtgtcagagtggggccaccttcgtcttggaataaacctgctgtccttgctgccccaggctgtggattctgaactgctaaccccttataccaggtgtccccaaacaccaggccacggaccaggactcacagcaggaggtgagcggtgggcaagtgagcgaagcttcatctgtatttacacctctccccatcgttcacattaccatcacattaccacccaagctccgcctcctgtcagatcagcagccacagcattagcttctcataggagcacaaaccctattgtgaactccgcatgtgagggatctaggttgtacataccttatgagaatccaatgcctgttgatcggtcactgtctctcatcacccccagatgggaccatctatttgcaggaaaacaagctcagggctcccactgattctacattatggtgagttgtacaattatttcatgatatattacattgtaataataatagaaataaaatgcacaataagggtaatgtgcttgaatcatcctgaaaccatctccccacttcccatggaaaaactgtcttccacaaaaccagtccctgatgccaaaaagttggggaccactgccttagagagactggaggatacagacacagtctttttttttttttgagacagagtctcactctgtcacccaggctggagtgcagtggtgggatctcagctcactgcaacctccgcttctcgaattcaagcgattctcctgtctcagcctcctgagtagctgggattacaggtgcctgccaccacacctgactaattttttcttcttcttatttttagtagagacggggtttcaccatgttggacaggctggtctcgaactcctgatctctggtcatctgcctgcctcggcctcccaaagtgttggaattacaaacatgagccaacacgcccagcccagacacagtcttaggctacagattgacctaaatcctctgcaggcttgagaataatctattattatccccattagcactacgggatggggcctggggatgggacaggaaaagacaactgcaaaactgctagacaggtagaggcaagtggtgctgggtcagggtgtgtgtgtgattgggatgaggagagaaagtgagagcaatggaaacaaaaacaccttgcactgaaaattatgacactgacggacttcatctgcctcacatggcttcctgagcccggcttcttgatcatgatgaatctcaggcttctgatgccccttgctgcctgcctataagtaatcaacctgcttcatgtcattcattgtgtgtgtgggtgtgagcctccctggactcagaaaaattggtaatcagtgcacagtgaatttgctccccaaaactgacacagcaggcggggtccagtctgacagaatcatggcttattggtgaagcagggggcaaaaccccctagtacctggttgaaggtggagacgtcagcctgggggcacaagagctagatggtactgctggacatgttatgggtcaggaggggttatatgtgggactcctggatgtgagtgagctggacatggactgaggctgccaggaaggcacgtggaaacgagattgtggcgcatggccctgaatgttgggcactgatgtgatccttcattcctggggctgcagagctcaggaagagaatgctcagatggaccctgaggcacctgagaaggatgtggtcctgaggcatctgagcaggaaccaaccatgcaatgcaggctgccacagaagaggagactctctagctaaaggacaggtatggagatggttcagagatggcttatgcagcctggttgatgtgtttgtttgataaaaggacattgcagacccaatgtctcaggctaaatggtgtggttagattgaggccaaggtctctgggtctccactggaggtcaacggcgctatactccagtccatacagaaagggaaagaaggggaattcagacttttctggggttcttggatattggaatccatatggcaatatttccaggtccccttaggggaataattagcctggtgacattgggatgtttgaggacaaacatggtgacctgtggtgcttatctgcttccaggtggggccctcaggccattctgggtgctggtgaccatggttcctaccacttcatgtattacaagcactaacataggctgcttgtggcacagaccatcactgtggcctgagggggtacagccccctacagctaagaatttgagctgtaatagtggaacatatccactgctgctggctacctgagctcccaagcctgatgggttattcaacaaattagtgctacaaactaagtgaaagaaagtacattacttgtttaaatctacatcaggcagggttcaacctgagatgcagaacaaataggagatataaattaagaaactaatttaaaaaagttggctcccatggtgatggaggctggtaaggcagtccaaaattcacaggacaggccatcagaatgggtgggctaggactcacaggcacaggctgaagcccctgaacacagaccaaatctcccttttcagaggaacttcagcactgctggtaaggcctttcccctgattgaatcaggtctacccagattattgaatcagatcctctaggactgtatttaaaatcaactgattatggactttaatcacatctgtaaaacactagcatgaccgaggttagtgctcttagatggtcccactcttttggtttccatgttgttttgggggtagacttgaatgtgttgaaactgtattttgggtttcatttgctcactgaggtcatgtagatggtttgtttcaatctgttccattaaataatttgattgtgcccagttcactggctgatgggtgtggtttcaatggggctcatgatggcccagtctttcatggcacccagtttcatcaattatcaattcatggccaatctagtttcatcaatgacccaaccatttaccctttccccccatgggttaatttgaatcctgtatcatataatttaataatatttattaatttaatatttaatatttaataaacatttcagtttgtatttttaaaaataaggacccagaatgtagaaataaagattcagaaagactgtattacaaggtaagaagagatgcaaatttaaatatgatcatcatggcaggcctcattgaaaaggagacatttgaacaaagacttaaaggaagtgagtcacagagcaatatctgggtgaaagagcattccagggaaaggaagctaaagtccaaagatggtttctgaaatatttaaagactctcaaggagcccagtgtagctgaactgagtgagaggaagaatagtagaaaatgagaccagacaggtaaaggagagggcaggaatatcaggtggggtttgcaggttatcctcaggcctgtggtttttttactgtgtatgaactgaaaagccattggagagttcagagcagaaaagtgacatgatctcatgtatattgtatgaagagctctgactgctattttgaggctaggttgaggagggcaaaggattaaagcagagatgagttagaaggtcttgcaataatccatgtagaagagatagtgacaactcagaacagagtggtagccatggaggtgatgagaagcaactatctcctagaattactttgaaaataaagaatactttttgacacattatatctgagatgagagagaacaggaggagtcaaggagtcaagtgaacaggaggacttcaagattttgggcctaagcaacttgaaagatggggaaaaactgtagatagcaccgttttgagcaagatgacgattccatctggagcatgctgaattgcaggtgtctactagacatcccaatggaaatgctgagtagtaggcagctggacacagtggtctgaagttcagggggagaagtcaaggtctgagctatcatttttttggtgtcatcggtatacaaatatagagattgcatgaaaccatcaaagactatatagagaaaagaatttgtaagcacttaaccttaggagctccagggttaaaagcctctgaaaaaagaggagaggccagcaaaggagacggaaaggagcatctagtgaagaaagagtaaaattaaaaatgcatggtgccctggaagcgagtatggaactgtttcaaggaggagagagtgataatggtgacaatgctaccaaaggatgaagtgagatgcgtgaagtgaggtgagcactgatgaatgactgctggatcgacatcggtgatctggacaggaatggttttggcgaagtattgaagatgaaagatggatatcaatgggtttaagaaaaagtgtgaagagaggaattagagcgacaggaagtagacaacacttccataaatttttgccttaaagggaagcaaagaaatgacttaatttcacaaatataatgttaagcaaaacaatctatgtaagaatgcccaactatattcatataaaatatttttatgtatgtgtatgggtataaacacatatacatatacacacattttagagacagggtcttgctctgttgcccaggctgcgtgaaccctatagtgaattgtgcgtgtgagggatctaggttgcacactccttatgacaaccatagctcattgcagccttgaactcctaggctcaagtgatcctcctgtctcagcctcccaactagctaggactatagtggtggtgatgaagtggtcttccctaggtacaggcagtaaggaggagaattacctgtagagaatttaaaagcaatagtaaaactgatgaagggcctgtctgcattttattgttgccatgtaccagcaattctaaataatgatggtgataaagtatgctccccaccaggtgggctgctacccctcccggcttggcatgccaccctggcagtgtctaattaataacttttaccttctctagaacagtacaaaaatctttggttttgaacattcttctaatttctaatttattattgtccaggatgttagtcttatgtttttcaaaactcttcaagatataaaacgttactactgtttgacatggccagtgttgagatttactcacgtgttttctgtttcacactccctcttgcatcatatgccttccttttggggtaattttccttctttcttgaatgcatcctttagaaattgcttttggaagggtctgttacactcttacaaagcgagtgtgcctcactcactccatttctctttgtctgaaaatgtctttattttattctcattttttgaaatgtttttctctttgtatacaaccctaagctggcaattattttccccagcactttaaaggcattattccacgatctttctggcttcccttgtgtgccattgagaagtcatttgtcaatctaattatcatttttctgtaggtgatgctctttttatttttctgactgtttataagatttctttttctttggtattctgcagtttcactacggtgtgtttagacttgaatttcttttcatttactcttttggagagctgttaggcttcctaaatctaattcatgcctttcatctcatctgcaaaattctccatggatatttctttgtctgtctctcacttctatcttattatctccccaaggaacgtcaaatagacattcgtgaaactttctcactctaacctccatgtgtgttaattttttccactttcatctctgtgctatattctaaatgagttcttacagtttaatattttcttctttattgctcttaacttctacatagctcttaacttgtttattaagcttctattcttgactacagtaatgcatccttaataacagggatatttcttgagaaatgcattgccaggtgattttgtcattgtgcaaacatcatatggtatacttatacaaacctagatggcatagcatactacatacttaggctaaatggcatagcctattgttcctaggctgtaaacttgtacagcatgttactgtactgaatgctgtagacaattgtaacacaatggtaagcatttgtgtatctaaacgtatttacacatagaaaagatacagtaaaaatacacataagagataaaacatggtacacccatatagggcacttacatgagtggagcttcagggctggaagttgctctttcagggtcttgatccatcacccaggctggagtgcagtggtgcgatctcgactcactgcaacctccacctcccaggttcaagtgattctcctgcctcagcctctgagtagctgggattacaggcacctgccaccatggccggctaagttttgtattatttttttttagtagtgacagggtttcaccacattggccatgctggtctcaaactcctgacctccggtgatctgcccgcctcggcctcccaaagtgttgggtttacaggcgtgagccaccgcacctggccatttattataattatcaagtattatatactgtacgtaattgcatgtgctagacttttataagactggcagtgcagtaggtttgtttacaccggcatcaccacaaactcatgagtaatgctttgtgatacaacatcacgatggctatgatgtcactgggtggtagggatttttcagttccactacaatcttatgggaccactgtcctatatgccaggggttctcaacctccagtccaagggcctgtaccagggtccatggcctgttaggaaccaagccaccaccaggaggtgagtggcaggtgtgcaagagaagcttcatctgtatttacagccactccccattgctcacattactgcctgagctctgcttcctgtcagattagtgatggcatgaaattctcataggagcgggaaccctattgtgaactgtgcatgcgagggatctaggttgtgcactccttatgagaatctaatgccttatgatctgtcactgtctcccaggaaaacaaactcagggctcccaccgattctacattatggtgagttgtataattacttcattatatattacaatgcaataataatagaaataaaatgtacaaaaatataatgcacttgaaaccatcctgaaaccatccccctgccctggtttgtggaaaaattgtcttccacaaaaccagtccctggtgtcaaaaagggtggggactgctgatacacatggtccatcattaaccgaaacatagttatgcttcccatgactgtagttctattttttccccaaattcatgattattttgttctattcttatgatgttctatttatgtaccttgttctattcttatgatgttattttcctccatgtgtaaacatattaaacattttattttatattctaatactgataattcttctacgtcaaatctttgttagtctgatttcgctatttattacttcagttggcttgttcatgaaactttatatccttgtttgattctgaatttttaaaaatcataatctcctattcgatggaattttatttgtggcaatattttgattcctgtattgaggtacattctttcagaaaccatttgcctttgttacatataggtgcctggagacactgccaatcaggaccactttaaactaaattttcagcttgaaaaaaaaagtttagcctataggaataggactccagaattacgtaagtgctggtttataaaggcaaatgctgagggtatattctccagactccacccagattagtcttcttcattagggattttccccctgtcattttgtattttgttctgattcaccattcactgaggatgtggccctttggggttgtcactaaaaccaaaactctaggttctgggggaaccagcagatgccttgagcacaccgcagagtcaatgcttccttagctatctggcttcctgttcttgctttggcatctgaggatttttcttactttcttaccagtttagccgtttatttttttttaattaaatttatatccacgaaatccaagggttttgtggtgtaaagatttttctgatatccagtctgttgttgcctaatgaaagtaagcctttcttactttaatattttttaaaaagtctgttgcctttaataaataagcttttcttaataaaaaaatttaaaaacatttactgaaatttgtttaaatttcaaacaaccctaaagtccccatcttagtccattttctgttgactgagaatacctgagactaaaacatttgtttaaaaaagaagcttatttagctcacagttctggaagctgggaggtccaagatcaggtggcagcatctggctggcttttggcgagggctttgctttgtgctgtcataacatggtggagaaggaaggggaagcgcatgtttagagaccaaacatgagaggcagccttgcttataacaattcactcgagtggtaactaatccattcccaagcaggcaagagcttactttcaggagaaaggcatcgatccctcttgaatgacctaatcacctcttaaagacaccaattctcaacactgccacattagggaccaagcctcagcacgagatttggtgtcgtattccagccatggcacccctttctcctttaagctcaacccctcaatcccattcctcctaaggtaattgcatggagaccatctccattaggatagaaaagtaagaaaacaaggcaacgtctaaatgatcaggacccaaactcactcaaaatccttttaaggagtttattttgtttgataatgaaaatgtgggccacgtacgatggctcatgcctataattggagcactttgggaggccgaggtgggtgtatcacctgaggtcaggagttcgagaccagcctggccaacatggcgaaaccctgcctctactaaaaatacaaaaattagccgggtgtggttgcatgtgcctgtaatcccagctactcgggaggtggaggtggcagtgagccgagattgcactccagcctaggcgacaaagcaagactgtttcaaaaaagaaaagaaaagaaaagaaagaaaatctggcctttgacttcagctgtcctttgagttaagacaccaaaaaatagtttatgaaatagtggaacctaagcctgatggaccacacacaacctgcatttgagtccatgaatatgaagtgagaacactcatctgggctatctggaatgtcaaatagcacatactccacacacactgaaaaatatccattttgatgtatgtgagcctattccaaatccagacgaatccccatttcatgcacttaaaataatatcatcactgtgtttgacgtttcgggaggtaatctttctacgcagagtgcccctctccttactaatccctttggggttacaactaaaattccattttcatgattctaacttttatttaattaaaggtagattaaagtaccagttatcctagctggttaatctaatggagggtgcaatcagaggccatcagctggtcccagagtggctgagtgcaacggctgctggctgtgagcactgggcagggtcactgcgttatttcccagtgaggaaaatgaaggcagaggagcacagcagctgcggtttctgtgatatcaaaggggcacttggcgccactggactttcccttttcttttttgtgtgtactccccaaacttggtgataagagttgcttttcatgtcttaagcctcaagaccatccagggaggaggagggtgaaggcaaagaaattagtgaatgacggaggagtcttactgtcaactcccttgatcaagaagaaatgggcacttactcagtctgtttctcattccaaaagttatcgctgcaaattggggggtgaaagtggggaagtggggggcgatgagagggatgaagaggtctggtaacaggtaaccaagaggtgggtgttctggtgcaaaacttgtggggtgttattacttcatttacctaattaaaggcttattttaaaaaattaaccttatttgagatgttgtatggttatttacccaccccctccaaatccctcttatattcaaacttgtgaatttcatctatttttggaaacaagattctgccagaaaatcattttatatcattagtcaaccacagtacagtcttgtgccttcagtaaagacaattatatctaccactctctccataaccggcttggtgattattactaaattactcttcagctttttctagttgagataaaaatgcttcttttagctttcctcatgggcctcttcccctaatctttcagtcatcttcaaagatgtgtcttgaagcccctttttaagatcttcataaatccattaagacctttgaaactccataaatagcttatgttgtgacagcagtttgagagatgctgggaaaatgaaggaatcgcttctggaagtctcgatgcatcctactctttgctgaatctctgtgtcagagaaaaatcctgattcagtttgtattttctactttttagattccaatttttaaaaatggcatttggcatcctattagtggaatatcatgagtgcagacagagtcaatgatgaatggacatttatgattgagatttgggagttactaatcaatgcacttccatattactggctcttaaaaacttaatgaaagcatatttaattagattcctaccaaaaatcaatttttaagaagcacagttttcaagaccagccattcataataacacctttttttctttgtatataggaatagggtttgtcttctgttatgcctttgagctgtatgtttttgctcatcctgctctgtacctgggtaaactggtctcttctttagcaattaaactttaaaatagctttccatggaagaaccgaattgaaagttgttccagcattgaggatgtcagcagagactagcagagaagatacggtagcaatacaaagattttaaaggagtgacttaaatctattcctcttggtcaagaaggtaaaaggattcggaaacattgaagtatcaggggatacaaaaggtaaagcttgaatttttctgccaaattttagatttgttttcagcttttcatgcctgtgtgaccccctgccttttgaagaaagagcaaaaggtgttgatctgccaacaaagaagacactgaaattttaaattaggttacacaaaatagtggcagaaaggagaatagaaggattaatggctcgtttttatttctagtcctattttacctaattcagttataggaattcattcatttcaacttaggatataatggatttgtcgaaaagtaagggaaatatctggagctgattaatgtaaaagtctttagaaaaggtaagtgcctcctaaccatgttgattaatgtaaatagatgttatttttttcaattaggaaaagagagagagatgtttgtttattgacaacactaaaggccaggaatagtgtggtttagaggccagcacttaacctgtgtaagaactcatgcagtaagtcttatattctccattttactcataagaaaattgagacattaagaacatattacatctttagggtttactttaaaataatttagaagcaggggtgagaaatttcattgggagtggagtacagatgaaacaagattggccacaaattgatatttgttaaagtttgtttcattatactattttttcaaaatgttgtatgtatttgaagttttccaaaatgaaaaaattttaacatgtcactataaacatcaagattcaaaaccagattttgctgatttcaagcttgttctctcgctaacagatgatacacagaataatttctgaaaaactgaagagcaatttgccaaccagatagtaaattaggaatttacattttattttagaaagtaatgcttacacgtcgaatagcctcaaacaagcatattatattgaacaagtgtgtagtactgaatctacatgaatcttagtgttaagatttattaaatggaagcaatcctttcctctgttgaacaagtgcgactacaaagtagatttttaaaaaatgtcctggcattacttcatttaattttgtattctgaaatgatttctttttgcctttttgcttttaaacaagatagcttctaaatattttgtaggaattctcatctatttatagagaggtaagaatgacgattttgtccatgagacagagtagatttacagaatttgggaactaagctttaataagattgaactttagctagggcaaggaaaaacctttagctgtagctaatgagaaccacttccactggaatgactttatggctttaattttatgcagttctttcattccttcacctctttagtgaaaaggtcacctgtttaatgaaaaggtttcttaagaaatagaaccttaactacaccatatttctatttctcagtataaaattattctattgaagacatcatgctaaaggaaagaaactagaaataaaaggctatataaaaaataattccattgatatggcattctataatgacaaactgtatggatagaaaaccaatcagttgttgccagggacgaggggtggggagaggggattggtggcagagaaacacaagagcactgtttgggttgatgtttatcttcattgtggtggtagtcacacagctgtacatttgccctaattcatagaactgtacatacaaagtgtgaacttactgcacgtatattatttatcaataactctgatttttaaaagtataaagataaatagatatagatatatagttttgaaaacatgcctctttgtccatgagagcacagtggcccatgcacttacctgaatgtcaacaggaagccccagtccttggttgtcaaccacagtcatcgtcacgatgggttgaatcatcaaggcaatgaagggattaattccaaacgtcagggcatagtcttccatgctcagattaactccaatctgaaatctgtcattgtacaaatggaaagagttttaaaaggacacacacatgcgcattcaaatacaaaacagcgaattgtgttcttctcaaggctttggtctgctgaggaagcccaggtttctattgacagtttctttctgaaagctcttttagcagagatagactgaagaaatagacaaatgggatggtgcaatgtattttaacattccgtgggatgggatatagtacgctaagaatttaaaactagttaaacaattctaaaattaaaccaaattttcaaaatactctgcaactagaaaacattcaacattatttgagataaatatggcttagcaagtcacttttaaaatcagatgtatcaggccggtcactgtggctcaggcctgtaatcccagcactttgggaggctgaggcaggcagatcacttgaggtcaggagtttgaaaccagcttggtcaacatggtgaaaccctgtctctaccaaaaaatacaaaaattggctgggtgtggtggcacatgcctgtagtcccagctactcagaaggctaaggcaggagaatcgcttgaacctgggagacaaaggctgcagtgagctgagatcgtgtcactgcactccagcctgggagacagagggagactctgtttcaaaaaaaaaaaaaaaaaaattaagcttatcaataagtgaaaacaggtcagcatgaagaattttttacttatttaaagatttaatcactggattatttattgagttagcaatttcagagtctaatcagtgaatatttctctgcaaaatccacaaattatttcctttcatagttcattcaatctggtaattaattcattttaaataattgtactgggatgttaaatttagtcagtcaagactgacatatatagttaaagttcttccatgcaatttagctaaaacatttgtaatgtgaatctatttacaaaatgaaccaaatgaaaaatgttaactatttttatgtcccttccaaaattctttacataaaaaaacaaatacaagcattttaaaacgatgtgattcaacaaaaggcattatttccatgcaagatactaccaactaaacatagcaaaacccataaatgaccttaggtcccacgtagtgaatatgacaggtggttcaaatgggacttgtaatttcaggtctttcttgttcagctaacagtttttcccttgaacaaatgtggaactacattgatgcttttaaaacttagatgaaatcaaatggcagatttccttttagtatgcaaattatttcatgttggaatcttgatttaatccgttcagatgcctaagcagcttgacagtgatttatttggttttggataagacctctacatgtgatggattagaaaaaaacacagttctgacggtgggctgagagtggctttgaatcctaagatttttagtccaaacccccaaattatttccaagatacctgaaattacatgtaatcatactatttcaaatcttatcttgaagctccggctgggttatttcacagtggccttcacttggtcgctgtggagacattgagctaccacgcagagaacattgcctaggactagcaagttcttagaaaagtaattgttgtatttatattcttccattgggcatttggcagtaagtacagatgagcctctgggggattgtctgtaatttaaaaaatagaactaccttgaagttttattcaatcatttatatatcgtgtattacggaagtatgagattagcatttcccaatttactctataacttaaaggaaagtaatgggaacatttactaaagcataaaaaaattaggttgtgcctgtataacaatgaaattgttaaattaaaaaaatttcaggctgggctcggtggctcatgcctgtaatcccagcactttgggaggccgaggcgggcagatcacgaggtcaagagatcaagatcattctggccaacacggtgaaaccccatctctactaaaaatacaaaaattagccaggcgtggtggcacgtgcctgtagtcccacctactcgggaggctgaggcaggagaatcgcttgaacccgggaggcagaggttgcagtgagccgagatcatgccactgcactccagcctggcgacagagagagactccaccacaaaaaaaaaaaaaaaaaaaaaaaaatcaatagctcaaagttttactttcatattgcatgtatttatttttttattttttgaaggaaatactaaccaagtacctacttaaagtgagaactagaggaaacaccaggggcataacagggaacaagctagacaatgacggcacccacggagcttgagcttgcactccatcagggaataaattaggaccagataattgctttgattaattgttaattaaatttatcagtttttatgtcatgaaaaaatgcaaagtaaatatctttttatataataatcacaaattaggccaggcgcagtggctcacacatgtaatcccagcagttaagaaggcagaggcgggcggatcacttgaggtcgggcgtttgagaccagcttgaccaacatggcgaaaccaacagggcgaaaccccatctctactaaaaatacaaaattagccaggcgtggtggtgcatgcctgtaatcccagctactcaggaggcagaggcacaagaatcacttgaacccgggaggtggaggttgcagtgagctgaaatcgcaccactgcactccagcctggatgatgcagccagactccaaaaaaaaaaaaaaaaaaaaaaaaaatcacaaattattttatgtaaacttctatcatataatgattgaaatcatggatggtcaacagtcttagaatttcttctaaacctcaatactaaccctttgcatgagataaatttattctacacttgctaaatttataagttgcctagaagttggagcagtaattagatgtaaatgaacttacagagattgaattcacacatgtagaaaatgatattttgtcagtatgttgagttagatatgtaaatgatcattttatttagtgccaaagttcacacatctatttggtcaagttccctttgtttctctactgagtatgtctccagacactaaaatactaggtttattcaattcttgcccagtaattaattttaaaaatgtaacccaaattaattgtgtctgaaataatttttctcttcactaaacttactgaccatctgactgaattgacaaattagataaaagatgattgtgcaggactttggtggaaagctctgaacatattctctgagaaaaccctaacagtcagataacgagtctcattttacggcctcttagaatctcaggattctcactattcatgtggcttaacctttcaccgctttcatgtccataacaaaacattctgagcatttcttaattcatcaaaagattttgttttttctaaatatttcacatcctgacagttaattattaatatttttccaatttccctatttgtttcctcagtagaatgcaagttaacttgcatccatcagtagaatgagattaacatgcaatagaaacgcaatacggctgtgaaccaatatgttctgaaatattcaagaataatatacatttatcttttaacaacatggaagttatagtcatgaatagtaaaaataacggaaaaatcattatcatttttactaactttcaggttctccttcccaagtatagccgttgaccatgaaacgaaactgatttaggtttggctagaattattttttcctaatcaagagattgctaagtgaaaacaaaatatttagaatgaatattgggggaagatagagatttacttcctgttacagtaagaaaataacaaggtaagctaaaaatcatatttttccataaagagaaaataggcataaactgctgaaaatcaaataaaaacagaaaatctaaaagcaattgcaggctgggtgcggtggctcacgcccataatcccaacactttggggggtgggatcacctgacgggggtgggatcacctgaggtcaggagttcgagaccagcctggccaacgtagtgaaaccccatcgctactaaaaatacaaaaagtagccgggtgtggtgtctcatacctgtagtcccagctactcgggaggctgaggcaggagaattgcttgaacctgggaggtggagcttgtagtgagccgagatggtgccactgcacaccagcctgggcaacaaagtaagactgggtctcaaaaaaataaataaataggccgggcacggtggctcactcctgtaatcccagcacttcgggaggctgagacgggcgaatcatgaggtcaggagctcgagacaagcctggccaacatggtggaacaccgtctctactaaaaatacaaaaaattagttgggcgtagtggcgggtgcctgtaatcccagctacatgggaggctgaagcaggagaattgcttgaacccgggaggtggaggttgcagtgagccgagatcatgccgctgcactccagctccagcaaaagagtgagattctgtctcaaaaaaattaaataaataaaataaaaataaaataaaataaaagcaactgcaacaaaaacaaaaattgacaaatgggatctaactaaactaaagagcttctgtacagcaaaagaagctatcaacggagtaaacaggcaacctacaaaatgggagaaaatatttgcaaactatgcatccaacaaaagtctgatatccataatctataaggaatttacacaaattaatgagccaaaatcaaagaacccaattaaaaagtgggcaaaagaggccaggcatggtggctcacacctgtaatcccagcactttgggaggctgaggcaggcagattgcttgagctcaggagttccagaccagtctgggcaacatggtgaaaccctgtctctacaaaatatacaaaaatcagctgggtatggtggcatgcacctgtggtcccagctatttggaaggctgaggggggagaatcacttgaactctgggggcagaagttgcagtgaactgagaaagagatgtagttatctcccttttttcatttctgatattgataaattgtattttttccattctatgcacgagcactctctctcacatttattagacttttcaaatgactgatttggctttggtaatttttcctattgtactattttctattccattgattttattttttgttatctctaacattttcttcttttctttgagtttcatttgctgttctcttctagcttctgaagatgaatgtttaaataacttaatttgtgtcctttctttttttaaaaaataaatgcattggagactgtatgtttctctccttgcactgcttaagtgtatcctataagttgtgatttttcatattttccttgtcattcagttcaaattattttctaactccaagtataattttttgaccatgttctatctttaattataaaacatttgggtatttttaaattacaattttgctaacaattttagcttaattatggttgtcagaatactttttccatatgatttcaatcttttgatatttattgagggctactttttggcccagtccaagcctgtttttggtcactcttctatgttcacttgaaaataatctttatcctgcagtgtgtacagtttccacatatccatcactgcaactttatttgacatgtagtttcaatcttcctaatcctcactgatgttgtttgtctacttgttattgagagagctgtgttcacatttgcaactgtgagtgtggactattttatttctctaaaatttttttggcattttgcttaatacattttgaggctgtatttttcgtgcatacaaatttagaatagctttattggctgggcacggtggctcacacctgtaatcccagcactttgggaggccgaggcgggtggatcacttgaggtcaagaagtttgagaccagcttggccaacatggcgaaaccccgtctctactaaaaatacaaaaattagttgggtgtgttggcacacgcctgtaatctcagctactcgggaggccaaggcaggagaatcgcttgaacctgggaaacagaggttgcagtgagccgagatcgtgccactgcactccagcctgggtgacagagcaagactctatcaaaaaaaaaaaaaaaaaaaaaaaaaaaagaatagctttatttatctagttgttgatgaacacttttatcattataaaacgactatgaaacttataatgcaaagacaaatcactctggtgttattgcttatttcatctgatattgggatacctaaactagctttccttgtattagcatttgtacagtttatcttttcccatatttgcactttcagccttttggagaccttattttcaagaagtgtgtcttgaaagcaacataattaggttttgagttttaaaatccattcagctgacttttgtcttataattggagtaattagttcaggcacattttaatgattttgctgctatattgggttttaaatttaccatttatttgtcctgcctgatttacgttccttgttctgtttcttgtcttttgttgccttaattaagtttaaaaacactttccctcccttcattagcttgttagtactatcttattgtattattcttttagtagttaccatatatattatagcatgaatttttgacctagcagagtctaccctaaaatagtattttcaccacttctttgacaatacaaggattttgcaatactttaaatttattatttccccttccttttgtgctattaccatcataaattttaactgtacatatatttttatttatttatttttttgagatggagtcttgttctgtcgcccaggctagagtgcaatagtgggatctcggctcactgcaacatccgcctcccaggctcaagcgattatcctgcctcagcttctccagtagctgggattacaggcacctgccaccacgcccagctaatttttgtattttagtagagatggggtttcaccatgttggccaggctggtctcaaactcctgacctcaagtgatccgcccgccttggcctcccaaagtgctgagattacaggtattaaccatcgtgcccggactctacatatatttttaaaactagaaacattaggccaggtgcggtggctcacatctgtaatcccagaactttgggaggctgaggcaggtggatcacttgaggtcaggagttggagaccagcctggccaacatggtgaaactccttctctacaaaaactacaaaaaaattagccaggtatggtggtgcacacctgtcatcccagctacttgagtggctgaggctcgagaattgcttgaacctgggaggcagagcttgcagtgagctgagattgcaccacttcactccagcctgcgcgaatctgtcttaaaaatcaagatttgcttagatttacttatatgtttattctttccagtattatttttcctatattattgcaatgctaatggtgatcattttcattctgcctaaagaattccctttatatttcttttagtgtaagccacaataattttgcttaatttttttgtcttaaaaattctttattttgacttaatttttgaggaatatctttgcttagcataaaattctaggctagcagttctttacttttcacactttaaaaatattcttgggaggagggcaaaagttgaaaaactaccaattgggtaatatgctcactagctgggtgatgggatcaattgtatcccaaacctcagcctcaagcaatatacccatgtaacaaacctgcacatgtacttcctgaatctaaaccaaaaggtgcaattatttttaaaagataaaaataaaaataacaggctgggcgtggtggcttacgcctgtaatcccagcactttgggaggccaaggtgggcagatcacgaggtcaggagttcgagaccagcctggccaatatggtgaaaccccatttctactaaaaatacaaaaattagccgggcatggtggcatgcacctgtagtcccagctacttgggagtctgaggcagaagaatcgcttgaacccgggaggcagaggttgcagtgagctgagatcgtgcactgcactccagcctggacaatggagcaagactccgtctctaaataaataaataaataaatagaaataaaaattaaaatgttgtttcattgttttctggcttccagtatttctgttgaaaattcagatgtcatcattactaatactccttagaaagaaacgcatctgaccttcattttatagccaaacagactagaaaactttaaggccacagagcatgtcaaagattatgctgccagtaatgttcagccaaggaaaatattttcagatgtttatttcggattaacttggtatatagaatgaaatacattgttacacagaaaacgagaagcaacatcgaattccttgaagtgttctccaaccagcatccaccacctccttagctcatttacttcatgattaatctaaatcaaatacttcatatttttaaactactgtgtgatatagtatttagacatagttttatagaacagcttcacttctgtaacagctctcagaatatttgataagtcatttcaaaaagaaatagatacgctctgactatacaagcaggacaattgggagtgaaaactaaacttagtcaaaattagaatcgcatcttattatactgtgtcgctaaatcagacaaaataaaagcctaacaatatattactgcttaagaacttcaggtatcctcctgattaggaatcttagtcaagtcgtaagagaaagttgattcaaatgggaatatagtttcattgcctcttgtaggaagccttaggcataacattgcaaaatgctattcagaggaactggaagaataaataaacatgttttgttgcttcaggtttaggtagttaaaagaaagaaatggtaaatacttacacggctatggttataaagagcataaaacttgacttgaatatcaagagaccagcatagtgcacccaaatattagttgtgaaatgcatgggacatagagaacctccatctgctcctgagaagatcaccaagggcaactcacccggaagatcccagatgactttgatgtagccactgtgaaggctgccacggctcctaaaataaaataaaataaaataaaatgaaataaaataaaataaaaaataaactacatcttgttaatccatgtacagtaaaatagcacacggttttgttaaaatccacagttacagaagcactgaagcgttttcagactaaggtaaaaaaaaaatgctgacttattgtgaactttgaatgaaaaattgcttgatccacctctgtgaactgtacatatcattttctcttaagggttgaaatagaccaattgaatttaggctttcgtaaatcatagactggagaggacccatggagagggccatttttttctttcctcttccctttgcagatgttaaaactcaggcttagaaacctggtgtcaaataaaaagaatatatatgtgacttagataggagaggctttatttagaagaaaggctattgcaataaaaagaactctctgattgcagaaatctgcatgactcaagatcaaacagaaaaaggatttacttttatagggtaaagagggtacaagcagacataagcagaatctctgcagaggaagctggattcacagggggaaatggtcagtggcgtttgacaggaaagtatcccactgtggtcagccaattcccgtttggagctgataagggtgacacattccacatttttttgtgtttgctcagggtttggagtaagcaacatttaggggtctgtaggaaagccaggagcctgactaaagtctggtcaagacaaacagagggtaagaaatgggaaactgaatgcttggtcattggcttgaggtgcacaaggtctgcagcctaaagtttcctaatgtgtggtgcctgctcttttcccccccgccctttctgtgagcctattaccaatgccctaggaaggatggcctctctctctttgcccttgtctctcttttctctttcctttctgtaacaccatttaaaaattttcctcaagatccctggcagatgccaagcttttctctctctctctctctctctctctctctctctctctctctatatatatatatatatatatatatatatatatatatatatagagagagagagagagagagagagagagagagagagacagagagagagagacagagagacagagagagagagagagatgggatctcgctatattgaccaggctggtctcgaactcctggcctcaagcaatcctcccatcttggcctctcaaatattaggattacaggtgtgagccactatgcctggcctggtcattcccttctttatttgttccttccttccttcttttcttccttccttctttccttcatttgttaaaccagcaagtacttttgaggttctctgtggaacaacatagtggtaaattttgggtccttgctttgaaaacaatgcagcctagtggggaaattagataaataaatttaagttaataaataaataaataaatacggtatgataaagattataaaagagttctgttgggatgctgaggcgggtggatcacctgaggtcaagagttcgagaccagcctgaccaacatggtgaaaccccatctctactaaagatacaaaaattaggggggctgaggcaggagaattgcttgaacccgggaggcggaggttgtagtgagcctagatcacgccattgcactctagcctgggcgacaaagcgagactcattatctccctcaacccccacccaaaagctctgaccctaatccaaatctgatctagtggttgtcaaccaggggtatttttgccttctagcagacaggtggcaatatttgaagacagttttggttgtcacaatggggtgcatcctggcacctagtggcttacgggcatacaatgttgctgaacatcctacagagctcagaacagtgccctcgacaaagaattgcccagcccaagaggccagcagtgcagaggatgaaacagcgatccgatccctgacctaatcaaccaagtgttaggaattttcagggagggaaatgacaagaatgtgagctcaacaatgggccccgccatgttcaataaacaggtgggtgtggaacaacctaactttaaaataaacagcttcaaagtctcatttgatgtgaaagctttgttttgtcaggaaaatacatgcagattgttgggctaacttcaaagacagctctggggcctgccctttgtaccctggagtattaatgcctgtgtcagcccacctctccctccttgcaccacactgcctttggaagagtgttttaaagctcacaaagtatattctgggagagatgaggagtgcctggacaagcatctcaaactctccaaactactgtagcttctgagccaggaggaaggttttgcccaagcggaaggcccaggatggaccttgaagggtgaacccaggcgtgggagctgaaaccctcagtaccccagagaccttcccaagatttctcttggttgctcagtcttcttgcctttttcctgtcagacaacacaaatatcagaaattcatctttagataaggaggaaggagacaccagccaactcaagggacagcaatgatactcaggctgggaaccctgatatttataagatagctccaagagcagaagctttcaaacttctttgaccatagcctgagaaaaatatattttatatattaattagtacatatatatgtgtgtgaacagaatttttgcaaaacaaaatgtacccttacaagctgatatgctccctattctatactagacaagtctactccgatttaaaaatgctggtcagcaacccactatattgaattcaagatccacaatctctaaagggccaggtagtgaatacttacggcttatgagccacatatcctgttttacaagtcttgttgcatatttttttttctacaatcccttaaaaaggtaaaactattagctgcggtcaactttggcttaggtcagtttatgcatatcaggtttgaagaccattaccgtgagtgtgcccaccttatggtaatgtagtctgcaaaccacattttattattattttttgacacagggtctcactgtcatccaggatggagtacagtggtgcgatcttagctttctgcaggcttgacctcctgggttcaagtgattctcttgcctcagcctcctgagtggctgggacaacaggcgaacgccaccaaacccggctaatttttttacattttttgtagagatggggtttcatcatgttgcccaggctggtccacatgcctcggcctcccaaagtgttaggattacaggcatgagccatcacacctggcctttcaaaccacattttaaagactagagttattgaaagattccagaaagaaaaaaagttttttttgttattttttttcccaagagtcttgctctgttgcccaggctggagtgcagtggcaagatctcagctcactgcaacctccacctaccaggttcaagtgattcttgtgcctcccgagtagttgagattacaggtgcatgccagcatgcctggctaatttttgtatttttagtagagatggggtttcaccacattggccaggctggtcttgaactcctgacctcatgatccacccacctcggcttcccaaagtgctgggattacaggtgtgaaccaccgtgcccagcctgtttgttttacgagacaaagtctcactctgtcactcaggcgggagtgcagtggcacaatcatagctcaccgaagcctagaactcctgggctcaagtgaccctcctggcctcagcttccccagttgctaggactacaggcacacaccaccatgcccagctaattaaaacaaattttttttttttatagagacagggtctcactatgttggctgggctggtcttaaactcctggcctccccacctcagcctcccaaagctctgggattacaggcatgagccaccttgcctgcctgaaaagagttttgatagtttaaccttaaaccatctaactcttcatggtcaaaccataattggccagcaggacaccagtttgtagctcctgtttttagggatgagtgtaactttatcttccatgtatacctttttcaatgttttattacattagttgcctcttttaaatttgtgacaaaactcttctttttcaaactacttggtagttggtgttgaaatcactacaacaggattattgaagaatacaatttgaaagttgtgttatttattttatgttcaagaaaattaaataaaaacaactattttttacccaagatactacagtacacaattacctccgaatgcatgatatcttttgatctttaaagcaatcctgtgcagctacccaggaggctgaggcaggagaatggcttgaaccagggagctggaggttgcagtgagccgagatcgtgccactgcactccagcctggtgacagagccagaccccatctcaaaaaaaaaaaaaaaagaaaaaaagctatcctgtgaaataaactagcagatattgttctggccttttaagagaagagaaaatggattgctagaattttcattgatttgcctacttggcaaatgatagaacatagataaaaaaattgagcccaggggccaggcacggtggctcacgcctgtaatcccagcactttgggaggctgaggtgggtggatcacgaggtcaggagttcaagaccagtctggccaacacagtgaaaccccgtctctactaaaaatacaaaaaattagccaggcgtggtagtgtgcacatgtaatcccagctactcgggaggctgaggcaggagaatcgcttgaacccaggaggtggaggtggcagtgagctgagatggtgccactgcactccctcctgggcgacagagcgagactctttctctaagaaaaaaaaaattgagcccagtgtttttttatttttattttttaatctagtcactagcttcattataaacagcaaaaatatcaattaaatatgtgttgtatacttgacgtagcgtaggtcttgtaatatcagttcttactatcttacttttttcagggctctattgcactgaaatgcattgattggagttacttccgaacaggtctaattttttaccatggagtatcttacaacatggagcagcacattttctgcacattgatgagataaagtcttatatacctagacccaaaggtttcaagggcttctactgctccattatatattgatagggtttgactgtatccccatccaaatctcttcttgaattgcagctcccataattcccacgtgttgtgggagggacccagtgggagataattgaatcatgggggtagtttcccccgtactgttctcatgatagcaaataactctcataagatctgacagttttataaggggtttcccctttcgcttggctctcattctctcttgcctgctgcgatgtaatcagtgactttgctcctcctttaccttctgccatgattgtgaggcctctgcagccatgctgaactgtgagtcaattaaatctctttccttataaattacccagtcttgggtatgtctttgtcagcagcatgaaaatcgactaatacatgtattgtgaaactttgagatggtgccttgtaatcccataggatttgaacatagtttaacatctggttaaaacctgttgtggaaaaagcccaccacaggggtcagtaaaagagatgcttcgaggagtagcactcctgcaaatcccgggaccactgcacaaaatctctcaaagccacattgcttggctttggggtgccccactgctggcatccaggtcccctgaaacagtgaataattccgagtgaactgctttgtgatccttgtgagattcctctaagatggcgtcctctcctggtggcttttgaggagtttcttttttgggttttgcatgaaaaaaacatgctctttttgggcattggtagaaaaggtgagaaaaggaaggccacggagacagaggccaaggatatgacgttgaggtaaaagtacaacaggttcaccggggataccaagagtcgggccagcaccgaccctgctgtgtaggtggccagcgtgacactcctgcagtagccgctcactctctggtagtgctcggggctgaccacgctgtatatgtaggcgtagtaagccacctcggcggcagtgaccatcccgtagaagaactctacaacctgcacggtcttcactccttggccaaacaggagcggcagtcaggtaatgatgaaactaataataccttgcaagatgatgactggcttgtagcggacgtaatcggtgaggacaaacacaagcagcagcagcaccaggtaggagtatgtccaaacggggaagatctcatctgtcatctgcaagattaagtggggagagtgcaaagacaaaaaaacatcaggacgtgaaatacaccctgggcctctgacacttaacattatcaagatgagatgtatcaaccccaggacgcactgcttggcctttgccaaagtgggtctagtttcatggtttacatgaatttctaacaatactttggaaagcaatgggaaactgaaattcagggaaacaaattgaatgacagatattcataaggtgagaatttatatttccaggtgtaaaaaacacagcagctattatcttagttatcagccttttaaactttataaatgtaatttgatctgcaataagctatggaggctaggaaaagaggccataatggataaattaatctgtttacacttgacaggatttccagaacaatctagggctgctcagatactgttgcttactagcatgtaacaaaatagtttattcctcttcacagtgagaaccaaaaggtcaaaaaggatgtttcagtactggaaaaacctgaccgccttctttccctttgatatccatcagtacaaaactgaggagcccattgcgttaccatctcggtgatcaggaaaatatggaacaaatgaccagtttgagattgaatgtcagaggaagaaatgtgtgtgtttatcttctactcttccgttttcttcactttacttttttgggctgccctggaggaaccataagaaactacttagtagctctctcattcaagacaattttggccacagtttctcttggaactgctggcactggccaattatcggcgcctatctgtcgtaagtgattatttcactttctataaggggaatgtacagtgggtggaggatgacacaaaggcggttggggtagaccttctcaaatccctgtcctctgaatttctagactaccaaaataaatccacagatttactgagcctgagaatgccctttgctatgacctaatctgtgtcctcatgctttgggttcccaggtagacttttacccaagcactcttgaagtttggtagaactttattcttgctgtttttggcttttgggtatagtcactaacatggtaaaagctgtatgccagatatgctttttgtgacaatctctggtatttgaatccagcccagtcatagcttctagctaaaccagtttgtacctcatgggatgtactggtgtttattgtgaagaaaaaaggtggattggtttagaaggcaaaatctacttggtgtgaggtgggtgaatgtagatggtggctaggaaagagaggcaaaataagataaaattgttgggtgcaacggctcatgcctgtaatcctagcactttgaaagaccaaggtgggaggattgcttgagcctgggagttccagaccagcctaggcaacatagtgagaccctctctctacaaaaaaaagaaaagtaaaaattagcctggcacctatagtcctagcagcttgggaggctgaggcaggaggattgcttgagcccaggagtttgaggctgcagtgagctatgatcatgccactgcactccagcctgggcatgccatttaagaccatggattctgcagtcagacagtcaggtccaaatccttctctgctgcttacaaacatgtgacctttggtaagttactggacctttttatacctcagaatcctcatctgtaaagtggggatgataatatgttttgaggattccatttgctagtgcatgttaaaacaatgcctggcacacactacgcagtcatcagtcataagctatacaatttgccatactgatggctttgaaaggtattgatgtgctgacacgcacatcttaccactagcctgggatctccttgagagcagggattcagttttgtcaccttagagtctagcacagtgtctgacccatcaaaggtatcgagctgggagcagtggctcatacttataatcccagcactttgggaggtagaggcgggtggatcacttgaggccaggagttcgggacctgcctggccaacatggcaaaactctgtctctactaaaaatacaaaaattagccaggcatggtggcacatgcttgtagtgccagctactctggaggctgcggcacaagaattgcttgagcctgggaggcagaggttgcagtgagccatgatctcgccactgtactccagcctgggcagcagagtgacaccccgtctcaaaaaaaaaaaaaaaaaaaaaagtatcctagaagcgcttgttgaaagtacagtcatcaaaccagacttttctgaccataaaaattcaaataataatatgttttccaagcgtttaacttatttaaagttgttctctggaatgagaactacaagcgaccatctgattctcaagaatatgctggttacttactcctaaaacagctctggaataaggaaaagaggattttctggtgggaagaacatgggcattgtagttgagtaaattaaaatctctaatccactctttcaagtcatgtgatcctgtccgagtttctctgtgtcttggggcctcagtttcccttagctgactagggagattgtaatgcacatcacacaggtgtagtcgtgaagaaatttcctggcctaatgctttcctggtagcaggtgcataacgtgggttacattccacattatgccacctctacgtaggaatccacatctagcttctgtggccgtggaagagagaaggaccatctttcagagcgtggagacgctggtcatcatccagctcgtataagtcacaggcaggtgctggagcctgaaaccgttaagttttaagtgagtttagcaattgagattgttatttacactgattagtcctgctggcgattaaggggaatagccaggggagacctgtattcactagaaataatcctctggaaagtgagatattaaataattgcatactttagaaaaatgcataatttcttgtcaccagatccattgcagttttacaagtgtattttgcagaacattaattcctgggttacttctaataaaatagagagtagaaatgatttctagggccaggcacagtggctcacatctatcatcccagagttttgggaggccaaggcaggaggatcacttgagcccaggtgatggaggctgcagggaggtatgatcgtgccactgcactccagcctgagtaatagtgtgagaccttgtctcaaataaaacccccaaaattagccaggaaatcaaatctcaaatcctctttctgaatcagtcatggacaaaacatcactcaccatttttgaggaccaggagagaccatggcttcaggtttttacattggaaataactcctgattcctcccctaatgctagcagcagaatgtttaactcaagatggttggatgggttggttcaactaaattaggaagtccatcaccagcacagtgaaaagactcaaagaatatgagtgctcacatggagaaatagctacaacaaatcctcttcagtgcgagatttccacaactctgattaggatgggcaccaagtttgccccctgctagtatcttcatttattataaaaagacggtgaatggtatattattttatttgtcagcattctgcttacatggcccctctgaactgaatgcttttccttatggactacagaaaacgaatgactacctaggaaaaactttgaaaacataaagaatacaatatcccttgattatgtggtctgtctgagatggaagggagcaagaaacagcctgaaagattcaaacattctttccttagggctatttttctaacttcaaggcattcttctatttttacaattaaaggcagagttataactatgtaacaaaaaagacaaacagtgaacttacaatcccatgttatgccagtggcatactttttaatatatcaagcaggtgttaatttttatttactgtttaacctctgcttcaaaggtcattggttaacatggtcattggttaaaatcagttaaaacgtcaccgaagaaatgctctgattttctcctaattatgttagaatgtaaatttctaacctttgcaaggaagatgggtgcagagaaagcagtggacttctggtctgggccactggtctatcctagtgttgctatagacagggaatcctggaacttgggggctctggctattgcagagctggtgggctgctctgagcagcttggtatttcataaacatcccaggtattactgtgatgtggccatcagatatttttttctgttgtacttaatcacagctagctgaccttactcagattccttaacctgagtcccactgattaagagaagataaaaattatccactattttgtttgtaaggagtaaataagatcaataggggaggaatccaagcagcacctagtataataaatacagctgtctttcccttgcttttccttgaaaatctcatctagtcccagtcacccagaagatcacaaggaccaatgaattggtgataaaataaaagctcataatgtcagacccagctaatatagattgttgatcatctgtacaaaaaccaatgtaaaaggttacaaaatcaatttcaaggctatcctgtaagaatagagagagattgaaaaagtaaatttatgacttaattaaggttgcaaggaaaactgtttctttaaggaattacattgtttgaaagcactttataaatactaacttatgtaagactagcaataaatcattcttaactgctctttaatcaaatgttcagtccttcattccatagttccttccatagggaacccttggtcggcttcgttaaattctgctcaaaatacatgctttccacacccatacttccctatttggatgttttactgattcattttgattcttctctacatagtctaaatcagcaaatatttaccatatgtactttttaaagagttgaaaggaagttatccctatattctagcgcctcatgactcgtgtctcagcatgaaaagtattttttatccagattacttaaatcaacattgcatgccaacatttcccatctgaaccttggcctgcccgtttttcctggcaatgttgcttaacacccactgaccatgtagtctcatcatttttaatggtgatgaggcagatttcctcctagttcacattgaatagtctatgtcactgatcttgctatttggatgccatgagctaggactagggactcgtttcaatggcctgtttctctatcacccaggaaatcacaaggctcaatgaattgctgatagcaattttggtactgaaaagtagggcggggctataccaaatatgtaaaagtgtggaagtgcctttggaattctgtgatgggtagaggctagaagtgttttgaagcacttcatagaaaaagcctagattcacatgtctgaaattgttggtagaaatacagacattaaaggcaattctgggccgggtgcagtggcttatgcctgtaatcccagcacgttgggaggctgaggcaggtggatcatgaggtcaggagttcgagaccagcctggccaacatggtgaaatcccatctctactaaaaatacaaaaattagttgggcgtggtggtgcgtgcctgtaatcccagccactcagaaggctgaggcaggagaattgcctgaacctaggaggcagaggttgcagtgagccgagatcatgccactgtactccagcctgggcgacagagcaagactctgcctggcggagtgggggtgggctgggggaaagacaattctgatgaaggctcaaaaggaagagaggagagctacaaagaaagcttctattgtcttagagaatacgtgtaccaccatgtacagaatgtttctagaattatgcacattacaaggtgtttctggtgaggtctcagatggaaaggggtagcatttattggacactgaaggaaaggtgattgatctgtgttataaagcagcagagaacttggctgtattatgtcgtggtgttggaaggaaagcagaacttgtaagtgatgatgcacttggatatttagctgaggagaatcccaagcaaagtgtgcaaaggggaagcctgttgtctccttgttgcttgtaataaaatgtgagaagaaagagataaattaaagaaggaactgctaagcaaaaaggaagcagtacctgatttggaaaattctccacctgtccaaatagtatactatagaaatgtcaaaagtatggctcaacaagtgtttgctaaataaatgaggtgtgtggctcatggatccaatcatttatctcatcagaagccaagaatagagatgtagttgttcaggaaagatctgtgcagggccctcttgtctgatggcttagatcaccatgaatttcttgggaggctgacaacgtttttgagaattttataccaggagaaacattgccattctggactgaaagagaccataaaattaacaagaatgacttaaagcctggagtgctggatgcagaggccagtctcgaactcctgaccagttcgagaccagtctagccaacatggtgaaaccccatttgtactaaaaatacagaaattagccagacgtggtggcgggcacctgtaatcccagctactcaggttgctgagacaggagaatcgcttgaacccgggatgcagaggttgcagtgagctgagatcacgccattgcactccagcctgggtgacaagagtgaaactccatcacaaaaacaaacaaacaaaaacattgtagtcttttatgagaacatctaagtttttaaacaaccaccatatgggtgtaaaagatcatcaggccatagaggattatgctcaggccttgaagtctttttttttttttaattgtaagttttcttcagtctcagaaggtatcaggccttgaaatctaatggaacttgccttcctaggtttcagacttgcttgggacccatgaccccttttttctttccaatttctcccttttggaatgaaaatgtctgtcctatgcctagatattgtattgtgtaagcagatgactcattgtctgacttcacgggttcatggatgaagaagagtttgccccagggtgattcatactctgagtctcagccatcagtgatgtagatgacaacatttgggactttgagttcatgacctttagatgaaattttggacttagagttgatactggaatggttaagacttttgggaatatttggaaggggtggatatattttgcatgtgggaaagatgaattttggggcaaaggggaagactattatgggttgcttgtgtcccccagaaagacacgttgaagtcctaatccccagcatctcagaatgttaatttatttgaaaatagggttgttgtagatgtaattagttaggttatgataaagtcatggtggagtagggtgtgttcttaatccaatgacttggtgtccttataagaaagggaaaagagacacagagacagacctgacagtgagaagacagccatgtgaagaccaaggcagagattggaatgatggatctacacgccatggaataccgagaattgctggtaaacaccggaagctgaaagatgcaaggaggggctctccccgataggtttcagagggtacatggccctgttgacatcttgaattcagacttctagcctccaaaactgtgagacaataaactcacgttgttttaatccaaccagtatttatggtatgtcattaaaaccaccctaggaagctgacacagattgtgctacacctaatttgaatttttaatcatttgcacaaaatgtgggattaaatctttaattaaaatatttcatttaaatctactgtattctgattttccatgtatcaatactttcacttttgttaaatacaaataggacagatgaatctatatttacatatggagtgaaattttccagtttgtttttgttatctttagctaggtaataaatgttagttacaccccgtgtggtggttgtttgaaaacttagatgttcacataaaggactacagtgttatttatttatttatttatttatttatttatttgtttgtttgtttgttttgagacagagtcttgctctgtcgcccaggctggagtgcaatgatgcgatctcgcctcactgcaacctctgcctcccaggttcaagcgattctcctgtctcagcctcccaagtagctggaattacaggtgcatgccaccacgcctggctaatttttgtatttttagtagaggcggggtttcactatgttgaccaggctggtctcaaactcctgacctcccacctcggcctcccagagtgctgggattacaggcgtgagctaccgcgcctggcctacagtgttatttttaaaaactagatactatatgaaatgcagacatgataaaggggtgcttaacccttttaggtgacctgcctttttaagaaaattgcaattttcataaaaaaagtatacattttaaaatagtttagtcattactcattttgtaatttattttatattgattttcccctctgagattcaaatgtttgtaaccattgctgtcttttttacaggtctctcttctttatcaagttatcatatttgggaacaagtgtaacatggtagaaatgaagatgtctcttgcgtgggaggctgatgctccaagggaaccttgggcaggatccatgctttctgttaacacaggcttcatctaccctaagtgctcaggcagcgtttggagaaggaagaaggatgactggaaggaagaaagttacttttttttttttttttgcagttgtggggaaattgcactgattcacgcatgtacttttctccagtctccccggtcacgaacagagcgtaattgctgcacgtctggccagaacaaacacttgagctggaaataccaaactgtatatatgttaaacacaggctagttttacagaattttcacctctacttctcaatacaaaacctgtttttcacaactagcattacccccacacgcagaaatttttaaagaaaagatgactaggtctattctagaaccttttgttattcctggcagtagtacaatgaaattgggtctagtggtatttattgttggggtggatgtaactcctattgaatctgaaagcacagcatcaagtgaaaactgctgaacaaatgctaagcatagaaactcttctgtttatgaactttttggttttcaataggctgccctgagtatgcttttttgttcttaattgaacacaacatggtacaaaaaattactacccctggccgggcgcagtggctcacgcctgtaatcccagcactttgggagaccgaggcaggcggattccaaggtcaggacttcgagaccagcctggccaacatagtgaaaccccgtctctactaaaaaatataaaaattagctgggcatgggggtacatgcctgtagtcccagctactcaggaggctgaggcaggagaatcactcgaacccgggaggcggaggttgcagtgagccaatatcgtgccactgcactccagcctgggtgacggagtgagactctgtctaaaaaaaaaaaaaaattacctgtgggtgctgggctgagccatgattttgttcctcatctggagggattaaggactgcttggctaagctcatccccagttattgactcagttggacttgtggggaaggtgtgaaaccaaaattttttatttctaacaaattcccaggtgttgctgctgctgctgctggttgtggacctcaccttgagaaccactgcgtagctcacagccgtcctggccagctctcaggctgaaagtttgagagagatttctgtagtcattttagctgtaattcccccgagggttacactagagggcagtgtgattacagctactgcgatggacagcaggttgacttcacactgaatccagaccgaggttttatattttgtttccagatgtttcatgtaggcatttgtaggtagaaaaggttctgctgctaaaaagaagttaaaagtttgctctctctcctgtctttttattttatttacttatttttttgagacggagtttcgctctttttgcccaggctggagcgtaatggcacaatctcgtctcactgcaacctctgcctcctgggttcaagtgattctcttgcctcagcctaccaagtagctgggattacaggcatgcaccaccactcctggttaatttcatatttttggtagagatggggtttcaccatgttggccaggctggtctcgaactcctgacctcaggtgatccgcccgcctcggcctcccaaaatgctggggttacaggcgtgagccaccacgcccagcctttttattttaaactcatatatatttattagctggagagctgaggctattgaggtgtacaattttattttccattattcagagaatgttagagataaatttgctatttgagctcacttttctaaacgtgttttcagtgactcctgttttgttagtagtagaaatagggtttgagaccaaataaagctggaaacactgagttaaagttacacagactcctttattaaaatattccttagagcctgtgtttgtacattggaaaccactgggaggaggatgcggaaggcaggaccgctgtgggagtaatgccttctgggtattttggacaggaaacacctgcctggtcctgattcttcgtcttttccataaggaattaaaaactggaagagaaaaatgactgctatgtagtgacaggacctgtctccggactgcagtccagggtactttccgtaggaccaaaatattattacctgcagttctatgtgcaatgacaatacccgggccagtcaaatgcactcggtcttcgggcctcgggtcttcctgttccacctgttaggacgctcttgctccaggcatctgcagccttgcctcctcactgcgtgcagagtgcttaaatagcaccttattaaagaggacctcccagaccactctccaaaatgggcctccttgggtcactctctattttcgtaccttgctttgtcaccacctgttatgtgcttaattatttttttgtttgcttcttctctctaaaatagagctagaaccgaagggactttatctatcttagtgtctgctatatccctagtactttgtaggtgctcagtgaacatatactggatgaattaatattttcaaagtatagaacataagattggttattctatcagccagagttctccagagaaatggaaccaacatattgatatataagtatacataacacattatatatatatataatgttaaatatgttaaaatggtaaaaactggtatcttttattaaatggttctaacagtacccagataatgtgaacattatatacatttacagaaaaatttccacttgcacttctgggtttaaaagtgcaatatctggccaggcgcggtagctcacacctgtaatcctagcaatttgggaggtcggggcaggcggatcttttaagcccatgagttcaagaccagcttgggcaacacggcaagacctcatctctacgaaaaaatacaaaaagtagccgggtgttgtggcgggcgcctgtggtcctagctacacggctaagattatacctagacctacactacacctatgctgaggtgggaggatcacctgagcctgggaagttgaggctgcagagagccatgattgtgccattgcactccagcctggatgacagagtgacaccctgtctcaaaaaataagataataaaagtgcaacatctgacactttctagtaattgtttaaatataatgatattgtatactctggtttctcttcaaattgtgtacatcttttgccttttaaatgtaatggtattttattttattttattttattttattttattttattttatttttttgagatggagttttgctttgttgcccaggctagagtgcaatggcgcgatctcggcttactgaaacatccgcctcccaggttcaagtgattctcctgtctcagcctcccgagtagctgggattacaggcatgcgccactacgcccagctaattttgtatttttagtagagatggggtttctccatgttggtcaggctggtctccaactcctaacctcaggtgatctgcccgcctctgcctcccaaagtgctgggattataggcgtgagtcaccatgcctggccagtattttatttttatatactctggttatgttagagaatatccttctaggcttcagggcgtttgaatttaaatattattaaggtaaggggtatttatatttatccaaaggcctctctgagaaggaattctatactgggtttgactgtaattaaggtagctgccttggagaatactggtcattttaattttccactctccaaatttcacagaagtgtttctcattgtcagactgacctacagtcatacagggaagggaatccaggcaacatcatcccaggtttcttccataaaggaaggaggagactctagaaggtggtggtggtgatgccaacagacatgaagtacaggatctttcaaatgagattttgaagttcacacaccttccataaggcctaccttcccctcctccactgagcatcacggggttgcattgtctgtccctgagccgcaaggcccctcctctcctgctgactgcgaggcagtgggggtggggagtggagtgtgtgtggtcttagatagaaaagaaagcctgaaaagaaacgtaatgtgctaaacaactgatgtgttaaacacctgccttctgatattcttaaatggcagtcctgtctccagtgagaaataaatgtctcttgataaatgcatttacacttactctctagtcacgatcagccagtcctctgggtaatgtcactttgaaggaaggttggatgcttatcaggagagagtgagtggccttgggtggaatccagcgcccagtgggggacagctttagtgggatgaccttccagatcacaccacactggctgccacccgctctgccctgcacaaagtggacccaggtgaaatagcccttcttggagacccattagatgaattcttgtcttccttaaagtaaagttattactgttccaatttatatcaaccaaactcttgcttacatggagtaggtggcaatgacagttagaaactgaattatacccataaagagcaatgctgataaggagaaaaatctgtcagtggttgaattgacactggctgcttcccatctagtttgacttcacagaaagtggggaaatgctctttttttgtgggatacttctgaggtttcctgggtctttcctgtgcaaatgaatgatgaaataactatctgcggagtcacttaggagccttactggggtcagccattttctgtgctccagaaagcccaccctcttttttcttccattatatttctatctcgtctgaccacgtgttgttgcacaactccaagggtgaacttggaactgagattccagtcttttcttcctcatgctctcatgcttttcagagacctggagatgctgaaattcctctgccttttcttgtctctttgcctgctctagcacttctgtcctctgaatttggtgggagaaagtcagaagaaataaatctcacagaataaacagaataacagtctccttagagagaggaggtgatgaagaggaaaaaatacagacatggaggtagatggtcttaaaggagaaaggagattggaagccagtccccacaactaacaaggagagtaataatgctgccttttcaggatttttttttgggttggggggggacaggatcttactctgttgcacaggctggagtgcagtggtgcattcacagctcgcagctcactgcagccttgacttcctcaagctcaagcaatcttcccacctcagcttcccaagtagctgggactacaggcacacgccaccatgcctggctaatttttgtattttttgtagtagagacagggtttcattatgattcccaagctggtgtcgaactcctgggctcaagcaacccacctgcctcagcctcccaaagtactgggattgcaggcatcagccactgcacccggcctctttttcaggttcttgagctcaaatgtcagcatcatcactttctagctatgatcttgggaacttagatgtggtcactgatattgtccttgcttctcattgctgcctccagacaattattcccaactccttgggagaaaatgaaaatgtcaatctatttgaaactcaatcagctagagcactgtctcctcggcgctgacatctactgacttcctggtccgtcttcctcagtcatcaaaccctttggcatcaattctccatcctaggtcctgccattatcttgcagcttttcagtatccacatgtgatacatcttgtcttttttgttcctcaatcccctcatttctagactccttttccactctacctcagctccccattcttgtggccacatcctgtcctccctccaatgtaaggaactgcgtcacctggctctgtctacagggatctcgccttcttgcttactcgatcatctacttccacgggaccattcttcagtgttatcgggacatccttgttctcctctcaacctccctgcctgtcctttcttcacttcccttatttcctctacagcaatcacaccaatgcccaaagctccatggcctccctgtgtttcagtcacatttgtatgaaaaaaaaacaatcccaggaaaaatctttgatctgcttgctagagaaagtcacacaatacagcaaaataattccatcataagctcacaatcaccagcttcaagtgggatttaatcaggcagtcctgtgaggtttctctagttggctagttattattattattttgagacggagtcacattctgtcacccaggctggagtacagtggcgcaatcttggctcactgcagcctccacctcctgggttcaagtgattctcctgcctcagcctcccaagtagctgggactatgggtgcgtgccaccacacccagctaattttttgtatttttagtagagacgaggtttcactgtgttagccaggatggtctctatctcctgacctcgtgatctaccctcctcggcctcccaaagtgctgggattacaggtgtgagccactgtgcccagctggctagttcttactctccatcttggccatattacactgtgtctgtatttctcagtcctcaaattcccctactctgccttcattcccagagactataacctactttatagagaaaaaggaagtcaccagatgccatctccctcaagctcccagcaacatgcaaactactctccatctgcctccgctcaccatgtcacactctgtaacacgaggcagccattccttctcactagggccagtcccttcatcgggacctggaattcctgctccttccccctctgagcacatttgcactacatttttttttgtttaaaaaaataaatatttcacttcttttacttaaattgcctctccttatttaaaaatttatttgacatcttccattttagaaaatcctctcttgacccggcaacgctcctcaatgacagtctgacctctcttccttcatcaaagacaaacctcctgagcaagttttctatgttaactgtctctacctgctctcctccctctcattttaaatctcacctgcaggtatcctgtctcctaaatagaaacatctcttgctgagatcaaaaataacctccatgtttgcacctgcagtgaaaacattccacagcctgttacttgatgtctcattttcattggccactactgatcacttcttcccacttcaaacattctcctccctgggcagccaaaccctttctgttttcctgctttttccttctgtcctctccttagaccactgtgcatgctcatccttctctaagtaattgtatttcttcaaaagtctgtccttgagccaggctcacgtctgtaatctcagcactttgggaggccgaggccggtgaatcacctgagatcaggagttcgagaccagcctggccaacatggtgaaaccccgtctctactaaaaatacaaaaaaaaaaaaaaaaaaaaaaaaaaaaaagagccgggtgtggtggtacacacttgtaatcccagctacttgggaggctgaggcaggagaatcacttgaatctgggaggcagaggttgcagtgagctgaaatcacaccattgcatgccagcctgggcaatagagtgagactccatctcaaaacaaaaaacaaaaaacaaaaacaaaaacaaaaaaaagaaacttcactcttacatatcaccaagaaagataccaggatctctttttaacagacaagtgttcctatagtctcctgctgtagagtaatacttttttctttttgtttaataccttgagggtacagacaaagtcttgtccatcttcagaaactgattaaagatctagcactttttcttgaaatttccctgtaatctgaatcaaggcttatgctttaggaccatagtgggagaaaccagggagacagtatattagcttgcactgctgtaacaaaatacaacagattgggtggcttaaacaccaaaagaaatagattttcttaaagttctggaaactggaagtctaagatcaagataccatcaggattcggttctggtgagacttctcttccagtcttgtagacagctgccttcttactgtgtcttcacctgatcttttctctgtcagatagaaagagctctggaatcctttcctctttttataggaacaccagtcctgtaggactagggcaccacccttatgaccttacttgactttaattatgtccttaagggccctgtctccaagtacaatcacgttgggagttggggcgttcacatatgagttttggaaggacacaattcagtccataacagatggtaactctaacagaattcaaaattgaaaggaaaatctagtcggtacaccacgtaatgtatttcaattacacaagttatatctgtaatttctagaattctattttatcagtccatggcactatctttttctttgcaagttaatacttcaggtatgggttatataatatgtactgaatgatgtttccatgttactcactgtcagaaggatgtgtactttcaactgtgtgtccaaaggtggtgataatttgctttgagtaatacacatttccctatccagtcaatctgccaaaccatggtacagaagacaacagggtacaatctgtggatatgataatggaatacagctaagcggctcacagaacagtagaatctcttctctggccccagtcaagaccttgtggtccttccttgagaacacagtctccatctggttctctctggtgctgccaatagcctggaagatgggctgcattctccactgatcatggtcctgcctggctgccctgaggcccttggttccttgatcatttcactcctgccatggtgacaccttggcacctcatcagccagcttcctcggctgtcctctctgttccattgtgcaaggaaatgttctgggtctcttccattccacatgggatcagggggagccttgtgggtcactctctgaagttgagcaggccatcccaggaagaggataagatacacatccacatatttcttctacctctatttttctttctcttcttgtccccatatcctactgagtcagaaggcattcatatccccgtttcttgtatatcacaccttctgagttttttcttttttaatctttgaagcctggttcttcatatgtaaacaggagctttaaaattttagaaaaatttcttctaaactgtaactcttttttaaagccaaatgtttccagagtggatatagatgagaaagaactctagattcctttacgcatactggaataaatagtaacaaagaagtagctatttgtcatgtgccctgggtcactccatcaccatcctcaggatggtacataagggcctcccccagcaggagaaggcatcagacctccacacctgggaaaaatgttaagattccagaagaggagagagtggaaagaggaaagaaaatgggataggacatacttcacgggaaaaggtttaacttatttgtgcaagccatgaaatgactgtgatattgagcaaacacccttctaccctttgggcctcagtatcctgagtcctccctcctcacttccctcgagtcctctctactgacaccatgggttgctgtggttgtggaggttgtggtggctgcggtggcggctgtggtggtggctgtggcagctgcaccacctgcaggtgctaccgggtgggctgctgctccagctgctgcccctgctgccgcggctgctgtgggggctgctgcagcacacctgtgatctgctgctgccgccgcacctgctgctcatgtggctgcggctgtgggaagggctgttgccagcagaaaggctgctgccagaagcaatgctgctgctaggcggccggcctggctctgcttctggactgaggtgcggggtcctgctttctccaggtaatgagactttcccccatgcccctgcctgcttctctcccagacctccccatctggtatcacctgggtgtccagggacttgctcctttggactctataaccccctctttgaacctagtggtttaaaatctttttattaaaaaaaaatccaaataggaaatggccattaccaaaatacaaccccagactcatccctaaagatcagtccgccttgctgagcccagccaagagggtcatgatcccaagcgttctgtttcctgggtgttcagatggcctccacctttgtgtttctacttctctgcacctgcatgggcaccatttcccaccttttctatgagttttgtttccagtcaccacatagctactgcttatttccctaataaaacaatgtcaacaaccctgagtgcttctgtatttattctgccacgtcaacagagggaacgtaagagatttcttacgttggctcacacctgtaatcccagcactttgggaggccgaggcgggtggatcacttgaggtcaagagttcaagatcagcctggccaacatggtgaaaccccgtctctactacaaatacaaaaattagccagatgtggtagtgcgcgcctgtagttccagctaattgggaggctgaggcaggagaattgattgaacccgggaggcagaggttgcagtgagtcgagatagcaccactgcactccagcctgagcaaaaagagtgagactccgtctcaaaagaaaaacgaaaaaaagagagagtgagatttctatctccttgaacaagttgagcgacagatgcaccatgaccggaccgcaatgccagcacggggctgctggggaggccactaccaggcctctggggacctggcctccctgccacctgccctttctccatctcttgagatcggcacttccctcaggtatttccacacctgctgccacgtacccctgttcttctaaagaccccaagacccagcttacttgtcaaaaaggaaccatgcacctctccagatgcaacttcctcaaaacaaatctaaatatttcacataagtccatgtcgaactgtaaacaaaaggcaggtctaaacaagctagaaaaatggcctatcgtttttttctaaggatggttattctcttgccttttctattcccttatttctgttatttgtctgtgaactcttgtttttgtggttgttgtctcagagttgttctgtgtacaaactaaagcccttaaaatgtttctccatggggtattcctatgagccacaaaactactatctcttacaaagcaaacctacattctcatattttttctaccttattttttatttctaactgtatttttcttttcttttatttatttatttttaagaccgggtctcactctgtcacccaggctggagtacagtgtcatcatcgcggctcactgaaggcttgaacttgtgggctcaggtgatcctccctcctcagcctcccaaatagctgggactacaggtgtacaccaccaggctcggctaatttcttctgattttttgtagactcaaggccttactatgttgccgaggctagtcttgtattcctgggctcaagtgatcctcctgccttggcctcccaaaatgctgtgattacaagcttgagccacagtgcccagcatcttcaaactctattaagagtgaaaaaactgcaaaggactaaaaacttgtagccaatagaacaaagaatatttttggtgctttttcaaaggcatgtttccctctactggtgtattccaaagaggaaaggaactacaatcagtttatttagtaaattaagcaaagatgcgatatgaggcacctttcactgggagtgactaaggttgagtactcaatcttttactaacattgactttgaataccaagtgagttgaccaaagcatttgtgcctattattatactaaccacaaagtaacctttgttatgttgtatagttggttaacaaatatgaacacagaaaccaagagcacttacatgacctccaagggcaagtaattaatatgaatgacatgttcagtgtcactgttaagaattttgagccccattagccaatttttgtaggaccctatgctttactagtataaatatacatggaaactttggaatcaatacctctttatttaaactagtggctctcggccgggtgcagtggctcatacctgtaatcccagcactttgggaggccaaggcaggaggatcacctgcagtcaggagtttgagaccatcctgggcaacatggtgagacccaatctctactaaaatacaaatattagccaggtgtggtggtgtgcacctgtaatcccagttacttgggaggctgaggcacaagaagcacttgaacccaggaagctgaggttgcagtgagccaagatcgtgccactgcactccagcctgggcaacagagtgagactctgtctcaaaaaataaaataaaataaaataaaataaaataaaataaaataaaataaaataaaataaaataaactattggctttccaggaggtggtactgcccccgtggggtgcttgggaatttgtagaaatagtttttggttgtcacaatcagaagtacactactggtgtctagtgggcaggtgcagggatagtagatcctgccgtagacaggatatccccacaacaaagtcttgttttgtgacacatatgattttcaaaagtctctttggcattcaaataaatgaagtccctgtgtataattattggaacctataagtaactccactctacacataaacagagtatttttcacattagcttaatgtatagtgaagattctaggaaagcaatagatagtaaattaagagaagattccattctggtggttggaagttttaccaagcatggttcttaatttcagccaatcatgtcattgattgtccctccacaaaacagaattcatttgcatgtccgcagacaagaatcaattgcattattatcatttcttggtattcccattagttctctgcattgttttcagttctctattacagagttataaaatagctcaaaggcagtagaaggctaacatcagaaaacccagaaggatgtaccataaacaatgcgtggttccctgctggagacacccagtaatatttttgcttattccaaatttccttaggcatttgaattagttatagtagattagtttcaggtgttctattaacagtaatgttatgttgatctttctatgtattttttgtgccggagcacactgtcttcattattttagctctgtaataggctttaatgtctatttgcagaaagtcctttctcatttctttttttttttttttccaaattatccatctatttttcctctgtgtccacataagctttttgtttaggtttctgtagtgcagtggttagcctgttcaccttacacatgcatatgctctaggatcatttcattacagggaaacagcatctttagacttcgaaattatagaaaagctcatagattgatgaggaaggaatcaacagttttgcaataatccatgttgttatccaagggatgtaggtatataattatagttatttttaaagctttcggaattttcaagcttaagcaaaaagcttttgcttctttaaaggattcaattctcaaatcaatctagttcagggaaaattattattggttttcatttttatagttgaggaaaggaagatcacagaagttaaagtgcttgttgagattcgcacaattagtatgtggcaggtgtaggatttgacctcccataccaaggtctgtgttctgtgtcattacatctgggagaaccaaaacctagggtggctgcaggtttatctgatattcatgtttgctacattttagaaattggagaaagactgatttgaatcacagtcatcataagagcatctttcatttggtcttgtggtcctctaagaaactctagagtttttaacatgaacaatacagagagacacaagacttcccttgagagcattcaaatgaagacaagaatcatgatttttaatatttgtgaatatgacttactacaaaatgacaacacttcaaagtttaactttcatcccacagttttcttacctagacaggcatccaaaaatctcacaaaaatacttaatgaacatgagtcagtccgtttaaaaaaaaatacttaccacatttataccatagtcagcaatcataaggctgtagtcatttacataatcacaaatgtctcaattcttatgttgttttttctatctttcacaataggaaaatttacaaaagaagagatcattgttctcccaaggccctcaagggtgaaagagaatttgatgcctgaagaatagcagtgtttttttaaattctcttttttaaatttttcatcttcaagtatccccagtctaaccaaaggcaccagatcatgactatatgattgggtcctgtagtgtcagactgaggatacttttccagatttgttgctttattactagtcagcttgatcattaatctaagaacacatgatctaacagaaaagtggcacttcattgctttaatgtgctttccaagtggcctaagggccccttaattcttcagctcacttacctaactcagacttgactttatcttctctttgtgggtacaagtgttcttttagactttgtaaactttcatggaatttagcatttcttgtaatctttgcatttagttttttttttttttgacgtccctgagaacatgttgcaatttgtttttcaaagaaatagttgcgcaggaattactaaagcagacgagaaaaactgggtgtgacagtaaacaggaaagatatatcaaaactggagacagtatcactgcttactgatcataagcatcagtataagtttcctattcttatattcagacggcattatgttatctagcatgtggtatttaatacaataccataaatatcttataaaatgctgttcttggaactgaaattactaagataaaataatactgtataattaggggctataactaaatggacaatgatgcatatgtaactgtaacctgaatgaatattaaataactaacgaagcttggccacttctgagggtagcagctggtaagattcccaaagcccactcccccagaagatccctgtggactttcacatggcccactgtgaagatatagccgtgtcccctgaaaggaaggaataaccatatctatatcttggtagccaaagtgtgaaatggctttatccattgttgtcaatacccatactacaacaaaatacagattttttttgcttgaattttgatttgatgaaaagcaaccttgtgtcagagacaagtctgacagaaaaaaaaaaagaaaaaaagaaaagaaaagaaagaaaagcaacttgattcagctctaccagatgttaataaccttttcctttacttattgttttcttctccttttccttaattcattggcgtgaggcagcagccaaggcctgcaatggttctgtcttctcctggatcttcctttggcttctgtgaccttttggttagctacatacctggttagctccataacaaagggttccttttcctgcaggacacccatgccaccaaggtcaggggcaacaagaactgacaaggggggctgtctgtcctcctgggccccagctcataacggtgagccccagctagttcttcctctcctccccttatatccatttttctgccctcacttcttgatctgcgcacttcaagctccagcagaaggacacagactggcagagaacacgtagccaggtcctcaatggcctaggttcctgaggaagcctgagtctatgatacagcagtcacaccttactttgcttattggtcctcagcccaattccttgtaggtctgttttaatttactggaagtgctagaaccacatatctacatatctattctctaaattgatttaataaagacattttctataattagggctatttttttaatgtgatgagaatgtatttgtgtttaaaataaaaactgattttctgggcactgtggcttacatctataatcccagtgctttgggagacagaggtgagagatgatgtgaggccaggagttcaagaccaacgtgggcaataacaagactctgtttccaaaaataaaaataaggctgggcgcggtggctcatgtctgtaatcccagcactttgggaggctgaggtggacagatcacttgaggtcaggagttcaagatcgacctggccaacatggtgaaatcccgtctctactaaaaatagaaaaattagaccgctatggtggcgtgtgcctgtaatcccagctacttgggaggctgaggcacaagaaccacttgaacctgagaggtggaggctgcagtgagccgagactgtgccactgcactccaccctgggtgacacagtgagactctgtctcaataaataaataaataaataaataaataaataataaaataaaatgaaataaactacctgagtgatatggtttggctgtgtgtccccacccaaatctcatgtcgaattgtaatccccagtgttggagaaggggccgggtgggagatgattgaatcatgggggcagacttttctcatggtagtgagtgagttctcatgagatctggttgttgaaaagtgtgtagcacttcccccttcgctctcttcctccttctcccaccatgtaagtcgtgccccttttgacttctccttccaccactattctaagtttcctgaggcctccccagccatgcttcctgtacaggctgcagaatcgtgagccagttaaacctcttttctttataaattgcccagtctcaggtatgtctttataacagtgtgagaacaaactaatacaatgggtgtggtggcacacactgtagttccagagacttgggaagctgaggcaggaggatcacttgagcccagattagagctgcagtgagtcgtgaccacaccactgcactctagcctgggcaacagactgagaccttgtctctaaaaacataaattaataaaaatataataaaatagttaaaatcgtacataaaaaaaaaggctgggtgcagtggctcatacctgtaatcccagcactttggaaggctgaggtgggaggactgtttgcggccaggagttcgagaccaacctgcgcaacacagtgagaccctgtctcaaaaaagttaaaaaataaaataaattgagaatgacatgaaatacacttaaagaataaaaaataataaatttagaaaggaataaaaaataaatatttacctcctatttcaaacttgcatgtaggaacaacaacaacaaaaaatcccggagtaaagccagattccagagctagactggaatttcacaagttggaggcaatgagaaaataagcccaaggttttcttgcaaaatgtcaacaaacacgagtgtagaacattccagtttcttagaaaatgtcttcaaaaacagaacaatcagaaaataaatgcagatagttggatcaacctctgactcctatcatgtgcttccctctggcctccgaaggaaatgtgagaagggtcacaagctgcctcaggaggaaaaggcaagagtgtgaccaaggtcctatcaacctcatgcctattttaactcctcagatgagaggaaggatacaacgggcaggaagaaagctccccaatgaggaaactatgatgaaaattggagaccctcacatccgttcttgtttttgtttgtttgttttgagactgagtctcgctctgtcgcccaggctggagtgcaatggtgggatctcgggtcactgccacctccgcctcccgggttcaagtgattctcctgcctcagcctcagaagcatctggtattacaggtgcccaccaccatgcccggctaatttttgcagttttagtggagacaggatttcgccatgttggccaggcttgtctcaaactcctgacctcaggtggtccgcccgcttcggcctcccaaagtgctgggattacaggcatgagccaccgcacctggccaccattctttagaacttccttctgcagtttctccaggtcccgatgctggctaagaccacattgccactatcaattcaaccttttcattttctttctctgtattcttctttttctctgctgtcatctccataatcaaatggtgtttgttaaaaagtaatatgttctgaggcccgccacagtggctcatgcctgtaagctcagcactataggaggctgaaggcagttggattgcttgagcccaggagtttgagaccagcctgggcaacatggagaaacctcgtcactacaaaacaaaacaaaacaaaacacaaaaattagccaggcatggtagcgtatgcccgtagtcccagccacctgagaggctgaggtgggagaattgcttgagccccagaggcagaggctgcagtgagcagagagtatgccactgtactccagcctgggtgatgggagtgagaccctgtctcaaacaaacaaacaaacataaaacataagcaggatatatagaatcggtggtatctcttaattttacactgatgaaatgcagcctcaaagagtattatacaacttacacactttgtaaggaatagaatatgattgagaattagtctgtccgattaaggtttaatcacatgctcccttgataaaggatataacaaaagtagaattgttgggttccctgctttctaatcatgcctttcttaataagaagtattcttggctgggcatggtggctcaagcctgtaatcccagcactttgggaggccaaggcagatggatcacctgaggtcaggagttcaagaccagcttggccaacgtggtcaaaccccatctctactaaaaatcaaaaattagctgggcatggtggcacatgcttgtaattccagctactcaggaggctgaggcaggagaatcacttgaacccgggaggtggaggttgcagtgacctgagatcatgccactgcactccagcctgggtgacagagcaagactccatctcaaaaaaaaaaagtgttcttgacagtgacctctgaatgcgcacagatccacagccattttgtgaaactgacttaaagaatgtttactttgacaaggtaaagtaaaaacaccttacacttcaatagcttctcttgccttgttatatatgtgagaattatacaatgatgccttatgattccataaaacttgaattataatatgctgggtagatacaaagggaccataacctcttttcccccacataatactgttctggtttcggtcaattctggtcacaatttaacatggattgcctaagaaactcagaagagctttggttctcggaatctcaatttctagaaaacagaaggacaattggcagaagaaggcatagaggaaggtgcagatgtccaccccaaattgcttctccttttcttctgtctgaacttgggggaatagaagccacatgtagagccacagagaaggcagagcagtgaaggagctactggcaataatctaccaatgtcttcctttaagagtgggcgaattggctgggcacagtggctcacgcctgtaatcccagcactttggaaggcctaggtaggaggatcacttgagcccaggagttcaagatcagtcggggcaacacagggagacccccatctctatttattaatataaaattttaaaaaagggtagttgaattgaggctgcagaggatctcctgggcggaatttgggctgtgcttctttttcccgtgtgtgtgtgtgtgtgtgtgtgtgtaaatttatggggcacaatgtaattttgttacatgaatataaagtccagtggtgaagtcaaggcttttagtgtatccatcacaagaataatatacattatacaccttaagtaatttctcatcatccacccctcccaggacccccacccttcatgaaatgcaattcaggcataaaaaagaataaaatcatgtcttttgcaacaacatggatggaactggaagccattatcttaaacgaaataccttagatacagaaagacaaatagtgcatgttctcacttataagaagctaaataatgtgcatacatggacgtagagcttctcttttgttttgacttgacccttctcaccctagagctgtctgagatgtaactgtatctacatttctatttctgaggcaaactgcattcctcccccattttgcctttagtctagccaccaagagtagtggtatttaggcttccaatcaatgtcattctccatgcactgtcttcttggctttacttggagaatataaaactagcccagtggttcaagtcttcatttaggacagacaaatcaagtaaaccaagatgttttctcattttgattttaacaaggacaactggtggatcatttaaatgagggaaggtgatcgtggggaagaaaatggatcttgggaaaagaaagggtaaatttctgatttaagtgacatttctatcccaaagcaagtgaactgctgcagcctcttatcttctcctacttgtatttccatgacctgcagatatattgggacaaatcctgggagcagatgatgtaccttctagtattgctttaaaaaaaaatggtgagatgacctcaaagaagaataaatactccctttgggaaatatttgttcaagtattcctttactttgtaagtctttaattttaagtcaagggcaataggatcatctggtcagaatttacaatttgaggtactgtatatataaggcatttgaacattttgaatcccaatcatcctccactagttttgtgtgtgtggaaaagcaaacaggtgagactaagcttccttgaaatgaatcctggttaagatgaataaaataatgtgaatctttgttatttattatccaagaatcataaatgtctgtgagtgtaaacttaagcatgtattcttctttgaggtcacataaaaatctatatacacagatgattactgtaggaacaaccccagataggctcaacaaattttggcagtgatccatttctgaaacaaagccaaaagcaggtaagcagattggccaatggaatatccttgttaaaaactagactgagtgtattttataaaactggaatgaccactgcaaacactttcctagtttagatcatggttttaggattattctgcgtagtactaatctgttcggcaaatcttcgtgtatcttttccttcatgaaaaaaattaaaattgacaaatgggatctaattaaactaaagagcttctgcacagcaaaagaaactaccatcagagtgaacaggcaacccacaaaatgggagaaaatttttgcaacctactcatctgacaaagggctaatatccagaatctacaatgaactcaaacagatttacaagaaataaacaaacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctctcaccagttagaatggcaatcattaaaaagtcaggaaacaacaggtgctggagaggatgtggagaaacaggaacacttttacactttttgtgggactgtaaactagttcaaccattgtggaagtcagtgtggtgattcctcagggatctagaactagaaataccatttgacccagccatcccattactgggtatatacccaaaggactataaatcatgctgctataaagacacatgcacacatatgtttattgcggcactagtcacaatagcaaagactcggaaccaacccaaatgtccaacaatgatagactggattaagaaaatatggcacatatacaccatggaatactatgcagccataaaaaatgatgagttcacgtcctttgtagggacatgggtgaaattggaaatcatcattctcagtaaactatcgcaaggacaaaaaaccaaacaccgcatgttctcactcatagatgggaattgaacaatgagaacacatggacacaggaaggggaacatcacactctggggactgttgtggggtgggggtaggggggagggatagcattaggagatatacctaatgctaaatgatgagttaatgggtgcaacacgccagcatggcccatgtatacatatgtaactaaccttcacattgtgcacatgtaccctaaaacttaaagtataataataataaaaaaggaaaaaaaaattaaaaaaattaatgattattttgaaacagcttataggtcaagactaagttttgttgacccacaagtgaaacagaggtatcactaataaatcatcactccaagataatgttttccatagtgcatctgtgacagtctcctagggtggaatgaaaatgataaactagagtccacagaattttgctaggaagggaaagaaggtagtaggcatgaggtatcttaagtgttaaaccctgaaggagactttccattcttgccaataaaatggacacatagtgtgtagctgttaataaattgaaaacaggtagtcagatatacatgttctttaaaatgtgttttaaggctggtcaaactaccagtggagaataagataatagatacagacatggtaggctgggcgcggtggctgacgcctataatcccagcactttgggaggccgaggtgggcagatcacttgaagtcagtagtttgagaccagtctggccaacatggtgaaagcccatctctattaaaaatacaaaaaattagcagggtatggtggcacacatctgaattcctggctaatcaagaagctgaggcaggagaattgcatgaacctgggaggagtaggttgcagtgagccgagatcacactactgcactccagcctaggcaacaaagtgagactcaatttaaaaaaaaaaaaaaagatacagacatggtaaaagtttcttctagagcattacagttaaagtgaatataggtggaccacaggattatgtctcttttttttttttttttgagatgtagtctcactctgtcacccaggctggagtgtaatggtatggtctcggctcactgcaacctcctcctcccaggttcaagctattctcctgcctcagcctcccaagtagctgggactacaggtgcgtgccaccacacctggctaatttttgtatttttagtagagatggggtttcactacattggtcaggctgttcttgaactcctaaccttgtgatttgcctgcctcggcctcccaaagtgctgggattataggcgtgagccactgcgcccagccataggattatgtctcttttatgtttgtttgttttcttttgctttttgtttttgagatggagtctcactctgttgcccaggctggagtgcaatggcatggctcaccacaagttccagctcccgggatcaagtgattctcctgcctcagcctcccaagtagctgggattataggcacacaccaccacgcctggctaattttgtatttttagtagagacggggtttctccatgttggtcaggctgttctcaaactcctgacctcaggcgatcctcacgcctcggcctcccaaagtgttgatgttacaggcgtgagccaccatgcctggccacgtctcttaattggaatagtttcctattcagataatcattgttttaattttagaaaagaagcatagcaaccaaaaaaggccatatcaagaaggaaataattgaaaattaacttttttccttaggttcaaaatatatctccatttaaaaaccaacctgtattagtctgttctcacactgctatgaagaaatacttgagagtgggtaatttaccaaggaaagaggtttaattgactcacagctcagcatggctggggttgcctcaggaaacttacaatcatggtggaaagcaaaggggaagcaaggcatcttcacaaggcggcaggacagagtgagtgcaagcagtggaaatgccagatgcttataaaaccatcagatctcgtgagaactcaatcactatcatgagaacagcatggaggaaaccacccccatgactcaataacctccacctggtcctgcccttgacacataaggattatggggattacaattcaaggtgagatttgggtggacacagagtcaaatatcacatccttaaaaaaaattaaaataaaatagaagccatccctatatataatttaaacactaaaaggggagggctggtgttcagagttatgaatcacaatgattttatacattattccatcagatttagtctactgaatctgaaaaaaacacaagtacccagataatcttaaaggttctaaaagttctcaaaatctcacactcaggactcagttcagtgatcagtagtttctttttgtcaggaattccttgccctgagcaggtattgttgatcggccctcctagcatgcatctgggaatctgctcttttggcctcaacctctctctgggacagcatgcatttggctactgatcctatttatcttactgctggtctctaagtgagtcccttaagagcggaccatgccatcctttttactttaacgtcactgatgttttttttctttagaatatggggtctctctgtcagactcctgggctcaaatgatcctcctgcctcagactcctgagtagccaagactacagacgcacaccaccacatccagcaaagtttttaaaaagttttttgtagagacgtggtctcgctatgttgcccaggttggtcttgaccttctggcctcaagcaaccctactgccttcacctctcaaagtgctgggattgcaggcatgagccactacacctggccaaccctcactgatttttatggtacccagtaaagggcagttatgtaagaaactttttgaaatataaagattctttagatcaaaatgttttctagctactcctgagttaatctaaaatatactttaaaattcacaacacttaatttccttgcaatcctatgagttggaattttgctggttagtgggatcctctagagcagtggtccccaaactttttggcaccagggactggttttgtggaggacaatttttccacggactgggtgggggtgggggtggtttcaggatgattcaagcacattacatttattgtgcactgtatttattttttctttttctttttttttttagacagagtcttactctgtcacccaggctggagtgcagtggcgtgatcttggctcactgcaacctctgcctcccaggttcaagcaattctcctgcctcagcctcctgagtagctgggattacaggttcccaccaccacaccaggctaatttttgtgtttttagtagacatggtatttcaccatgttgggcaggctgatctcgatcccccgacctcaagtgatctgcctgccttggcctcccaaagtgctgggattacaggagtgagcgactgcgcctggccctgtgcactgtatttccattactatttcattttaatatataatgaaataattatacaactcaccataacgtagaattggtgggagccctaagcttgttttcctgccaccatttagccccatctgggggtgaagggggacagtgacagataccaggcattagattctaataaggagcatacaaccttgatctctagcatgcactgctcacagtagggttcccactcctgtgagaatctaatgcctccactgatctgataggaggcagagctcaggtgagcaatggggaatagctgtaaatacagatgaagctttgctcactcacctgccgctcacctcctgctgtgaggcctagttcctaacaggccaccgaccagtaccagtccgtggaccggggaaatagggaccccgctctgaattttattttcatgagtggacacaatactctcctgtgttgagtatagagcagggtggtattgtagaaagaccacagtttttgtggtcagacatacttgaattcaaattgcaccttcactatttcctgtgtgcttgactttgaaccagtttcatatgcctatgagcctctttcctgattgaggaatcacagttgggattgataatcaaatgacaccccaaagtggctggtacttatatgaggggtcattatttaaaaaatttttttcattactgagataccaaataaaaaattttaatttaatttttcaatgtcaggtctacttattattattaatttttttgagatggagtctcactatgttgcccagggtggtcttaaactcctgggctcaagcgatcctccctcctcagcctcccaaagtggtgggattccaggaacaagccaaggtgcccaaccaggcccacttatttttttcttctgttgtttgttccttttaattataaatgcacatttagtaatccattcacattgccaaaaatataaaactatcataatggttgcatggcaaatctccagctccttattcttcaatgcgaatttatttcccaagaggttaaatgcttttttgtaaaagtcgtattttaatttactggtgggttattcatttggtgcaagcatcaaacaccatgagaatgtgatgtctccctcccatttcccattactccacagtaggcaatcattggtatgagtttcagttgtttatttatttgtttgattgttggtttgtttgttcaagacagggtctcactctgtcatcagggctggagtgcagtggcatgatctcagctcactgcaacctccacctcctgggctcaagcgatcctcccttctcatcccctcaagtagctgggagtccaggtgcaagccaccatgcccagctaatttttgtattttttgtagagacagggttttgccatgttgcctaggctggttttgaactcctgaactcaagcaatccacctacctcagcctcccaaagtgccaggattacaggcatgagccaccgtgccaggcctcatttgtctttttagaaaagttatacgcatatataagccaatacagatatttttgtcctttttatacaaatgctgagttgctgcgttcattattattttggtgcttgacttttttccacttgatagtagagctcttagagttctgtgtcactaaagatcttcctcattttttagcagttaattttgttataggtgaatatgtgaaggaatcataatgcattttttaatccactttgggtctcactctgtcgctcaggctggagtgcagtggcacaatctcaactcactgcaacctctgcctcctgggtttaagtgactcttatgcttcagccaccgagtggctgggattacaggcatggaccacacccggctaattttgttgtttttagtacatacagggtttcatcatgttgcccaggcttgcctccaattcctggcctcatgtgatctgaccgcctcagcctcccaaagtgttgggattacaggcgtgagccactgcacctggcctcctttccaatttctgacctctgatttttcttgtttgtctaattgtgatgcctaatgcctccagaataataagttaaaaaagaaggataatagactgggtgtgaggtggctgaagcctgtaatcccaacactttgggagaccgagacgggcggatcacctgagaccaggagtttgaaaccagcctgaccaacatggtgaaaccccgtctctactaaatatacaaaaatcagccgggcatggtggtgcacgcctgtaatcccagctactcgggaggctgaggcaggagaattgcttgaacccgggaggcggaggttgcagtgagctgacattgcgtcattgcactccagcctgggtgacagagcaagattctatcaaaaaaaaaaaaaaaaaaaaaaaaagaagaagaagaaaaagaatagcggccattccttccttgcctttaatgtaagtaggaatgttattagttttctccactaagtgagtgcattgattcttgggctggatcttagtccagtgaagaatttcgggatttggagaggagtatacttgagaaacatattagtccattatcacattgctataaagaaacacctgagactagatagtttgtaagaaaaggggtttaattagctcacaggctatataggaagcgtggcaacatctgcttctagggagtcctcggggaatttttactcatggcagaaggcaaagtgggagcaggcatcttcacgtggccaaagcaggagaaagagagagtggggaggtgctacacacttttaaactaccagatctcacgataactcactgtcatgagaccagcactgaggggacggtgccaaaccattcatgaaggcttcacacccatgatccagtcgcctcccagccggccccacctctaacattggggattacacttcaacgtgagatttggtggggacacagatccaaaccatatcaaaatccaattaaaaatttttttgtttgttttagacacagggtcttgctatattggccaagatggtctcatacccctaccctcaaattaacctctcacttcagcctcccaaaatgctgggattacaggtgtgagccacagcttccagccttaatataaatcttgactcagcattctttattctcactgtcagactgctcaatgcatcccttattgaagtttcttgaagtttcgaaaaacaggtatgttcagataattttcagcagaattcatcaaaaaatgttaacaactctttaaaatttttacacattttatttagcacaattgctaccatttaaaaatcaggtgttttggccaggcatggtggctcacgcctgtaatctcagctctttgggaggccgaggcagacagatcacctgaagtcaggagtttgagaccagcctggccaacattgtgaaaccccatctccactaaaaatacaaaaattagccaggcgtggtggtgtgcacccatagtcccagctacttgggaggctgaggtaggagaatggcttgaactcaggaggtgaagtttgcagtgagccaagatcacgccattgcattccagcctgggtgagagagcgagactgtctcaaaaaccaaaacaaaacaaaatcaggtgttttattccactccccccatcagtgttttcttatttctaatacttctagaaacctcctttaagttttcctattttagacagacaccacacaggtgctcttttttgggaggagggggatgagagtcttactctgttgcccaggctggagtgcaatggtgcaatcatagctcactgtagcctctgactcctgtgctcaacccatcctcccaccatggcctcccaagtagctgagactacaggcacacaccacgctgcccagctaattttttaattttttagtagagtcaggtgtcactgtgttgcccaggctggtcttgaacctctggcctcaagcaaaactcccaccttggcctcccaaattgctcggattacaggagtgagccactgcacctggcccatagatgcattaacacctgtctatggtggtggagagaaggctcactgcctctcccaggccactgggaaatgaccttgtgtattctgcaaatacacaagaggatctgaagctattcttgagggagactttcaacagcaaaactcagagcacaaaatggaaaataatcataaaaaaattaaataataatactatcaaatcataacgtgaataatgctgttattagagttgaagagaagcccttagaaatgggacaaacattgtaattctcttagagaactgtaacttaaacagaaatacacttaatagaagaggaaagaaaatggttcatgtgacacaaaggtcccatgtgttgacttctttggtaagatcaaataagtatttaagcctagcaatagggtcagtccagttagtatttctcctcacaaatggtgaatatcaactccaggatggctggagttttctcatggtttggttccacgccatctgcatgtctttacaagtgataaaaaccagaattttccagctgctactagtcacagggggtccccaatatgggttgtttaattatgatgacgggtcctgtcaattgcatccagtaaaattggtcacatagagaactcatctaaaactgaggttttgttgtggttttgaaaggtccattggaatccagatttgcaaagcatgtcaagttatggcaaaacatatgccacccatctcaaaatctttccttattattgcataactttgaaagccactgttgcgtttgttgcgatgaggttagagttttgttgacatgatgatattactctcttcctctgggtgagacacatctggattctcacttggagcagggctctgtacatccttctgggatttggttgagtaggtaatatacatgcttctcattaggaaaattccagcaattactgcaaaatagctcccataaactaaaaactggagaaaaacaaataattagccacatataaaatatgaccatctatgtcaatgataatacatcctaatactgttggtttgcttggattatggggtaactgagacccaggtttttaatatgggtcatttaggttgaacaatactctcctatcaagtaagaaatcaagatcaagtaagaaggtgtaagcaatacggtgactaagagtcttggctttagagcaggttgcttgggttaaaatcatagttactatcatcaatagtaaaaaacaaaacaaaacaaacccaaaaaaacactaaaactcattgacctgtctctatgtctttgtttggaggctggtgcaatgctacattcaatgtctccaagaataaatttaagcattgaggttacttcttacctgccttatccatgtaaatgttgtcctagttgcaattattgctcaaaacctacttggtgtgttataatatgataatgaaggaattatgtattttttaattgcttaaccaaggaactcaagaaatttaaatattgcttgttgtaaggttgagaaatttttgaggttacctagttgaaaacagaagtattgcagcttacctgaatgctgactggcaagttgagccctctctgatctactacaatcacagtcatgatggtctgaatcaccaaggcaataaaggtgttgattccaaataccaaggcatagcgttccacattcagattaactgcaatctgaaatctatcattaaacataaataagcattttaactataatatacatggatggaagtcttaaaaagatagaacatattggccacaggggtatttgtgtcacccacctccagctccaggtagtccagcaaagagagagagagactgtctggaagaaagtaaaggaaaagaacaagtgtctctgtctggtaatccagagaattcttctggatcttatccaagaccaccaaagcagtagctctaagagtctgctagaaccacagtgttactgggcttggggtgctccctaatgtagatacagtttagatcacaacacccaaatccttctgaatacctggaaagccttcccacggaggacaggtacaaaaaagcccagacagcaaagactacaataaatacaactcttcaataccctgacactgatgaacatccataagcatcaagatcatccaggaaaacgttctcaccaaacaaactaaataaggcaccagggaccaatcctggagaaacatatacgaccttttagacacagaattcaaaatagctgtgttaagaaaacgcaaagaaattcaagataacacaaagaaggaattcagaattctgtcagataaatttaataaagagattgaaataattaaaaagaatcaagcagaaatgctgtggttgaaaaatgcaattgacatactgagaatgcatcagaatctcataccagcagaactgatcaagcagaagaaataattagcaagcttgaagacaagctatttaaaaatacagtcaggagacaacagaaaaaagaagaatgaggcacacctacaatacctagaaaacagcctcaaaaaggaaaatctaagttattggccttaaagaggaggtaaagaaatagatagaggtagaaagtttattcaaagggataatatcagagagcttcccaaacctaaagagatcaatatccaaggacaaggttacagaacaccaagcagatttaacccaaagaagactacttagaggtatttaataatcaaactcccaaaggttaaggataaagaaaggattctaaaaggagcaagagaaaggaaataaataacatacaagagagctccaatgtctggcagcagtcttttcagtagaaattttagaaccagggagtggcatgacatatttaaagtgctgaaggagaaaaacttttaccctagaatagtatatccagtgaaaatatcaaacccgaaggagaaataaagaccatcccagacaaatagaagctgagggatttcatcaacaccagacctgtcctacaagaaatgctgaagggagtacttccatctctaagaaaaggacgttcatgcgcaataagaaaacatgtaaaggcacaaaactcacttgtaataataggtacatagaacaacacagaatattatcacactgtaactggggtatgtaaactactctcataagtagaaagactaaaagatgaaccaatcaaaaatagtaactacaaattttcaagacaaatagtacaataagatataaagagaaacaacaaaaagttaaaaagcaggaggacaaagctacactgtagagtttttattagttttctttttgcttgtttgtttatgcaaatagtcttaagttgttatcagcttaaaataatgggttataagatagtattgcaagcctcatggtaatctcaaattgaaaaacatgcaatggatacccaaaaagtaaaaaagaaattaaattatatcaccagagaaaatcaccttcactaaaaggaagaaagaaaaggaaaaacactgcaaaaccagaaaagaaataacaaaataacaggagtaagtccttacttatcaatctaaactcttcaaaagagagtggttgaatggatttttaaaaagacccaatgacctgttgcctacaagaaagacattttacctatagagacatacatagactgaaaatgaagggatggacaaagatatgccatgccaatggaaacaaacaaaaaaagaggacttgtagctatacatatagcagagaaaatacatttcaagacagaaactgtaagagacacaggtcattaaacaatgataaaagggtcaattcagcaagagaatataaaaattgtaaatacggccaggcgcggtggctcatgcctgtaatcccagcactttgggaggccgaggtgggcagatcatgaggtcaggagatcaaggccatcctggctaacacgatgaaaccccgtctctactaaaaatacaaaaaattagctgggcatgatggcaggcgcctgtagtcccagctactcgggaggctgaggcaggagaatggtgtgaacccgggaggtggagcttgcagtgagctgagatcgtgccactgcactccagcctgggtgacagaccgagactccatctcaaaaaaaaaaaaaaaaaaaaaaaaaaattgtaaattttttttaacgtatggagcacccatatataaagcaagtattagagctagaaggagataagagaatccaatacagtaatagttggagactttaaaaccccactttcagcactggacagatcttccagagagaaaatcaataaagaaacatcagacttaatctgcactatagaaaaaatggacctaatagatatttacagaacttttcatccaatggccacagaatacacattgttctcagcatatggatcattgtcaaggataaaccatgttaggttacaaaacaactcttaaaacatattcaaaaatttgaaataattaatatcaaacatcgtctctgaccacaatagaataaaactagaaatcaacaacaagaggaattttggaaaccatagaaacacatggaaattaaacaatatgcccctgaatgaccagtgggtcaatgaagaaattgagagaaactgaaaaatttcttgaaataaatgataatggaaacacaacatgccaaaacctataggacacagtgaaagcagtattaagagggaagtttatagttacaagtgcctacataaaaaaaagaagagaggccgggtgtggtggcccatgtgtataattccagcactctgcgaggctgaggcagatgaatcacttgagctccagagttctagaccagcctgggcagtatggtgaaaccctgtctctaccaaaaatacacaaaaattagccaggtgtggtggtgcatgtttgtgatcccagcttctcaggagtctgaggcaggaggatcacttgagcccaggaggcagaagttgcagtgagtagagattatcacgccagtgcagttcagcctggagaacatagtaagaccctgtctcttaaagaaaagaagaaaaaaaaagtcatctgaaataaataacttaatgatgcgtcataaagaactagaaaagtaagagtaaacttaacccaaaattagtagaagaaaggaaataataaatatcagatcagaaagaaatgaaattgaaatgaagaaaacaatacaaaatgtcaatgaacaaaaagttgggttttagaaaagataaaactgacaaacctttagccagactaagaaaaagagagaagtcccaagtaaataaaactagagatgtaaaaggaaacattacaaccaatactgcagaaatttaaaggatcatcagtggctactatgagcaagtatatgccaataaattggaaaatctagaagaaatggataaattcctatatacaaacaacctatccgattgaaccatgaagaaatccaaaacctgagaagaccaataataagtaataagattgaagtcataataaaaagcctcccactaaagaaaagcccaggacccaatggcttcactgctgaattctatcaaagaactaattccaatcctaaccaaactattctaaaaaacagaggagggaatacttccaaactcattctacaaggccagtgttaccctaacaccaaaccagacacattaaaaacaaaaaacaactacaggccaatctctgatgaatattgatgcaaaaattctcaacaaaatactagcaaactgaattcaataatacattagaaagataatctatcatgactaagtgggatttatcccagggatgcaaggatcatttaacatatgtaaatcaatcagtgtgataaatcacatcgacagaatgaaggacaaaaactatgatcattcaattgatgctaaacaaagtatgtgatacaattcaacattccttctggctaaataccctcaaaaaactgggtatagaaggaacatagtcaacataataaaagccatatatgacagacctacagctagtaccagattgaatgggaaaaagctgaaatgctttactctctaagatttggaacacgacaaggatgcctacttttaccactgctattcaacatagcactggaagtcttctctagagcaatcagacaagagaaagaaataaagggcatccacattggaaaggatcaagtcaaattatccttgcttgcagacgatatgatcttacatttaggaaaacttaaagactcttaccaataaactattagaactgataaataagttcagtatatttgcaggacataaaatcaacatacaaaactccataacatttctatatgcaaacagaacaatctggaaaagaaatcaagaaagtaatcctatttacaatagctacagataaaatacctaagaattaactaaagaagtgaaagatctttgcaatgaaaactataaaacactgatacaagaaattgaagaggacacacacacacaaaatggaatgatattccatattcatggactggaggaatcaatattgttaaaatgcccatactatccaaagcaatttacagattcaatgcaatccctattaaaatgccaaggatattcttcacagaaatagaaaaagcaattctaaaatttatatgaaaccacagaagacccagaatagtcaaagctatcctaagcaaaacaaaacaaaatgaaacaacaacaacaacaacaacaaaaaactggaggaatcacattgcctgactttgaattacactatagagctatagtaaccaaaacagcatagttctggcataaaagcagacatgtagaccaatggaacagaagagtgaacccagaaacccaatagtgaacccacacacctacagtaaactcattttcaccaaagatgccaggaacatacattggggaaaagacagtctcttcaacaaatggtgctgggaaaactgaatatccgtatgcagaagaatgaatgaaagtagacccctatctctcactatatacaaaatcaagtcaaaatggattaatgacttaaatctaagacctcaaattatgaaacaactacaagaaaacattggggaaactctctgggacgttggagtgggcaaagatttcttgagtaccccacaaacacaggcaaccaaagcaaaaatggacaaacgggatcacatcaagttaaaaagctcctgcacagccaaggaaagaggccacccacagaatggaaaaacaaatttgcaaactacccatgtgacaagggattaaaaaccagaatatataaggagttcaaacaactctacagggaaaaaaagtctaataatcagattaaaaatgggcaaaaatctgaacagatgtttctttaaaggcatgcgaatggcaaacaggtatatgaaaaggtgctcaacatcattgataagagaattataaatcaaaactacaatgagatattatctcacttcaatttgaatggcttttatccaaaaaacaagcaataaatgctgatgagaatgtgcaacctctgcctcccaggttcaagggattctcctgcctcagcctccccagtagcagggattacaggttctcaccaccatgcccagctaatttttgtatttttagtagatacggggtttaatcatattggccaggctggtctcgaactcctgacctcaggtgatccacctgctttggcctcccaaagtgctgggattacaggcgggagccactgtgcccagccgtgaatatttttttttaatgcaaagaaatgatataatcctactttaacaaaatcttcacatttaaaaaaaagcaacctaagatacatgattctgattaaattaagacatttccatgaagaaaataaacataccaactaattgttttttcctttgatgattttttcccagagtgctcatatttctgtgttgtaaattgtttataaaacattcttcacaaattgaaagcaaaacttgatgaagcttttgtctccacttctttcatgcaatttgaaattcaaatgtttctcattttttttggttaatagcaaagcatattttctgtagtcagctttagctgtacttttatatgaaaccgaatggttttttaatcattttcttaaagagatctctgagaaaaaagtagaagcaaaaatgacgggaaattctaaatcccagaaattatttttagaaaatgactgaaaactagatctggcgtggtggctcacacctgtaatcctaccactttgggaagctgaggccagaggattacttgagcccaggagtttgagaccagcctggggaacacagtgacactctgtctctacaaaaatgaaaattaaaaatttagccaggcatggtggtgtgcaccagtagtttcagctactcaggaggctgaggtgggaggactgcttgagcccaggagatcaagattgtggtgtgctatgattgcaccactgcactcctgcctgggtgagaccctgtctcaaaaagaacaaaagaaaagaaaaactgcttggttccatacacgactgcagctaaaggtttcttgttatctttgcatctactttttttagtatccaactttttaataactttcctgagaatcttttgtgtcataaaagtatgtgcttagaatttctcaagcaaacaaatgaaagtaggaatgaaatctaaacctaaccatttgaaagcagatcacatcacactttatgtagaaagttgctggaaataaacaaatcaaatcctgacaatgatgccagatgtagtggctcacacctgtaattccagcactttgggaagccagggcaggtggatcgcttgagcccaggagtttgggaccagcctgagcaacatggtgaaaccccatctctacaaaatacgaaaaattagctaggcatggtggcacatgcttgtcatcccagctactcaggaggttgaggttggggactcacctgagcctgggaagtcaaggctgcattgagtcctgatcgtgatcgcaccactgctctccagcctgggcaagagagccaggccatctctcaaacaaaataaaacaaaaagaaaaacctgacaatgtatcactgcttttggtctataaacctacagagttttttcccttgatgacttaaggtatattgtagcaatattcagagagcaaatagttaaatgaaaagttggcttagttgtgtctaatttaatataaagcagtcaacatttaatattgcaattgactaaaatccttctgaagttcttagagaaagtttagaaagacagaagagagaggaatacagttcagttttaggagtggttggtaaaacttacactgctatggttataagaagcatatagctggacttgaatatcaaatagccagcatagcacgcccagatattggctgtgtaatgcatgagaaataaagaaccggcattgacaactgagaagaccaccagagccagctctcccagaaggtcccagttgactttcacataacccactgcaaaggcagccacagcccctgaaaaaaaacattgaaggcaatcaaacataatgactttgcatgcaggaaaatatcaacaccctctcttaaaaacccaggtctcgggtaattctgaaagataaatatattgctttcacaaaattgtgtgatcgacctgaatgtggatctatccttttctcaagcgtgtcttcttttggcttttcttttcacttgctattctttcggtcacttagtcaccatacttttaattagcatcaactacacgccagacactgtattctgcagaggggccagaaaggttcctaaccacagcagtgtaaggagaaatgatacattaacctagtcactcagtacaacatgcagggatggaaaaggatgaaataaattctctgggaatacactggcctctctatttgcctttcttttctcagtttttgctgtaagtctttttcagtgatgagtatcagatgtgttacattgaaagttttagtcttttttcttgccctacccagttttagtctttattatgaacctttagtaatcttagtcttatttccaatctccactctaaagtcttcaacatctgacataatttacttgagaagctttgggtgaaaatatctatatagacttacagagttcaagaaattgaaataattgacagtaattagggttagcacttttgtgtggttctctttaacaaaggtaaaaggtatttagggctggggacagtggcgcactcctgtaatcccagcactttgggaggctgaagggggtggatcacttgaggtcaggagttagagaccagcctggccaacatggtgaaactccagctctactaaaaatacaaaaattagccagcatggtggcgggcacctgcaatcccagctactcaggaggctgaggcaggagaatcacttgaaccctggaggcagagtttgcaatgagctgaaatcatgccactgcaatccagcctgggtgacagagtaagactctgtctaaaataaataaataaacaaaaggtatttagatttcaaattactacattgacatatgactaactttcccacatgtgatcatgaccacagaggaaaaaaaaaataactatttttccccccatggatttggaatgtaggagcaataatttcagtgaagcaattctggcacagtcctggtttccaggagttaaactgaagcttcccaaaagggagataataataaaatagaggtcacacgggttttctaaaactttttgtaaatgagggtggggcgaattctcacttcctaaaaaatatcttcaaagtctcatttgacatttaagcttccagttactaggaaataaacatttattgtagattaaacttcaaagacagatttccctctgatattaaaatcctgactttcacatctcttccagccctcatttaaataccatgagaaagctgcttttgaaagttgttggtgtatagcctagaattgttataggtgcatgctagctagttcaaatcctgtattaacaaaaccctcagtgagaatttggaatccttaatttattttctaaaataatgaaaacatatacacatatatgtatatattttgatattaaaaataatcctaaaagaacagggcatgttattaacctttgtgctaatgatgaattggaatcttagggattcaactagaatttcattgtttggtgctaatccctgagctcctaagagttacttcttgtggctgggcgtggtggctcacgcctgtaatcccagcacttttggaggctgaggcgggtagatcatgaggtcaagagattgagaccatcctgggcaacatggtgaaaccccgtctctactaaaaatacaaaaaaatttagctgggcatggtggcacgtgcctgtagtcccagctactcaggaggctgaggcaggagaatagcttgaacctgggaggcagaggttgcagtgagctgagatcgcaccactgcattccagcttggtgacagagtgaggctctgtctcaaaaaataaaaaagttacttgtaactacaacacaatagaaagtcacagtattcttatttttccagtgactttcattctttttatttttatttttatttttttgagaggagtctcgctctgtcatccaggctggagtgcagtggcacgatctaggctcactgcaagctcagcctcccaggttcatgccattctcctgcctcagcctcccaagtagctgggactacaggcatccgccaccatgaccggctaatttctttgtatttttagtagagatggggtttcaccgtgttagccaggatggtctccatctcctgtcctcgtgattcgccagcctcggcctcccaaagtgctgggactacaggtgcccgccaccacgcctacctattttattttttgtatttttagtagagacggggtttcactgcattagccaggatggtctcgacctcctgaaatcgtgatccacgcgtctcagcttcccaaagtgctgggattacaggcataagccaccatgcccggccgtgactttcattcttgactgaaaaaagttatgcttccttctgaacagagctaattcgctgccatgaagttcggtacctggaggaatggacttaagcgggtaaagccaacaaaggaagattaagtgacatttgcttacctccaaaggttgcaatagcttctacggccccattatagatggaagaatcttgggatggcgccttgtaatcccacaggatttgaacatagttcaaaacctggttaaaacctgctgtggcgaaagcccaccatagagaccagtagaaaagacgttttgaggagtagcactccttcaaatcttggaaccactgcacaaaaacgtccacagtcacattgcttggtttcaggctgttcagctggcccttattcagcttccctgaagtgctgagtatttctgatgtgggtttctgctcttcacagcctggtgcttcaccttcgtgagtttcctctaatactggattcacgcttgatgacttctttatttctctgctgggttttgcatgaaaaaacatgcttttcttgggcattggtaggaaaagtgagaaaaggaaagccacggagacagaggccaaggatatgacgttgaggtaaaagtacgacatgttcgccagggataccaagagttgagccagcaccgaccctgctgtgtaggcggccagcgtgacgctcctgcagtagccgctcactctctggtagtgctcggggctgaccacgctgtatatgtaggcgtagtaggccacctcggcggcggtgaccatcccatagaagaactctacaacctgcatggtcttcactccttggccaaacaacagcagcagccaggtaatgatgaaactgataccttgcaagatgatgactggcttgtagcggacataatcggtgaggacaaacacaggcagcagcagcaccaggtaggagtatgtccaaacggggaagatctcatttgttatctgcaaagttggtaaattgcatgaccacgaagcaccggtactttactaaggtacctgtggtttgtatctcaaattctgcctccaattggaaattattcgcattacggagaaacataatgagaaaactgattttcaaggaaatcacaagaaaagatagtctcctttcccattggtaaaaaccaatgtacacacttagataaaccccggcagaaaaatatattggcttattgtgcaatctgaattatgtattaagtttagatagtatgtacagttgagtagatgagttaaaaagtttttggacacttctaagattttccgattctttttttttgaggtggagtcttgctcagctgcccaggctggagtgcagtggcccgatcttcgctgactgcaaccaccatctcccaggttcaagccattctcccatctcagcctcctgagtagctgggattacaggcacccgccatcatgcctggctaatttttgtattttagaagagacggggtttcaccatgttgatcaggttgatcttgaactcctgaacttaggtgatccgcccacctcggcctcccaaagtgctgggattataggcgtgagccaccgtgcccggcccaagattcttaaaaaatataatttccttcttgtttgaatattaacattagacaagtagaccacaatgttaaaagaatccaggccaggcatggtggctcacacctgtaatcccagcaccttgggaggccgaggcaggcagatcacgaggtcaggagttcgagaccagcctggccaacatgatgaaaccccgtctacaactaaaaacacaaaaattagccatgaatggtggcagacacctgtaatcccagctacttgggaggctgaggcaggagaatcgcttgaacccaggaggcagaggttgcagagagccgagactgtgccactgtactccagcctgggcaacagagcaagactccatctgaacaacaacaacaaaaagaatccaacagcctttattttcatgtgatctatcactacatcaaatatttcagcccttccaacatctggaaagatatgggaaaatagggaaagagtaaataactttgccacattatagagtggaagcaaataatgtatctcattttccttcatgggcaaatttgctaggttcccaaccttccccctgctccccctaacaattctgctgatttgtttatggctcaatttaatatggatcatctcacagatttagtcagaaatgcatgggatctcaattttcacagttggaaggactggagttgctgatctgtagggatgggtgagtgccgcagcctctcaaatcactgaacgtacccaccttgacacctggatcactgaggttgctggagaaagcaggaggccacagagcaaagaccacacaactgagctgctccttggagggaaggtctgttaactggtccacagtggctcgagaagcagaacccagtggattcattgagttgcttctgaccctgcatctgtcctttgttgtcttaattgtggcatgcttcaacctgagcaactcggaaacagggttgtccctaagtgatctgatgctacagaagaagcttgcctttctgtctttgccacctcaccacccgaggcacccatcagccttgcaggcgaagccacacactttacacagtgttttcaaggctaaggctggagattgtaaaatcagcccagggtaattttgcagttaggtcagtgcattttcttgttgtacttcttataaagaaatgcgaggccggtggcggtggctcacgcctgtaatcccagcattttgggaggccgaggcgggtggatctcttgaggccagaagttcgagaccagcctggccaacatggggaaaccctgtctctactaaaaatacaaaaattagccgagcatggtggctcatgcccgtagtcccagctactcgggatgctgaggtaggacaattgtttgaacctgggaggcggaggttgcagtgagccaaaatcaccccgttgcactctagcctgcacaacagagtgagactccatctcaaacaaaaacaattaaaaaaaaaaaaaaagaaagaaagaaagaaaaagaaaggcgttgctcttttaagtaagagaaactggcattccagagaaggaggcaagggctgggagataaagctgttaatggctcacctgctggcaaacagtgtcataaagaaataccacaattttttatgagatcctgcttatccctcagcagcctgagagtttatttagatctagatcctgtgcctgccagtgatgctattttaggattagtataatagaatcaacggagacctgaaagtctcctatcattaacacaaatgttaggactctatgcaagttaaaaatttgttaacacatgtaatatgttttggctgcaattttttgcaagtaagaagaggaaatagtttgaaaagttctatatgggacacatattatgaaaatcaggctcactgagtttaatgtgttcatcttatatcaagttgagggaagccctgtatccttgttcaagtcccataaaatttaaaaaaccacattaagatatgtatgtatgttaacttacctctgcactggtcaggtttttatctggtccagataaatatgggataaggaatggttctgagggtctcatcatggagaaaaaaccaaataagcagaggatcacagtggggtaaatccaggaactgcttagtgaagttctgtaacaatccatggctgatcaaatggaaacaaagagaaaattaagtgatgcttattctttttagcatccttgatgcgatgaaaacctgattttttttttttttttgagatggagggtcgctctgttgtccaggctgaagtgcagtggcatgatctcagcccattgcaacctgtgcctcccgggctcaagccattctcctgcctcagcctcccaagtagctgggattacaggtgcctgccaccatgactggataattttgtatttttagtagagatggggtttcaccatgttggccaggctggtcttgaactcctgacctcgagtgaggaaattgcttgaaatgcaagctttagacataaagcccaatagaggatctcatttgtcactgcacagaagaaacaaaaaacaaaaaacaatcattgtatggcagctatatttgaaaacatcttgctatctcatgtgaattatcatgtgcacaggaaaattcactaattcctccacattttagctcaagctttgccttattgtaatgtttatagatttttgatggtcctgcatgtggctaagttctctgagatacatttataggaaggaaactaatttgttgtatgatgcttttctgcatactatctccttaaatctacataataactgtaagacagatatcatttccccacattcccagaggagcatatggaagatccaagatgcccaaacactggcttcaaaccacatgatcaagatctgaatccaggtctccctactcccatcaggaatctttcacccactccactctccctcattctggaggccccctcagctactggtattaacctaatgacaaccacagtgagggaaaaaacgtgtatttataaacacattcacactaaagattatggttacatatatagagcttttagggtcaattgcagtttgaaagcagacgagagagaaggaaaagcattctcattccggaatagcaagtcttacctgggtggaattccaggtatccagtgggtggggagctttactaggggttggggaggtaggaaggacctactaggtcacatcattgcggcttgccactcaccctaccctttcccaaggtgaccccgacagctgcataattcctctcttaagttcaatagggtaaacactgtttatgtcaacaaagcccttgattaagcagtggagagacaagagcgatcagattttgaaactaggattacagcatcagtgagcaatgctgacaatgtgaaaattttgccaaaggcaaattacagtgactgttaacctactcccttagtccagaaaacagggctttctcttcttcctggaatgctgctgggtttgctggtgctttctgtcttcgttgttaatgatcttatagaaatggctgtcctggacaggtgatcactgaggcttggtcatcttctgaagagtggtcttgctggggtagcatctgctggctctatatccagagcctcctctccacctttgctgaccacggatttgttctctaaatccaggtcatcatcttctctgtgcatctgagacctaggactatgccacagtgatccacaggctgctaaaagcctgctggattatctatctttttatttctttaggtttctaatacagctgtccaaatcgatttagttgggatggtcaagcagaaaaaaacctataataagacatgccctactaaagtacaagcccaggagggcagggcgtattgcctggtccaccacattgtcttaagtgcctagcatagcacctaatacatagcactcaaggaagatgctgaatgaattgaataaacaaaccactacagtctacttgaagaagggtaagggtgaaaagagagaagtgtcaggaacaggcaagaatccaggagttagggaagacaatcttatagaaggaagggcatgagtcacgcctcaccactgagaataaattcaagtgctgcctggttttcgtgagtgcatctcacttcctagctgcatgccttacaggacagaaaggtcctcagatctccaagtgttttaccatttacgactaggactatgataattgaattacttatgcaatcttttaaaataatttttacattttgaaaatgatttaatttttcttggagcattctgtgaggcacatggaggtggtatggttgtcactggatagatggggaaatggaggactaaaggtagtaagatttgtgctcattttcacctttaacaaacatcagagcctggacttggtctcagtttcctaattccaagttcagctatctttcctcttaccctctgtttgagacagcctggctatatcctcaaaattcccattctaaactgagcatggtgcccagcactttgggaggctgaggcaggagggtcacttgaggccaggagatcaaggtgtcggtgagctgtgatcacaccactgcactccagtctgggtgagagtgagatcttgtctcaaaaataaaaataaaaatccaatttcagtttattttaaaacagtgcttttcatattgtggtgtcaaggaaatttagtatggggttgcaaacagcattattattattattatttgagatggagtctcactgttttgcccaggctggagtgcagtggcacgatttcagctcactgcaacctccgcttcctgggttcaagtgattctcctgcctcagcctccagagtagctgggattacaggcacccaccatgcctggctaatttttgtgtttttagtagagatggggttttgccatgttggccaggctggtctcaaactcctgacctcaggtgatccgcccgcctcagcctcccaaagtgttggatttttttaatggtacaaaaaatgttaactatcagaatgcattgcagagaaaggctaagctttttttctgaaacttctgtttgggtcagcaatatataaatacaaatatataatcataatgtacactatcttactataggacacggtactaagttagaagttgtagaggaagactgggctcagtggatcatgcctgtcatctcaacactttgggaggccagggcaggatgactgcttgaggtcaggtgtttgagaccagcctggacaacatagcgaggccctatctcttaaaaaaaaaaaaaaggtatacatgttcatgtatctttataatacaataatttctatttcttgggggtatatacccagtaacaggaatgatgggtcaaatggtatttctgtttctagatctttgaggaatcgccacactgtcttccacaatggttgaagtaatttacgttcccaccaacaatgtaaaagcatttatttttctcggcaacctggccagtgggaatggaatgatgagaacgcatggacacatggggcgaacaacatgccctcgggtctgtcggggaaatggggaggcgggggaggaagaatggctaatggatgcttggcttataccaaggtgatgagttgatctgtgcagcaaaccaccatggcaaacgtttacctgtgtaacaaacctgcacatcctgcacatgtaccccagaacttaaaataaaagttgatgaaaaaacaaacaaacaaagatttagcgtggtgtggtgaagcatgcctgtaatcctagctacttgggaggctgaggtgagaggatgactttagcccaggagttcgaggctgcagtgagctgtaatcatgctgctgcactccactctgggcgacagagtgagatcctgtctgaaaaaaaaaaatgcagaagaaaaaatgcactaaatatgaacacatgtcccttataaacatagtaaccacctgtgctgtttgggaggatcacttcctccacaacaaagtattattctggaatagactgttcttttgtcttttttccatttatcattccattttgatcccgtcatattatccgcctctaaaaaagtgctctaaacgtccctttgcttccactgcttctaaggtgaggacatgaattgacttgattttctgagttcatacctgtgaaagccagatgtttacctttccccttcattttctgtgtgttccaaatcacaagatagtccttttaaaagttactcctgtagcagtcatcttcacccattattataagctctatcactttttaaaaaggtacaagaacactgtgtaaacggtagattaaaaattttaaaaggctgggtgtagtggctcatgcttgtaatcccagcgctttgggaggctgaggcaggtggatcacctgaggtcaggagttcaagactagcctggccaacagagtgaaaccccatctctactaataacgcaaaaattagtcggttgcggtggtgggtgcctgtaatcccagctacttgggtggctgaggcaggagaatcacttgaacccgggagatggaggttgcagtgagtggagatcatgccactgcaccccaacctgggcaacagagaacgactgtgttaataacaacaacaaaaggcacattccctaaacaaaagtcagcctatcaggctctcacgatttgaaacatgcagtgaagatgctgaaagtagaaagaaagagtcaattcatcagctgctctttttagcagagactcagagcagctaaatccacaacagaccttaccttggtggacttggacgcacaggagagagtttacagtggcacagtgttagctacaacagcagattgaggaggtgaaccctgagctttggcctttgctccactccagagctacagtgaccctgggcgggtctccctgctgcacctgcacggcagaccagagtgcacttgtcccctgaccctgttgcagcacaccacatgagccctgaagaaaatggccacagacactgtggggatacacagaggcgctgatccagccaacatctttgactttgaatgagccaacacctttgcattgcaagtggtcacttcagttgccttggaactgatgggttcctttcttcttttgctggtagaaaaataattatttttcagccaggcgcggtggcttatgcctgtaatactaccactgtgggaggccaagtcaggtggatcgcttgagctcaggtgttcgagactagcctgagcgacacggtgaaaccctgtctctacaaaaatacaaagttagccaggcatggtgatgcgcacctgtaatcccagctacctgggaggctgaggtgggaggatcactgaagacctgaaggcggaggttgcaatgagctgagatggtgccactgcactccagccgggcaacggagcaagaccctgttctcaaaaaatatacaataaaataaaatataataaaaaaaaacaaatttaaaaaataatggaaataattatttttcatattatgaaaaaagccacagctgtcccaccaagggatgcttcagttctctactgtttggcctccagcttctctcaatctctattttttttgagacagagtctcactctattgcccaggctggagtccagtggtgcaatttcagctcactacaacctctgcctcccaggttcaagcaattctcctgcttcagcctcccaagtagttgagattacaggtgcctgccaccatgcctggctagttttttgtatttttagtagagacgggatttcaccatgttggccaggctggtgttgaactcctgacctcaggtgatccacttgccttggcctcccaaagtgccaggattacacatgtgagccaccgcgcccagcctgaatctgtatttggagcccattgccatgtattccacataaggccacattgtttactgctggctccccttctttggggtacgtggggtgccacagccttttgaaaaaaactctcttgctagcatacctaatcctacttcattttaaaatgctcttagttttcttttttttaatctcccacaaaagttaacttgtattttgactatgaatgaatttggcaggagtggcttctcatgatttttgtttttatctgccttgcaacctattacatgtttgcaaaatttctttttatgcaacctattacacagttgtagtctctttgtatcagagttcaattttttctttcttcttttatttcaattattaccatgttattggcttttccacttttaaccatctccttaaattgttctttccacctggcagccggacacggtggctcatgcctgtaatcccagcattttgggaggctgaggcgggaggattgcttgagcccaggagagcctggcaacatagtgagaccctgtctctatcaaacaaacaaacaaacaaacaaacaaacaaaccaaaaaaacaacaaaaaaaactttccaactggctgcaggctaaccttctttgatagataaatgctttcacaataattataagtgtttagttgatttttaatactatctctgaaactgtcagtgttcttatagtgactgcaagataagttcatttgtcatcctaattctgtagcatagaaaaactaaggtttttgtttatttgtttttagtgggaaacaaaaaaaaattacttcattgctaggatctcatttggagtgagttacaaatgaagattggaactcacatctcctgggtttgctgctgtatttccttcagtgagtcttatctcagagtcactgtgcggattaagacctttccatagttgtgcacacaacaatgttcacgtattgttcatatatgcattggggaatcatattggatctaagctaatttggaccttatttaaatttcagacatggatagtgtcctatttcctaatccataggttgtctgtatctatctctaagtgcatatacttaaaagccctatgtccacaaatatttccaagtatattttccatttttgtagggtaaacaactgttaaaaagcaagaactgcagaaactgaggccgggcactgtgcctcatgcctgtaatcccagcactttgggaggctgaggcgggtggatgacttgaggtcaggagttcaagatcagcctggccaacattggtgaaaccccgtctcaaactaaaaaatgcaaaaattagccaggcatggtggcgggcacctgtaattccagctacttggcagactgaggcacgagaatcacttgtacctgggaagtggaggttgcaaatgccaagattgagcaaatgcactccagcctgggtgacagagcgagactctgtcccaaaaacaacaacaacaaaagaactgcaaagctggcatgcactggtgggtttcctgaagccagggtgattttctagctaaggtaaagccttatttggtcagattcctccacccatacacacccacttgcacacccagaggatggaattctcccacagccaaagcactcagagctgtggggctccctgaggtaggggacaaggtgacctgatgaaagcaagtaactccctcaaacctgataagtttcccacaactgactgcctggagaagaacaagatattgggtgggtggaaagaaatcactttatcaagtcctcgtccatgttgtactgacaatactgccagaattaacccagatgccagtaatttggaaggaaattatctacaatagtggtacccaaccttcctggcaccaggaacccgtttcatggaagacaatttttccatgaaaaaatgggggaggagttagggggaatggttttgggatgaaactgttccatctcagatcatcaggcattagattctcacaaggagctcgtaacctagatcccttgcatgcacagttcacagtaggatttgcacttccaggagaatctaatgccgccactgatctgacgggagacggagctcaggtggtaatgcttgcttgcccgccactcacctcctgctgtaatggcccgttcttaacaggccataggacccctgatctagaatccccactctccacctacttcctgcccactcctttctactaatcattccagccatctcagagagggtgtctagccaggcagccatctgagaaatgggctagcctgattttcacaataggctagaactttactgcagtcaaaacacttctttcaaacagaagagcaataaattggtaattatatgtttgccagactccatctctacaaaaatacaaaataaggctgggtgcggtggcttacacctgtaatcccagcactttgggaggccgagacgggtggatcacctgaagttaggagttcgagaccagcctggccaacatggcaaaactcggtctgtactaaaaatataaaaattagccagttcaagacccgcctgggcaacatagagaccccatctctttaaatattaaaaaaaagaaaaacgaatcttacagagcatgatcttcagctccttcccccccagtttttagactatctatggaccccactccaagctatcttattagcataaacacgttatcaaagagggtcattatgaataaaaagacacctgttactcaggaattcccaaaagttttagcttaaagaccaaatacattttatgttatatcagttacagtttccaaaaagcccacctcccaggctttcaacactgctagagtcaagcccttccctagacagagcaaactcaaagtctgattactaaaaacaaaaatatttgcttttagctgacatatcagagcagacaaactaattatgccttttaatctgcttattactaaaatagaagagaatataactttcagtaaaacattcaaataaagcaaagggctgcagtcagcttaagtcagggcaagatggtcctgaaggaaggcaggggaaaggattccagggtcttgcttaaccaccgtcgttctgctgcagtcagaattagtgggtggtggccaggcgcggtggctcccgcctttaatcccagcattttgggaggctgagacaggcagatcacctcaggtcaggagttcgagaccagcctggccaaaatggtgaaaccccgtctctaatacaaatacaaaagaattagctgggcatggtggtgggttcctatactcccagctacttgggaggctgaggcacaagaatctcttgaacccaggaggtggaggctgcagtaagccaagatagtgccactgcattgtggcctgggtgacagagcgagactctgtctcaaaaaaataaaataaaataaaataaaataaaataataaaataaaataaaaattggaaggtggttccaccaacttctagggagttattgtattctggctgtaacttcatcttacttgaaatgcatcttactgatcactgcctcactccatacacaaaaactaatttgacataacaaatactaacaccacagcatgccatccagaaggaaacagatcttcgttacctagggactggcacatatttgaaataataaaaagaatcttaaaagaaaaaaaagataaattgcatttcatcaaaaagccacatctgcttatcaagaggtactgttaagaaactgaatggaaaggaggctgggcaccgtggctcatgcctatagtcccagcattttgggaggccgaggtaggtggattacttgaggtcaggagtttgagaccatcctggccaacatggcgaaaccccgtctctactaaaaatacaaaaattacccaggcgtggtggcacaagcctgtaatcccagctactcgggaggctgaggtagaagaatcgcttgaacccaggaggtggaggttgtagtgagccgagatcccgctattgcactccagcctgggcgacagaatgaaactctgtctccaaaaaaaaaaaaaaaaaaaaaaaaaaagccacatctgcttctcaagaggtactgttaagaaactggcaagggaccaggtgcagtggctcacgactgtaatcccagcactttgggaagctgaagcaggagggtcacttgagcctgggagttcaagaccagcctggacaacacctttttttgtctgtacaaaaaaataccacacacagacacacacacacaaaggcaaagaaattagaaagggaagccacagactgaagagaaaatagtcttaaaagcaatatctgataaaagaattgtctccaaaataaagaacccctgtaactcaataagaatagatgaacaaaagatttaaatactttgcaaaagatgtggttggccaagagcacatgcaaagatactcaacataagtaatcagaaatcctaagttaagactaggagagaaaactagcactagaatggctacagaggccagcataccaaatgttggcaaagatttacagcaagtgaatccatatacattgcttgttcgaatgtaaaatggcaccaaccctttggaaaatcatttggcaatctatccaagaatgttcatatatttatatttgtgaaaaaatgagaagcaactaaatgtccattaaatggggaatgaataaataatgataaattttggcaaccaatactaattagcaataaaaaggagtgaactactgcaaatacgtgaatgaacataaaaagaaaaatttgctgtgccaaggaatccagacacaaaaaaatgtatgatttcattaacatataaagtcctaaaacaagcaaaacttatctgtagtgatggaaatcggattggtggttgcctggggtgggaggtagggaagagagtgactgcaatagagcgcaggggaacttcctggggtgaccaaaacactctacaccttgattgtggtgatgattacaaacatttgtccaaactcatgcattcatactatacacttataatatacattttcttatttgtaaaccacactgctagggtttgaatatctgtcctcttcaaaactcatgttaaatcttaatcccaggctgggtgcagtggctcacacctataatcccagcactttgagaggctgaggcaggattgcttgaggccgggagttcaagatcagactggtcaagatagcaagaacacggttctacaaaaaaattaagtaaatgactgggcatggtggtatatgcctgtagtcctagctactgagaagctgaggcaggaaaatcccttgagcccaggatatcaaggctgcagtgagccatgattgcaccattgcattccaggttgggctggacagtgagaccctgttgtaaaaaaaaaaaaaaaaaaaaaagagggggtggggcttttcaagagtgattagatcataagggctctgtgctcatgaatgaattagctcattcatgaattaatggagtcaaaggttaatgtattaatgggtcatcatgggaggggaactggtggttttctaagagaaagccctgagcttgcagccttagccctctgaccatgtgatacctgcgccaccttgggattctttagagtccatattagaaagaagtgccccctaaaccttggacttcccagcctccataactgtaagaaataaagctcttttctttctaaatttcccacgttcaggtattgttataagcaacagaaaacagattaagaaaaaaaagatgtacttcaacaaagatgatttgaaaaaaaaacaacaaaacaaatcactgatacacggaagaaaataaagcagtctcaaacattatcctgtgtacaagaatccagatacaaaaaggacatagcatgaagatttcatttacgccaggtccaaaacaaccgaaactacttcatgctgatagaaatcacaactacggtcatcttggaggtgggggtgggtaagaattgatggtaaaagggcaggaggcaattttctgggttgatgaaatatcctatatcttgatgggatatagttatgtgggtgtatacaattataaacacttaaaatctttgtttgtatgtagattatacctcaacttaaagaaatgcatcctattctccctcctccaaagcattttactgtgtacaactctctgtagctctggacttttctaggggtgcaatgactattttaaatttaaagtccacatcagggcaaggcctccgtataataggaaaactgaacaggatctttgaaactgagtctgtcccagaacatttctgatgaaaacagtgcccgtaacgcaaagctaggacagggcaataaaccttgtaagtctggccacatataacatttttcagttaatacagatagaatctgaatctcagaagctgaggcaggaggatcccttgagttacctgtttttttctgtgcccccagtttctttctttctagaaccaagctggcttcctgccttcaggtccaacttctgctccttcctgctgcccgccactatgaaaatccctttccataccctggagtctcttgtcctcctccttcagacagagctgccaagagcaatagctttatacgcagaagcccatccacttctggtggctttatgtactggggcccaccctcttctgcagccgatgacatttgaaatcccatccaaaaaaaaaaaaaaaaaaaagcagacacccagatccagatctttctgaaatacaagtgattagagagataaatacatgaataacacctttccctgactattctttttttttttttttttttttttgagacagagtctccctctgtcacccaggctggagtctggagtgtagtggcacaatctccccactcaccgcaaccactgcctcctgggttcaagcgattctcccacctcagtctcctgagtagctgagaccacaggcacccgccaccaggcctggctaatttttgtatttttagtagagacagggttttgccttgttggtcaggctggttttgaactcctgacctcaagtgctccacccgcctcagccactcaaagtgctgggattacaggtgtgagccgccgtgcctggccttgccctgactattcttactaaagtcacctaatttagcttctatagaattttgtgctaagtgacctagactctcaaaaaactacaaagtagccttatcacccatctataatcctttatgtcaaaccccacaccccccccaaaaaaaaatctttgctgaaataaagcatgccacacaacttccaaagacgtaaactagacccagatattcagtatgtgggccagaatagttctgttgtttgtttttgtaagagcagaaacaagtgatatttttaaaattttatttttagtaaagatggggctttgccatgttggccaggctactcttgaactcctggcctcaagaaatccgcctgccttggcctcccaaagtgctgggattacaggtgtgagccaccgcacccagcccaagtgatctttaagatgcttcagattttattttatcatatatggtaccattccttttaatttgcatgaggtgtttgctggtaaattaatcatttccttccaaattctgtttattctgttatgtctatgttcagatcaatctagtcttagggagagcaggaggaatatgcctaagaaaaccataaaactaagaaaaacataaaacggcttagaaagtcaactgagcccagcctgggcaaaatagcgagacctcacctctataaaaaatacaaaaattagctaggcatggtggtgtgtgcctatagtgccaggtagttgggagactgaagtgggaagattgcttgaacagggaaagtcaaggctgcggtgagccgagatcccagccactgcactccagcctgggcaacaagagcgagactccgtctcaaaaaaaaaaaaaaaaaaaaaaaatttcaaaaaccccaaacaaaacaaaacaaaaaaggaaagtcagctgacatctaatccttgagatgcagtgaaagtttctgattaaatgcactgagagaaggtggtgttgtagggaaaaaactggattaaagaaaaattagaggtcatttgagctattttacaactctgtaaattttaacaactgatggcaatgttaagtaattattgtctatagacatgcaaataaggtttatcccatgaaggacaacagtcttcctttcccccatggaaaaccagtttcaatattcctgatctatatttcattattcaatattcctgatctacgaatgtacccattctttgggttcttctttgatctggctactacagactcatcagtttcgtcactaataagtgccgggactcagaagccgataccccaaaatatggggctttgacatgctggagacctcaaggtctctctgaccttcccggctcccagctcaaaaaaacctttgtctgcctaagatccagacccaccaaaaggaacaactgtttcttttcccttccctgtaagaccaagaatataccccacacctgaacagacccattcacaagataatgtagcttattctctcccctgacccattcatgctccctagcagaagcccatccacttctgctggatgctcttcggctccctcccgtaacctcatttgccagggtagtctataagcttctgagacatgttgcagggtgggtaatcaatcactctgattctccctgtgtgcatgttaaataaatgtgtatgcatttaccattacacaaccttaaaagagtgttgttggtctattagcaataatgactgaaggaaattggtatttttgtccatttcagctactactaggataatcttataagatatttgggaagttatgttttggtctatttaatatatgtgcctcgatgaaaaaaacaccttttgccacaggagacaccaatgtttcaatattgataggagcaaaacacatgagagtgctttttttttttttttttttttttttttgaggcagaatcttgctgggtcgcccaggctggagtgcagtggtgcaatcttggctcactgcaaccttcgcctcccaagttcaagccattcttcagcctcagcctccagtgtagctgggattacaggcacccgccaccatgcccggctaatttttgcctttttagtagagacggggtttcatcccagggccaagctggtctcgaattcctgacctcaagcaatccgccccgctcagcctcccaaagtgctgggattacaggcgtgagccactgcgcctggcctgagagtacttttagaaaacattattcctttacctttttcaaacttgaagcactccgaaagtcccaaccttttgcacatttgcggcagcgacattgatttggtaaacagctgtcacactatttattatttgatgacttaggtatcctttccagcagtgtttttgtaaggtgtagttgcgttttcttttagtttcaattaactaaatttcaagtggttcccaaaaaagcccctgctctcttaaattcaaactcaccttcctttttcccactaggaaggaccttttctccatccttggattggaatttggaattctatgctaaaatgccttttcagttaaaatctgtgaacgtgggatgtaaccataggaggtgctggcactttacgggaatcatgattttatttaatctgcgcttccagaaggctgcaaatgggaattccagacaaacccacttgggtgaatcccagcacgcgggctgcggcgtagggggagagctcctcacgcggctcagagtgtagcccaggcccgcagagccaggaacccgcccccagctctccaaacccgggaagagagaggcgacactgctaagaccgagggatgacggtgcttcttcaattaattcgccccccgagatattcttacctacagaagggagtgtctgttcaccaaatcgctcacttgccgcacgaccacgcacccgcggctgtcggatggatccaggcgctcttggtgggaagggggcggagcctgcctggcccggagcccggggccacgcccccacgctttgcatatgcgaatccgggcgtccagacctttcatcccagtgtggaagcccagattttcctggcccagggccggttttctgggcagaaacagtcaactctgctgaaaggaacaacttaagtaatacactgacattcagcataatgaagcaagagggcctgaatccaacagcgatcgtttgctttatttacaaatatgtcctttcttatgaatccatttatttctctccaaaagcttaggagagagggctggctggctgtcacccccactctacacatgaagaaagtgaggcggaaggaagtaggcctagtaaatagagaagcctgggttttagttggggctcctggctccagagccagtggttataatcactctgcactttttttttttaaaggaggtagagtgggatggtttcctggcactttgaaaatctgatacaaacaattttttcttttcttcttctttttcttttcttttctcttttctttctttcttttttttttttttgagacagagtctccctctgtcgcccaggatggagtgcagtggcgcgatctcggctcactacaaccctccgcctcccgggttcaagcgattctcctgcctcagcctccaaaaattaacgcccagttaatttttgtgtttttagtagagacggggtttggtttcaccatattggccaggctcatctcgaactcctggcctcgtgatccgcctgcctcggcctctcaaagtgctgagattacaggcgtgagccaccgcgcctggtcttttttctttctttctttctttctttttttttttgagatggagcctcgctgttgttggccccgggctggagtgcaatggcacgatcttggctcactgcaacctccacctcccgggttccagcaattcttctgcctcagcctccctagtagctgggattacaggcgcccgtcaccacacccagctaatttttgtatttttagtagagatggggtttcaccatgttgtccaggctggtctcaaactcctgacctcaggtgatccacccgcctcggcctcccaaagtgctaggattacaggtgtgagccacagcacccggccacctggcctcttttcttttcttttctctttctttctttcttttttttttttttttgacaaagtctcactttatctcccaggctggagtgcagtggtgcaaccccagctcactgcaacctcaatctcccaggcacactgatcctcctgcctcagcctcccaagtagctgggcttgcaggtgggtgccaccacgtcacattaatttttttgttttttttttttggtagagacagagtctcactatcttgcccaggctggtcttgaactcctgggctcaaaggatcctcctgccttgcccgcccaaagtgttgggattacaggcatgagccactacgcttagcctgcaaagagtttatatattaaagtgaaacttcttattaaacagagaatttttttaaagcattacaaggttcttattggttaaaatggaaaaaatatttttatttctgttcatctcttggtggacttgaaaaaccctccctaaagataaacactgcgtggcttctaagggctaccagtggaagtgaaatggattaaaacaccccgaggtgtcttggttctctgtcctacgactctgcgttttctattttcatcttcctatgatttgtgaaaagtcctgagctgaaccttaggtgtaggagtgccctgctcattgtgcaaccttgcaaattgctgggtcctcccaaagaatattgtgaaattttcttaaaggctgaaggtgtcatgatttccttcacacctcttgaagaaaatgagttcaaattggaccttgagaagtttactctgattctctaatatctcatagccacagtctaaatcagagagagatattgaggaattcattcattcatgcatagaaacataaatgacacatttgcagattacatgacatgacatttgagtttgatcccatacgactgtgtggggagaaggctgtggatggggtcatagatgacaaaagattggctgtgtgttgattattgttgacttgggcagtagttcttagaaactgattgcactattttccatttttgtatatgtttattttccataatacaaaattgttttaaaatcatttattctgactgggcacagtggctaatgcctgtaatatagcactttggggagccgaggtgggtgcatcgcttgagcccaggagttcaagaccagcctgggcaacacagtgagaccctgtctctacaaaaatacaaaaattacccagacgtggtagcatgcgtctgtagtcccagctacttgggaggctgaagtgggagattggcttgagcctaaagaggtggaggttgcaatgagctgagatcacaccattgcactccagcctgagtgacagagccagaccctgtctcaaataaacccatacacaaaaaagaaaaaaaaatcatttgttcattaagaagttatttattgagtaactatgtgccagacactgtcctaggtgcttgggatacattcgtgaacaaagctaaaaatctctgccttgtaatttacattctagcttgggatggggtatatagagggaacataaatagtaaacatgatgagttagtgaattttatagtgtgttagaaagtggtaagtgccgtggatcccactgagaagaggatggagaagatgactaagcctgaggcttggagctccaacttgggaaagaacctacagggaggctgaatgagaacagtaggagagggagccatagtgtattagggagttgctcaacactgtgtacctccctattatacttcctcttgcactgttactaaaaaatgtggctgcaattatgtccatgaaaacctatacaaggccaggcatggtagctcacgcctgtaatcccaggtgagtagatcacctgaggtcaggagttcgagactagcctggccaacatggcgaaaccccatctctacgaaaaatgcaaaaattagccaggcgtggcggcacacccctgtaatcccagctacttgggaggctgaggcagaagaatcgcttgaacccaggaggtggaggttgcagtgagccgagatcacgccactgcactccagcctgggtgacagagtgagactctgtctcaaaaaaaaaaaaaaaaaaaaaaaaaagtctatttgaatagttgatataggagtggagaaaaggtggccaggcaaagaaaatctcacattaggattactgcaagtaggctaatttatctgtttcactcttaaatgttaactctttgaaggcaaatatttgtttagtttttttttttttttttttttgagatggagtctcactgtgttgcccaggctgtagtgtaatgggtcgatcttggctcactgcaacctctgcctcctgggttcaggggattctcctgcctcagcctcccgagtagctgggattacacgcacctgccactacggccagctaatttttgtatttttagtagagacagggtttcaccatgttagtcaggctagtctcaaactcctgacctcaggtgatctgcccgcctcgatctcccaaagtgctgggattataggtgtgagccaccgcacctggccttatctttagatttctatcttggctggataactggcctaatagagcagccacatatttgctgagtgaatgagtaaaaaacacatagagagttggagagaagctgtgacctgccgtactgggaccatccaacactcccaatcataaatcagttgcagatgttggagctcataaaccgataacacaaaatacagtgccttgagataccgaactgcagaagcctaagggtctgtctgatctccccgacaaggtctcttctgaagaagctgaagtcttctgtctgcctaagatctagacccaccaaggggaactatggtttttccttcccctccttgtaagagtaagaatgtaaccacacttgaatagaccctctcacagtcaaagagaactacttacaaattaatctcagtacctgatcctttattgtccttcagcagaattcctcttcttcctcctcccataatgtgtttagccaggctggtagattgaagggggccagcctctccacacctgtgggtatttctcgttcatctcttggtgggacgagagactgagaaaagaaatacgacacagagacaaagtatagagaaagaacactgggcccaggggaccggcgctcagcatacggaggacccgcgccggctctggtctctgagttccctcagcatttattgatcactctctctaccttctcggcgagggggatgtggcaggactatggggtaatggtggggagagggtcagcaggaaaatatgagccaaggactctgtgtcataaataagtttaaggaaaagtgctgtgcctcgatgtgcacgtaggccagaattatgtttgactttacacaaacatctcagtgcagtaaagagcagtattgccaacagcatgtctcatctccagccataaggtgttttctcttatgtcagtaaatagaatgtacaatcgggttttacaccgagacattccattcccagggatgagcaggagacagatgccttcctcatatctcaactgcacagaggccttcctctttcactaattctccttagcacagaccctttatggatgtcgggctgggggatggtcaggtctttcccttcccacgaggccatatctcaggctgtctcagtggggaaaaccttggaccatacccaggctttcttgggcagaggtccctgcggccttccgcagtgcatggtgtccctgggtactcgagactggagaatggcgatgacttttaccaagcatactgcctgcaaacacatttttaccaaagcacgtcctgcacagccctaaatccattaaaccttgagtcaatacagcacatgtttctgcgagcacagagttggggttagggttacagattaacagcactcaaggcagaataatttttcttagtacagaacaaaatgcagtttcttatgtcttcctttttctatataggcacggtaacaatctgatctatctttctttcccccacagtgtataagcttctgaaccctgttgggaggtgggtacactcagtgattctccctgtgcaaacattaatatatttctatgactttaccttttttttcttttttaatcttccagggtggattgcagtgatgccatctcagctcactgcaacctccgtctcccagttcaagcaattcttgtgtgcctcagtctcccgagtagctgggattacagacatgtgccaccacacccagctaatttttgtatttttagtagagatggggtttcacagtgttggccaggatggtttcaaactcctggcctcaagtcatccaccagcctcagccgcctcctaaaattctgggtgtatgccttttctgtaatgaatgtaccttttttgtgagttgattttcagtgaacctttggaggctgaaggggaaactgcattgaccccaacacggacccacatcctgggaagatgtgtagacgagcacaggaatttctgtcagtgacactgatgaccaaaggttggaatttactcctaattttttatctttattgtaaaatctgctacagcatagtatgggacctggcatccactaactgaaacccatcccaaatctttacatatcacccgttgtcttttgctttgttggcctcaccaatgcaaggtgtacatcttacagaacacagagatgcctgagaatatggagagattattatttttattaaggaagagtagcctttttttttttaacagggacacagaaacaggaaagaagttagtgaatgtgcaatatgaaacaacaataaatccatcataagaatttttttcaaaaaaatgaaatattagttctcacgattttattttgttaagctcagaatacaaatatatttttgacatgggtggctgtgcttccaccccttatgttgataacatatgctaatcttttatctttttttccaaaagaaaacaagattacgaaaatgatggagaataatagcataatagcacaatagcataatagcataatgttaagtcttggaagatacagggagaaggaattgaagtagacataccaccacaaaggaggaaaaacaatcctgacacttcagactacaagggacagcatgagcagttccaacgcatccaggcagatgaggcaggacagaagcagaaaggaagggtgaaggaaagtttcaccaaattctgtgagcaaagcctcagcgtttcttaggctagaggcagagccaggctggcccgcctagcagcagcattgcttcttgcagcagcccttctgctgacagcagcccttctgctggcaacagcccttcccacagccacagccgcagccacatgagtggcaggtgcggcggcagcaacagatcacgggcgtgctgcagcagcctccacagcagccgcggcagcaggggcagcagctggagcagcagcccacccggtagcacctgcaggtggtgcagctgccacagccaccaccgcagccaccaccacagccaccactgcagccaccaccgcagccaccgcagccaccaccgcagccaccacacccacagcaacccatggtgtcagtagagaggactcaggtgaagtgacgaggaaggactcagcagaggtgaggaggtctgatgttctttgcttcaggggctcttaaataccccttccaggcctaacatgtggcaggtggccacttccttgtttcctccagcttccctggaggaatttcacaagaccctgagtgtatttcctcattgaacacctctgacttcataaaattgcttattttcacatttacttcttcctcaggttatgcttctaattgtttcttaaatatttagtcttgttttaacctagcagttttcaagtgtgatctatgagtctcatttgatgaaagcccatctcctatcttccattaatcaggatcccttggcgccgagaggatctttcccttggtttccccctcctctaaaggaaggcttttctgttttcaggtggtgtctgcagaatgcaagagaaggtgagatccctcatgaaggaaacactcaaagcttcacatgtcataaggtcccttggctaacatctcagaaggctttctcacctgttttcagacttacttttgctgttaattcacaagtcaaaatatgggaaagatacccatcttgggttgatggtcacggtgtatttcaaagtgagcttcccacactggctcatgttcccctcttgtcctatactcatggattagtggatgaggtagctaagagcctctgccaccagctggtttcatgtccctaaaaaagccatgatccctatgtgacccagtttccttagcttagggtaaataatgcataaacttttaaaagaccttattttttagagcaatttttggttcacatctaaattgagctgagggccgggtgcagtggctcacacctgtaatcccagcactttgggaggctgaggtgggtggatcacttgaggtctggagttccaggccagcctggtcaacatggtgaaaccccgtctctactaaaaaatacaaaaattagctgggcgtggtagtgggcacctgtagtcccagctacttgggaggctgaggcaagagaattgcttgaactcgacagacagaggctgcagtgagccgagatcgagccactgcactccagcctgggtgacagagtgagactctgtctcaaaaaataatagcaatataataataataataattgagctgaaagtacagagttcccatatattccctgtcctccccaacacaacctccttcactactgacatcccatgccagggtggtacatttgttacaactggtgaacctacagtgagacatcataatcacccaaagtccatagttttcatcaaggctcactcttgtcttctttcaccaccctgggtacttagccccttcagaatcatacgtcctgccgggcgtggtagctcatgcctgtaatcccggcactttgggaagctgagacaggcagatcacctgaggtcaggagtttgagaccagcctgactaacatggtgaaaccctgtctctacaaaaaatacaaaaattaaccaggtggtggctcatgtctgccgtcccagctatgcggaaggctgaggcacgagaatggcttgaatccgggaggcagaggttcgacagcctgggcaacagaatgagacttggtctcaaagaagaaaaaaagaatcatatgtcctaggaattgtctccaaaaaattaaaagaaaagaagaacttcatgtaaagtccttttgcagccttcaaaggctattcctaaactggcatccttttccacagtgctatgatgtggggatttctacagaaatcccttagatttctgtagagcagtggatctcaatgaggggcaattttgcccccaggagacacttagcaacatccgaagacatttttgcttgtttttttgttttgttttgttttgtttttgagacagagtctcactctgtcacccaggctggagtgcagtggcactatcttggctcactgcaagctctgtctcccggggtcacgccattctcctgcctcagcctcccgagtagctgggactacaggcgcccgccaccatgcctggctaattttttgtattttcagtagagacggggtttcaccgtgttagccaggatagtctcgatcccctgacctcgtgatccgcccacctcggcctcccaaagtgctgggattacaggcgtgagccaccctgcccagctaattcccttatttcttaattgccaatgttagtttctgttaagatggatggggatttaactctcttgtgtcactcctaatatatttgtattactagtttttgtaatatctataaccaatggtaacttgattattataatataaatattgctcgctcaactcaaatagtctatataattacatttcctgaagcagtcttttatttttctaaagtattggatttaattctctctctctcttttatttttttaactttttgcttttatttctcttgatctatttgccgttgtcagccacataatgtttcatgtagattttcctcttggacagtaattgataaaacttttcaagcccccaaacttatactttattctaattacaaaatgctttcttattttaaatgccatgtgaattgtatcaaaaaagatgtatcattgcgaaggtttacttgtgctttataagcaatcacacaatgttattttatttatttgtttatttcttgagccagagtctcactccgtcacccaggctggagtatagtgatgcaatcttggctcgctgcaacctctgcctcccaggttcaagtgattctcctgcctcagcctccaaagtagctgggactacaggtatgcaccaccatgcccagctaactttctgtattttttttagtagagatgggggttcaccatgttggccaggctggtctcgaactcctgacctcaggtgatccacccgccttggtctcccaaaatgctgcgattacaggcatgagccaccacacctggccaacacaacgttaaatatactgaataatgaaacatagagccaggctttataactgtgtggtggggagcaaaatcttccattctcagggggacaatctccagtgagagtatccggctgcttctgcagttggcaatgacatatgtgcctgagacacctgccatttctccagtctttggtaagagaatttctgggcactatacaggaatagcctcctgataatgtttattcattgttcgaacgttggaccatccattcaagcattgctgttgtactatatgggctttctgagtgtgtccaaaactgttgataataccccctttcccatggctctcaggaggtcttactggaatttttaggacattcgactcagaaaataaacaaaacaagtaatctcataaacctagctcccattccaaagggcagtaaataatatattatgagatcctcccatgacagttgacccaaacaataactaggaagtggtcatgtgtcttccctctcctcttcccagagttggtacataagggcctcccccagcagaaggaggcatcagacctcctcacctctcaagtcctccttcctcacttcacctgagtcctctttactgacaccatgggttgctgtggttgtggaagttgtggtggctgcggtggtggctgtggtggctgcggtggtggctgcggtggtggctgcggtggtggctgtggcagctgcaccacctgcaggtgctaccgggtgggctgctgctccagctgctgcccctgctgccgcggctgctgtgggggctgctgcagcacacctgtgatctgctgctgccgccgcacctgcggctcatgtggctgcggctgtgggaagggctgttgccagcagaaaggctgctgccagaagcaatgctgctgctaggcgggcccccggcctctgggaagatgctgcaggtaacgaactgtcctgttggtaaattttctctccctcctgccaggcttctctgatttgaaagtcacaagaagttttatccacattccctggtctctgagatcctgcctgcacgtgaaaaccaccaacacaaaccttctctatcaatcaccaatcaaagtatgagtccaaaaaaaaacagagggatatttttaatgctatgttttcttgaaattttactgttgaaatgtttgtttccattccttttccctcctttctgtagtttctgtatcctgcatgtctgctcctgctttctgtttctgtaaacctgagacaatattttcccaattaaccacataaaattggcattaaagattcatggacatctccttctttctttcattcttctaatgtgtctaaaggaaagatgcgatgaaatctagaaaactaacactccgtatgtttgtttgtgatggctttagaataataactaacagactgggtgcggtggctcacgcctgtaattaaagcactttgggaggccgaggcgggcggagttcaggagttcgagaccagcctgaccaatatggtgaaaccctgtctttactaaaaatacaaaaattagccaggtatggtgatgggtgcctgtagtcccagctacttgcgaggctgaggcaggagaatcacttgaacccgggaggtggaggttgcagtgagctgagatggcaccactgcactccagcctgtgtgacaaagcgagactccatctcaaaaaaaaaaaaaaaagaaagaaagaaaagaataatcactaataaactgggtgcagtggctcacacctgtaattccagcactttgggaggctgaggtgggtgacttttaaggccaggacttcgagaccagcctggtcaacatggtgaaacccatctctactaaaaatacaaaaaattagctgggtgtggtggtgtgtgcctgtggtcccagctgcttgggagattgaggcaggagaatcactttgaacctgggaggtgagggttgcagtgagctgagatcataccgctgaactccagcctgggcaacagagtgagactctgtcaaaaaaaaaaaaaaagaaaagaaaagagaagaaatcatgaataatctgttcctaacaggttttcacacagtggtaaaagtttgttggcttctatctgaattagaaaaaagattcagaaaactatcaatgagatcttatttcatcactttctctctacccttagattcaaattttctaacagagtttaacctcagcatctatagccagatgaaattcaatacctaaagctatttaggtcttggttattttggttttggttctattaacagactaaaatttaattacagttcaatgaaattaaaaaaaattcatcatcagtactagttaattgtctttctggtagattatggtcacaaaatactaatgtggccatactggaataaatctattagtaaaagttgtgacctgctaaggcactatatccactttaattttgtatatatatatttttttcctttttttttttgagatggagtctcactctgttgcccaggctggagtgcagtggcgtgatctcggctgactgccacctccgcctcctgggttcaagcgattctcccgcctctgcctcctgagtagctgggattaccagtgcccactaccacacctggctaatttttgtatgtttagcagagatggggtttcactttgttggccaggctggtctcgaactcccaacctcaggtgagttggccttggcctcccaaagttttgggattacaggcgtgagccactgcgcttagccctactttaattatattctatcacaagtaagtaagaatattataagaacaaaaaaatacagagttcacaaggggtggctttcataccacatctgtaagtcccctgaaagtgaagccacatatggtgtatgttgaaaaacccatcttctgaatgtagtgtcctttattaaatgagatatccattagaattttgagctcaactctcttccctgttgaaagcaagggatggagaaagggacagaagacttctccgtggtgttggcagccaccctgggcctgagaaaggtaatttactgattcttgctcctggaccacagaggtctcttctctttctcttccattcttggaagcactcacagaaagtagatacctcagaaatgctacagtgaaaagaaccgtagaagatgctagtccaggggcaagttcaaagtctgcattaaatagtaacaccacggatgcttccaaagagaggctgttatgagagtttcataagagtcaaggaaaaatgggcacttcttgcctgactcaagtgtgtttctgtagggacctaaaagatgaggggctacagtgctgacttggtggttatttcttgttattgcctgtcagtttcagcatcaatatgtggatcaaaagaaccaggtaataatataaagtagatgaatttgtttcagcatatatctggcaatcacaaactttgcatcagacactgcggtgggcacagtaggacacgtgaaaacaagccccagatggccaggatttgagtaataactggcagtttccctaattcttattccctttttccaatataagaccaattagagagagtcgaatatgcactcctaatgaatcacataagatgccctgcttctagttagtctgtctgcaatgtcccataccaaaagcctctcatctgggcatacctgaaaccttcccttcttctggtataaagctttcccactcctccgcctgcctttgagtgtccacgaaaacagaggggatgctgtggcaaaccatcactttgctatggcaagcataattaaatagcctttacctggactaatttggtgggttgtcatttatttccacaagactcaggaatttcattcctaagtgtgtgtaaattctatagatacatacaagaatgctcacagtagcactgtcaaaaatagcaaaaacctggaaacaacgggacttcctatcatctggagagtaaataaacagaaatggaatgtaagtggatgtagtaaaaccatgtccaaagaaatgcaaaggaataacaaacacaagctttttctgtttttgtttttgagacagggtcttattctgttgcccaggctgtagtgtggtgtcacgattatggctcactgtagccttgatctcctaggttcaagtgatcctcctgcctcagcctcctgagtagctgagactacaagtatgctccgccacgcctggctaacttttaagtttaatagcaattagttcttgctatgttgcccaatctcaaattcctgagctcaagcaatcctcctgcctctgcctcccaaaatgttgggattacaggtgtgagccaccactcctggctgaacacaagctttagggcaaggactaccttgggtgtaggagggcaggaggacaggttgggcaggaggagccttatgttagatcatactgtcaaagtcctgaacagttacatcattaaaataattaacaaattaaataaagaaggctatgtttaaagtgttctatgaaccaaaagggcacacaaaccattgtttcctctgccccttaaaaaatggtatatgttctggcaaactgaatgcagcagtacatcaaaaattttatccaccatgatcaagtgggcttcatccctgggatgcaaggctggttcaacatatgcaaatcaatacacgtaatccatcatataaacagaaccaaagacaaaaaccacatgattatctcaatagatgcagaaaaggctttcgacaaaattcaagagcctttcatgctaaaaactctcaataaattaggtattgatgggacatatctcaaaataataagagccatttatgacaaacccacagtcaatatcatactgaatgggcaaaaactggaagcattctctttgaaaactggcacaagacagggatgccatctctcaccactcctattcaacatagtgttggaagttctggccagggcaatcaggcaggagaaagaaataaagggtattcaattaggaaaaaaggaagtcaaattgtccctgtttgcagatgacatgattatatagttagaaaaccccatcatctcagcccaaaatctccttaagctgataggcaacttcagcaaagtctcaggatacaaaatcaatgtacaaaaatcacaagcattcttatacaccaataacagacagagagccaaatcatgagtgaactcccattcacaattgctgcaaagagaataaaatacctaggaatccaacttacaagggatgtgaaggacctcttcaaggagaattacaaaccactgctcaacaaaataaaagaggacacaaacaaatagaagaacattccatgctcatgggtaggaagaatcaatattgtgaaatggccatactgcccaaggtaatttatagattcaatgccatccccatcaagctaccaatgagtttcttcacagaactggaaaaaactactttaaagttcatatggaaccaaaaaagagcccgcattgccaagacaatcctaagtcaaaagaacaaagctggaagcatcacgctacctgacttcaaactacactacaaggctacagtaaccaaaacagcatggtactggtaccaaaacagagatatagaccaatggaacagaacagagccctcagaaataataccacacatctacaaccatctgatctttgacaaacctgatgaaaacaagaaatggggaaaggattccctatttaataaatggtgcttggaaaactggctggccatatatagaaagctgaaactggatcccttccttacaccttctacaaaaattaattcaagatggattaaagacttaaatgtcagacctaaaaccataaaaaccctagaagaaaacctaagcattaccattcaggacataggcataggcaaggacttcatgtctaaagcatcaaaagcaatggcaacaaaagccaaaattgagaaatgggatctaattaaactaaagagcttctgcacagcaaaagaaactaccatcagagtgaacaggcagcctacagaatgggagaaaatgtttgcaatctacccatctgacaaaaggctaatacccagaatctacaaagaactcaaacaaatttacaagaaaaaatcaaacaaacccatcaaaaagtggggaaaggatatgaacagacacttctcaaaagacaacatttatgcagccaacagacacatgaaaaaaagctcatcatcactggccatcagagaaatgcaaatcaaaaccacaatgagatatctcacaccagttagaatggcaatcattaaaaagtcaggataacatcaggtgctgaagaggatgtggagaaataagaacgcttttacactgttggtgggagtgtaaactagttcaaccattgtggaagacagtgtggcgattcctcaaggatctagaactagaaataccatttgacccagccatcccattactgggtatatacccaaaggattataattcatgctgctataaagacacatacacacgtatgtttattgcggcactattcacaatagcaaagacttggaaccaacccaaatgtccaacaatgatagactggattaagaaaatgtggcacatatacaccatggaatactatgcagccataaaaaaggatgagttaatgtcccttgtagggacatggatgaagctggaaaccatcattctgagcaaacttttgcaaggacagaaaaccaaacaccgcatgttctcactcataggtggaaattgaacaatgagaaaacttggatacaggatggggaacatcacacaatggggcctgttgtggggtggggggctgggggagggatagcgttaggagatatacctaatgtaaatgacgagttaatggatgcagcacaccaacatggcagatgtatacatatgtaacaaacctacactttgtgtacgtgtaccctagaacttaaagtataataataataaattaaaaaaagaaaaagaaaaaaatggcatatgttaaaatgtggtaaccattataaaaaaaaatagagcacagtatgagagattgggattgaaggaatggtggatgggatttcaatttccaattgggtggtccaaataggactcaggtagaacctgacattccatcaaagactagaaagtgatgaagaagtgaactatccagttctctggggcaagaacactccagaaagtgggaagggaacagtgaaaaggcagttcaaccagcacccacttaatgggagtgtcaggagtaccgagttcagtgaagtaatggagagggtgttgttggcatttctcggggacaattttaggtcactgtaaaccagctttgactgtgagaaaagcagggaagctgggaagggatcctctgccttcctttataaaaggattactccaaacagtgccttgagaattgaccacaggagggtccaaggtaggacctgggccatcttgaggaagctcttgctgggtaggggtgaggcagcctgaacctgtggggtaggggcgtaggtcaagagaggattcagctctggtaatgtcaagtggatttgctgatacatccagtgtagggtgtgagaggaaaataggagtcaaggtggcaccaacgtatttttggcctgtgcagccaaaaggatggagttgctgtttattgagattaactagaaaaggtgttggccaggcatggtgggtgcgcgcttgtggtgccatctactcaggaggctaaggtgggaggattgcttgagcctgggaggtcaaggctgcaatgacttatgagcgcgtcactgaactccagcctgggagacagagcaagacctgtctcaacccctgcctcatcccccaaaataaagggcatatctgcaagaaaatcatgtgcttttttggggtgtgagtagggattgctggtgggaatttcaagtgttcagtttctaacatgtaaattttcagttgttaactgtcttcccttctataattgtgtcccctgtaaaactttggtgagagcaggagaggttttatataaaagttgaaagcagcattcttctcattcttctcagatgtggagacatccattaccttcaaggtgcagttcctttggtttgggtccacaagcagataagtatttgccccttgcttatgcagaggcagacaccgtttccattcggtcatgccaatttggaatatatttctgtcgtgttgatatggagccgttaggatagatgtgtttttttctctgcttagactcaggtggctccctgcctggagggtggggagtgtgtgtgcttttatttaagccgatgctcacaactggtctggagtactgacttcaggtctctacaaaagatgccacagtttgattttaacctcctgctgaatgagggactgaaatcacaaataggacagagtttgacacatttcaacaaagaagtaatattcatatcccacacgtgcaatgcttgaaatgaaatactccaagtatcaggaggtaataatgttggtttattgagtcctgagtaattgtccagctgtgaacttgggcaggggacaagcccactctggtgtgggtaggagaggggtgggagaccctgaagggagcagatgttttagctgtccatcacctggagctgaggcagatctgggaactgaaaagggggtgaagccctcccaaaggttggggcatcctcctcctttcattgcagttgaactgtggttcctgaccagactccaaggggagcaaagatgcttgagggcattccttgggaggagggagctggctggtgctgcccaatgcaggcagcatgggatagaggttaagtacttgtaagaggcacccagaggttgtatttgaccatgactttaaactactctgggttgtctttgaacctttactagagacttgccaataattatgatctgggttctgaaaggttgtagggaactaaaggaagaccctgttccactcttgggatagagaacagagaaggggagcttagttggaatggggtgaaagcagtggatgctaggagagttgggtcagcccagcagacctgggacccctgagagctgatgacaggaagacagcaggctccctgatgaagaggccagaagcagagcaatgctgcgtgtgatgtggtgcggtagcgggtagtctctgcctgcctagatgtgtgacctggcaccccaggaaactctcagagaaagatgagctcagagagtacatagtgcagaggtcactaccagagggataaaattccagcaaaaaagatgcaggtgaatccagccatcattattgaaggaatttttttttttctttgagacagactcttgctgtgtcacccaggcaggagtgcagtggcttgctcacggctcactacagcctcaacctcctgggctcaggtgatcctttcacttcagcctctcgagtagctgagaccacaggtgcatgccaccacacctagctaattttttgtagagatggggtctcactgtattgcccagggatattgggaaaattcaatggaaatgcaactctactctatttttttaaattaatcaattgatttattttttgagacagagtctcactctgtcacccaggccggagtacagtggcacaatatcgactcactgcagcctccacctcctaggttcaagtgattctcctgcctcagcttcccgaatggctgggattacaggtgtatgccaccatgcccagctaatttttagtatttttagtagagatggggtttcatcatgttggctaggctggtcttgaactcctgacctgaagtgatctgcccgtcttgggctcccaaagtgttgggattacaggcgtgagccaccgtgcccggcctgaatgactctcttaatctgtagttccccctccatctccctctctttctctctccttgaattgtgtttctcctgtgagttttccatggtcaaattttgaattttgataattgcatccccatgtaattagatctagaggcttattaagattcagtttctatttttggacaagaatgcttcatgtgtggtgttgggttcctccaccaggaagcatataattctaattgtctctctttgaatgatagtggcacctgctgttagtcactgcctacatccattaattcatttgggttgcaaaatggtgattgatattctactttttcctcatctatttgttggaatacctttatagaaagaaatgtgggctgggtggggtggctcacacctataatcccagcaccttgggaggccaaggtaggaggatcacttgaggccaggactttgagatcagcatgagcaacatagtgagacactgtctctaatactaaaaaaaaaaaaaaaaaaaaaagaaaacaaagaaaagaaaagaaatgtcccctcctcaactctttgcttactctgaggtacagttcatttaggaaaagaagaataaatgcctaattctcctcctaccattaaaaatatctatttcaaaataatgtgttaatttcttagcatcttccaaagatgaccaatgaggatttcttaaaaatttgctattattatgaactcatagatttaaaaaaaatttatgtgttttagctcactgtagccatttttctttttgatgcttaaattgttgtcttgatatgaacccattaccctttggtagcttccttgttttctggtgtgacaagatattccaggcttatcccgtacattttatgccccaaatctggaatcattttatttatttattttttattttgagacagagtcttgctctcacccaaactggagtatagaggcagaatcctggctcactgcaacctctgcctcctggattcaagcaattctcatgcctcagcctcttaagtagctgggacttcaggcacatgctaccacatctggttgattttctatatttttagttagagatggggttttgctgtgttgctcaggctggcctcaaactcctgatctcaagtgatccacccgccttggcctcccaaagtgttgggattacaggcgtgagccaccatgcctggcttggaatcattcatttttcttttcttttctttctttcttttttttttcgagatttcgagatgaagtctcactctgtcacctaggctgcagtgcagtggcgtgatcttggctcactgcgacctctgccctccgggttcaagcgattatcctgcctcagcctcccaagtagctgggactacaagtgcccaccaccacacctggctaacttctgtatttttagtagagtggtgtttcaccaggttgatcaggctagtcttgaactcctgacctcaagtgatctgcccgcctaggcctcccaaaatgctggtattatagacatgagccaccgtgcccagcctggaatcattcatttttcaaggagctcttatttgtatttctttttaaaatgcctgattcttcctttacatatttccctatgtgaatttataaaagttccttacatataaagatattaatcttttgtcctatatgcatatatattttccccagtttcagaaattttgaagctttgtttttgtcagaaatttaaacattttataagtcacatctctcaatttttttccatattgttgggaaaaagctgagtgttggggaaaaaactgaggcagggcttgcatgtctgaaataatgtcctctggaatgtgtctagacttgctggctccttgcttctagccctcctaggctcccagatcaatcgtattcgcattatctcaagtagcagaacatggtccatataaacactaaactatcacagctgtggatcatgtgtctgcccttttgacccccacattctcactgccggtttctttgttggattaccaataaatagcgtgggctcctagagctcggggccttcgccgcctccataatcgcgatggcaccctggtcccactttacttctcaaactgtctttttctcaatcctttgactccgccagactttgttgcccgcgcgacctggtgttgggtctgatcaccccaatgcgtatgatttttggtattggtgccatattaagcaaggtattccacagcccaggaatataatactattctcccatattttttatactacctctattgccttacttttttatatttcaatacttaatccggaatttatggagatttggcatgatgcaagggttttatggcatgatgcaagggttttacttaaaaaatcattttatgtcatactctagttgtgtaagatgttatccttgacggaagctggactaagagtacgtgggccctctctatgctatttttgcaaccaaaagtctattataatttcaaaataagtaaaaaaacaaaaaaccaaaaacactgagtagagtggctcccaactgtaatgtcagcactttgggaggctgaggcatgaggatcgcttgaggccaagagttcaagaccagcctgggcaacacagtgagaccctgtctctacaaaaaaataaaaataaaaattagctgagtgtggtgattcatgcctgatatcctacctacttgggaggattaggcaggaggactgtttgaacccaggagttcgagggtgcagcgagctatgatggtgccactgtcactctagcctgggtgacagattgacaccctgtctcaaaaaaaaaaaagaaggaaaaaacccatttttgtcattttgttattgttgtggtggtggtggttggtatccaggtttattcttccagatggttagctaaatgtttaattgcttagggagcttagtggtgaatatgaggtaatttacagaagttacatacataattggcgtttatgtggtcattaagaaacagtttctgaaaagcaaatatttaataatgagggtaattgtatatgattaaatgttaagttaaaaaccgggatacaaaattatatattcacaatatttttaattttgccatataaattcaaggaaatagccgggcatgatggctcacatctgtaatcccagtactttgagaggccaaggtgggcagatcacctgaggtcaggaattcaagatcagcctggccaaaatggtgaaaccctctctctactaaaaatacaaaaatttagccaggcatcgtggcacgtgcctgtaatcccagctacacgggaggctgagcccagatggcgctattgcactctagcttgggcgacagagcaagactccatttcaaaaaaaaaaaaaaaaaaaaaaatcaaggtaatagtctatgttaattaaaagaaaaaagaacccaggtgctgtggctcatgcctgtataaccagcactctgggaggccgaggtggtcagaccacctgaggtcgggagtttgagaccagcccagccaatatggtgaaaccccatctctactaaaaatataaaaattagctgggcgtggtggcacatgcctgtaatcccagctactcgggagactgaggcaggagaatcacttgaacctgggaggtggaggtcgcagtgagctgagatggcgccattgcagtgagctgagatggcgccattgcactccagcctgagtgacaagagcaaaactccatctcaaagaaaaaacaaataattaaaaaaaaaaagaaaagaaaacagtagattagcaatggcaaaatctggtggacatcatgttaattgggtgataaaatttaatatcactagaaatgggatcaattaacatcacacacttgttgatgtgatgcactgaggaaaacacatcaactgtgtaatatttctgcaaaaacgtttaaccagaacctgaccacgaggaaacaataagccaaatctctgttgagggttattttgcaaaacaactctccaggacaaaaataaaatgctggaaaaccgttctagattaaagttcaataaaaatacatctttgattggatctgacatgaaaaattattaaaaatgcaattccaaattataggacattcttgggataattagggaaatttaagattggttaaacattacataaaaacgtgtcacttttaaatctctcaagtgtgataatagtattgtagttctataggagaatctcccttttgggagacacttactaaaatttgtagtattcctcttcaacttactttcattcaaatgggagagagaaggctgggtgcagtggcccacttctgtaatctcaatgctttggaaggctgaagtggatggatggtttgaggccaggagttcaagaccagtatgggcaacatagccagaccccatctctacaaaaatgtaatataaaataaaataaaataaaatgaaagagagagaactaaaatgaaatgtatggcaaaatgttaactactggttaacttaagtaaatggtatacaggattttactataatattcttgcaaattttctgtgggtttaagattctacaaaatacaaatattggaaaaaaacaaaacatagaaaaatgatggagcaatgtgaagtggcttatgcctgtaatctcagcatttcgggaggccaagacaggaggactgcttgagcccaggagctgaagaccagcctggacaacatagcaagaccccatctccatttttaaaaggcataggaaaatgatggaagaaaatacgacaaaatggtaaaagtggttattacaggcactattaattttctcctttacgtttttctgtattttaaaattgtttataatgaacttatatttattattctaaattcagaaaaaaaaatttagaggagagaaaaaccactcaattttccccatttttctttttcaatgttctatgccaatttccataacctgacatgacaacaggtggactcaggaaagaggtagaggcagctgctgatgtctaggtgtggcaccttctgaagtgtttgggaaagtgctgttactatccatagcgtgcattttggaacaaccctcaactctgttgtgaacgtgttttgaggcaggtgtcccatctaggttgtgtttccctgggaatctaagcaatggttgtagatgtggtctaattccctgagcaaagatgttctgggcatgagctataagaattctgaagacatgctgggtgatgtggctcacacctgtaatcccagcactttaggaggatgaggcgggtggattacctgaagtcaggagttcaagaccagcctggcctacgtagtgaaaccgtgtctctacttaaaaaaacacaaaaattaaccaggtgtggtattgcgtgcctgtggtcccagctactcaggagattgaggcaagagaatcacttgaatctgggaggtggaggttacggtgagctgaaatcgcgccactacactccagcctgggcaacagagtgagactccgtctcaaataatgataataataataataataaatgctgaacacttgcagagaataagattagggtgaattacttactgaaacctatggcctgagcaaacttgagcccaagaatcccctgatacttcccccaaataacttcactctcagcctacaggaaccctgagacattgaagattttggccaattgaaaaatcagacatctgcattccacagagaggggagggcagccattgtcatgctgtcactgctgctgtttttgcctgacatctcccagcccagccccaaagctattgtgtatgtgttggaagacacatgggtccaggaaagtagaagaattaggagcgctgctctccctggttaggggttactgaggtcattaatacttcttagctgtgatgtcaaaagcacaccacaggccgggagtggtggatcatgcctacactcccaacattttggaaggctgaggtgggtggatcacctgatgtcgggaattcgagaccagcctggccaacatggtgaaaccctgtctctgctaaaaatacaaaaattagccaggtgtggtggtgcacgtctgtaatcccagctacttgggaggctgaggcatgagaattgcttgaacctaggaggcagaggttgtagtgagtgaagattgtgccactgcacttcaccctgggcgactgagtgaaactccatctaaaaagaaaagggagaagagcacaaaaacaaggtccccagacagagtccagagtcagccgtctgtagctgaacctggtggcatgggtctatagtcccagctactgggaggctgaagatggagaagcacttgaacccaaggagcctgaggctgcagtgagctatgattgcaccattgcactctagtctgtgtgactgagcaggaccctgtctcaaaaaatcaaggaacaaaatgaaacaaaaaggacagccatctcatacagcagggcaggcaggtctggaagtagcaggaaccaactgagggagtctggcccttatgtctctactgtgggcatcatagacattatacgagtgtctcatgtagggcactgggcagacaaaacagagagcaggaggactcctcatagccccacacctgtgagaggtagatcaagggagggtgtcttaagcctttcttctgctttcaaaaagtcagcttatgaaagaggtgccagttgtaaaaccacggacaccgacatcctgggggacatgcagccccctgcagagcctggtggttgttgatcagaacctgcagcgtaagttccaagagggactgcggggtctccaccgcatgggcctcttctgtgcgttgtctggagaatagagattagccgggcaggcctttaactctggagatagtcaggcaagaaccttaccctactgacttactcacacccacgggctacctggggcaggaaatggaggcctgacaggtagagtcagttggaccgaatgggatcattccaaataaacattccattagtgcgtgggcaggcctaagcctggagcctccccatgggtcttaaacgtgagagaggcacgagagaaggccagccaccaaatgtaaactttgttgcttttgttttcccaattatttaacagataaacaacaaacagaaacctcacccttgggagatgacttaggagtaggccctaaataattgcgtttttagcatttcacatagcacaatattttttttggaattttttatgatcaagcaattcttctggtgaatgaaaaatcccaaggagctagaaaagagaatatttgtgttttaaggtgagatataaggtgcaaggtaatacattcagaaatgcctactctgtttctttcttttttttagatggaatttcactctgtcacccaggctggagtgcaatggcacaatcttggctcactgcaacctctgcctcccaggttcaagtgattctcctgcctcagcctcctgagtagctggtctaattttttttttttgaaacagagtctccctctgtctcccaggctggagtgcaatggcatgatctcagctcaccgtgacctccacctcctgggttcaagtgattctcctgcctcagcctcccaagtagctaggattacaggcatgtgccaccatacctggctaatttcgtatttttggtagagatggggtttctccatgttggtcaggctggtcttgaactcccgacctcaggtgatccacccgcctcggcatcccaaagtgctgggattgcaggcgtgagccaccgtgcccagccaagaaggtttttttttaatatcataagactgtgtgatgaattccaacagagagaaaaacaatgttttgtccaacctgtgacaactgagaagtatcaacagagacacaagactttttacctggctctggattcagactctcatgattataaagaaatgaagattattcttaaatgttctaggcatttatttaattcaaaagatacctattgaatacttacaatgtgtcgggcactattttaagccctaacacacatttaagttcttgcaaacacaaacatcttagaggtgtgttctcatccaaacagaggtttaagagatgagcaaaagttaaatttagcaatattagcttgttaagatgttcacaaggtagggcgtaagacaactcatgagatcttttatgagatctcataaacaacaacaagaaataggataaacaacaacaagaaatgggccacatattgggcttggcttgctggagttgctatataagggcttccccggacagaaggcggcatcagacctcttcatctctcctgagccctctatcctcgcttctcctcagtcctctctactgacaccatgggttgctgtgggtgtggtggctgcggtggtggctgtggtggctgcagtggtggctgtggtggtggctgcggtggtggctgcggcggtggtggctgcggtggtggctgtggcagctgcaccacctgcaggtgctaccgggtgggctgctgctccagctgctgcccctgctgccgtggctgctgtggaggctgctgcagcactcccgtgatctgctgctgccgccgcacctgcagctcgtgtggctgtggctatgggaagggctgttgccagcagaagggatgctgtcagcagaagtgctgctgccagaagcaatgctgctgctaggtgggaacccagcctctgggcaggggctgtagccactcatgctgttggtaagactgcgggtctgcaggtgccgcagggaggcagcttgctccccttgctgtggctttcctccatcccatcccgtgtgctccctgctgtctccctgtcacccagacttcatggcacttttctgcttggttctcatctctgtagtttaagtaattcttcctattattaaggtagtcacatgggcaactggtacaatgtcattcaagcacaaagatgcaggacattttgagttttgagctcagcaaagcaggatcatgattttgaccatgctttcttctttgaactcttttctctctaggcattaggtcttcttgtgtgttccacatatgctctgtcttttctgggccatagagtcttttctaggtgttctcctaaaattttctttttttgttttactaattcatggtcttcattttagtgctataattttgattatatcaccaaaaaatcttttttccctttggtagtaacccatctatatttttttacttaaaaaaattgatacataatagatgtagatatttgggggggatacatgtgatattttaataaatttacataatgtgtaataatcaaatcagggtaattgggatattaatcaccttaaatctttttcttttatgctgggaacattcaaattattctctattaactgttttgaaatgggtaatagtttattgtttactatagtcactctactgatttattgagcactaggtattgttcttttaactgtatttttgtactcattaatcaaccattcttcatgaaaaatttcataataaaatgcaaaagtgaactctgaacagtttcccttagttttattcttatagatatttttcattaaactaccattaatcatgattttatgtgggttggaggccattaaggatacacatataattatgcccttgtgtggtttacttccatttatacacaaataaccacaaacatgaggtagaagaataacaaacgtgttaaaagttctatgttgatgtgtatgtcatgggcaggaacaactccacattgctggatggggaatgggtgtaattcaaaggaactcggatcacttcaagaaggaagggacatttgggagtgtgttttgaagaattagtaaggttttgacaggtggaggtggttggggcagatgtttcgagaagggcaaaaatgtgagaatggaaaagttcaagacatacatgggacaaatcatgaatttgacctacagtaggctaatataaatagttacaagtcaacaatgacaggaaggctgtcctacaatttggaaggctgaggggttaagaataacagcacggacaacagcaacagtaactggcatttgcattgcccttaaaaaccaggtattctggccaggcgtggtggctcatgcctgcaatctcagcactttggtttttgttttgttttgttttttagacagagtctcaatgtctcacccaggctggagtgcagtggcatgatcttggctcactgcaacctctgcctcctgggttcaagtgatactcatgcctcagcctcccgagtagctgggatcacaggcttgcgccaccacgcctgactaatttttgtatttttagtaaagacggggtttcgctgtgttggccagagtggtctcgaactcttggccctcagtgatccacccgcctcagtctcccaaagtgctgggaggatcacttgagcccaggagttcaagaccagtctgggcaacatagtgagacctagtgtctacaaaaaaatacacaaattaactgggcgtgatggtgtgcagctgtagtcccagctacttgaaaggctgaggtgagaggatcacttgagcctgggaggttgaggctgcagtagccataatagtgccactgtactgcagcgtgggtgacagagtgaaaaggggacaggcattcttctaagcacatacatgtgtcatgttgcagagagggaaatggcacagagaagttattaacttgttcaaagcacataactgccgcagggggcgctgcacacacagcaatgctatgggccagggaaggcttttgagaggggacacttacctggacagcaatgtgcagaattaatcggttcactgggagaacggagcagtgtcagaaatcctgggcaaagcaacgagggcccaagacaacagcagagtgggaatggcaagagtatttgtggggagttaaggcataatacaaaccaaacaaatgaggggaatgtctgagatgacaaaacaggcaagatgacaatggtgatttaacaatgcactgggacttctattcttcttttcttagagatttgggaaattgtacaaggtagtccagtttattctttatttttattttattttatcttgtttttttcaaacaaggtcttgcaatgttgcccaggctggagtgcagtggcaccatcattactgactaaagtctcaacctcctgggctcaagcgatcctcccaccttggcctcctgagtagctgagatcacaggtgcatgctaccacactttttacattttgtgatagaatcgaggtcttgctgtgttgcccgggatggtctcaaacagttgggctcaagtgatcctcctaacatgcttggattacaggtgtgtgccgctgtgcctggccccattttaaaattcttatcaaatatgatcaactaggtcagaaactggccatttcctttaaagttgtttgtttcactctgtaagatgtagcaggaaagggagttgataatctaaaaatgctttctaataaatgtgcatgataactcccttatatatcactgatcctgatcttggtgtatttactctattgcagatgaaatgtgaaatggttattttgagaaaaggcagatctgcttgactggctacattgggctgacccgaaaagatctaggcttgaaaaaaaaattgccttcttttttttttttttttaggtggagtcttgtgctgtcacccaggctggagtgcaatggcgcaatctctgctcactgcaacgtctgtctcctgagcccaagcagttctgctgtctcagcctcctgagtagctgggattacaggcatgcgccaccatgcctggttaattcgtatatttttagtagagctggaagtttcaccatgttggccaggctggtctcgaactcctgtcctcaaatgatctgcctgcctcagcctcccaaagtgctgggattacaggcgtgagccactgtgcctggcctgcttttttattttatttatttatttatttttaattatttttttcagacgaagtcttcctctgttgctcaggctggaatgcagtggtgggatctcagctcactgcaacctccgcctcccaggtttaagcgattctctcacctcagcctcccaagtagctgagactagtcatgtgctaccacacctggctaatttttgtatttttagtagagatgaggtttcaccatattggccaggctggtctcgagctcctgacctcaagtgatccacccatctaggcctcccaaagtgctgggattacaggcatgagccatcacacccagccaaaaattgcttttttagtctacttaaatgaatccttccttccttccttccttcctttccttccctcccccctccctccctccttccttcctttcttccttgcttttctctttttctttccttccttctttcctttcaagacagggtctcactgtcacccaggctggagtgcagccttgacctcctgggctcaagcaatcctcctgctttagcctcccaagcaggtggaactacaggcatgcaccaccatgcccgcctaatgtaaatttttttttgtcgagaaagggtcctgctctgttgtccaggctggactcaacatcgtggcctcagataattttcctaccttatcctcccaaagtgctgtaactacaggtgtgagccacctcctacttattgaatgttgattttttgcattcattttaagaacgtttggatgaagattgtagactaacaacacacattatagggatcacagggctcggcacatgtatagtttgccactaaatattgttagaatgagcaaatgttatatatattatatatactatatctacatataggtcaggcttggtggctcatgcttgtaatcccagcacttcgggaggctgaggcaggaggattacttgagggcaggagtttgagaccagcctggccaacatggtgaaaccccatctctactaaaaatacaaaaagtagctcagcatggtggtacgtgcctgttatctcagctactcgggaggctaaggcaggagaatcgcttgaacacctggaggcagaggttgcagtgagccaagattatgccactgcactccagcctgggcgacagagaaagactctatctcaataaaataaaataaaataaaataaaataaaataaaaccatatatattatatataatataggttatatatatgtttgtatatgttacttgtattcattatcgtatacttacgttatacatgaaattcatatatataggttatacatatgttacttatatataacagatacatatacctcagattatatatgttacaatacaatttttacatatccatatgttatatgtatatacatatgtatgtatgtataacacatacacagtctaaactttgtgacttaacacatgattttgtaaaatctagtagtttttggagcatatgttctcaaatacattgtttccgttgttaaggcttgcctctgcctcactgtgtctgttccttcccgatctttgggtcaactgtgattacagggacttcacccttgtgtttactgtatgctccttggcttctaccagaggttctcacaggtcagagtattaccattagaaagtcctttaggcacttcaatccagacaaagcaaaggcatcaagatcttctgtatgtacttatatgaagaatatccagtggctcacacctgtagtcccagcactttgggaggcctaggtgggcggatcacttgaggtcaggagtttgagaccaacttgaccaacatggtgaagccctgtctctactaaaattacaaaaataactgggtgtggtggtggacacctgtaatcccagctactcgggagactgaggcaagagaattgcctgaacccaggaggcggaggttgcagtgagctgagccaaggtcatgccactgccctgcagcctgggcaatagagaatgactgtctcaaatattttaaaaaaagtcctcgtgtgtgtttgtgctggctggctagtgagctatttgtgaaaagggtaagtgtatggtgtaagaaggtggacatggacaaataatggttgtttttgtcaccgctagagggtcatgactgaaaattgtccaggttcttgtcattttgaacaaagaactggacaaattgcccagcaaagcaaaaaaaagaatgaagcaacaaaagaatgaaagcagggatttactgaaaatgaaaagtacactccacagtgtgggttctagccaagcagtgggtcaagggcccagatacagaatcttcttgcgttcaaataccgcctagaaatttcccattggccacttcatactcacctcatgtaaatgaagtggtagccaacaatcagtctgattggttgtggacagcagccgaacagaggctgaagtgaagttacataggtcacacttctgtgcaaatgtctgataggttgcttttttggcagcaattggttggctagggtgaagttacaaagttataattctatgcaaatgaagtatacatagaagaacaagtgggtggaggaggcagagaggtggcagagaggttgctgtgagctgagatcacaccactgcactccagcctgggcgacagagtgaaactccatctcaaaaataaaaaaccaaacccccaaaaagcaaaggtgaattactcagaaatacagtataacatagtaaacaatttcttaactaactttttgtaagcacattatctaccaacaatagcatattgtatttgtctgctagggctgctataacaaaacacacaggctggggaggcttaaacaatagaaatttattttctcacagtctggaggctggaagtataagatcaagatgccagtgaaaccgcctttgcaaagttacaattgagtaaattatggcagtgaaagccgactccatcttgcttctaaccttcaagctgtccttgttcattcctgggcataggccgaactaactttaggaaggaattccgttcatggtttgactctgaaataaaattgataatagccctttccctaaaagacccccttcttgcctggggactagtctgcctttgcaagactaacaaattagctacaagattagaaattacagataggggtcacgcagcctctggctccaagagtccaaacctccccaaattgttcttggggataatatcactattttaaaacctaagatcagtgcttgtgatattttgcagaccctgcactatatggattagctgataccatccagactggtaacctagctcaaccagttctgccttcccacccagcaacagagaacatcaagaaaaagtcacttcgggctgggcgtggtggctcactcctgtaatcccagcactttgggaggccgaggtgggcggatcacttgaggtcaggagtttgagaccaacctgaccaacgtggcaaaaccctgtctctaataaaactacaatattagctgggtgtggtgttgcgagcttgtaatcccagctacttgggaggttgagacaggagaatcgcttgaacctgggagacggaggttgcagtgagccgagatcgcaccattgcactccagcctggacaacaagagggaaactccatctcaaacaaacaaacaaacaaacacacaggaaaaactcacttcgaccccctatgattccatctccaacctgaccaatcagaactccccacttcccaaacccctacccgccaaattatctttaaaaactctgatccctgaatgcttgaatgctctgggagactgatttgggtagtaataaaactccggtctcccgcacagccagctctgcataaattactttctccattgcaatttccctgtcttgataaattggctctgtctaggcagctggcaaggtaaacccattgggtggttatacagcagggttggttttttctgagtcttctcttcttggcttgcagatgaccctcctgccatgtcctcatacagcgttttctctgtgtccactcatctctggtgcctctttctttctttttctttctttcttttctttctttctttctttccttccttccttctttctttctttccttctttctctctctctccttccttccttcctttctttctttcttcctttctttctttctctctttctttttctttctttctttcttttctttctttcttcttttctttcttttttgagacagagtcttgccctgtcacccaggatggagtgcaatggcatgatctcagctcaatgcaacctccgcctcccaggttcaaacgattcttctgcctcagcctcctgagtagctgggattacaggtgcccgccaccacacccagctaatttttgtatttttagtaaagacagggtttcaccatgttggccaggctggtctcgaactcctgacctcctgatctgcccacctcggtctcccaaagtgctgggattacaggcgtgagccactgcttccggcctgcctttttcttctcatgggaacactggccatactgaattagggtcccaccttaagggcctcattgaatttaattacatcctaagaggccccatctccaaatatagtcacattaggggttagagcttcaacatatgaattttggtgggaggcagggttcacacttcagtccataacacatctcattattgtaaatccacaaaggtggagtactttgaacaaaacacatagaattaggggagccccagacgaattaatctctaagaataaaagtaggaagagttggcatattatatatacatcccatatctactcctacatggggacaatacctgtgagcaagaatatttgttgtattgtttgtagaagaaaaatgtttgaaacaacgtaatgacccaacaaaggaagacttagttaagtttggcacacgtgtgaaaagaaataaattatagtaacaaatgagaaggaggcagctgcctatgtattatttttaggtcatattgatgaggaaatcaaggtaagaagtagaatggtatactcagctgtcacaggggtctgtatgtgcatagaatatctttttcttttcttttctttctttctttctttctttttttttttttttgagacggagttttgctcttgttgcccaggctggagtgcaatggcatgatcttggctcactgtaacctctgcctcctgggttcaagcgattctcccgtctcagcctcctgagtagctgggattacaggtgcccgccactacgcccggccaatttttggtatttttagtagagacggggtttcatcatgttggccaggctggtcttgaactcctgatctcaggggattctcctgcctcggcctcccaaagtgctgggattccaggtgtgagccaccgcacccagccagaatatctttaaaaagatactcaaggcagggcgcgcagtggctcacacctgtaattccaggactttgggatgctggggctggaagattgctcgaggccaggattttgagaccaacctgggcagcatagtaagatcccatctctattcaattaaaaaaaaagatactcaagacaatggtaagggaggggaattggtggctgaaggatggggtgaggggtggaggaaagtttacttttcactctttgacctttttgtacatttaaaattttgtactatttctttttttccagggaaaaagtcataatgacattggttcatgcagaaataacccaacccaagaaactgcttggaaacgtatgattaaggagtttcaggaaccccgcccccacccctcccccactcaaatctgaatcagttgtgactatcaccttagggaggaatgactgcgattaatttaaactaaagaatttaaaattagtgttgattttgaagaactgattaaaatgatctgttgttacctaagacaaactttttttttttttgagacagagtttcactcttattgcctaggctggagtgcaatggcacgatctcggctcactgcaacctctgcctcccaggttcaagcaattctcctgcttccacttcccaagtagctgggattataggcatgtgccaccatgccaggttaattttgtatttttagtagagatggggtttcaccatgttggtcaagctggtctagaactcctgatctcaagtgatccacccgccttggcctcccaaagtactgggattacaggcgtgagccactgcaccaggcccaaactttttttaatgacacaggtaatatatggatacaagcatggcaaattcaaaaaataaaaaagtatatggaatgtaaagcaagatgtgtcttcatctcaccactaatctcatttctgctcctatagtcacagtcatgacaggatggggctggccaccagcaagactaagtgattagagagtgggcactttcagctctgccctctgacctccagggagtggaccagggctggagatggagctctatccaccttttgaacaaaaagattctgagagcttctgggttggtgaatgctccaactacccagggacaaaaactcctgcacatatagatacttgcacgtttagaaacataacttagcgggcttttttttttttcaatatagcagcggaatcaagatgtagttatttttcagaaagttgattatttttcaattagcattttgctttagagctctttccaggccagtttgtgtagatctaccttacgctttgttcattttttgagagtcttgctctgttgcccaggctggagtgcagtggcacaatctcagctcactgcaacctctgcctcccaggtgattctcatgcctcagcctcccaagtagctggtattacaggcgcctgccaccacacccagctaatttttctctttttagtagagacagggtttcatcatgttgtccagactggtctctgacttctgacctcaagtgatcctcctgcctccgccaccacacccagctaatttctctatttttagtagagagagggtttcatcatgttgtccagactggtctccaacttctgacctcaagtgatcctcctgcctcggcctctcaaagtattgggattacaggcgtgagccattgtgcccagccagctctctctttttatgtcagggtttctcagtcttggctctactgactttgtgggctggataattctttgttgtaggagactgtcttgtgttttgtagtgttaactaaaaggtatctgatacggacctcaatcagtttagaagtttattttgccaagattaaggacatgcccggaagaaaaaaacatggaatcacagaagcagcctgtggcttgtgcctttctccaacgatacatttgagagctccaatatttaaaggggaaaagtgagctggaggggaaatagggagggtacggtaatccacatgttgcaagagaaaaggagtaggtaaggaaatagtcaattacgcattcgtcttgtcctcagtaaatcagcactttacataagatacggtggctgggcgtggtggctcacacctgtaatcccagcattttgggaggctgaggagggcagatcacgtgaggttaggagttcaagaccagccgggccaacatggtgaaaccttgtctctactaaaaatacaaaaattagccaggcatggttgtgcatgcctgtaatcccagctacccaggaggctgaggcaggagaatcactggaacctgggaggtggaggttgcagcaagctgcaccactacactgcagcctgggcgacagagcaagactctgtctcaaaaaaaaaaaagttcccaccatctaatcacttagtcttgctggtggccagccccatcctgaggccatctaggggttcttccctaagtaaccttattagcataaacgcaggtaggattgaaaggggcctcttacaaataacaaaagacacttttttctttgagattcgcctgccttggcctcccaaagtgctgggattacaagcgtgagccatctcgcccaggcacaaaagacgcttctgtcactcagcaaattttaaaggtcttatgagttctgtgccagaaacaagggacaaaccccaaccatgcgttttatgacactgccttctataagaagcagagaggtgctttagtagagacagggtagcaaatggcaagagatgaggtctgagagctaagaggaccaggtcaagaaggaatgaagttaaagaatttctgctttagattcctgaatatttctctatggtagatgctaaaaatggatgtctcaggttgaaatttaaattctgataggctcacctaagttgctacaatttgaactcgtgctaatggcatctgaattgcccatttctcactcttgttaacactgggtatttctcttgccaatctggaaggagcatgaggcacttccttgagtgtcagggatcccaggctcatttcctcatgtaaattcctcatcactgctcctttttctggcaattgcttgttcatatgtattaagcagagataacgaacctctgtgttactttgctcatctgtaaaatggggacagtaatatcttccaacaacgttgttctggagagaaaattgtgtatgtcccttgcagagagctttgagaggtgcctggcccaggcccaggggacgtactctgtgcatggggtgctagtactgttgaacactcctgtgattaccatgtgctgattttttatttatttatttatttttagacagagtcttgctttgtcgcccaggctggagtgcagtggcgcgatcttggctcactgcaagctccacctcccaggttcacgccattctcctgcctcagcctcccgagtagatgggactacaggcgcccgccacctcgcccggctaattttttgtatttttattagagacagggtttctcctgacctcgtgatccgcctgcctcggccccccaaagtgctgggattacaggcgtgagccaccgcgccatgcctactatgtgctaattaatgggagggatggccttcctggcattggccgagagcagagttttgaggggtgacaagtggcaggatcccatcacatccacaggtggcctcgactctggtctttttgccaggttcgtctctgcaataaatctgaacccatctggctcaatccccgtagacgttaaggttgttcaaattctatttcttctaatccagtgctgaccaaggaacactttctttttttttttttttgagatgaaatctcactcttgtcccccaggctggcgtgcaatggtgtgatcttggctcactgcaacctctgcctcctgggttcaagtgattctctttccttagcctcccgagtagctgggattacaggtgcctgccaccacgtctggctaatttctgtatttttagtagaaacggggttttaccatgttggccaggctggtcttgaactcctaaactcaggtgatctgcctgcctcggcctcccaaagtgctgggtttacaggtgtgagccactgcacccagccagggaaagctttcataattgttagatctttcagtaagtagagtttattttaattaactaaataattaagtaattgcttttaagaggatacccttgtcagaggatttaagagttggcttgctttgggagttagtttaaagaaaaaaaaaaatgggcgggtgtggtggctcacgcctataatcccagcaatttgggaggtcgaggcgggtggatcacctgaggtcaggagttcgagaccatcctggccaacatggtgaaaccccatctctactaaaaatacaaaaattagccagtcgtggtgccgggcacctgtaatcccagctacttgggaggctgaggcatgagaattgcttgaatccaggaggcggaggttgcagtgagctgagactgcgccattgcactccagcctgggcaacaagagcaaaaactctgtctcaaaaaaaaaaaaaaaaaaagatcccttctgtaaggtcctctgaacaggcttcaccacagtagagccattgtgacccctgtgacccacacgtacaggcttcctggagtcacaaagcctggatcaatagcagaaccactaaagaaggagaaacagctacttcctgccttaactgataaccaaccttgcaaaattccaccattgtgttatgttcccgccctaccctaactaatcaatcaaccttgtgatattgtgccttgtgacgtccccccacctcatgactatgcaccttgtgacattcttccccttcccgaaaaaactcctaactgtaactttccactacttaacccttacctgtaaaactaactccaatcccaccacccctccgctgcttctctttctggactcagcctgctcgcacccgagtgaatagacagccttgttgctcacacttagcctgttcagggtgtctcttcaattagacgcacgcataacaacttctggcctaactgccttgtctgggcttggtagcctgagtcactgtttcaggcctgaatgcctctgggcttctttctaaccccgctgaattcctacacggacctcagacggatgcagctctccctaggtacagccattgtaaggtcccagccgggtaccccacccatcagctttgctgggtgcattttcaccctgctcttgttccatgcctctttaactgtgacacgaggagtgaggcaatggttttcatatggatatcagcatttctcctctggaattcatcgtcatttgaaggcttctgtgcttctctctctctctctctttttgagactgagtctcgctctattgcccaggctggagtgcagtggtgcagtctcggttcactgcaatctctgcctgccaagttcaagcgattctcctgcctcaggctcccaagtagctgggattacaggcacccgccaccatgccaggctaatttttgtatttttagcagtctatcatcttaaccactcggccacctcgtcctacaatttttgtgtttttagtagagacaggatttcaccatgttggtcaggctggtcttgaacccctgacctcaaatgatctgcctgccttggcctcccaaaaaagtgctgggattacaggcatgagccaccacacctggactattttttttttttttttttcgagacaaagtctcattctgtcacccaggctgaagtgccgtggcaggatctcagctcactgcaagctccgcctcccaggttcaagtgattctcctgtctcagtctccctagtagctgggactataggggcccaccaccatgcccggctaatttttgtatttttagtagagacagggtttcaccatgttggccaggctggtctcgaactcctgacctcaagtgatccacccgcctcggcctcccaaagtgctgggattacggacgtgagctaccgtgcccagctctgtgcttctctttaccacagcctacaaactctgacgtaatctagtcctcaactaccagctttcagtgcacccctctgcgctggactgcagctcatctcttctcaatcttccttgcctcagggcctttgcacctactgtttcatcagtttagagtgcactttacccctattttgcacttctggctccttatccctctgtcaggtctcacggagccctctgccccattactgtcatcattgtattccttgcacattgacattatatatatttgccatttatgatctgttttcctccatatttggtgcaaatatcatggaaatctgtctggtttagcactatatccccagggctgggactagcctatgctaatcagttacaaattagtagaaagaaaaacaaaacaagagtgacctaatgtttgcagaaattggatcagcagtcctagttcccaaacacgcagatactgaggccctggtgtggccttcaagggcttcccaaatcttatgccagctctttttctaaactcagtgtctaacattccccttcattcgagccatgtttacattaacccacacactttcatccaccatctctgctggttagatggtttgtttctcagcctggaatacactttctgctacccccaggccagctttcagcacgtgggatgctgacctctccatgtgtgtagttgacatctccacgtggatgcagtgcaacctcatgatgctattttatgagttagcgagagtccaaaaaaggggccttgctgggtgagcctgaagcagttgatgaagaagatcaaggtgtccttgatgtccttgccattgtccttgttctgcggcttagggtggtgcgtgggggaaggctcttcctctgggttcactggctcgtgtgttccttttctttttcaaaagccactccaggaaaagtcttgatagcagaagtcagttattaaaagctgtgtaaatgtactaaagaggacaggtgccagacacattttcatttaacattttactctcaactgggaactgtttgcctttgaaggaatgtcaggcacagttcctagttggggctggagcatttttgtgatgttctgcacaagttttggtctagagaagaaagctggctgcatggatagcatgaagaataccaatccacttgagtaataattatgcaaaatcaggtttcagggcccactaggtaatcatccaacatttctgtgctgactcttgcacatagcacaagagagtgaagtatgccagatccaggaaaaggcaaagttcaataattagctataaatacaactttatagccatttccccagactaaagggtaaaagtttaacaactggctataattacaactttattgctacatctccagactctatttttatagggagaataatggcttcttcaatgattaacacggttgatagctactgctctgtctttgaagaagcacatggtatttcgtggaaatgtgcgtatgtgtgtgtttgtatcttaagtcaaacattaacaaataacacagaaagtcccttgttttcttgtcttgcacttagccttttgcatctcacttacttctttctttccttctttctttctctttctttctttctttctttcttttctttctttctttctttctttctttccttccttccttccttccttctctctctctctttctttctttctctctctctctttctctgtctctctctctctttctttctttctttccttccttctttctttctttccttctttctttctctctttctttcttgacacagagtctcgctctgttgcccaggctggagtgcagtggcacaatcttggctcactgcaacctccgcctcctgggttaaagcaattctcctgcctcagcctctcaagtagctgggattataggcacccacgaccatgctcagctaattttttgtatttttagtagagatgggtttcaccatgttggccaggctggtctcgaactcttgacctcagatgatccatccatctaccctccttggcctcccaaagttctgggattacaggcgtgagccatcgggcccagctacatcttgcttatgtctaaggaaaactactgaatggggatcattctcctggcacgtacatgtgggtatacagtaccttctgtctgagtactaaccaggcccgaccttgcttagcttcctcaaacagatgaaatcgggcatgttcagagtactatggccatagactatatagtgtcttatataagatatagcacatgttatgtaaataaatgatattcacacaaaaatatgcatatcctcccctccaccccatagtttttgggtttacctatcagctctcagagtggaggactgaaggaagcccagaaagaaaaaatcaatttaggccaggtgcagtggctcatgcctataatcccagcacactgggagtccaaggtgggtggatcacctggtcagttcgagacaagtctggccaacatggtgaaacctcgtctctactaaaaatataaaagttagccgggcgtggtggcgggcgtctgtaatcccagctactcaggaggctaaggcaggagaatcccttgaacctgggggacggaggttgcagtgagctgagaccacgccattgcactccagcctgggtgacagagcaagactccgtctcaaaaaaaaaaaaaaaattcaatttatattggaagatcaaggaaggattagattggcgggggtgggggtggggtggggaaggtgggatcctaagagaagaaagccaagactgagttctttgggaatttggggggagttttgggagccctgggagagatgaggacctctgccatgctctgacggggaggcacagtgagaccaagggatgagtatgttgatagtgcttttctctggctcctacaatttgctgcccattttgaactttgctaagagagtgcagtgaagattcctattgctcattattgttttcttggttaactgattttgtttcttttttctttttttcctagaaaatcatgaaacaaggaataaaactatgattttgtactgagaccacaagacagcacagttttacacagactgcacacacccatctctctgccactctgtctagacttttaattattattattattattattattatttttgagacagtcttgctctgtcgctcaggctggagtgcagtggcacgatgatctcggcagactgcaacctccacctcctgggttcaagcaattatcctgccttagcctcctgagtagctggggttataggcacgtgccaccacatctgcctaatttttatatatttagtagagacggggtttcaccatgttggccaggctggtcttgaactcctgacctcaggtgatccacctgcctcggcttcccaaagtgttgggattacaggcgagagccaccatgcctggcctaaacttatattaattttatattgcacaaatagattatggtgatggagaaatttattctctggaactggacaaagtagaaagcagacagtcacagtgaatctcatcacctaaaggtgaccacttttgcatttggtggctatgccttcaggtttttcctaagcatgtacaaatgtaagttgctatttgcaaattgagacttttgttctatatgctatatattttttgtgcaactttcttttcttttttttttttttttttgagacagagtcttgctctgtcacccaggctggagtgcaatggtgcgatctcagctcactgccacctctgcctcctgggttcaagtgattcttctgcctcagcctcccgagcagctgggattacaggtgcatgccaccatccctggctaattttttatattttagtagagacagggtttcactgtgttgcccaggctggtctcgaactcctgagctcaggcaatctacccgcttcggcctcccaaaattctgggattacaggcgtgagccaccacacccagccttgcttttcttacttattattacagtactgcatgtcatttctgttgtctacacgtatcttttagcaatttttgcaaagtgttccatcttatagatttaccacaatatttttaaaaatttttaaatgtttactgtaatttattttattttttttgagacggagtctcactctatcacccgggctggagtgcagtggcaccacttggctcactgcaacctctgcctctcaggttcaagtgatcctcctacttcagcctcctgagtagctgggattacaggcatgtgccgccacacccagctaatttttgtatttttagtagagacagggtttcaccatgttgaccaggctggtctcgaactcctaacctccagtgatctgcctgcctcagcctcccaaagtgctgggattactggagtgagccaccgcacccagctcacaattattttttaaggtgaggtcttgctatatatggcctaaactggactcgaactcttgggctcaagtgatcctcctgcctgggcatctcaagtagctggggctacaggtgcatgccattgtgcctggctcccacaatttatttatgtcaccaataatgggcatttatgttgtgtctaattttttgatattgtaaacaatgctgcaatgagcatccttgaacatatagacatgtagattctaccagaaactacccttaaagaaaagatttgtttttttgtggtggttgtcagtgaaagcactaccccagtatcatgtggctctggaggtctctgtgtcattaagtaacctcaaaacctgcagcatatggttttgagttatcttagtaattccctcttcttttataattggaatttgagtggagaaaattaaacaatacacatgtaataacatcattctttatctgttccctacttaatatgtgatttcttttattggctggaaaaagtacatagctgctgatttatctacttcaagtagcaggacaatatgcttaccttaaatagtcaaatgtagaaaagaacaatggtcctgaaacacagtccacgccgtcacaggaagaggagaggcctgagactatgaggagagggagagaccagtgatcaaaactgagctctacaacagtcctctctgttgggggaattaaaaagcaaaggatttgaacaagtaattcacagatggggtagtacaaatggccaggaaacttctcaaataacttggaaaacgtgaaaccccaaggatagtgttaagagaccgctttaaagtgagatttctgttattcatgtttaaaatatgaagtattcatcagtcttctggaagagactgacacacaaaaaatataacaagtagcttgtattgatctttcaccaggagactttctgagaacttttcacatattagctcatataatccacatagcaactttatgaagtagacagttaattatttccattttgtagataaagaaaacaaggcgcacagaggcattccgtgttttgtccagggtcattcagtccttggcagagctggcatttggggtcaggcagctgggctcctgggcccgagcgcttaaacactgccttgtgctaccacctggtggtcaaaagcgatacacgcaacaatggaggtgagcccaggccagccaggagccggctccctggaggatgtgaacttgaagcagaaatcaggaaagacattccagggagagacagcagcactcgccaaggcacaaaaacagcagttactgctccatgcatgaggagcaagagacaactgggaatgatagcaagaggagtaaaaaataaaaagaatttcttttcttttttttttttaaagagcaaagaatgatgtgttaggagattgagtggagaggtcagctgggaccagatgacgggagagctcctagtaaggggattggactttattctgaggctgatggaaagccactgaagagcttttaatcacggcagtcggccaggcgtggtggctgacacctgcaatcccaacactttgggaggatgaggcaagggaatcgcttgaggccaggagttctagaccagcctaggcaacataatgagacgcccccgtctccacaaaaatgaaacaccacacacacacacacacatattagctgggtgtggtagcatgcctgtggtcccagctacttaggaggctgaggtgggaggattgcttgagcccaggagattgaggttgcagtgagccttgcactccagcctgggagacagggccagaccttgtatggaaaattgatcagtcggccgggcgtggtggctcgtgcctgtaatcccagcactttggaaggctgaggcggtcggatcacctgaggtcaggaattcgagaccagcctggccaacatagtgaaaccccgtctctactaaaaatacaaaaattagctgggcatggtggcgcacgcctgtagtcctagctactcgggaggctgaggcagaagaatcacttgaacctgggagacggaggttgcagtgagctgagatcatgccactgcacttcagcctgggcaacagagcgagactctgtctaatatatatataatatatatatatatatatatatatatatatatagatagatagatatagatatagatatagatatagatatatatcgatcagtcataatcagtcaatcatggcagtgacctggggagagttacagtttgtataaagtccctagtgactgtgaggaaaatggatgtgggggacaaggcccagggagaccaatgcagagccgccaggaaagagcctgcaagttcccaagtcaccaggaccccagcggtgacggagtggggagagcacaggttcaagaaatatttagaaggcaaagctgtcagcacttggcgaatgaacgtgatgcgaaatggacagagtgggagaagcaggctacagacaccaggaaaaagatcgttccaatcactctttggctgttccgagccttatagcgggatcctcaaccaggggccattccgccccccaggagacaaccagctgtgtctcggacagttttgctggtcacagcaagcggccggggtggcggtgctagaggacgctgctaaacccccttggtgcacagggcaggccccatgggacgggaatcctgggctcggggcgcggctgcctgggtcccctctggcggcgccagctccaggaggcaggaaacgaggaggccctggctcacggagtgtgcttttacagaagcaagccctggcgctccgggcagatgtccgggggtctcccgcagaccccttgccctccatggaatcccgttcctcccagggttcccctcccccatttacccctccaggctcctgagcgctgaaaactgcattctgcggcccagacaaggttaccgtcttactgccgggaagccactagatacagttgcaggctaaaggcagtgtgattcccctcaagcaggccttagtttatcgtagggcacgggacgtgcctccttccccagagtctccttttcaggagctgcagggcctctaggcttcccggactgcagctttacctgcctgcccccagcaggatggtcttggggtctatacctgagccgagatctcgccactgcactccagcctgggtgacagagtgagacatcgtcagaaagaaaaaaaaaggtcatccatgagaagaatcggtattgctggattctgttgatgttttttatttgcttctgattatctatgttggttaaaggtaaacacaaaatttcatttagacaggaggactaaattcgcgcagtctattgcatatcatagtgacaagagttaatcacaatatattgtatacttgaaaattgctgagtagatttcaagtgtcctcaacacaaaaatgataagtatgctaggtaatgttatatgtttaatagctgatttaggcatttcacaatgtatgcatatagcaaaacatgttatacaccataaatacatacaatttttacttgtcaattaaaaataaataaaacaataaataaaagagtatataaaaattgttggaaattgctcatatgagatttgttgttgatcaataacattattatactctaaactcatttatttatttaatttttgagacggagtctgactctatcacccaagctggagtgcagtggcatcatctcggctcactgcaacctctgtctcccgagttcaagtgattctcatgcctcagcattccgagtagctgggactataggcgcacgtcactacacctggctaatttttgtatttttagtagagacggggttttaccatgttggccaggctggtctcaacctcctggcttcaagtgatccacctgcttcagcctcccaaaatgctaggattacaggcatgagccacctcgcctggccctaggctcattttattaatgtgaaaattctttaggccccagaagcatatattctggatagagtgcaaacagattctgagtgaggcttctggggccaaattggaggggaggggcttgccctgtgctctgtacccactctgacgctttcgacttgtcaaaagtttgtcttcattcttttatctttaaatgaaaacacactggggctcaccatgtggaaattaatcgcatttaccagcggaattactttccttttgttctgtatcaaataaacacaaatttggtggcctaaaacagcacactgattctcttacagttccaaaggccagaagttcagaaccaggctcactgggctaaagtcaaggtgttcacaggtctggttccctttggaggttctcaagggagagttcgcctccttgccttttttggctactggaggctttgtgcactccttgacttaaaacctcttcctcaaatcattccaacctttgcttccattgtgacatctacttcctcctctgtagtcaaatcttgatctgtttctgtccgatgaggccacttctgattacatttgagtcccaccctgataatccagaatactctttccatctttccattaacatccttaatcatctgggctcagtggctcatgcctgtaatcccaggactttgggaggttgaggcaggcagatcacttgaggccaggagttcgggaccagcctgggcaacatggtgaaaccccatctctactaaaaatacaaaaaaaattagctgggtctggtggcacatgtctgtagtcccagctactcaggaggctgaggcaggagaatcacttgaatccaggaggtggaggttgtagtgagccgagatcacaccaccgcactctagcctggtgacagagccagactcttgtcaaacaacaacaacaacaaaaacctttatcacatctgcaaagtccacttatggaaggtaacattcacaggttccagggattaagacctagatatctttggggtcttttattcagccaaccacagcacattctcctttaacacaaattagatgactcagaggattgcgtttagtctggggcaaaacctcatagaatcagaaaatatttgcaaaatataaagctgatataacttccctcaaagcaaatgttttggctgtgggaagggttatttggtcaaagaaaatgattcctttataattattgaggaattcaacccgttagccaataaaacatttgtttgctaaaaatacgttttatttgaatagcagcttttttttttttttttgagaccgggtctagccctgtcacccaggctaacgtgcaatggcacgaccttggctcactgcaacctctgcctcccaggttcaagcaattctcctgcctcagcctcctgagtagctgggattacaggcgtacgccaccatgcctggctaattttttgtatctttagtagagacgggtttcaccatgttggccagattggtctcgaactcctgacctcgtgatccgcctgccttggcctcccaaagtgctgggattacaagtatgagccactgggcctgaccttgaatagcagctttttattataattcatattttaattttatgtattttaagaataggctgggcacagtggctcatacctgtaatcccagcactttgggaggctgaggcaggtggatcacttgaggtcaggagtttgagaccagcctggccaacatggtgaaacttcatctctactaaacatacaaaaattagcctggtgtggtggcatgcgtctgtaatcccagctacctgggaggctgaggcaggagaatcacttgaactcaggaggtggaggttgcagtgagctgagactgtgccactgaattccagcctgggcaacagagcaaaaccccgtttcaaataataataataataataataataataataataataataataaaaaaaaacattgtcatgatgacttctgctagttttccccagtgttgtatcataggtgttttccctagagtttcctcgggtctgagatttccttctttctccttgtttaactgatcatgaatcgattgagctttgggctgcgtcaaagttctgttttgcctacaacagttccacggggaacacgattctgctgaagaaaaagactgctgggttctggaggagtattttacctcctccttgctggaaacagttaatgccctggagaatgtggtcgatggcctcatgcaggcggaggcatgttttaaaatgggtaaatctagttttcttcagcagtggcatgaatcgtaggagatctgctcaaatgctaaccagctaacttctctgaggccaaatacttgctgtcttcagcctctggttcttcattatgaagtgaaggattttgtcaggttatctgtagctttcctcctttttctcccaggccgacattcttataagttaagtctactcttagaagtttctccactagccaggcgcagtggctcacatctgtaatcccagcattttgggaggccaaggcaggtggatcacctgaggtcaggagttcgagactagcctgaccaacatggtgaaacctcgtctctactaaaaatacaaaattagccaggtgtggtggtgcccacctgtaatgccagctacttgggaggctgaggcaggagaattgcttgaacccgggaggcagaggtggcagtgagatgagattgccccattgcactccagactgggcaacaagagtgaaagtctgtctcaaaaaaaaaaaaaagtttctccactacttggtgaaggccttctgggtcattactgaggacttctctctctctctctttttttttttttagtagagatgaggtttcaccatgttggtcaggtgggtcttgaactcctgacctcatgatccaccagactcagcctcccaaagggctgggattacaggcacgagccatcacacccggcctattgagacccttctctaggcagttttctccttgagatctccagaatcacaataacactcaaagtgcaaagcaaacaaacaaaaccagaacacaaaggaagagagggaatttgaaactgcaggagtcatatttacttgctccttgttccatgtgacaaaggggccaggtcatattgtgtgatgaagtttgtacttatcagtcacctggccaagtcgtgtaaaccaggggtccccaatccccgggctgtggaacagtaccagtctgtggcctgctgggaaccaggccacacagcaggaggtgagcagcagttgagtgagtgaagcttcatctgtatttaccacaactccctattgctcacattaccgcctgagctctgcctcttgtcagatcagctgcagcattagagtctcataagagcacaaaccctattgtgaactgctcatgtaaggatctgggttgcgcgctccttatgagaatctaatgcccagtgatctgtcactgtctcccatcacccccaggtgaaactatctaattgcagaaaaacaagctgagggcttccagtgattctacaatatggtgagttgtataattatttcattatattacaatgtaataataacagaaataaagttcataataaatgtaatgcacttgagtcatcctgaaatcatcccccactgaaccctcactggtccgtggaaaaatcatcttccaaaaaaccagtccctggtgccaaaaaggttgaggactgctggtgtaaaccacacaattctccccactggccaaacgtggaaccatctttcacttaccacaggccataatgaatgtgtatacagtgtatgctgggattgctttgtgccttaggctgtcactcagtgtgctaagtggggctctactaggcccactgtctttcttccccaagggttctgagtgtcagggacacacctagcttgtatgcatttatatggtcaccagtttctccttcccctcctctctcatcatacccaagtttctgttgctttataatgcaaagcacttcagcattctcttttgtttccctgtccttgctcatggtgatcttaaccacttattatgactttttttttcttatgaaaatagttccctctctgagtatttctggcagcaagtgtcttttttttttttttttttttgagacggagtctcgctttgtcacccaggctcgagtgcagtggcgtgatctcggctcactacaagctccgcctcccgggttcacgccattctcctgcctcagcgtcccgagtagctgggaccacaggagcccaccaccatgtccggctaatttttttgtatttttagtagagtcggggtttcaccgtgttagccaggatggtctcaatctcctgacctcgtgatccacccgccttggtctcccaaagtgctgggattacgggcgtgagccaccacgcccggcctaagtgttaagattatgaaatatttactctctgcatacttagttcacctataatactaaagatacagggagagaagtgttgctaaggggaagaagatcttgggttctaatataaatgcaatcttgctttgaaagcttggctccttctttctctgtaccaaataggacaaaataaacagcttataacataataagtgaagagttaatttttcagtgacagataactattatctccagtttctcctttggccatcttcctgtatttatgaatgcctcttctttgaaaataatagtgaattactataccatttttccatattctaacattttgcctttttcatccaaagcgatataagcaaaacagagtttgtgggttacatgaagatcgtgagaagacctggattggggtcctgattctccacgcactgaggtattgctcctcacaagagggcattagctacgggggtctgcccacagaccctgacccaaacgacggatggataaaatgtacactgacacacagatattctgttttgccagtcctgctgagtgtctgaacccctacacaccaagagaggtttgtcactccggccggtccggagcagctcgccctccaggcatttgtttactatacaattaacaacagaagctctgagtcttgtggataattaacatggttaagagagtagttctacaaatgattaaagctcaggtaccgcgttttaaagtaaataccattagggggcagtatttctggtccacctccccgcgagagggccatctggctcaacagttggttaacggaggtagggtaaacagacttattggggaagcctctactgtccctagtattctaattctctaaggtaagaactggctgccttcagcctcttcaattattacaagctatgtaacctttcggccttccaaagaggtttgtgactattccctataactttccgtaatatttccttttaatatttctgccaccatcctgagtgaatcccaacaactcactagataactcaccctggaaaagtcattcaacaaatctgcggccccatttcatcatctgatactcaaatggttgtggagatggcctctgcagtttctattaaaatatcaccaaattctaagtaggtcattttttttgtagtagacttttctacatttaaattgctggtaggaagactctttcaaatctaggtaagccagttttaaaacagacaaagaatacagaagaggaaatgacaacgagtttgctgttttccatttcttaattttaaaaaccaaagtcctggtattatctatcagaatttccgttaatcatgaaaagcacactgggcctctcatcttcgtctctcattgattgacaacctttcattttgattccacccagcattacaggagttttctaagttcttaacatttctaatggtctggcaaagctgtgtgaatgccatcaatactgatttccaggaaatcttgatgttaacattttatctttagtgttgcggtgttttgcctgctctgatatgaactggaaaatattctcacccacattttgaaaactggtgtgaaaagtgatgctaacagtaaaggtctttcttttaatgaaaagacaaatgctgacatttacacatttggcttcaacttttcattcctctctatgtgctgacaggtgcagtctcaatccacatgattcattttctgcttgttgttctttactttgtatcacttcaaatgatccatttgcttaaaaagaaaaaggtacaagaatatgtcactataagttcatggtttctgcctgtaggttttaggttgctagggggtggtttgacctttaagataagtctggtaaaatgcagatgggattatataatgtttacagtagcatataattgaagttgtaaggggtgtgtgtgtgtgagagtgtgtgtgtgtgtaagcggtagagttagaagtgagtagaagtcacccccggaaacagatcctgactccaaggaaaactaaagcccatagtcccacagtgtctcaattttctctggatgtttaaagagaagaatattttttttaaatttaatttaattaatttatttttttgagacagagtctcactctgtcacccagcctggagtgcagcagtgtgatctcggctcactgccacctccacctcctgggttcaagcaattgtcctgcctcagccttccgagtagctgagattatgggcacccaccaccatgcccagctaacttttgtatttttagtagagatgcagtttcaccaggttgaccaggctggtctcaaactcctgacctcaggtgatcctttgtcagggagccttgggcctcccaaagtgctgggattacaggcgtgagccaccacacccagcctcagggaagaatctgtaggaaaaggaaaacaaacaaacaaacaaacaaaaaggaatcttctttcatgcagtagaaaggaaaggagcaggacatggccgcagagaggttttggtggggcattgggaaccagtgggaagaaacgcttcttgcatctgattatggagaaggccttacgaaaactaaattaatccatgaaaagcaggagaaaggacacgattcagctaaaaagataataacaggccgggtgcagtggctcacgcctgtaatcccagcactttgggaggccgaggcaggcggatcacgaggtcaggagatcgagaccatcctggctaacatggtgaaaccccgtctctactaaaaatacaaaaaattagccaggcgtagtgatgggcgcctgtagtcccagctactcaggaggctgaggcaggagaatggcgtgaacccaggaggcgaagcttgcagtgagctaagatcgcgccactgaactccagcctgggcgacagatcgagactctgtctcaaaaaaaaaaaaaaaaaaaagataataacagtctgcttggactagacttatgcttgtgcatagacatttttttcaattttcaattttgctcttttattgtggaataattttgggtatacaggaaagttacaaagatagtagggagaattctcgtgtgcccttcacctgactacctccactgtgggcaacttacatagccatgttgcattgatgaaaacagagaatcacattggcgcattcatgttaactaaactcctgaccttatttgggtttcactagttttccactaatatgttttctcggtttgaggatccttccaagagaccacattacatttagttatcaggtgtcttcagtgctccttggactgtgatagtgactcagtttttccttggttttaatgaacttgatatttttgaggagtcaaatatttttaattgtttacattttattaattattacttttacgaaaagtggattttctttctttctttctttctttctttctttctttctttctttctttctttctttctttctttcttctctgtctctctttctttctttctttcttggcctgtcttagtctgttcctgctgccatagaaaaataccacagatggagtaattcataaatgataaaagtttatttcttcatccatctccaaaagctaggaagtctgaagccaaggtgctggcagattcactgctctctctgcttccttgttgctgtgctctccagagaggatgaatgctgtgtcctcaattggtagaaggcacgggatgaccagccagctctctgaagtctctttataaaggcattaatcccattcacaaggatggagtcctcacgcctaatcatctcccaccatcactttgggatttaagttccaacatgaatttttggatggatgcatacattaaaaacttagcagccaccaatccaccatcctggaggctccaagagcttctcatgtgattccctcacgactgctgtgcacctgccaaattcaggatctgctcacctgtagctgcacggcccagggaggaagggaggatctattcctctctgccctcttcctaattccttggctgtccattctttccttccttccttccaccttctttctttccttccttccttccttccttccttccctccttccttccttccctccctccttccctccctccttccttccttccttccctccctccttccctccctccttccttccttccttccctccctccttccctccctccttccttccttccttccctccctccttccctccctccttccttccttccttcttttctcttccctccctccctgtcttccttcctcccttccttctttccctctctccctccctcccctccctctctctctttttctttttttctattacacaagtttatttaacaaaaagtctaatatgaaaatgtacatgacctaattttttcatcatagtaaaatgggctctttggagagaggacgtggatttctctgctgaacagccgttgtttatactcattccaaggcttctaacatttacttatttatttatttatttatttatttatttatttatttatttatttatttttgagacagagtttcactctgttgcccaggctggagtgcagtggcacgatcttggctcactgcaaactctgcctcctgggttcaagcgattctcctgcctcagcctcctgagtagctgggattacaggcgcccaccaccacgcccacctaatttttgtgttatcggtaaagacggggtttcaccatgttggccaggctggtctagaactcctgaccaccagttatctacctgccttggcctcccaaagtgctgggattacaggcatgagccaccacgcccggccaaggcttctaacatgatgatactctttccttgtattaccacctttccaatattgttctgttgcccactagttgccatctacatgcatccatctatcacaagattcataaagggctcaaatctctgcaatattccttgaacatgtctgccaccatttaacttcaatgataacttcttgtccataagttttttcaacttgagagggtgagctttgctcatggtgtctactccacaggctcacagatgccttggaacggaatctctttctttcttcttaggagatgggggtctccctatgttgcccatgctggcctcaaactcctaacctcaagcaatcctcctgcctcagcctcccaaagtgttgggattacaggtgtgagccatcacacctggcgcaaatcactttatttgagcaaagttaagtgttaacaagtgaagagccaaaagggggctgtttttcccccattcagagttttggcaatttggcaaaaagggggtatcaatttcttcaaaaccggggctaaaagactcagggagatcagagaatcccattttgagaagccattttcttcttagaagtaactgaggtgctgtacgtgtgtcaagagagaagtaggtggcagaaaaaagtgtgctttccacaagggagttttgccaccagaaggaaaagagaagatggattgcaggaaggaaaaaagggctctaggctgggtgcggtggctcatgactgtaatcccagcacttttggaggccgaagtgggtggatcacttgagctcaggagttcaagaccagcctggccaacatggcaaaaccctgtctctactaaaaatacaaaaaattagccgggcatggtagtgcaagcctgtaatcccagagacttgggaggctgaagaacaagaatcgcttgtacccgggaggtggagattgcagtgagctgagatcgtgccattgcacttcagcctggatgacagagcgagactctgtctcaaaaaaaaaaaaaaaggaagggctctccttgccccagggatggaggcccgatgcacctctctcttagcaagctgggtgtgggggaactacccagtaacctttttatttttattttattttattttttgaggagggacagagcttcagtaaacatccaggctggagtgcagtggtgtgatctcggctcactgcaccctttgcctcccgggttcaagccattctcctgcttcagcctcctgggtagctgggattacaggtgcctgccaccacccccagctaatttttgtatttttagtagagacggggtttcgccatgttggccagtctggtctcgaactcctgacctcaggtgatccaccttcctcagcctcccaaagtgctgggattccaggtgtgagccaccgtactcagccttcagtaaccttttttaaaatagctttatcaagatgagttcacatgccatgtaaggtatacaattcaatgtcttttattatattcacagggtcgtgcagctatcaccacaatctaattttagagcattttcacactcctggaagaaagcatgtgcattcacagtcattccccattcctttcccacctctagttcctgcatccatccatgtcacttctatttctatgaatttgcctattctggacattttatataaaggggaatcacgcagtatgtggccttttgtgcctggcttctttcactcagcatgaagtttctgaggttcatctgtgtgtagcatgtatcagtgctttgcagggttttttttgctgatcaatattctactgtatggacataccacattttattattaatgaccgactccatgaaaaggggaggagaaaaccagcagagctgtcatgtaaatgttgctatagcctggataaagtgaaagagaagacacagctgcctttttgaaaagactagagtgctatggagtgtaaacatctaaacatctgacagcagaaactactttttttttttttttggagacgaagtctcactctgttgcccaggttggagtgcaatggcatgatttcatctcactgcagcctctgcctcccaggttcaagcaattctccagcctcagcctcccaagaagctagaattacaggcactcattatcatgcctggctaatatgttttttttgtatttttaatagagacggggtttcaccatgttggccaggctggtctcaaactcctgaccccaagtgatctgcttgcgttggcctcccaaagtgctgggattacaggcatgagccactgcacctggcccaggaaccacatttctatgtattattctccttgtgtctgtctggccctgcctggtctccagccctgcagtcccctctgcgtggctaggactcctggatccccacctgctggcccggcattgctccattttaaggacatattttcaatgttgagtgtgaagagtgtatttaaaaaacactaccttattatctatttatctattttattaacagacccaaagcttacaacctcattgctttttaaatattattttgatatcctggaagataaccatagacgatctgttaaagaacaaaaaaggaatgctgttgttacagtaggtagctagtcagacatgaacagggcaggggaggcccccccgacttcccaccaggaatgtcaggcaaccatcaaccatctagtgatggtcaggtggttgttaaactgcctttctaaaataataattggtcacagccagtgccagggaaaggcagtctctcagtagatagaaaaaacctgaaactggtgatcagcagcttccagataagatctcaggcgttgggtgagtaggctcaagcatgcgcactaagaggcgaaatggcagagtttaattggtatatgaccttataggaacactcacgtggtaaaggaagaatagctcaagggagcgtgcgtacaacttcagtaaacacactgtgcatggggcccctcccaagtgctggacggccaccgtgcatgcggacagcctaccccaagggaagaatccggggaaaagggacagacgccaagaccccagaagcatgccaacgtataaaaccccaagtcaaaggtcaaagagtgcacttgcctttcaggtcgcctgcttggccctcttccaaatgtagtttacttccttttattcctgctctaaagcttttaaataaacttctagtcctgctctaaaacttgcctcaatctctcctttggccttatggcccttagtagaattcttccttctgaggaggcaagaattgaggttgctgcagacacataaggattcgccgccagtaacactgtgatcaaatatgtttgggaaatgacttatggcccctttttggagatatcaaaattcatctgagtatacaaatgccttggcaaaaacatcagtaaagtatctggtgagctttgcttagcccagcgcacccaagctacccctcaccctccccagcgagcatggtggtccacggaagagtgggaaatgcctccttccagacaatgtgctaggactctgcccccttgccactggtccaacccgaccatgcatccagctgtgatttctgggcttctgccctattgctggggccaaggccaggtctcagttctggagacggccgtgcctttttctccgtcactttgctctcaccccagggaccgcagcctgtcctgaaaactgggcacagtgatggggctctgttattttctgttcatttctctgttgttctctgcatccctacccactttgttgaataggtctcttcatagattgcttgtcatctctggggacactccagtttcttaactcttgagcatcgtgacatcctgttcttctgcctggatgatccacagctgaactcatacggctcccaccttctgtagctgctgtccactccattcctgtctcacctcaggtcttgatgcagtccccagtcttccttgtcccatggttgtctactgaggccaaggtgctgtgtgagaaacacagcagtgccactcaggaatgtcttgcgcaaggtggatgtccaagactctgctgctgaagttgtagcaggcagcatccatgtgttcatcctcccgcattgtttcttcattttattttatttttcgagatggagtttcgctcttattgcccaggctggagtgtaatggcacggtcttggctcaccacaacctccacctcccaggttcaagtgattctcctgcctcagcctcctgagtagctgggaatataggcatgtgccatcacgcctgggtaatttttgtatttttagtagagtggggggtttcatcatgttggccaggctggtctgaactcctgacctcacatgatctacctgcctcggcctcccaaagtgctgggattataggagtgagccaccgtgcccagcctctcccacattatttcattctgtaccatgttgttgctgaaggagcatgagctctagtgccaggcagactcacgtttccatcggggctctgggacttactagctatgtggcctgcggtaggacataaatttttctgagtttcagtttcttcatctgtaaagaaaaatgggtgtgaatacacttacctctcccagttgttgtatggattgatttagaaggtgtagacagcttcactgttcacaagattcatgtgattctggtatgagtagtttccaaatattctgagagacacaggagtaaataatggattcaaaagtccctagcctgggattttttaatgttatgagttaatatttgaaaatcactaacaaaaaggtctggaataaaagccatgttagtgttatgtaaatgttgtttaaaaaaggaagttccctttcttcttccttctatatagtaaggatcttgagctattgactgaggtttcaaagtgaagaaatgggaaaaaccatttatatggggttgctagtcacaccaggagttgggggcaatgcccaccttggttggattctactgtggtaacaatggaccccacaagacagccagaacttcaaacagcatggaagaggtggtcactgtgctagctgagaagtgaaacttcattgcgcttttgaagaaattctgtcaccgaaacgaaagaaaaactaagtggatagcaagtagagttctgcttctcaaagcgtgtagtgattcccctcccacccacgtagaataaccacatctcaagcactttcttaaagatccctgactgtctgactagaatatcctccttgtccactcaatgttttttttttgaaacagagtctttctctgttgcccaggctggagtgcagtggtatgatcttggctcactgcaacctcccatgttcaagcgattttcctgcctcagcttccccagtagctgggattacaggtgcccgccgccatatctggctgattttggtatttttagtagagatggggtttcaccatgttggccaggctagtcttgaacttttgacttcaagtgatccacccatctcagcctcccaaagtgctgggatcacagacgtgagccaccgcaccgggcctgtccactcagctttaatcctagcatcgagaccttttctgttatctcattttttgtcccctatttcactttcccagatccatataacaccagtgagaaataaccccaaatacctagggagaagtgtgatctcactgtgttcactttttcccgaacatgagctccacgattgtttccaaacagtaaaagcagtttctcctttttatctcttctggtaaagctgcagttgggaagcagagaggtttggcagagttgatgggacctttggggtggtttgtttcctattggaaagaaaatgagggtaggaagctgctgaacaaagagtctctgccttgcctttgcagggctgctgaccctcataatgggcagaagctactgccagcctgctgcatagagctgtctttgcagatttaatactttagtgaggggctaggggcctactgctgagcccaggatatagtcagttactaaaccttgcgtcatgaagccagctggcaaatctttagttttgttctggttagatgtgaccatgactttggtttttatttacttctctcttttgtataactataaatatttttagactgggtgctacacagttaagtctgtatatatgatttgcattatccagtttaggcccaaagtcaggaaaattgctgccatgcaagatgagttgacatgttcctgtttttgtggctaagaagctttggtatatagaattagaaaaatgctctcaatagcaaagacttggaaccaacccaaatgtccatcaatgatagactggattaagaaaatgtggcacatatataccatggaatactatgcagctataaaaaaggatgagttcatgtcctttgcagggacatggatgaagctggaaaccatcattctcagcaaactatcacaagggcagaaaacaaaacaccgcatgttctcactcataggtgggaattgaacaatgagatcatttggacacagggcagggaacattgatcactggggcctgttggggggtggggggctgggggagggatagcattaaaaaaaaaaaaagaaaaatgctgattcaagtaagaaaagaatgtgtgtatgtcttggagttggtgatagagaatgatttggaggaaaaaaccctcttgattttgcaactaactagttttaagactttgatgaaatttgtgggtgtttggtggacttgtttgttgaattggatgagttcacttatagccctgaaatctgactgtggattcaaacatttcattcccttttctctgaatcattttacatgtctaacttgaagctctgaattgataaacatagatgacaggaataaaatggttctacatttttcatatttctcaataggtttgggtttcccttttgggaatttttttcaaaagagaactgattggctctggtcccagtatcaggaaactacctgctcagtcaggcagagaatgaaaggcttgagataaagggcctgggaacagtttatcagtcagactttcaaaagaggagtaatcaagtagtgtaggaaaagcacagcataactgtctgaacaaggataaaggaaagaagtggggaagtgccacagctgggaaattagctgtggtgctcaaataaccgggatcctggaattctgaccataggaaagcactgagggaaatttggagcctcttttgttacaaaaaagaccctggactgttgaaattcctttgtgtagtaggctcagggaaatacattgaaaagaagaaacacagtttgtttgtttgtttgtttgtttttagagcaaatctgaggatttgcagaggtgctccgaggtagccattcttcaactttttggagttgtggactccttgagggctgggatgaaaactatggcctacttcccaagaaaaatatagctatacatataaagccaaacacaatttctggggctgggtaaacatcttgaagaccacccacggcagtgcctagggatccaaacaatttgaagttaataattcttcagtttgaagtattgtagcaaactgctgtaagtgataagtaattatgaagcaaggagtataaggaaatgcttcatggaagacagagttacctccagcaatgccatggaagacttggaaaagttatagggcaacagacagaagcaaggtcacaaggctagaagtcaaaggaaaacactgtagaagaagctcgggttttggaagaaggtagttcagtgttgaatttctgattccactagagtctagccatgtgaacctgggcaagggtgcttacccaggtttggaatccagtgattccagggcagccatcaactttctccttttatggccagtatggaagaagcgggtgatggagcagaagcagcgtggaatgtgggtctggatttatctggtttcaaatctcagctccgacattacaagttttgggtgaccttaggcaagttattcaattgtccaagtctcttatctctaagataggtatagaaataggtacccaaagaatgattagtacataaataacatgttatagagagaactttcaataatcgataggctttattatgagaaaggaggcttatttaactcaacagaaggtacattttgggagaaagtggcagatctatgaagaaattaatgccaaattataactatcaaagagctataaagctctgtccatttttgggtaaattttactcatttaatatttttgtgtgtcttcctatgtaacttcatacttaagatgttagaatttcttttgataggtaatgggtgaagaatgggaataataggcatggtctgcattttaggggattctttggatattagagcagcaagaataattgtttgggcaggataatttctgggttgctagactctgccaatggttagtgatatacctttgcataggtcacttaagttttgtggacttcagttttcttatatatttaaggagaaaacttcctttttgtgttttatgattctgtgatcctgaggttctattgtagccagaataaggctgagatattctgtgatctagttttttaaaaaaattatttgtgtattttctgcagaggtgggggtcttactatgttgcccaggctggtcttgaactcctggcctcaagcaatcctcccgcctcagcctcccaaaggtctgggattacaggtgtgagccaccatgcctggtataatttagtcttgttcaacatgacatcaagcaatctactagtctaagcacaaagttctcaaaaataaacttcaacttactgtaggatttcttgcaaaggtaagaaatcctctacaagttttttccatagagcatcatttagcaaaaaatttcaaactattccctttaaacatttttcctttctttaaaatttcaaactcatggttactacccccccgaaaaagaaatctcatcacctcactctgttcatgtaatttccccatcattactcttctttcctatttattacttctcctcaggtctagttcctaaaaaaggatcttgcctgtgtcaaaaacagccccctggggaagttggactggtctgtcaacccctttttctcccctggggaccaaccaattagaacaatggagaacaatttttgtgatgttatcatcctattattctttgattctgtggctgcagtgaggacgctgcttcagaaaactactatattaatacagactttgagctctgagacctgagaccaggacagccaatgtgggagagaaggaaatgagttggaggcaaagtgtaaaaagaattagtgacaaacagatagggcaaatgagggtaggagtaatcaaacgtgacttcacatggttcgtccatcttccacacatccttgaacttttcagcaccgtctgtcaggtgctaaatggacaaggacaggacaatacaggtgattatgcggtgtgaaaaacaaagcccaatgggagttcaaagtagagaactatttcatccaattatgggaacttccttgaaaaagtagcctttgaattagacattgaatgacatgtagaatatgaccacctaacaagagtgatggttggagctactccaggggcaagggaaaacacattagggaaagatcttagatatttttattatggtgagtgagagataagaccagaagagattttctattttcccaggacttcttggaatgacggaattgcacaggagaagtgtggatagaattccaccaagtgagttccctctcatgttctgaggggcttctccaagcctgcagatgtgtatgctgaatgttccctaggctagtcaccttgacagtggtgagggtctgaagacctggatctaagaaggcctcgtgtgtccccagagacagacacacaatcagttcctttcccctctactcttggctttgtcttctgtctgaggccgatatgtgtttagcattcactttcccaaacaatgtctttccgccctcctcattttccgaatcttcatttgggaatcatgctaacttttctcccgcatcctgaatccccgtttgagtttctctgtttgtgtcacactcatgggcttggcgaaggggatcagatggctcttgtgtgatcatgctaggcggctgttagttagtcactcctgggaactggatttggttcaagtttattcagtgggacttaatgctgacagactactttctactctaaagtcaagtctcttcctgatgtacaggaaatgataaatagttcacgacaaaaagtaagactaagaagtcagcaatcatcacactgcaagagttgagggtgaggagggagttggggtagtccctgccagaactccaggccaaatggcttgcatgccaggtaaacttttgtaggatgctggcatgcacattgtgggtggattgcaaatttttttgaatgatgaaatagaagcagggtgtttgtgtttttttttttttttttttttttttggcatcacatacaagaaatgtctacaggtgccaagagataatcttatcatatctaggaagtttttgtttgtttatttatttacttaggacattgttctccctcttccatttctagaatatattttctctccttagtcaaagaaaccctagttgctgtttatgattcagacgagtcttgagagaatagaaggaaagaagagaacaacttcatttcttcttctgtgtaaaatgtcctgtgtcaaattcccatactctaacactttatttgtagtatcttcataattcaccaacttctttaaaggaagagaatagtttttaatatatctttgtttctctgagaatattccattagagtgagtgttcactgctaggttgttggttacctgaataatgtctcctttaataacataaaatgtggaacacagaatttagaaccgtattttcctctttatatttatttttcttctccttattctcctcctccccttcctcctcctcctctctttctctttctctctctctctactactgagttcagatctcatttctgtcacttacttcctgtgactctgggcaagttacttcattttactttgtagcagattcctcacttgttaaatgggaattataatagtcattgtgacatatacaatagagaatatacatgatgatacttctattattattgtaatgattaaacaaattaatatacataaaatacacataaaagtgcctgccagtaagttgctacataaatgcttgctgttgtgactttctcatgaatttttgttttgtctttctaactaaatcataagctgctcaatcacaagactatttctcttatgtctgtgtcttgaccatattgcttagtgcagtagaaatggtatcatcaataatagtttgcgtctgagtcatactttacattgtacagggtactttcacttggattacctcaccaatcctcccaatcatacttggatacatgcttattcccactttttaaatgcagaaactgaggctaaaattttgtttgatcagggccacacggctagtgtgtgacccagatgaccctagaacttagtctttctggtttctggtcttacgttatttcctccaggcaaatctgaccatctgaccacacggcagatgttcaacaaatgcttctgtgtgtttatgtgtttctctaagatgcatctttcacattctatagagtaattggcatggtaactttgagtggtcatttcttatttatacattttggtatagttaaaattcctgaaataagggattcctgtacttataatgtgttttattgctataaattataggaaacatcacattcagtcttttcctcctttcctcccctccttcactgaaagttctcattagtgttagcttcccagtttctcaaagtaattccctgcattcttgtacttaatctctttcctcttctccttctccttctccttcttcatcttcttcttttttttttttttgacagagtctcgctttgtcacccaggctggagtgcagtggtgcgatctcggctcattacaacctctgcctcccaggttcaagcgattctcctgcctcagctttctcaagtagctggaactacaggcttgcaccaccacgcccagccaattttcgtatttttagtagagatgaggtttcactatgttggccaggctggtcttgaactcctgacctccagtgatcctcccatctcggcctcccaaaatgccagattacaggcatgagacactgcacctggccctagtatcttacttctgttatgtgttgtggaggtcggacttctttggagttggagggatgaagaaacttgtgtctgaatgattttcttagctgccttcatgctgaaacaaaagctttctcatttgtaatggcattttagccatatgcgttcatgctacctacttattctaaactcccaaaatttgtggaagaacttgctaatgtcttttctattagaggtacagtttgaaagtaaacacatacatttttatcaataagtaaaagggtcaacatttttctagagctggttaagtaaaattctactcatgtacactaacatttggcacagaaagcagggaaggacaaaaggaagcagaaagaggggaaaatatcatataccatatttcatatgtaaaaactaatggcctattgaaaagaaataagaaaagcatgtgggaagggagagaagacagaaaagagggaggaggaaggcgagaaaaaaaaaagcttaaatccccaaagaaagcagaagtgatattaaaataaaataaatacagagtaagagaaatgaatgaaggagaactatataaaggtgcttcatgtgctacccaggctccacggtgttgtgagttacctgctttcattactgaaatcatctttttaaaagtgattctgggctgggtgtggtggctcacactgtaatcccagcactttgggaggtcgaggtgggaggattacctgaggccaagagtttgagaccagcctggccaacgtggtgaaaccacacctctattgaaaatacaaaaattagccgggtgtggtggcatgtgcctatagtcccagctactcaggaggctgaggcaggagaatggctggaccccgggaggcagaagttgtagtgagccaagatcatgccactgcactctagcctgggcaacagaaaaagcctccgtccaaaaaaaaaaaagggattctgaatttctattcctgagtaacacatagttttagggtggaaaagtctctagtgactttcatggtaagatactcattttcttagaatcatagctttccttaacatttatttatttattcattttttttttaattttaattttttttttgagatggagtcttgctctgtcgcccaggctggagtgcagtggcacaaactcggctcactgcaagctccgcctcccaggttcacgccattctcctgtctcagcctcccgagtagctgggactacaggcacccgccaccacgccctgctaacttttgtatttttagtagagacagggtttcaccgtgttagccaggatggtctcgatctcctgaccttgtgatccacccgcctcggcctcccaaagtgctgggattacaggtgtgagccactgcacccagcttatttattcatgtatttatcagagatggggtctcactcagccacccaggctggagtatcctaatcctagctcactgcagcctcgaaattctggtctcaagtattcctcctgcctcagccttttgaatagttgggactacacatgtgtgtcaccatgcccagctaaatttttatttttatttatttatttttgagatggagtctcactctgttgctcaggctggagtgcagtggcatgatctcggttcactgcaacccctgcttcctgggttcaagcaattctcctgcctcagcctcccaagtagctgggattacaggtgtgtgccaccatgcctggttaatttttgtatttttagtagagatggagtttcaccatgttggccaggctggtctctaattcctggcctcaggtgatcctcccacctcagcctcccaaagtggtaggattataggcatgagccactgtgcccaacctattttaattttgttttgtagagatggagtcttcttatgttgcccaggctgatctcaaactcctgagctcaagtgatcctgctttggcctcctaaagtactgggattgtagatgtgagccactgcaccaggccttaactttttttccttcagtggtcctgttcatccctcagcttaggtaacaattatcacctgcatttgactcatctctgggagcaggttctttcctggaaggcttactctgtatgacacagatgtttaaaaggggttgacagtcttcatttgtctctaccaagggagatcggtgtccctcagaaagggcaggagtctctcagaagatgcttatactcagtcatcatggaaggtgtatcctattggttggctttcaaaaaatttcagactttttctggagatattatactgatttttgtgccagttgaaatcacattttattcttattcatctaccatcactcactcaagctcccttacatgtggccagcttggaaagatccgcacgacagaggcaaatcagtaagtcaactcagtaatggatccaaagctttgggcttattagtgtcattccctggttagctactacgtcaccctacctagttctacaacagttgaaacatctttcgcatcaagccaatgattcatttactctttctgatgtgccgtagagactccaagcagattggtgccttttggcctgggctggcagtcatgatggagcattccagttgctcatctgcttctagggttgggttcactcctaatgggcacctgtaagccctaaagaaatgggccataaatggtaatgtatgtagctggaagtgacatgatagcttagggtttgcctagcttctgctgtgagaagaaaggctgactaagatggcatgatgtaacgcaatcatgaaacagaacaaggttcaaagtggatgattgtttacggtcagaccatgatgaaaggcaataaaatgtttataaaaccactggttaaactgttgttataaactgattaaaatcatcaggctagaatactgtaagaggttatagtcatttcttcttactgagtggaaatgaagctgctaattagtaagatctgtaaaagaattcttttataatattgaatcatacgatattactttccaatgttatttttatagcattgaatcatataatattacttcccaaaaagagtccaggaagtaactaattgcatacttctaattatctaatggagatactaagacccagagaacgcaagaacttgcccaaccaacacagtgagttattggtatggttaattagtgattctttagctttcatgagatgaagtaatttgtgtttctcaaactgttttatggacatatttttctaacataaaataacttcacagttaaattctctaaaagcttaaaagtttacttgccatgtaaattgtttccaattagctttcatctattttatcctgtaaatcccaatacaaggtataatatattattgatgtcttcctggcagagttatgtttcttctagggccatctgcaaagttaggagggcagtgaaaattttgtaaggctcactgtaatattttcatgagagactggtatgaagtattctaagaaataatgtctttcttggccaggcacggtggctcatgcctgtaatcccagcactttgggaggccaaggtgggcggatcacctgaggtcaggagttcgagaccagcctgaccaccatggagaaaccccatctctactaaaaatacaaaattagccaggcgtggtggcgcatgcttgtaatcacagctactcaggaggctgaggcaggagaattgcttgaacccgggaggcagaggttgcattgagctgagatcgccccattgcattccagcctgggcagcaacagactctgtctaaaaaaaaaaaagaaataaggtctttctttctcttcgtggcaatttttactataaagtattaaagctataaataaaagtaactctgtaaaattatatttcttgtttctttttcttattttctttgagacaggttctcactctgttgcccatgttggaatcctggagtgcagtggcatgatcttggctcactgcaacctctgcctcccaggctcaagccatcttcctacctcagcctcctgagttgtcgggactaacagcatgtgccaccatgcctggttgttatttttgcgtttttgtagagatagagtcttgccatgttggccaggttggtcttaaactccttggctcaagccatctggctacctcggcctcccaaagtgctgggattacaggcgtgagccaccaagcccagcctaacgttacatttctttctttctttttctttccttttttttttttttgagacagactctcactctgctgcccaggctggagtgcagtggcatgatcttgtctcactacaacctctgtctcccaggttcaagcaattctcgtgcctcagcctccccagtagctaggattacaggcacccaccaccacccccagctaactttttatattattagtagagacagggtttcaccatgttggctgggctggtcttgaactcctgacctgaagtgatccaccctcctcaggcttccaaagtgctgggattacaggcatgagccatggtgcccggctatatttctaagtttattttgcttcatataccaggaaccgtagtttgtttcacatgtggtcttgaaaatagtttgttctgttctgattataagtaacatgtgtttattgcttttttttaaaaaagggtaaatatccaggtgcagtggcatgtgcttgtagtcccagctactcaggaggctgaggccggaggaagcttttgagcccaggcatttgagactgtagtgagctgtgattgttccactgcattctaacctgggtgatagagcaagaccctgtctcaaaaataaaatacaattaaattaaatttaaaaattaaaaaattgataaatatagaaaaaatgtgaaaaccaaaggggaacgcctcccactaccagagatcatttctattttcattctggagaatttccttctagtttttttttaaaacgcataaatatgggaaatacacaattatgggaaatatacaacttcccataatgagttaacacaccatttacgattttgtgtcctgctagtctgtcattatgtcattagcgtttatcccttgcataaaatgcttctcagattactaaatggcaacatactataatattgaactttgtggatatccaacaatgattttaatcactattctcttactatttgtgtattttttgtttcctttcctattttaattatgatgcagtgaatagttctgtatgtaatttttgcacgcatttctgattatgttcatagtaaatatacattgtcttaaacaaatggttaggcttagattttcctggaataactctggagccatatacaaatgggcagctggacctttttctatagaactgtaaaagacttaaacccacataaaactggagtatttacacatcacaccttagaacttggaatatgtcaacatgctagcctattagttaacgccattcataacgaccacttggaaattcttggctctaacctgaagctacgtgctatgaaggaacgcaggcctcggtctccagtttgtgccttaactgatcagcattccttagtaaattgttctctgcgtagtccgatgattactatagctgccttcttcatatcaattgtgagacacatgcaggggaattttcagatttacgatagagagctaccaatatttcatcatcagcaccacaactgtcatacatattaaaaacctttgatctattaagtaaatatgctcggcacccagaggctcctttggaaagtacgggagtggtagggactgccctccccatttccattggttctcttcttccagttcttcgatttccctggcaaaatatttactttaagagctcagggtgtggcatactcactttacaacggcatgtgttctttgtgccaggaaaaaataaaaagtcccttgtggttagtgaagtagaggtgaggacataatcacaatagccgatagcgctgaggctcttgtcacattttagactcatatttatgagaagaagatgtagttgcttccataatatcctaagtaaattcatctctatctgatctttgtgaaaggtgcagggaaatgggtttactcgatcagagagttctggaaggttgttttgcaatctctctctttttttgagacggagtctcactctgtcagctaggctgaagtgcaatggtgcaatcttggttcactgcaacctctgcctcccaagttcaaggattctcctgcctcagcctccctagtagctgggattccaggcgcacaccaccacaccaggctaatttttgcatttttagtagagacggtgtttcaccatgttggccacgctggtctcaaactcctgatctcaggtgatctgcctgccttggcctcccaaagtgctgggattgcaggtgtgagccacacacctggcctacaatctcaaaactattaaatatacacatattttttgaccccaacatttcatttcttgaagttatcttaagaaagtaattaggaatatgtacaaagattcatccatagactgttcttcatagtactatttataataattgaaaaattagaaacaacctggggaattcaaccatgaataaccatacaattgaaaactgtacaactgttttaaatgatggcataggaagtcattttttaaaagatgaacagatgactgtattcatatccttaaatgaaaaggctaggttaataaaatgtactctaagattcaatttatgttaaatatatgaacagaaatgagtctagaagttattaaaaaattagcactgtaattctctagatggtgagtctatgactaatctttgtgttcctcttttaacttatttatatattttattttttcaacagagtatgtatcatggtaatattttttgaagcacagaaaaagatttaaaactctgttctttctgtattgtgcctcaaagactttcttccaccttcaagagaagacaaaacaatagaagatttatgtacttagattgacatgcacattttgtctttgcgataaagtctctttgcaaggaaaagaccaaacaccaaacattacattaaaaccactacaaaaaattgggagcagatatgattctagagttacaaatatgctgccttcatgacatcattcttcccatctcaaaacagtcatcccactctcctcaatgtagtgcagttagcctcagaatctcaaccaaaacctttcatcaaagatcggcatccatttgccatctcaggaaattatcatactaaaatcaattagaaatctggtaaagagaggccgggcgcagtgactcacgtctgtaatcccagcactttgggaggccgaggtgggcagatcacctgaggtcaggagttcgagaccagcgtggccaacatggtgaaaccccatctctacgaaaaatgcaaaaaattagccgggcatggaggtgcgtgtctgtaaccccagctactccagaggctgaggcaggagaattgcttgaacccggggggcggaggttgcagtgagcagagatcatgtcactgcacttcagcctgggagacagagtgagactctgtctcaaaaaaaagaaaaaaaaaaaaaaagaaaagaaagaaagaaagaaaactggtgaagagcatctgttgcatttttcatgaaatattattataaaaaaaattcttctaaaccaagaagcatagcgtttccctttaagaaaaatgctatgaatgcgttagaatatttaaacaaaaaagcacaatttattttattgtggagaattctacataacatgttggaaatacagaaaatcaatacttttttcctttttttttttttttttgagacgaagtctcgagtctcactctgttgcccaggctggagtgcagtggtgcgatctcggctcactgcaacctctgcctcctgcgttcaaaggattctctcgcctcagtctcccaacaggcacatgccaccacgcctggctaatttttgtatttttagtagagatgaggtttcactatgttggccaagcttgtctcgaactcttatccctcaaatgatccacctgcctcggcttcccaaaatgctgggattatacccgtgagccactgtgtccagcctaaatcaatactgttttaaagtacaataaatcagtgtacctgtgttacagtgtacaccccgatatcttctcatggtgacaccatgcacacatacacagacattcagcatgaacactgagtattttggtatgttctatagtatttaccatgtttcttaggggagttttaatttcttgatgttttgtttagcatttaattcctccctcaacctggatttcaaggcacagatcttggttgaaccaacagggcttgaggcattctactaccaattgagcaaagaaaggcaaagttggtttgataatactaaaatttgaaaagcttatatttcctaaaagacttgaagatttaaaaaatcagtcatgtgggcctataaagttgtttcaatggagttgattctttactgtaaggacaattcaatcatggaaagctgataggcttggttatgcaaattatcgtgaagtggtaaggaagactcactggcttcaaaagttaaaagggaaattcctactaaaacctttgaaccctcatgtacattgataagtagaattgcctttagcatggtgaaaggttccttgaaaagcagccaagtccccacttccttatccagtaatggaagcaataatctgcaataatcagaaatgatctgctttattttatactatctaataacaacaaactttttgatcacaaatacgttgagcctgaaaatcaaaataaaagaaagacgaagaagttgcattcaaaagtattttgaaataacatggcttactttcctatgtgtaggagaaattttgtgttttatatctatctgtatgttttatatctatgtatgctctctgtaggatagcatatcgtctcctgtgttttttgtggtttatatttttgtagatatgtcatacttcattcttgacatggggaaggaattaagcaatgactcttttatatcttggaaaaactgggatttcaaaaaatagttttgaactatgtaaaacactttcaccttgaaggttcattattgttttttctttctttctttttctaagtaataaacaatgtgatgctaacggtgaagattctgttacttatattaaaggaaaaacaggtcaacaaaaccatttgccccacttacattgaaggtcatgttttgttagtttgtttgatttttagctgaatgaagtataatgtaatgtttaaaaaagtggctgagtggtctctaaaatgattttatttgagttcctaccaaatattgcgtctagtttcaaaattgtgcctagtttcagctgtatttgagctatgactttcagaattaaggcgagataggcttctgtaggggagagaaatctctccatttgcacgtctattgggcattatagacatgacatgccttaaaccaagattctattattcccccaataatctactccttcttaagtgctttctgcctgattaaactgtacaaccatccccttattatttaagccaaaacatttagagttattcctaattttctttttctttcatagtcaatatccaattaatataaaatgactgtcattttaaactttattttattttatttttctgagatggagtcttgctttgttgccaggctagagtacagtggcacgatctcggctcaatgcaacctccacctcccgggttcaagcaattctcctgcctcagcctcctgagtgattgggattacaggcatgcgccaccacgcctggctgatttttgtaattttagtagagatggggtttcaccactttgtccaggctggtcttgaactcctggcctcaagtgatccggcagccttggcctccgaaagtgctggaattacagatatgagccactgcagcctgcctttttctctccgctttggatgctctttctccagatgtctgcacggctccatcccttacttcatacaggtccctggtcgatgttttctccatagagaggttttcctgatcactttatctcagatgacacccgtggacactctcttcccattatcctgcttaatttggcttcataacacttccaccacatgatattaacttacttatatgttaattagttagtttcttgtgtgtttcttctactctttctcattctctctttctttctctctctctctctctctgatttgttactttgtcgtcaaccaatgggcactcgtctactaataatctaagttgtatgacggtagagactgttttacttagcactttattcttcgtgacatgaacagtctctaacataaactaggtgcattccagcctggcccacgtggtgaaaccccgtctctactaaaaatacaaaaattagcctgtgtggtggcatgcaactgtaatcccagttcctcaggatgctgaggcaggagaattgcttgaacctgggaggcggaagttgcagtgagggaggtcatgctattgcactccagcctgggcgacagagtgagataccgtcaaaaaaaaaaaaaaaaaaaaattaggtgcacaatggatctttattgaatgaatgagtgaatttctatccttcctcttcagtgaacagtagggttcatgtaaatgagtcgttatttgagtgataatagttcatgtcctttttcctccctgaccatagtttgtactttgtgtgtatagttgtgtgtgaatgtatgcatgtaaatgttctaacattgaagactaagcagagattattttccatagcagaaaagaagtggccctagcagtttcataaatcagaattcaatttagggttctatgtgaaaagttaatttcatcccatggcagcacagtggaaaaaaacaatttctacatgtctgcaaaaaacgtttttattttcccaagatcaaaaacaagcactgacaggctgggtgctgtggctcacacctgtaatgccctcactttaggaggctgagttgggaggattgcttgaagccaggagttgaagaccaacttggccaaggtagccaggccccatcacttaaaaacaacaacaacaacaaccagtgttaatggtctacctgctgggccctccaaaaacttagggacattatctgatgtacctgtgttttcacagtatttactattaaatgaaggtaaagagtggcttctggttggttaaaaaacagttgagaaggagatattgaaggttgtcaatgggtaataaaacctggttttaatactatcctgggaccctctggtggaggcaaggaaggattcctgtggtctctctgcagatgttttgctaaatgaaaccctgcaacctggaacttcaaaagtatctcaagactgggcgcaatggcttatgcctgtaatcctaacactttgagaggctgaggccaggggattgcttgaggctgggagttcgaaaccagcgtgggcaatacagtgaaaccccgtctctactaaaaatgcaaaaattagccaggggtggtggtgtgtgcttgtagtcccagctactggggaggctgacaagatcacttgcacccaagaggtggaagttgcagtgagccaagatcacaccactgcactccagcctgggcgacagattgagacgctatctcaacaacaacaacaacaaaaaaggtatctcagattatgtagtctcagatggtatagcgatgggagcgatggttaaggaaaaaattttcagcagcccttcggctgtcaacaagtataaacagtcaggcaagaaacaaacaaaaaaacaaaaacaaaaaaacaaacacacattaacaaaaccattcaagaggtggccttcagcaaaattagcagactccaatgtagaaaaccaggtcatttggggtgtgtctggaggacagagaaagaagcccagcattgcaatggaggtgatgagagctataactgttctgtttctggataagcccaccactggcttagatgttagcacatcaaatgcacttcttctcctgaagatgacaaggcagagaaggcccatcctcttctccattccttagccctgttaggccatcttcaaaccttttgatagccttaccttgctggcttctggaagggtgatgttccatgggtcctgtataaaaaactttgaaatattttgctctgcgagttaccagtgtaaatcctataaaaactctgctgatttcttcacacatgttaatagaggctcctctgctgtgaccttaaataggaagcaaggaggtgagaaacctggggaacttgaaaagcctcccaaacaggataaacaatgaatagaggaattagctgaattttatgtcaattgttctttctacagggaaacgaaatatgaatgtaatgaactctcagtaggtgaaaaaaggagtgaactttctttgatcatcaactcaggtgggtgtccaaatgtttattcaaaaattggtttggtgagcatcaagactccattcctgaaataagagccccagttatcagactggggcatccaggttctttactgtggtttaaacaatagccctgcaggaatttataatagaggtggcttcctgttctatttgtcctgcaaccaatgcctgaacaatgtctcagtggtatttcttctggttcttgaaaaaaagcagtctgtgcatgagtctaccagtggctattttagagtatcatcgtatttctttggaaagctgatatctgacctactccctgtgagaattttataaagtgtgatataatgagtgcattgcatcttatgttaagaccgaagctgaaggtggaatctttctttctttctttctttctttctttctttcttttttttttttttttgagatggagtctctccgtgtctcccaggctggagtgcagtggcgcgatcttggctcactgcaagctccctctcccgggttcacgccatttgcctgcctcagcctcccgagtagctgggactacaggcgccctccaccacgcccggctaattttttgtatttttagtagaaatggggtttcaccatgttagccaggatggtctcgatctcctgacctcgtgatccacctgccttgcctcccaaagtattgggattacaggcgtgagccactgcgtccggcggcatctttcttttttaagatgcctcccggccgggcgagatggctcacgcctataaccccagcactttgggaggcaaggcaggcggatcacgaggtcaggagatcgagaccatcctggctaacatggtgaaaccccgtctctactaaaaatacaaaaaattagccaggcatggtggcgggcgcctgcagtcccagctacctggaagactgaggcaggagaatggcgtgaacctgggagacggagcttgcagtgagccaagattgcgccactgctctccagcctgggcgacagagcaagactctatctcaaaaaaaaaaaaaaaaaaaaaagatgtctcactcgtaaggcttgcactgacctccagtgccttggctctggctctcgctgcaggtcagagtgacccccttgggctacccttctcttgactttccctttagctgatgaaaattatttcagccctctgcgtgaatctcagaaccagtaggccttggttttcctggatccagtatataagcattcctcaatacaaccatagaggcttgcaacataatgactttatggaccaaagctttagactcggaatacatgggctacacacacacaaaaccaaggcctgtggatatgccatgtgttctggggaagactttttacaaaaccaaagaattgagttgtcctcttggggtctatgaaggagtcatctggccttggcatgtgtgatggtgattttcttaattgcctactaatatggtttggctgttcccccacccaaatctcatcttgaattgtagctcccataattcccacgtgttgtgggagggaactgcttggaggtaattgaatcatgggggtcggtctctctcatgatagtgaataagtctcatgaaatctagtggttttataaaggggagttctcctgcacacgctctcttgcctgcctccacgtaagacgtgcctttgcttttcctttgccttctgccatgattgtgaggcctccctagctacgtggaactgtcagtccactaaaccactttcctttatacattacccagtctcgggtatgtctttattagcagtatgagagcagacaaatacacctacctaaaattaagcattcatacgctgtgtgtagcagatatctctggaaccccatataccatgctttcaatcccctcttcaatttcagccccagctgtagtgtacagtttccagtgagctcagaccacctggcactgacgatgactcactgaagcctgctctgcctgctttctgctctggggcattctctgaactgaggggatgttgggcctctcccctcctctaagcacagcttaaaaatagagaaggatcagtgtcctggggaccatcttcaacgaatgagaaatgtgagccagctgatgaataatctctcttctccttcaagtggagaattctggaagacatttgcttctttctcaggaggttctagtggaatcaatttcccattgcccacgaatgaccttccaaacctttcctccctccatttgcccgcctgttcctggcttctgagagtaactcacaaataaattatctgcatctgaggctctactttcaagggaacccaagctaagatgctgagaaacaagatgcttgatttgttttaaggagtcactgtggaatttgtagtggtgctagcctccattaaagttgtggtttattctttttttttagtgaagctctgtaatacctcagtatatgatgaagcctgtatggaaactattgtagcaggatgagccacagacgaaactcctcagacaccggattaaagaaggaagtggtttattcggcccggagcgtcagcagactcgcgtctttaagagccgagctccccgaaaaagaaattcttggcctttttaaaggcttacaactttaaggggaccacgtgaaagggtcgtgataaatcgagcaagcgcggggaacgtgactgggggctacattcatcagctaactgaacaggaagttttgcaatgctttttcatacagtgcctggaatttacaggtaacacaagtagtttaggtcaggagttgatgtcattattattacttttttttttaactcctagggccgggtggtggtgccaaggttgtctggctatttatcttacttctgtttctttcccactttttgctttctcactttcctcctgtcttgtgaactaggcaaggtgaggaaaagagggcagcaggagtaatagtggtctccttccttactatggcttctattactgtctgaaagaaactaaagtgtgggctaatggtatgtactatgatccatttgataattgatatcaactttgaggaggaaatgaggaagattatattgacctagggaaggggggtctgatttctatttccagcttcagtctttatagtttgacactggcaaagtccaatgtctctctggcttcagtgtcttcatctttctttcttttcctctttttttttttttttttttcaagacagattcgctcttgttgcccaggctggagtgcaatggcatgatctcggctcaccgcaacctctgcctcccaggttcaagtgattctcctgcctcagcctccctagtagctgggattataggcatgcgccaccacacccggtaaatgttgtatttttagtggagaaacatgagctttaccattaattataaaaaacagttttcatgcttccacaataagactgtgtttacatataattgtaattatttctatgataatgatttatgtaaaatgaatacggcctgtaccccgtactgctttgttttacagatatttgtgtgtgttttaactataatttcacttgaattaagatatcatgttctcggccaggtgtggtggctcatgcctgtaatcccagcactttgggaggccaagacgggtggatagcttgagtttaggagttcaagaccagcctggccaacatggtgaaacctcgtctctactaaaaatacaaaaattagccaggcatggtggcaggcgcctgtaatcccagctactcaggaggctgagacaggagaatcgcttgaacctgggaggaagttgcaataagctgagatcgcaccactgcattccagcctaggcgacagagcaagactccgtctcaaaaaaaaaaaaaaaaaaaagatactatgttctagtattaagtagcttccacataagacccttgtcatatcttttctgaaaaaaaaaaaagtctaagacactgtgactctgctacacgcaggaattagtactcattaggatgtatctgagatatttcaaaagaatcgctgaataataaattccagtgcaataaatagcattctaataaattaggtttgaaataattttgtaatgttaatctcatttaacacatttattgactgaccaaaaaacctcccaaacaatttaagtcacattttagaaagttttttaaaaaattattattattattttttgagatggggtttcactctgccacccagactagagttcagtggtgttatcatggctcactgcaacctctatctcccaagctagagcagtcctcccacttcagcctcccaagtagccagaaacaaaaggcgtgtgccaccaggcctggctaatttttgtagagaaagggttttgccatgttgcccaggctggtctcaaactcttgagctctagggatccgcctgcctcgacctgccaaagtgctgggattagaggcatgagccaccgcacccacccacattttagaaagttttaaagggacaaatatgaaatggtacatcgatcaaaataagcacaaggaaatgcaattctagtcaatataaagatactaaaaatagtttatttatggctattaaatggagaagaaaagagatctgtgattaagacatgagagagagggaggagaagagacaacaggaatggaggaaggagaaatgaacacagactatagggaaccaagagtagtcgtaaagaaagaaaaagcatccatgggctggggtgcgtgttaagatgtaggtacatggagagttccttttttgttttgttttgttatcagctttattgagatataattgacctaccataaaatgaccctttttatgtaaacaattcagtgtgtttttagtatatttatagggttgtgcaaccatcaaccatatgtatttataaataaaaaataaaaaacaaaccacataccccttagcagtcactccccaatccccttcccttccctggacaccacaacccagccctaggcagtcactattctacttctcctctccatagattcaccatttctgaacattttatgtaaatggaatcagacaatatgtggtcttttgtgcttggcttttccacttagcatagtgttttcaaggttcatccgttttgtagtttcttttttcttttggagaaagagtcccactctgtcacccaggctggagtacagtggcacgatcttggctcactgcaaccttcacctcccaggttcaagcaattctcctgcctcagcttcccaagtagctgagattacaggtgcaagccaccactcctggctaatttttgtatttttagtagagatggggttctgtcatgttggccaggctggtctcaaactcctgacctcaagtgatccgtcttccttggcctcccaaagtgctgggattacaggtgtgagccaccatgcccagcttcattttgtagtttctatcagtatcttattgctgaataatatttcgttgtattgatttgccaggtttaatttatttatatatcagtttataacttttgggctgcttctacttttttggctattatgaataatgctgctacaaacattcacgtacacatttttgtgtggacatatattttcatttctgttgggtgtaaacctgggagtagaattgctgggtcacatggtaactctctaattaactatttgaggaattgtcaaagtgtcttccaaaatgactgcaccatttttttatttccatcaacaacatataaggattccaatttctctacatcattgccaacacttattatttgtctttttggttatagctatcctagtggatgtgaagtggtatgtcatggtggttttgatttgcattttcctacttactaaaaattttgagcatctttttatgtgcttgttggacatttatttatcttcttaggagaaatgtctattcagctgttttcctcattttttaattgggtcactcatcttcttcttattgagttgtaagagttctttatatattctctatacaagtaaatgtcccttatcatatatatgacttgcaaatttttcctttcctttctatgcgttttcttttcacattctttatagtgtcctttgaagcataaaaatgtttagttttgatttggtccagttcgttaatttttaattttattgtttgagcttttggtgttgtatctaacaagtcattgcccaacccaaggtcatgaagattttctcctatgttttcttctaagaatttcatgtttttaactcttacattgagatctatgatccattttgaattaatttttatatatagtgtgaagtaatggtctaactttattcttttgctgtgaatatccagtagttccagcactatttgttgaaaagactgttcttcccccattgaatggtcttgccaccctaacacaaaatcagttgaccatagacatgggggcttatttctcaattgtatgccattgatgtgaacactcatgcaattttcacatgtcttgatttagtgtgattttttagtaaattttgaaatcagaaagtgtgagtcttccaactttattcttcctttttgggattgttttatcaattcaaggtcccttgcaatttcacatgaatttgagtattggcttttccatttctacaaagaagccagccaggattttaatagaaattgtgttaaataggccgggcatggtggctcacacctgtaatctcaacactttaggagtctgaggtgggcggagcacctgaggtcaggagttcaagaccagactggccaacatggcgacaccctgtctctactaaaaatacaaaattagcaaggtgtgatggtgcatgattgtagttccaactacttgggaggctgaggcaggagaattggctgaacctgggaggcagaggttgcagtgagccgagattgcgccattgcactccagcccgggcaacaagagtgaaactccatctcaaaaaagagagagagagagaggaaaagaaaagaaattgtgttgaatagaagcggtgagactgaacatccttgtcttgtccttgatctcagggaaaaggcagtaagtctttcaacattgagtgtgctatcagctatgaggcagtcatagatgacctttatcaggttgagatgttctctgctattcctagtttgttgagtgttttgtcatgagaaggtgctggattttgttagttacttttcatatagtttttatttttattcaattaatttgtagtattacatttcctggaataaatcccacttgttatggtgtatggtccttttactatgttgttttgtttttgtgtttgtattcggaaaggacattggtctgttgttttcttttcttgtgatgtgtttatcttattttggtgtcaggataatactgtcctcatagaagaagttgaagagggttcccttctcttctatactttgaaaaagtttgtgaagaactggtattaattcttatttgaatgttttgtagaattaaccagtgaattaatctggtcctgaggttttatttgtgaaaaatatttggttatcaatttgatatctttacttgttatagctctattcaaattttctattttttttttgagatggagtcttgctgtgtcgcccaggctggagtacaatgacacgatcttggttcactgcaacctctacctcccgggttcacgccattctcctgcctcagcctccctagtagctgggatcacaggtgcccgctaccacaccaggctaattttttgcatttttagtagagacagggtttcaccatgttagccaggatggtctcgatctcctgaccttgtgctccttccgccttggcctcccaaagtgctgggattacaggcatgagccaccacgcccatcccaaattttctattttcttcttgaatcagggtcaataatttgtgtctttcatctctattcgtatcagctgtgaggtggtcatagatgacttttatcaggttgagaaagttctcaactattcctagttagttgagtgtttttgtcatgacaacgtgttggattttgtcagttgcttttcaaatcatttttattttttatttgattgatttgttgtattacatttcctggaataaatcccacttggttatggtgtatgatctttttactgtgctgtcggcatagtaattttatttgcatacagtttttttttttttttttttttttttacctccctttcctttgtttggtttggtctagtcaaggcttgttagttttgttgatcttctcaaagaactaactttcgcattcgttgatttcctctattgttttgcattctctgttttatttattcctgctctaatcttcatttccctccttctgcatgctttgggtttagcttgctctgcttttctctagtttcttaaggtagaagtttgggttattgttttgagatgtttctttttttttttttttaatgtgagtgtttacagctataagtttccttctgaggactgcttttgctacatcctataagttttgatatgttgtggacttttttttacatttcaaagttgttttctactttctctagtgacttttcttttgacacattgttgttgttgttgttgttttttcctttgagatggagtctctgttggccaggttagagggcagtagcgtgatctcggctcgccgtaacttctgcttcctgggctcatgcgattctcctgcctcagcctcccaagtagctgggattacaggcatggactaccacacccggctaatatttgtatttttagtagagacagggtttcactatgttggccagtctggtctcgaactcctgacctcaggcagtccacccacctcggcctcccaaaatgctaggattacaggcatgagccaccactcctggccagacacattggttatttaggaatatgtggtttcctttctgtctgttactgatttctgatttaattccattgtggtttgaatgtatactttatgtgatttcagtcggtttacatttactgagacttgttccataacctaccatatgctttatcctagagaacattccatgtgcaactattctgttgatgttggatagagtagtccttcgatgcctgctaagtctatttggcttatagtgttgttcaagtcttctattttcttgtggatcttctgcctaaattttattaattagtgaaaatgtggtaccaaagctgtcaacttttattgttaaatttcctattctgctgggcacggtggctcatgcctgtaatgaggtcaggagttcagcctgggcaacatggtgaaaccacgtctctactaaaaatacaaaaattcgctgggcgtggtggcacgtgcctgtagtcccagctactcaggaggctgaggcaggcgaatcgcttgaacccaggaggcggaggttgtagtgagccgagatggtgccactgcactccagcctgggcaacaagagcaaaattctgtctcaaaagaaattataataataaaataaaataaaatttcctattcttcccttcaattctgtcagtttttgctttctgtagtttggggtgctactgttaggtatatatatggttataggttttacatcttcccaatgggttaattttgtgttaccatgaaagtccctttttatttccggtaacattaaaaaaaaatctattttgtctgatataggcatcaccaactccagttctcttttgtttactgtttggtatacctttcttttgatccttttactttcaacctatttgggtctagtggagagttcttatactgccttaggttagggattcatattacattatcatcattagtactgttatttgacatttgctgtgctgactagctactgctgataggttttctttcctcaacaattctgaggctctatattgagttatattagtacatcatcatggagagttaaaggtaggtaaggattattttctgaactgcaatattgattaaagccatgtgaatgtataagattcttagaagagttgacattaaatcaaggtgaagctgaggtttgagccttacttaaaggctgatattttccactctaactgcggacagtactgtagcactgttatagtacctgctctgaatgttagtctagcaactcagggtcttcttcatgacagctgaacctcaaccatgtgatggtaaatgtgtagcagagtatgcctggcatcccacctgctcctcctccccctcctccttgactggttctggaaagcaaatagggtgtaacaataggagttctggaatgttcctgtgtggggctgacctttgtatcgctgttaatcctctattttcagacacaaaaatgattaagttaaaactggatgaaagtcttttctgggtcacagggctgagctgcttttgctctttgcaaatacaaagaatttaacaggattctccccttctcaacttcctgtcccccaccctgaccttcgcaccttcccaatatgaggaaaaagcaggaagttttccttgcgggttttttttatgatgacatgatggggccagttgatcaatggggaaaaccccatgtggcaacacgccttctgtgtacattcccaatatttgctataaatagggccatcccaggctgctgtcagaatataacagcactcccaaagaactgggtactcaacactgagcagatctgttctttgagctaaaaaccatgtgctgtaccaagagtttgctcctggctgctttgatgtcagtgctgctactccacctctgcggcgaatcagaaggtaagtgtcgctctttccgctagcacagaagaaagactattttcattttccttttagccttgagctcaactgggggtccctaagggatggaaaactgttaggaagtatacaagaggtagtgatggaagttgtctgcccatggtggagtggaggagagaagagttactgctgcggatcaggctttcctctctgctgtcaatctcagcagatttggggagtggtgggctcttagagatccctaaacttcaggataaagccaaagtgatgtttctgggagtgatataaagtgtgtaatgttaccagtagatggggccattttgaaatgtagagaatcctcctgtgtccccaactttcgtacctcccaacttaatagttttggtaaagttcaaaactcatcctttagaagtagattataatacctgacatcaacatccccacaaggcatgggggacattgcttgccaactttaaaataacattaatcccttaccttacagcatgttgtaatctgactcgggaatgtccaagtattgctttattgctcaatagtcacacaacacttttagcaacaggtgcattcctaaaaatgcacattgaatttttttttttttctgaggcagggtctaacttcatcacccaggccagagtgcagtggcatgattacagctcactacagcctcaacctcctggagtcaagtgaacctccagtctcagcctcttgaataacagggaccacggccgtgtgccactcacctggctaatttttttacattttttttttttttgtagagacagggtttcactgtgttgcccaggctggtctcgaactcctggaggcaagcaatccttcctccttggcctcccaaagtgctgggattacaggcatgagccaccatgcccaaccacatgttgaacttttatgaacaaaattaaacattcctattaattaataggacaatttcaaagtgttttcactcctataaatcatatttccctttgtagctctatttctcaatacttagtagccagataatagattaaaatctgccaatttattcattttctgcttttggaagtttatctacataagggttccttcaagcagtagggaaggggctgctcatattcttgaatgattatagtgaactgaaatgaaatattgtcaatttgtatttcttactgaagatatcccacttatgagaagtcctgtgtttctcaattctattattgaaccaaaacttctcggcacacaaactgttttttcaaagaactgtaaactatgttagattggttctcaacgaccttacaaaggtttccaagacattgaaactcctcctctaagtggtttattcgtcatatacatgagattcactagatttttcacaacttaaggtagttttataataccaatcacaggataagtttattcatgtggatccaatacctttcacttttttttttttttagcagcaagcaactttgactgctgtcttggatacacagaccgtattcttcatcctaaatttattgtgggcttcacacggcagctggccaatgaaggctgtgacatcaatgctatcatgtaagttattaattgattttaattcagttgtatcaggaatacctagaaacttcagttttaaaaatgtttgcctttttagagtttcattcagaaattactgatgttttgaacataagatcttattttaaagagaaagaaatgatgtggcaaagatagctttgtcttagtacatatctactttaaagttcactttaaacaggactggaataaggcaaaaccttttttaaaaattttttttggtcaaacggaactagtatagggcaaaaatcactttctaaggctattaaagtgatatattaggaaaatagggaagatacacatttcgaaatgagcatcttctaccagaaagtgtttgagaccaaaagtaaaatctcagactaattatactatcacatataattttcttgatttatataggatattatattttggaattatacaagttattgatcagatacatacatattctatgtaaccaccaatagcaaaattatatgacaattctgggactttatcttcctgccattgtactattatttgttacattgcagagaaagagagaatcactttgattttgcattaatcttcatcagaagcattttttgtgcattttattttacctcatcaactgaaatgtttagtgtgtaatcaactggaatataaaatttccattgtatgttctatgaaaaacccattgaaaagctcattaaacacaaatcaaattttctgatttttcagctttcacacaaagaaaaagttgtctgtgtgcgcaaatccaaaacagacttgggtgaaatatattgtgcgtctcctcaggtatgttacactgacatttagcctttgcaaatgtttgaggaaagaggagtgtgcaaaggggtgggccgtaggttttctgggattctttagtttaactattgtggaatttttaaagggaaaatttgagttggaccacaaaaacaaagaatgcatttttccacttacagatcatcatcgttattattattttaatttagtgatttcttacatgatgtattagatttctctatgcatttgatagttactagctgcctgattcttgttgcaaagatgcctactatttatataatttaaaggcaatctggcatttggttgtttgttaaaaactgaaaaatgaacattagttaaacagagatcaatggttctgatttacgttgacaataatagacagtaacactttatcaatggacagaaggcacctaacaccagcatgccatagatactgaacttggagacacaagataagtgtccatagcctgtttctgtcattaatgagctgagttaggttgggcaagggccatcctctctaaacctcaatttcctcatctgaactctgagctgcttgacatactgagttgagattaagggcaggtgaagcaacctttaggtaccaaagtcattcccaccatgcagtcaccttgtcattacttacacttttcttctttttcattttacagtaaaaaagtcaagaacatgtaaaaactgtggcttttctggaatggaattggacatagcccaagaacagaaagaaccttgctggggttggaggtttcacttgcacatcatggagggtttagtgcttatctaatttgtgcctcactggacttgtccaattaatgaagttgattcatattgcatcatagtttgctttgtttaagcatcacattaaagttaaactgtattttatgttatttatagctgtaggttttctgtgtttagctatttaatactaattttccataagctattttggtttagtgcaaagtataaaattatatttgggggggaataagattatatggactttcttgcaagcaacaagctattttttaaaaaaaactatttaacattcttttgtttatattgttttgtctcctaaattgttgtaattgcattataaaataagaaaaatattaataagacaaatattgaaaataaagaaacaaaaagttcttctgttgattgagttttatatcatttttatgatgtgtattgaaaccatttccaggcacagaaaatataagaattttctgagaaattatatcctccacttacttctagttgttccctttatctcggcccctcatggccctggacttgattttacatgaattataatggaacagttgttcttttttttctttaattcaaagtcgtccagattaaaagttgaaaaagatcctatatctgagattcataacccaatgtttattgatttaagaaaactgtttaaaataagaaaccatgcccacacaccttttgactacagggacacaacaaccatttagaatataccttcaggcatcacttcttccatccttctgtcaccagccaggatctcagcatacgaacatttctccatttaaaagtcctcccgagtcatctttaagcagtttccgaaaggaaaatgactattcagagagttcttagtggctgccttgctaaccagcggggagcccccagacgtgtgaaacctggtaagagcccagcaatcaggatgaaaagactctgaaccagtagttactatcactacattcatgcatcaaggttcacagagtgcctcggattccaaaggacacacaggatcactggaggcaggcatgctgatgatatgatgcaaaatcaagacacataaacccataaagtagggcagtggtgggtcacttgatgtggagccaaaaaagagtaagtggctcaatagtccccaagggcgtctgcatcctcaggaacagcaacattgaatcatcagggaaagtatgctcaacatcctgtgtgttgattcatcatcacacataggttcagtatgtgctgggcaccgtgccaagtgctagagagaagaagtgacttaaaacttaataacttgctgctagatatttaaggctgagcaatgtggcgagaggcaggaatgagtaaagcagctcttacaacacttggtggtaagcactttaataatgaaatcattgggcatcattcgtgagggcttccagaagaagtactatgcagttgaatcacattaagtagccaatatttgatgtcattgacctgagaagatgacaatttcacaagattcagcccaatacttgtggtatgaagaatcagtaggaagtagctagttggaaaagggacagcaggaagtgtttggaaatatctgcgggcatgtgtagttgtcacaatgtctgagggtgagtacaacaagcattcagagggtaggagccagggttgctaaactcactagaatgcaacggatggttctgcacaatgaagaattgtcccaccccaaacgccaatcgcgccacccttgagcaataccggatgaagaggagtatatgcaagtggggcaggggtggagtagctgcagattaagttaaactgttatctcaactacgtgtggtggtttgggcttgaccatggagcccttgggaaaccactgtaaaggtcaaaatacatgttgtctctgcacggcagaggaaagggaggtggggtggatggaaagcagaggtaccagagacagctgcaatgaggaggctgagaaatggtgaacttcagtcacagccacggcaaaaaaaaaaaaaaaaaaaaaaaggcagaagaggtgggattgtgaagcctgggacttatcccagacaccccttctctcctccccatcagtcactgttggaacagcacagtcaaagcaaggcattttcagggggcagcagatttgtctcattgctggaaggcctcagcaggtaaggcttgtagagtcaggaaaggagaaaattttgttagcactctgaagctgtctgaatcttttgaggccaggactactaataagtattaagtgagtttctgaagactgaaatctccaggctggaatgccaatttattaatcaacaacgaaagcatccaagcgtcaagtatgcggacacaagcacatggctagattagggaagcaagctacctgagcagtcaaattggaatcacaaagctggtttgttaaggctgggatcagagagcagggcctcagctatgtaatttgaatatttaatgctctagttttcactggattaaatatgatcttagattagggatgccactcccaattcacagctctctctctctctcttttttttttttcattttggaaaaaaagcctatttactttttaattgaagtataatttatatgcagtaagatacacaaatctttttttttttttttttttttttttttgagatggagtcttgctctgtcaccccggctgaagtgcagtggcatgatctcggctcactgcactgcaccttctgcctcctgggtttaagcaattctcctgcctcagcttcctgagtagctgggattacaggcgtccaccaccacacctggctaacttttgtatttttagtagagacagggtttctccatgttggtcaggccggtctcgaactcctgacctcatgatctgcccaactcggcctcccaaagtgttggcactacaggtgtgagccccctcacctggcccagatacacaaatcctaattgtgcagcttaataaatttttgcatatgcacctacctgtgaaacaaccctgcctccttcaagacagtaaatgttttcaacacagcaggggaaggagctctcatgttcccctccatttgtagaacccaggggtagcagctgttctgatctgtttcacaatagattaatttgccttttcttgatttcatatatatggaactatccagcatttactttttggtttttgacttcttttactagaatcttctgtctctgaacttatttttaatggcatgtatagtacatgaattcactctcattcttaggttcaagcaatagtgatacggtgaaggtctcctttaaactttcatcaagccccttgactctctgaggtgaccccacaggatgcctttgctctcccctgggctaagtagccctttctgtttgtacagtcttcttgagaaccactgctagtttatgtaagagtctagtcctgtctcctaaatacactctaaccatctgaatgattctgaggcttttggtcatatattttccaaaagtctcttgtgtaagactgctgatgtctggccatagccataggccctatgtgtggatttgacttgctgtattctcagagttgtctccaagttcttcggtgcctccctggtgctttccattagtgtcatcttaagaggtaagtaagataaggatggaataatgtcttgcccctggcaatctgtaggtcattggtaactgtaagagtattcagtgaggtagtgtaggagagagaatcccaatgacagtgggttgaagaatgaatggtgacaagtagtttggcaatgaaggtaagaggaaataaaagctagaaggggagccttttatctttagatggaaaagtattgaaagagtcagggagaagagagagagagagagagaatgagagagagattgaagatattataaagagttgaagattctggaagagtaacaaatggtacctcaacttctctcaaaaggcgggtttccagaacacagttcagctgagtcatctcttccttcggaacaaaattcactcaagaaagagcaggagtaggtggggagaattttgcaatttgggatggaggaagttgacagactttgaatatggtggtcttgcttttcttggtgaaagactagtcaccttttgagagtgatgagtgagctttgacatgaatggagaagctttgagatagtcagtagaggacacaggggtacactcaaggttgttccacagtgttggggttcactgaagtcggagataactaagctgctgtgatttccattggcacacaccaggtggcctgctgcagtttgggtgtaagaatagacagtggtgactagttggactagtttagggtcaggctttgcatctaggcacagtgcaaggacaagagggcaagagtcaatgacagaggttcagagaggggttaaagtgctgaaccatgcagtctagaccagagacaggagatgaggtccaaaggtatctgagacactgagagagtatggggaggccctcagataaaaggcctcaatgtggtcaaagagcaggagaatgggagggctggaggggctggagcagctccaggggccaaagtccaagtgtgtgactgtgggtgtgcaactcaagtggtggggtagcagggcgatgactggaaggctaccaggatggatgagtcattcccattgattttccctctactttttccctcttttttaaaaaaatatagagttggggtctcactatgttgcccaggctggtcttgaactcctgggctcaagcatcctcctgcctcagcctcccaaagagctgggattacaggcataagccaccatgccctgcttccctccactttttattatggaaagtacaaaagtggagagaatcatataaaaatcccccttgtatccaccatctggattcaactgactaatggccaatcttgttacatctacaccacccaactcacttcttcccatctatccccctggattactttgaagcaatttctagacattaaattattttgtttataagtacttctccctctctctatatatgtacatatatatatatatatatatatatatatatatatatatatatgaacttttaaaaacatacaatttccctcacatggatttaaaaatcaacactaattctctaatatcacccaatgtccagtgttcaaattttcttgcttgctttaaaaaaaattgttttaaaaaacattatttgcatccatcttttctttaaatgaagatataaagatgtagatgaaggtgtaaatgaagatccgaaagaggtccacacacttcatttgtttggcttgttttttttttttttgcttttaatctgagagctcctcaccaccagcccccatctcctttccttttcctttgaaatttatgctttggagaaaccaagacatttgttctgtggtttcccaccttgtgggttttgttaattgcattcctgtggtgttatttagcatgttctttgaccctacttagaaatagaggctgggttggattggaatttactatgcaaggggacaaggctactgaataagtggcattatgccacatgggtacaaagtggtccacactgatgtcaacaggaatgaaagggaacactgagctgaagaactgatcaaggccattaactgacagccagcgggaggggaagtggatggtctaatgacatccatatgcttcaaagaagatgatgggaaaggtgtgtaggaatgagaaagtgccatcatggaagcacaagaatactggtctctacccactcctggccctgtggtgggagaggagtgagagaggagccccttcatgttgagaagaccccagggagaagtagtgttcttgccataaaatctgatttcagatgaagccaggagatggagaagtggaagatggaaggacagagaagttgctttacaacagaaaaaagtttccactgaaggtcatggggggcattgtggagttcagctggaggcacaaaggagaattgggacggaagcactagcagtatgagaaagaaaagatgaatacaaagatttgggtagtaatcatgtcattaataatatttagattatttaagcatttgtatgttaatatcatctgctaagattgccaatgtacctcattggaatatgagctctgaactctatttttatgcctgttcttgggtaaagaaactgaggctcaggagagttaagaaacttactcaaggtcacacagtctttagaaatacaatggagtctagagttggtctcagggctccctcctggcctctggcataagatatttttgtgtcaaggagacggcagatgctcagtcttggggctgtttatttgcaatcttcttgtacatctgtttgctctgctgttctagaagttaccatcaaagtattagagcattttagactttttttttggattaaaaaggcttccaaataaaaagtttgtttctccaaggagtaagcttcaattgtgatgtggacaccttcttccctagcagtgccagacatatatcacactgttgtacttttctttcttgctacatctcttcacagtttattggataaaaataatgttttccactcactcactcatttattcattcaaccaagagatgtttattgaacacttactctgtgccaggtcctgaggcggtcattggggataaacaagacaaccttgcggctttcatgtgcctcatggtttagaagtggggacacacaacacatagcaccaaataaatgtatgaaatgtgaggacaataaagttgggaaaagggacagaggatggggatggagaacttcatatctgtgtagagcctgacacagtttcctgcctttctctcagaaacaaagcctccgtcttccccttggcttagaaaggaccctggatagggcaaggaagacaggtctgattaaacctgtccaagagtgtagtctttatttatttatttatttatttatttatttatttatttactgagatagagtctcggtccatcagccaggctggagtgcagtttccaatcactttgttattttttttattctcctttactggtttgacctcttttgcctgatctttaaacaccaagcatctttacacttcaaatctaaagattcttctcctctcaccttacattctttccctatataaatcatcagtgccatggcttttgtggtgttgttgttgttgttgttgagacagaggctccctctgtcacccaggctggagcacagtggtgtgatcttgactcactgcaacctccacctcccaggttcaaacgattctgctgcctcagcctccccaggagctgggattacaggtacgcaccaccacgtctgggtaatttttgtatttttagtagaaatggggtttcaccatgttggccagactggtctcgaactcctgatctcaagtgatccgtccaccttggcttcccaaagtgctggaattataggcgtgagccaccgtgcctggcccaagagtgtagtcttagtttttggagataacataggtctgtggaagactgttgcactgggccttgctttactctgactgaaagggtagctcataagttagaacccctaagattataaaattttcttcactgagcttaccaagtgtcaagactccagctggggccaactcaagttcgcaaaacttgaatatgcattcgaactgtgatttggggattgcattagcacacagcatcattgacattcctcgagtctggtgattcttcgaatttgtgttctttctgtggctctgactcaattaaaacaaataaactatgtctagcaataaatacgatacaatgatgtagttacagaaaatcctgcccgttctccaaaatggtacaacacaatttgtattcctttcgttgttgacatcaaggcacttctggcaggaaatgctcacaagtttgaaaagctggtgtacatttttttttttcatttttcttgtttctggcccccctcccttcacctgaaaaaacaataattttaagagattgttaaaattcaataatctaaaatcttcaatttaggtgaattaaagttgaagttcttaatttgaagaaattcacctaagttccaggtgatgaggaaagtattgaatgtagattcattcatactcaggccataatgggcttagtgcttcataggcttaaatccagcgaagaaagagcctgcttagtactgagagttgaaatttacaagcagatccatgtacgtaaaggacctaaagactaaggagccaagaagagcaaatgggggctcatgctgggtcctttgggatttattgcatgtattcatatcctttttttttttttttggagatggagtctccctctgctgcccaggctagagtacagtggcatgatctcagctcaccgcaacctctgcctcccaggttcaagcgattctcttgcctcagcctcccgagtagctgggattacaggcatgtgccaccctgcctggctaatttttgtatttttagtagagatggggttttgtcatgttggccaggctggtcttgaactcctgacctcaagtgatccacctgcctcggcctccccaaagtggtgggattacggccatggccacctcgcccggccaatttatttctaacgttgttcaccaaaaccatgtttttacacattcctctcttttcttatgtgaattactccagaaattttcccacatcaatcttagccccattttgggggtaaaactgtttatcaagtggcgtagtcctggaaaaacttctgaattaatgaacatcccatctcacctgaattatttggcagcaattgcttcacatctcaagccaaagggtgacgcacgtctttctccctgaaaaacacacagggcatccatgtgtccccctgcaccaccctctgtaacagcagaggctctttgtcctgttttgcggcagttccgtggcattccctgggcatgttgtcaaacgcaattagaaagggcacgtggtgtctgtctccttcaaggcagccaagtctgaggaggtcgcagtgcttgcctccaccctcttttgccacctcgtttcttggctccctgggtttggcatgttgggtgcagttccatttggcccagatgctgtttcacttgttgaaatgattccatttcctcggtttccaccctcagggctcccagggcagggcttgcccttgccacttgcctcttcctgccaccaccattctgctcagcttggcagagctgatttgtctaggcctgacttgactcgcccctcctccctgccctaccataaaaatcagccgcactttctgtttggtgaaatctgcttgccagtgaacgagtgtgggtgaaagcatcagcttgaaaaaaggggtgttttccgttttgtctccctccctccctccctcccttccttccatcttcctttcctttttcttttcttttctccttcttctcaccctccctccctttcttctctctctctagacaaactatgagtatttcctccccaaacatctccctgaggttgagacttccctctgtctgtctctctctctgtctgttgtctgccagtccatctgtctctctccacttaccaatcattcaggttcaaaaccacaaagtcgtctggctccttcctcacccttagtcttccacccttaccactagtcaggcactcacctggctggctatggttggcaatagttttcctccctactctttgtttccgttctcactgccctcatctttctgtggctttcacctctgaagaggttttctagccttttctctctccttatttgaacatgtcttgccaaatttatgccacaatattgattttatcattctcaggattctaaatcgcttctgggtacccattacctatcaagtcctcagcttggggtgcagggccttccatgatccagttctcatcctgcctcttagagtgatttatgtgtttcacatactccaggcacactggcttctttaccatggcatgggcatactttgccattttctgtccacacatcttcgtacataacttcaccaagaatgctgctcaatctccatctagattaagcacatccagcttgagtgattgtgctcctacgtggaccactcccagatcagccaaagctcctccctcatccctctgcgtgtctgtagcatgtctcatttctcccactgatggagcgtgtgccttgttctcccatgcactgtacttcctccatgagctttctctccgcaatgctgtggttttcttcggatgaagaacattgcatagcttctacctcttcgcatttcttgcagtgcctaacatgaagccttgcagctagaaggtgcttttgggatgatttggaatggctagaaaaactacttgataattcctgggggaaaccagcattcttgtatacaattggtagaagtataagtcagtaggaattttctaaatacatgttttcaggatgcatcgaaagccttaaaaatatgtatctatttcacagtacagtatttccatttcctgtgaattcattctaaggaaataattgcataagagcataaatatgtgtggataaagatgctcataacagggccaggcgtggtggctcacacctgtaatcccagcactttgggaggccaaggtgggtggatcacctgaggtcaggagttcgagaccagtctggccaacatggtgaaaccctgtttctactaaaaatacaaaaattagccaggtatggtggtggtcgcctgtaatcctagctactgggtaggctgaggcaggagaaacgcttgaacctgggaggcggaggttgcagtgagccaagatcgcaccattgcgctcaagctttggcgacaagagcaaagctccgtctcaaaataaataaatgaataaataaataataaataaatacatacataaaataaaatagtactatctaaaattttgatgtaatatctagacttagtaaaattccaggatgcctaaagaaatatttttgaaactaagaggacaggaatatttcaatctcagagaaaactgaacaccagggacagtcttaacaaggtaccacgtgccatttctctttcttcatgtcctttaatttaaaaaagttttttaggcttagcctggtggcattaaaagaaattagatgactaccatttctattagcaccttgggagaaaaatttctcctatgtttcgcaagccacctggcttcatctcttaattagattttgtccggggctatgatcctgaaatagtgtttctccatattgcttgttaaaagtagaaatttctgaagattctgacttagtaggcatagagtccaggaatctgtacttctacaagtgccaggctgattctcatggttaggtgagtttgctctctggtcaaagttcatgagagaggaagcaggcctgcttatctctgtgaaggtcaggatcagcctgaagaggtcctctctgatggatccttgaagctggaaagttgattaagagggagtttgcagggaaaatgttgttttcttccttcaagaactggccttcctcatctgaaggacataggtgagctttgtctctctacaccatgggaccaggtcatttcccattccaacatggtgctgtgttgatggacatgtccaccctggggaccagggggagaggagagatagtaggtggaacaagcacccaggcttacatgttcagcaagaggtgaggtccaggtccaagtacaggtcaacttggctgtaaagtccatgccttaagaattctgagcagaatgagataatcagaccattggtagcatttcaggtacactgtaacgtgcccagaatgtaagctgcctgataacagagaccctgcccaccactcaatcccaggctggacagagtgtctgtcacgtgctagaaaccctgtaaatatctgataaattcatgatcttgaggtcacttgcccaaatacaacacaatacgtttgattttctttatgtatttcaagtcgctaaatcaagtttttcttttcttctatgagctcactagtccttacagacaatcactgcaaataaggactagtgagaactggtagtattgggtccaccttttaccctaaactctgagatcctgatattctacttatcaaatgcagagtctatatgaaattattaaccatgaacttgcttctgaacagacccagatgggtttcaaaatgtatctcatgtgcatttatttactaatgtcaattctccaccttgaaaatcaggtcagaatatttctgatgttgcattaacagttagccattcagtcttacaattttcaaagaattcaatgtaagtgatacccagaagagaggtgaggaattgaaagcaatctgggcacagctgtggtccacttctgcaatcaacagaaagcagcactccctcagccttcttgtcagactcagaatattaggagtggataggcattcattctcgattatttctcaggcttttaaaggtgatgttggaggaaactttgcccctctgccttcattttctgattcaagtaccttttacacatttccacaatcactcgcctctttcaaaattacagatttttgttactttttcattattttgcttttcttgttcatctttgatcaactctccaactgtttgcacattagtgcaggatcaacagaagggattagcttaggaaacacctcaaggtaagatttcaggaaaaattaaagaatgattaagtaggatagtgaacacagattggcatttatttgaaaagagccccatatgccccattaaatacagtgtttgttgttcaaccagcaactcagtaaaagatcaaggtgaagggcctctgaattctctttttttcaatgtctttcttttgtttcttttccttccttccttctttctttctttccttccttccttccttccttccttccttccttcctttctttctttttttttttttttttttggcataatctcactctgtcacccaggctgtagtgcagtgccaagatcttacctcactgcaacctctgcctcctgggttcaagcgattcctccctctgcctcccaagtagctgggattacaggtgtccacgaccacacccagctaatttttatatttttagtagagaccgggtttcaacatgttggccaggctggtcttgagctcctgacctcaggtgatccacccaccttggcctcccaaagtgctgggattacaggcttgagccaccacgccgggcccagtgtctttattttcggactatgctttccactataggtccctgttgtgaataattatcttgaaggttgcttctaatcttgtaataccatgtttctgtgatatattactttgagatcctgttttagtatattaataatatctggaatgtgttttgagctattaaaaatatctttaaagagcttagttgtatatcacatactactataagttcactatatattttgtaaagtaaaatgtggatttttaagtcacagtttaatctgtgaatttactttgttatgcagttttgaaagaagtgatttcatttttttctacaaaggtggctttccttagtagactgtccctgccaggctaataaattactgcagataataatttgtaggctgtaggagaggaaagttgggaaataacaaaatgtcagccttgagagtcttgcaacagattgggtttcatgatgtctatgagacttgacacccttaagtcttacatatgagtccatgcacttccgtgctaggtaggttgcatcgttatcacctggggatttaaaaatgtataggataagataggatcttatcctataggtctggggtggagtcaggaaatcaattttttttcctaagtgtccaagggtggtttgatattccaggttttggtatccttgcctaagtgtaagttcctgtcatttcaaaatattattattattattgttattattattattttgagatggagtttcactcttgtcgccctagttggagtgcaatggcacgatcttgggtcactgcaacctccgcctcccgggttcaagtgattcttctgcctcagcctcccaagtagctgagattacgggcacctatcaccacgcctggctaattattttatttttggtagagatggggtttcatcatgttggccaggcttgtcttgagctcctgacttcaggtgatccacctgccttggcctcccagagtgctgggattacaggcatgagccaccatgcctggcccaaaacattatttttttaagatatttatttcttagattcatagagctttatcagagttcagagtggaaaatgaaaatcgctgcaagtaatttaatcaagaagggatttaatacaggaaatctggccatagaaaattactggaagggctgaaaggattggttcataattggttctctgggaataattatagaaacagaaagaagtgacccaccatgagagctgtgctggaattaagaatattgattggagtaggtcgggcatggtggctcacgcctataatcccagcactttgggaggccaaggcaggtggatcacgaggtcaggagttccagaccatcctggtcaacatggtgaaaccccgtctctactaaaaatacaaaaacttagccggacatggtggtgcatgcttccagtcccagctacttgggaggctgaggcagaagaattgcttgaacccgggaggcagaggttgcagcgagcagagatcgcaccactgcactccagcctgggtgacagtgtgagactccatctcaaaaaaaaaaaaagaatattgattggagtcaccaactgctgtgctggcaatgtgaccaccacttcacccacacctagactactaagaaactagagactggacccccaatagctacaatccagggattagaaagcctcatcaagaagccccgacagcttgctacccttgaagttggtgaaggatatggaatgcttgcagaaacacttcatgatctatgaattttccaggtagcaaagaccagaaaaaatagatgtaaagatgaccctagcctggcatagtggctcatgcctgtaatggtagcactttgagagggtgaggcagggggattgcttgaggccaggagttcgagaccagcctgggcaacataggaagaccctgtctctacaaaaaaaataaaaaattgggctgggtgcagtggctcatgcttgtaatcccagcactttgggaagccaaggcaggtggattgcttgagctcaggagtttgagaccagcctgggtaacatggggaaaccccgtctctacataaaatacaaaaattaactgggtgtggtggtgcatacctgtagtcccacctacttgggaggctgagatgggaggatcgcttgagcccgggaggtggagattgcagtgagctgagatcgtgtcactgcactccagcttaggcaacagagcaagaccctgtctcaaaaaattaaaaaaaaaaattagccaggcatggtggtgcatgcctgtggtcacagcttctcaagagattgagatgggaggatcgcttgagcttggaaggttgaggctgcaatgagccatggtcatgccttcgcactctggcctgggtgacagagcaagatcctgtctcaaaagcaaaaacaaaaacaagacctttcctcatttctgcattacaaatcttgtactagttcatctaataggcagaccccattcacatccagcactctagctgaaaggcagttttcaaaaacgttgcttttaactttctaacctctccagttaggaaaaaaaggttgcctggaagttgagtgagccaatctatgttatccatcatactgagagaacaaagaaagctttggtacaaaagacatttttatgggtcgggcacggtggctcacgcctgtaatcctagcactttgggatgctgaggagggtggatcacttgaggtcaggagttcgagaccagcctggccaacatggtgaaaccccatctccactacaagcataaaaattagccgggtgtggtggcacatgcctgtaatcccagctactcgggaggctgacgcaggagaatcgcttgaacccaggaggcggagattgcagtgagccaagattgtgccaccactgcactccagcctgggcaacagagcaagactctgtctcaaaaaaaaaaaaaaaaaaagggcatttttatgaagaagaacaagtcatttgtttggctgttgtggggaatgtgaataggagtgtgtcaggagtcttccaatggaagttaggatttgatcctaagccatcgaaagaagaataacatgatcagatcttttttttgaaaactgattttggcagcaagtcttaggatagattagaaaagaccagtactagaagtcagatacccttgtgttactcatggtgaacagaaccacggttttgtttactttattcaaatatttaataattttatttaaattcattttgatttgatattgtcctattttcaaaacacactctctgttatgagcttataaaagatgatcttattcattactctcctttttgttaaaacattttattataaaagattttcaaaaatacaaataaattcaaaggccagtacgatgagcaccaggtaccacccgctagtttcaacagttgttttaccatattgttctcttgctcttgctcagtctctctctgtctgaacttttgagctgaagtattcaaagtaagttgcagacacaatgcgatctcacttctaagaatttagcatgggtctcctacagaaattctcctccatcatcaatgtcaatatcacacctaataaagttaccactcattctttaatacatctattgtccaatccatattacaattccctgaattgtgttccacatgtcttttttggctgttctttctcccttccaaattaggttctaataaaggttttttaaatttaattaatctaattaaaattaatttaattttttttaattttttaattttttgtagagatggggtttcgtcatgttacccagcctggtttcgaactcctgggctcaaacaatcctccctcctctgcctcccaaagtgctgggattacaggcatgagccactgagccactgtgcctgggaagttataccttttttaatctagaaatttcaccagatttctctagttatctcaaaaaaaaaaaaaagttgactttttttttttttgagaccaagttgagatctgtcatccaggtgggagtgtagtggcatgatctcagctcactgcagcctccgtcttggggttcacgccattctcctggctcagcctcccgagtacctgggattacaggtgagcaccaccacgccttggtaatttttgtatttttggtagagatcggatttcaccatgttggccaggttggtcttgaactcctgacctcaagtgattcacctcccttggcctcccaaagtgctggaacttacaggcacgagtcaccgcgcccagcccacgttgactttttgaagagttatgtgggctggccatggtggctcacgcctgtaatcccagtattttaagaagccaaagcaggaggattgcttgaagctaggagttcaagaccagcctgggcaacatagtgagattcctgtctgtacaaaaaaaaaaaaaaagaaaaaaaaaattaaaaaagaattatttgttacattttacattctgcatttggtggttgcttcttttaatttaatattttctctgacttccacattttcttcaaactggaagttaagtctaaaagctgagtaaatttgggtaaaattgacataattttataggagatgtttggattacatgcttcccttcacaaggcaaataatggtagtttgttgcataattagtgaagcgaatttgatcacttggtgatcatcgcaggatgccagccagatctctccattgtaagggagggtcttccctatgcaaataatgagtaatccatggggtgacattttgacatgatgccaatatcctgttccccattatgattttgaatagtaatatttttaaatccatggatgatcctggcctgaatcaattacttttttgatggttttaaaaaatctcttattattccttctgcattgatcagctataattcctctgtaaaaatgagcttttcctcagtccctgaagatagagttagaaaaatgtaacaatttttcagagtaaggatttgatgtgacagacaactgtcagtgacagcaaatgtatgtttcccttcctctttctatatggtatggatttttatttattcaaggttttgcaatcacttactgttgtggagcccaagttaacccatgttacctcccccttccttatatcttatcgaaaaattaactcaagatggattaaagactcagacgtaagttagggttagcactaaggttagagttagggttagggtttgtggagcccgtgttaacccagatatagctcctgtgcccttttgacatgtgcccactagtctttgagcatttctggctttctgtaacaagatgtctcaggcttgcctttggccttctctacctcagacctggaatcagctatttctccaagaagccatggttatgttgtggatggcaggtgacagcacatagaaaccaaaatctgaattctaaggtactctttgcaaacaggtgttatagctcctaatattatccataagggaagaactaggaaatatattgtgaaaatgtgtgagtttatattgatatttccaataacatttaattttacagagtttttacttaatttcttgcatttttgttttagatttattgattttcatacgttgaaccagccttgcatcccagagatgaagcagacttgaccatggtggataagctttttgatgtgctgctggatttggtttgccagtattttattgagggttttcacactgatgtttgtcatggatattggcttgaaattttcttttttttttttttatctctgccaggttttggtatcaggatgatgctggcctcataaaatgagttaggggggagtccctctttttctattgtttggaatagtttcagaaggaatggtaccagctcctcttgtacctctgatagaattcggctgtgaatccatctggtcctgggcattttttggttggtatactattaattactgcctcaatttcagaacttgttattggtctaatcagggattcgacttcttcctggtttagtcttgggacagtgtatgtatccatttcttctagattttctagtttttttgtgtagaagtgtttatagtattctctgatggtagtttgtatttgtgtgggatcagtggtgatatcccctttatcgttttttattgtgtctatttcattcttctctcttttcttctttattagtctggccagtagtggtctatctattttgttaatcttttcaaaaaatcagctcctgaattcatcaattttttcaaagggttttctgtgtttctatctccttcagtcctgctctgatcttagttatttcttgtcttctgctagcttttgaatttgtttgctcttgcttctctagttcttttaattgtgatgttaaggtgttgattttagatctttcatgctttatcctgtgggcatttagtgctacaaatttccctcgaaacactgctttagccgtgtcccagagattctggtacgttgtgtctttgttctaattggtttcaaagaacttattatttctgccttaattttgttatttatccagtagttattcaggagcaggttgttcagtctccatgtagttgtgtggttttgagtgagtttcttaatcctgagttctaatttgattgcactgtggtctgagagactgtttgttatgatttccattattttgcatttgctgaggagtgttttacttccaattatgtggtcaattttagaataagtgcgatgtgttgtcaagaagaatgtatattctgttgatttggggtgtagagttctgtagatgtctattaggtctgcttggtccagagctgagttcaagtcctgaatatccctgttaattttctgtctcattgatctgtctaatattgacagtggggtgttaaagtctcccactattactgtgtgggagtctaagtctctttgtaggcctcaaagaacttgctttatgaatcttggtgctcctgtattgggtgcatatatatttaggatagttagctctacctgttgaattgatccctttaccattatgtaatgcccttcttggtctgttttgatctatgttggtttaaagtctgttttatcagagaccaggattgcaatccctgctttttttttttgctttccatttgcttggtaaatattcctccatccctttattttgagcctatgtatgtctctgcatgtgagatgggtctcctgaatacagcacaccgatgggtcttgactctttatccagtttgccagtctgtgtcttttaattggggcatttagcctgtttacatttaaggttaacattgttatgtgggaatttgatcctgtcattttggttctagctgattattttgcctgttagttgatgcagtttcttcatagtcacgatggtctttacaatttgttatgtttttgcagtggctggcgcaggtttttcctttctatgtttagtgcttccttcaggagctcttgtaaggcaggcctggtggtgacaaaatctctcagcatttgcttgtctgtaaatgattttatttctcctttgcttatgaagcttagtttggcaggatatgaaattctggattggaaatgcttttctttaacaatgttgaatattggcccccactctcttctggcttgtagggtttctgcagacagatccactgttcgtctgatgggcttccctttgtgggtaacctgacctttctctttggctgcccttaacatttttttccttcatttcaaccttggtgtatctgacaattatgtgtcttggggttgctcttctcaaggagtatctctgtggtgttctctgtatttcctgaatttgaatgttggcttgttttgctaggctgaggaaatgctcatggatgatatcctgaagagtgttttccaactgggtttcattctccccgccactgtcaggtacaccaatcaaacgtaggtttggtcttttcacatagtcccatatttcttggaggctttgttcgttccttttcattcttttttctctaatcttgtctttatgcttcatttcattaagttgatcttcaatctctgatatcctttattttgcttgattgattcagctattgatacttgtatgtgcttcatgaagttctcatgctgtgtttttcagctctgtcaggtcatttatgttcttctctaaactggttattctagttagcaattcctcttaccttttttcaaggttcttaacttccttgcattgggacagaacatgctcctttagctcggaggagtttgttattacccaccttctgaagcctacttctgtcaattcgtcagtctcattctctgtccagttttgttcccttgctggtgaggagttgtgatcctttggagaagaagaggcgttctggtttttggaattttcagcctttttgcgctggtttttcctcatcttcgtggatttatctacctttggtctttgatgttggtgacttttggatggggattttgagtggacgtcctttttgttgatgttgatgctattcctttctgtttgttagttttccttctaacagtcaggcccctctgctgcaggtctgctggagtttgctggaggtccactccagaccctgttggccaaggtatcaccagcagaggctgcagaacagcaaagattgctgtctgttccttcctctggaaacttcttcccagaatggcacccaccagatgccagccagagctcctctatatgagttgtctgtcaacccctgctgggagatgtctcctagttaggaggcatgggcatcagggacccacttgaggagacagtctatcccttatcagagctcaagcgctgtgctggcagatccactgctctcttcagagccagcaggcaggaacatttaagtctgctgaagctgtgcccacaggtgccccttctcccaggtgctctgtcccagggagataggagttttatctataagcccctgactggggctgctgcctttctttcagagatgccctgctcagagaggaggaatctagagaggcactctggctagataggctttgcggagctgtggtgggctccacccagtttgaacttcccagaagctttgttttcactgtgaggggaaaactgcctactcaagcctcagcaatggtggacgcccctcccccaccaagcttgagtgtgtcccaggttgacttcagactgctgtgctggcagcaagaatttcaagccagtggatcttagcttgctgggctctgtggtgctgggatccactgagcaagaccacttgggtccctggcttcagccccctctccaggggagtaaacggttctgtctcactggcattccaggcacagctggggtacaaaaacaaacccctgcagctagcttggtgtctgcccaaagggccgcccaattttgtgcttgaaacccagggccctggtggtgtaggcatccaagggaatctcctggtctgcaggttgcgaagactgtgggaaaagcatagtatctgggccggaatgtaccatttctcacggcacagtcctcagggtttcccttggcaaggagagggagttccctgaccccttgcacttcctgggtgaggcaatgccccaccctgctttggcttgccctttgtgggctacacccactgtctaaccagtcccaatgagatgagctgagtacctcagttggaaatgcagaaatcacccaccttctgtgttgatctcactgggagctgcagactggagctgttcctatttggccatcttgctgtccaccctatcccactaagttattacaaagcgttgtgttaaaaaaatgactttaaataactttttttctctatggtatagtatcatcttgacaaataatcaggttcatttctttccttttcactttaatttttgatttgttttcctaacattttattgtacaaatttatataaaaatattgaaacagctgtatagtgaacacacctccccactaacaagacactgtgattaatatatgtaattccaatttgcttcatctcctaattctatccaccatcaacccaacatattttttgaaaaagttcaaaataagttgcagacgtagtgttctctacctctccctatttcaaactacctatcgttaactatggttcaatatttgtttatcatgcttagcgtaatcaacataaaatgtaatgcataaatcttaagtgtaccattccataaattttgacaaatgcatgcacttgtcaaagtgcaaatccaaaccccaaagatatatagtgttatcgtcaccctagaaagttctctcacaccttttttcatcaataattaacatcaaccccagagacaaacactgttattaattttcccacatagattagttctaaaacttgatataaatggaatcatacagtgatatggtttagatctgtgtccccaccaaatctcatgtcaaattgtaatccccaatgttggaggtggggcctggtgggaggtggttgaattatgggggtggatttctcatgagtggcttagcacaatcttctaggtgtcattctcataatagtgagtgaattctcatgagatctggttgttaaaatatgtgcagcacctcccgccttgctctctggttcctgctcctgccacgtaagacatgccttttcccccttcgccttctgccatgactgtaagcttcttgaagcctcctcagaagctgagcagatgtcagcatcatggttcctatatagcctgtggaactataagccaagaaagcctcttttatttataaattacctagtctcaagtatgtctttatagcaatgcaagaacaaactgaaacatacagtatgtgatttctttcacttggcatgatttttagattcatctatgttgtaacatgtatgtagcccattttgtttatttcttttcttagcaatgctactaactgaatagtgtatttcctgttttattgttgaatagtggttcattgtatagatataccacagtttgttcattcattcacctcttgatggacatccccgctattttcagttttggattattatgaataaagctgttgttgaccaacaaaaagctgaactttgtaaaatatttgaagaggtttattctgagccaaatatataagaccatggctcagaagacagcctcaagaggtcctgagaacatgagctcaaggtgttgggttaccgcttggttttatatctttcagggagacagaagttacaggcaaagatgtaaatcaatacatgtaagatatacattgatttggcccagaaaggtgggatatcttgaagagggtagctatgggtcataggcagagtcaatgattttctgagtgacaattggttgaaaaggttaagctttgcctgaagaattgaagttagcagaaagaaatgcttgagtgaagataagggggaagccaaggttcttattatgtagatgaagactccaggtagcagggttcagagagaatagatgataacagtctcttattagaccttaaaagatgccagtctcttagttaagtctctcctgaataaggagaagacctagaaagggaagggaattctctacaaaatgcaaattttccccataaaagatggctttgcagggccatttcaatacatgtcaaagaaatatattttgggataaaatactttgatttccttcagggcctgctatattttgtgtgatgctatatcaggggtaggttggagtacagtatctcattgctacaaatagtctgttttgtcagtcttaggatctctgttttaatattaatgctggtcaattttgcttaaacttcaacaacacggggtataatgaggcacgtttgacctcccttcccctcatagcctgaaatagcttttaggttttctttaggatccccttggccaatcaggagagagggtccgttaagtcagatgggaggcttagaatttcatttttgttttacactgttatgaacacacttgtacaaatctttttgtagacatatatttttatttctccttggtacattagaagcggaattgctgggtcggggataaatgtatgtttagttttataagaaagcgatggacctttttcctaaatggttataacatttcaaactcccaccaaccatacataggtgttccagttactccacatacttgccaacatttagtgctgttgtttttaaattttttaaagccattttggtaaatgcgtagtgggttttttgtttaatttcttgaatatgtaatacattactgaaaccatctttgtaaaaattatgacaatgagaaaaatatgacatagaacaattatgacagtgaaagaggtctgacctaactgaccccatcttacctttaacctctaagctgcccttgttcattcctgggcctaggctgagctaactataagaggaatttaacttatagtttaactttagaaccgagatgataatagtcctaccccaaaacaaagccctttcttgcttggggaccagactgcctttgtaaaactaataaattagccacaagtttagaaattatggcccaggagtcatgcagtcagaggccaccagattcctaacctcctcaattgctcctatagataacattactattgtaagacctaagacgattggtgttcaaagaatttttatgactgcattctgatgaaccagctgttgccacccagaatggtaaactggctcatctggtcttgtgcccccaacccaggaactgactcaaagcaagaggatggcttcctatgatttcatccctggcccaaccaatcagcattccgcattcactagcctctgtttgccgaactatctttaaaaaaaatcctagcctctggtccatgtgtggtggagcatgcctgtagtcgtaactctttgggaggccaaagaggtgtcgatcacttgagctcaggagtttgagacaagcctgggcaacatggtgaaaccccatgtctacacaaaatacaaaaattagccaggcgtggtggcatgcatctgtagtcccagctacttgggaagctggagtgggaggattgcttgagcccaggaggttgaggttgcagtgagccgtgatcatgccactggactccagtctgggagacagagcaagatcctgtctaaaaacaaaaaacaaaaacaaaaaaatacaaaaacaaaaacaaaaaaacctggcctctgaattttcagggaggctgaacttagtaataataaaactctggtctcctgtttagtcggctctgtgtgtattaaactctctattgaaattctcctgtcttgataaattgattctatcagggcaagaagaacccatagggcagttacattgtgatctttctctgattaaaataaaagttttactttctcattacttccggaccttagtatcaatcactcaatcacataaactaaagcctgcatgtgattttggatattatctaatttatctaattttacaagtgaagaaattgatgttcagggagcttgttcaagtatacaccaagaaggctatagcatgggaaacctcctagccccagctcattgctctttctactcaacaaagtccttgtcatttaatgatgtgctttccccctttgctgatgacaacctcttcttgcaaaacatcctttatttctgacttcaaaaaaacaacatggctgaccaagagggcaaatttgataatttgatatatatatatatatatatatatattttttttttttttttttttttttttttgcatcagggtcttgcgctgtcacccaggctggtgtgtggtggtgtgatcatggctcattgcagccttgatcacttgggctcaagcagtcctcctacttcagtctcctgaatagctgggaacacaaccacacaccaccacacctggtggctaacttttatattttttgtagatacagtatctctctatgttgtccaggctgctcttgaactcctggcctcaagcaatcctcttgcctcagcctcccaaaatgctaggattacaggtgtgagccactatactcaaccaaatgagattttttttttttttttgagatggagtctcgctctgtcacctaggctggagtgcagtggcatgatctcaactcacctgggaggcaacctctgcctcccaggttcaagcaattctcctgcctcagcctcttgagtagctgggactataggtgcacaccaccatgcccatgcccaactaattttagagacaaggtttcaccatgttggccaggcttgtttgcagtggcgtgatctcaactgaacctgggaggcaacctccgcctcccaggttcaagcaattctcctgcctcagcctcctgagtagctgggactacaggcgcacaccatgcccatgcccaactaattttagagacaaggtttcaccatgttgcccaggctggttttgaactcctgaccacaagtgatctacctgcctcagcctcccaaagtgctgagattacaggtgtgagccactgtgcttggccctaaaatgcaatcatttggaataaagttttaatcttttctttgttctattgattgatgactataacgctctaacaaggatttatccatcatttaggaaatgacttcatgaagttgttagggactgataactgggtgagatgaagcccaggggggttctttcctttctgtgtgtcaaacattgttttttgaagtctaacaacaatttacacaaattttctaatgactaatattctcttttcttataaacttgttaaaaattctttataaagggaaacaattttctaatagacctgtgttctatctgaagaaacctttcaaatgtacattgtttaagggaaaaagttttaaagtttgaagagatttaaagatgagaattttaagccaccttatcacagagaccctaaccaaatggcattaaaaaaaaaaagtagagcattacctcatacactcaattaacatctgaattaagggaaacattcacttgtaggtggggaaatttttattagcaaaacttcactgacattaaaaaaaaatcctggaacacgtgtatataagtttcagctttctgtgcatgaagcccttcacttcatctcattcctagtaaataaatgatctccagaaaagtatgaagacacagtgctgggtgtgtccaaatgtgtcttctttgacatcttttaacaaaaatccatacataatgacttgtaattttacaaaatttactaggcatctatttatgtattagaggtgagggtttaaggatatgttccataagaaacatagcaatatagggcagggatagtgactgacacctgtaatcccagcacttcgggaggctgaggtgggtgggtcacctgaggtcaggagttcaagaccagcctggccaatatggtgaaatcccgtttctactaaaaatacaaaaaattagctgggcgtggtggcaagtgcctggaatcccaggtactcagggcgctgaggcaggagaattgcttgaacccaggaggtagaggttgcggtgagctgagattgcaccattgcactcgagcctgggcaacaggagtgaaactccatctcaaaaaaaaaaaatttccagagttggtgttgttcacatgcacttgaccataaatccccctaagatggatccttgaaaaattttagacttggactaagtctataatgattcataaacataagggaattttataaaataacgaatgagagcatcttctacatgccagtcaatcctgtagctccaggtatatagagacggaaaataccatctctgcccattggttaagcaagggttttggcaaggctatggagcaaaaggaattcccatacattgctggtgagaaagaaaactgtggtaaccccattgaaaaacagtttgtcttaaaaaatctttttgaagacagagtctcgctctgttcccaggctggagtccagcagtgtgatcatagctcactgaaggctcaaactcttgggctcaaatgatcctcctaccttagactcccaagcagctgggactataggcacatgccaccacgcctgattaattttttatttttattatttttagagacaggatctcactatgttggccaggctggtcttgaactcctgggctgaagcagtcctctcatttcggcctcccaaagtgctgggattacaggtgtgagccactgtgcctggcccagtgtggcgttttctactaaagctgaacacatgtatactctgtgagtcagcaattctttctcatacgtgtccctgagtaatgcatgcatacatgtgccaggattcttgtaaacgaatgttttcagaagcattgtttattgtagctccaaactgggccatcaactttagaaagaataaataaattgtggggtatcacacacaatggaaatctagacagaagagaaaataaactacagctgaatgcagtaacatcctggaatcttaaacatggcattgattgaaaggaagacgacaagagagaacacccacaagatgaccctatttctataaaattcaacaccaggaaaaattaaactttatttttaagcatgcatacaaagctagtgaaactataaagaaaagtgaagaagtgattaccagaagggaaaggacagtagttgtttccaggagcatgtgagcagggtatggctgaaacaagacacatgaggtttcaggaagtgctgatttgcatgcagtttcacagattttcaaaaagtaatgattcaatattctgtatatttattttatgcattcttccatatgttgctgtaactgaaaaaatttttaaaagatcaaatttacaatcccaccttgaatttagagtgataatgaagttaaatgagatttggccaacagggctaggaaggtgagaataagtcctcactccatggataagtcttagagggaaaataggaaattagcagagaaggaaagagctgtctaggcagaggcaagactcacgctaaagtcttctttgtctatttcactccttcggcactgcaattcttccctctactccggccctccaggtgagtgtgagggtttaagaaatggggcccccaaagcaggtcagaggccagaatatgttctgttcatgtttagaagatttactggagagtttttggaagcaagaacatttttgttatgaagtaaaaaggaatatctaagatatccctccggccgggcgcggtggctcacgcctgtaatcccagcactttgggaggccgaggcgggcggatcacgaggtcaggagatcgagagcatcctggctaacacagtgaaaccccgtctctactaaaaatacaaaaaattagccgggcatggtggcgggcgcctgtagtcccagctactcgggaggctgaggcaggagaacggcgtgaacccgggaggcggagcttgctgtgagccgcgatctcgccactgcactccagcctggcaacagagcgagactccgtctcaaaaaaaaaaaaaaaaaaaaaaaaaaaagatatccctccttctcccttagaacaaggaaatacaaactaacggaaaaaccaaggaagatgtaaagaaaagaagagaaaactaaggaaaacttgagaaaattgaggcacagatacaaaggggaagagagagaagggaatgagtcaggagggaaacagagaaaagagattaaagacataaaaagataaaagtatcgggaagcattgcagtgtgaaagggaagaaataagcaaagaagactttggaagctgcgttcttaagatctctcttagatgaaaaaggggagagataaatgagagaaaagtaaaaaagttttagcagaaaaaaagagaaatgatcagaaatgtttaatagaaacatgaaaattagaagttcatggggcaaaaataaaatgtggcttatttttatttctctttcttaaaagagcaaacatttgcaggaaatcaaaagggctcaaatttcaaagatcaacaaaaccaagtgatgggaaaagcctttataagagaaactagaatggcataagaggaatcttaatagtttgatcatttaaacaggctaaggtaaatactcacgcgaaagaaccaaaaactttgtaagagttatgatgccagagaaaataaggaagaagaaaaaagtgaacactgttacgtgttctaacttgcaagtctctttccctcttactctgctaagaataaaagaaaaggcggaaggaagagatgaaaagggggtcattccaactcattaaaacagggaaaaaccaactattgcagaaaggaatggtgagcctggtaaaagttgggaggaggatgggaaattgcaagaagagggttgttaaagttatgagttcattttccctcgccccctcatggtaccatactcactcgactggaaaggcaagtttcactccagcaaatgaagcagcaaggaagtgacttcacaaaaatcttcctctgctctagggtaatttgggcctttcatgatttaactcagtctaccacatcttgacctagttgaaaactgggtcagactatttttcttgaacggaagcctaaaaaccaccctcccttaaatgaatttatatttttgcagtattgtctatactcagtttctcttttacctttttggagatgctaacaaaaattactcaagccagttaaagaccctggacccagaatccatcgacagaggaaaaggaatcagggatttcataggaaagttggaagatttgctttcggtccttctcctggtggggcactgggtgttaatttaagtgacaatcagcccatttcagtcatgaccttcctccctctctgagcaattactgaggcacagaagaactccattttggctcaaagagtttgtaaaccaaaaataaaattacaaggccccgccaaccatctgaatggacccctcttctcagacaagggcattccaaagttggttcaagccataatgtgaagggagggttggacatgccacattacaccctccttccttttggaattcaggaaaagccaaccagcattaatatcgacacagaccttgaagtctggtaagaaatatttacaatctattctcttggaagcctgctacttagaggcttcatctgattgataaaactttggtcttcacgaccccttatcatcctaaaccagacacttgtttctattgattccaggtctttagataataactctttcaaccaattgtccatcagaaaaattttaaatctacctataacttggaagccccactgcttcgagttatcctggctttccggactgaatcaatgtacatctacatgtatttgattaatgtctcctgtctcccttgaatttataaaactaggccgtgcctcgaccaccttgggcacaagttcttgagatctcctgagggctgtgtcacagaccattggtccctcatatttggctcagagtaaatctcttcagatattttagagtttgactcttttcctcagcaatttctatgaggtgtggaagaaaggcgtcaggagttggggaagagaagagtgaggaataaatgaggctgcccagttaggttaggggcagggactcccaggacacattgaggagtttgggaggatgataaaaagagtggcaatatgattaaagcagattagaagaaacaggcgtggctggtggagggatgtgagagaaaactggccagagtgggaagcaaattgattcttgatgagtaaatgcatcctggccaggaccataaatactccctagagtatgattactcatgatcttttccccatctggctggttggaataggtataatccctaaggaagcttgccagatagaataaaatagaggatacctcattaacttcaaatttcagatgaacaacatattttttttagtgctattatgtcccaggcaatatttggagcccacttaaaaacaaacaaacaaaaaaaccccacgtgctgtctagctgaaattcaaagctgctggggtgtcctgtatttgatttgctaaatctggcaactgtatccccagggcaatcttgggaatcatgagaaagtagagcccaaagatgttgctgggtctcagagctgcaagagaagtgcacaggaaggctacctagatgttaggacttctgacttccaaaactataaaagtataaatttgtattttaagccactaaaatgtggtaatgtgttacagtgacaataggaaacgaatacataatctaacacattttttcctctttttctttgtctaccccatagatatagacaacgctacacttggaaagcagaacctttttgttcattttcagaaaagaaaactgaggacataatcactatttccatttgtagagtaactcttggcattctttccttgacactatctacacactttcttatctttctcttcctcttcatctaattctctccctcttcccaattctttctattcctgtttccattgcttttcttttctctatcaattacccaaccatcatcatcatccatccatccatccatccatccatccatccatccatccatcatcctcttccctgctttattttcattactctaaaagagtacttttcaagttcactcatccccacttccccaaaatacttgacacattttatccttcatccttcctttcattatgttgtgtcactagttatagatccatttgagtaaagaaactttccttttaaaaacacaataccggccaggtgcagtggctcacgcctgtaatcccagcactttgggaggccaaggcgagaggaacacaaggtcaagagatcaagaccaacctggccatcatggtgaaaccttgtctctactaaaaatacaaaaattagctgggcgtggtggtgcacacctgtagtcccagctacttgggaggctgaggcaggagaatcacttgaacccaggaggtggaggttgcagtgatcccagattgtgccactgcactccagcctggcaacagagtaagactccgtctcaaacaagcaaacaaacaaacaacaacgaaaatgcaatacctccagtttgggtgtcaaatttcagcatgcgtctggggcacttgtttaaagccagtatttgggagatactcattgtgtaggtctgtgtggggttcaggtgtttatacatcagttaagcactttgaaaagtgatatgcagagaccacctgtttgcaagactctgggatttcacagattgctttttaaaaagttgtgggggatgcacagcagatgggggttgaccaacatacagtttccagttctttatcagagcaaagtcattacaaaccaatgaaaaagcaaatgtgccatcatttcattaaagaaaggacattttaacaccataaatatgggaagaacaattttgttataatgaaaaactcatcttaagaaagcccaggaggtaaaactatgttgatatataaatttttaaagagactatattaaggaattcagatatcttaccttacttgggcttattttttgtttctttatacaagcttgtcaatttgcacatatatatttggtgcagtgtgaaatgaagtgacaatatcctacttcttcctggatttcatttttatcagttattgttaaaaatctgttcctacatgcatatgttgacagaaatagaaacaactttcttaaagctatttcactcaatctaaaatattctgaataaagatgaagaaggaaccccatggtttcagccatttctcctgcttttcctcattctcagtaaagatgaaagctgatctggtaggtgatttgcctgattagcaaggaaaagagccagggctggcccccagggagcttagggctgaacatctgaggctggagaagagaagcctggcagaagaaacctcaccctagatagataccacgccattgacttttgttaggaagccacttttttttattatgtttggaaaatgtgaggaaaatttgccagccagtggttctctggagcacatcagaattgaagcagggtttttctcaaccctttcactggacttggaagaggggtgacccgtttacttggcctgccatgctcaacctcttgcaggaggaagcacatgagtgagtgagtgtaggatccagccggccactttgggcgctggaaggagcagactccatgtgggccatgcagtggcacccaggtgggtgttcctgcaaccctaaagtcccagagggcatgttacagtgccctcatcgctccaccagtgagagcaaagggccagtgtgatggccttttttgggtacctgcactaggtgagttccaagatcttatctggcatctaaggagaatgaggtagcatggacacctgaaggatggtgaaggcagagaattttatttagcgacggaaatgggtctcagcagagagggaagctggagatggggcaggacagacaataatctcccgaagtccaaagttaagccatttctcctctgaagtccaggtgtccctctgaagtcaagtcacctttctccagtcaagccacttctctctttctaccgactaagtctggggtctttacaggcacaggatcgggggtggggcaggctgtaggtagttttggaaaaggcaacgtttgattggtaaaaagacattattcagaaagaaccaattgggagagagcaggcaaacagggatagaagttctcactttgggtcatgggtttcaggcttttcggctcaaaggtggagtttcagtggggtcctgcccctgtctacctagaatttatctgcctcctgcctctagccaaatcgcctgtattgcttttaaaacagttacttgatcctaactcagacctaaagggtctgagtttctgggaggtttggcatgggtattttatttttcctaaaccatacaaatgacctcacctttgttaagaatcttgccatgcatcaatggttcttacccctggctgcctgttacgtttactgggagaagtgccagggccttacttaggaatgctttgcgtgggaatatctggctggggatgatggggctggacatcagtggtttctaaaagctctccagatgactctactttgcacctggggtaaagaatttcaggggaaatatgcttgtattcacataattgtgcacagtttcaggagctcagtgtaaggaatcctgcacgtcacagtttgaagccagtagtcagccagtctttagtgtgactgaataaatcacggggcttcctcaggtggcacacccagggcaagcattgtgatactaactaatgcttcttgaggactttctgggtccccagccccatttgaggggtttcaacttattgctctgtctctcagggacttaagaaggtcagcatttttattaacctcattttacaggagagggaatgaaggtcaaatcaattgtctggattcatgccctgagtaatgatgtaacctggctcagcacttatccccttaaccagaacgctgggcaggaggaagaagagcttgtctgggaaagggtttggaggggattgttgagaaggaaagttaatggagaagctcccagcatgttggcaagtaagggtgagtcagctttgctaagtgcagaagctggtggaaaggcacttgggaacatccctgggtgggaaggagagttggtgcatgaagtttgtttgatcaaagacaaacttccttgtcctatttcaaaaattccccagagctttgtacccaaaggagaggacgaagactgtttttcggtgtgaggcatgaggcacgtaagctgtaaagtgctcttcagtggtgagctcttcttattaccatgtggccactcaaagaaaagtcatttgaatcgaaggtatagtattacacgttcagtctctggaatgagggcagtcatggccctttcctttgtgttgttccgaccacaccaagagaagaagccatgctttggaaggaaaaaagaagatcaggaaaatgctcttacaggatggagtcataaagatgaaggcactggaaactgtggtgtgaggaaccagtggggtttcgaggtgatcttaaaggccatgtaaagctggcttccgctgggctgtcctgtagaagagaagttagatatgccaggtacagttccaagggctaacctggtaggtagaggcaggaggttttatcctattagaagaaagctatctatctccaactgtcttgagaagtgtattgtttgttaccagaaagaaccaagatagggtgaacattggcttcaaagagagtgtacctttcaaggtctttgtaactaacattcagtagttctatgatgattcctcagcctcactcagttacggaacaagactttattggtttattggcgttgtgctgagcttgagtgatgcagtggtgaattcgttgacttggcaggtaaaggagacggagaaataaacaactccattcctatacttactccaaaacccaggtagtgagttcagattctttagcactgtgtttcctatttatattttattttattttttgagacaggatctggctctgtcactcaggctggagtgcaatggctccatcttggctcactgaaaccctgcctcctgggctcaaatgatcctcccacctcagcctcccaagtagctgggaccacagatgtgcaccaccacactcagttaatttttatattttttgtagatatgtggtttttccatgttccccaggctggtctcaagcacctgggctcaagcaatcctccctcctcggcctcccaaagtgctggaattacagtcgtgagccactgtgcccagccttctatttatattttagagttctctctctctctgttttatttttatgtccctctttctttacatttagtatcttcttttcctcttctgaagccatctgtctcttagttattttttcttgtatctcctattctttcacttattccattcctattaccattaatatatgggtgtactccacttatataggtatatatctaaatatctgctcattgtttctatattcctggttacaatagaaaaatcaaattagtatagtctgcaaatatttaagcatcacacataactttcatcaaacccatgacatatttcaataaaagagaaaatcatcccttctctcctccaaaccagttctctgaaaggagaacttccttcctccgccttagtcatgggaagtactgagaagtttataccagaaaatacatctaacattgtatattttgttactggataatgaatagctttcttgttctgcctagggttatcaggtgccaaacatttctagaacagtagcctcagtaggacagccaaccctgacaattcattgtttaaaaagtgggggtttccactgtgaaaaaacgatttgaatttttttcttttcatgtctataggttaaaatcatgcgtgaattttgataataagcatttcaatatagttctgctttaccataaaagtggagagcatgtaacaacatattttaggaacattaacttgaatacaaaaaaataaaaaatccctgtaggcaatagcacttcctgcttcaagaaagaaataaatcaaggtagtagtggaagcaggaggctgcatatgaacacagttctgttacctgtaaactatgttcaggtacatttaaccatacgtttaaacagtgatatagtccagaagttttaatatgatattggccctgtattctaaaggaggttttaccccgataactttctacctgcaaaaagaaatcagaccccagttaggatgagattttccctggctttgtgccctgctagataatagaaattctttttttatcattcctgtaatgttgcacactttttactcattgtatccctgaaaaagatatggccagttgtctgactgccacagagatcatcaattgttaagggatagggaaatgacatttcatgatttgtgccaggtactttacaaggtggtttacacctatttcttgggataattcttctagctacagataaacattttacacatggagtactgaggcttggctctgagaaggtcagtaaattgtccacattctcatagggattaggtagcagagtaggaattggaactcccaccattctgatcctaacacttcttttttttttttttttttttgtatttttagtagagatgggcttttaccatgttggtcaggctggtctcaaactcctgacctcaggtgatctgctcgcctcggcctcccagagtgctgggattacacacttgagccaccactcacggcctcctaacactcttgaacttttcatcacagctaagaacatagctcagatttgggtttaaacaccctgctcccattctttctcacagctcagagaggacttgggtgggaaggtcacataaaaaacttgagctggaaggatgcctcagaaatgtagtctttggtttctcagcctccagcttgcagtggagccaagtccatgggggttgggatggagctgatggagccaaagtccaattcttgccatagaccaaagctttgaccacttgacacccatgtgtccccatcttcccacacttaaactttcaaaccacaatagcaacaaaaaaatgctctcttgatggcaataaaaccatccctcatgcaaatgagaatacttttttcccaaagcagggaccgcaaatgtcatcagttgcagcgttcatctctggggtttagtccttctttctttagtttaaccacagtcctgtatggttttactataacctatggacaaaattatgaagttaacacccaccaaaaagcctcatgtaaaatcgtgttgcaggacttttccttaattcagctgaagatggggttcttcgtcccacagccatgaaaatttaggctcgccgacaatttgaatggtaagacagggttttatggctgggcgcggtggctcacgcctgtaatcccagcactttgggaggctgaggtgggcagataacctgaggacaggagttcaagaccagcctggccaatagactgtctgtatctctactaaaaatacaaaaattagctgggcatgaggatgggtgcctgcaatcccagctactcgggaggctgaggcaggataatcacttgaacttgggaggtggaggttgcagtgagccaagattgcaccattacactccagcctgggtgacagagcgagactctgtctcaaaaaaaaaaaaaaaaaaaaaaacaacaacccagggttttactgggtaaaaaagttagaaaagatggaaacaggaactctcagctaggccagggtccccgttagaggacttcctgctcagccattcgaatcccagtttccacacaggaagaggacaggccaggctcctccctgttgcaaataccatgaacttgtgtggctcctcccagtgttcaggccggttggagaggctggagattctctggggaccctctcccacctggctgtctcaatagtagaaaaatgggagagagaaaaaaataagacacagcgtggaaagaagaaataagtttgctataacgatgaacagtgttcatttccgcaactgatcatgaagtttatttggtatttattgtgtctatttcctcctccactgccaattctgtgatctctttgccttcagcaggctagggtgtttatttaggggggggtcatccaaaccttcctttgtgaatggcatgaaccctaggaaggtccttgtcatgttggttcccatggtcttccactgacttttaccacctgacatgacaagatttctgggtttgaggaatattctcccatcaactgtatgatttaacaggaactccatttccccttgataatcagtctactcttcccagtcaatgtggtaaatccctcccctgctttttttttggattgtttattcagggacaaaaggaacctgaaatggccaaagggtagcttttagttacgggaacacgggtgtgtctaatggtggaataattttgttcttacgatctcagacgtctgaacaagcagaatcacagtcgaatagatcatgatcagacttttttgagtaaattactgggtggaatgtgaagagatgccactcacattcccaccattggcatccagaacaacgtgttctgaccataggagagacagcacccaagatggtcgggtgctggttcacagcaaaaaaaccacatcaagaacaacacaccccaacctaacaaatattgcttttcttttttttttgagatggagtctcggctctgtcacccaggctggagcgcattggcgcggcctcagctcactgcaccctctgcctcctgggttcatgcaattctccttcctcagcctccagagtagctgggatgacagatgtgcaccaatatgcccagctaatttttgtgtttttgtagagatggggtttcgcgatgttgatcaggctggtctcgaactcctgaccttaagtaaaccacccgcctcagccttccaaagtgctgggattacaggtgtgagccaccgcacccggccaagtgttgcttttccactcggccctggagctgagtgttctataggccagttgctcaggcaaggtatgtggcaagagaagagaaccatttgactgccttgattcttgtgagaaacaatattgtttggataccaggatgatggacaaggcagattgtgttgcaggagggagcatagcaggcagataaggaaaattcttttatttgagacggagtctcactctgttgcccaggctggagtgcagtggcatgatctcggctcactgcaagctccgcctcccaggttcacaccattctcctgcctcagcctcccaagtagctgggactacaggcgcctgccaccatgcctggctaattttttgtatttttagtagagacggggtttctccatgttagccaggatggtctcaatctcctgacctcgtgatctgcccctcttggcttcccaaagtgctaggattacagatgtgaaccactgcgcccggccagatatggaaaattcttatctagcataagtctttttcactgtgggcaattttttgtcccctttgtgatgagcagttccaacacaatcaaccttctggtgggtgtcagcctggctctccagggatggtaaaagaatgggcttcaaggttgattgctgctgcaggcaatttggatgcgtagcagtgcaattggcaagccagcccagtggcaatagataggccagccttggtgacaaggaatcctctatgggccatgtcttacctttattccagcctcttacactactttattaatgagcccattgagcataaactggggttggtggggaggaggctgactgacagccagtgtggatttatttatttatttatttatttttttgagacagggtctcattctctcattctgtaactcaggctggattgcagtggcacgatctcggctcactgcagccgccgcctcctgggttcaagtgattctcctgcttcagccttctgagtagcttggattacaggcacatgccaccacacctggctaattttcgcatttttagtttcggcatgttggtcaggctggtcttgaactcctgacctcaggtgatccacctgccttggcctcctaaagtgctgggattacagagatgacccactgagcccagtctctaatcacttcttttactaattaatgattgggtaggactcagtggtagttttaactaaagtgatcgaaacgggaagtacgttttccaaatcattagtgggcgagaacagattctgagcagaattttcaggtgggtctgccaaagcaacactgcagaactgttcactaggcctgtggctgactctgctatgatcagggaatagggaactgggacaccagcacacagctgatggctgtgggccacaatctcgctggcattctgaatggcctgcacttgtcttgtcaccatccatgatgctagagcccagctgtggagagctctgttagagctgctgcagaaggaaacagactacccccatgatgaccgggctgagcttgcctgcggcagccctgactctacctgccaatgctgcttctgcttcccagatggcacgggcatcacctgggtgttgcctgcttgatgggaatcaggccacacgtggaacctgggccctgaagctgtctgcggtctccagcaggcactaggcccactggcagggaaatgaaacagaactgaatgagccaaccaaagctgccaatgtggccatgtcagagttttggaaataaaaggacttaactgataaaatatgaggaaaaggggaaagggattgttcaggtgggctttgaagaagaaagagatggtttaggaaaaggagctgctacaaaggcagagttggagacagaaacatggaactaaaacataagagagaaagaaaaaagacagaaaggcaggaaaaagcgaaaggagcttcaagacaaaagggagtgccaacagtctgagaaagaaagaggaggtggagaggatctggaatccccctttgggagagtagccaaggtttgcgcagctacaccttccccccattacctactactgttgctcttttgagatgctgggcagtctgtgagatttatgtcctgggaacaaagttaacagaggcagtaacaagcataaaaccataggctttaaaagtttttatcattttaagtatttcctgtatatatttccattgaaaacaagaaataagaacaagctgatctttccctttctgctttaaaatgtcacttttcagcaagcacatattcagttcagttgacacacacaaagccaaaatcctggctgagacacattcaagctattatcatcttggaatttgttacggtaagtcctgcagggactgtgtggtgttgagttggcacagacgcacctcagagaagcagtagtataaacagttctgtatttgcaaaaggaaataagaaaataattgaaaaagtaagaaatttagaccaaggcaagtaaaattggctaaataaagaactatttcaaaatggccttaaacagagagggcgtatcaagctgtgctcttctctcaaagcctcaatttgtcatctgtaaaatgggaacaatggtccttactgcatagtttttgtgaagattgaagcagatgatttgggtgatacaattaacccagagcctggtacaaagtatgcattcaataaatgttaattattatcattgttaccattgctagcatgtttggtgtcatggcaaggagttctctctctctctctctctttctcggagtctcactctgtcactcaggctggagtacagtggcgtgcaatcttggctcactgctacctcttgcctcccaggttcaagcgatgttcctgcctcagtctcccaagtagctgggattataggcgcccaccaccacacccagctaatttttgtatttttagtagacatggggtttcaccatgttgctcaggctggtctcaaactcctgatctcaagtgatctgcctgcctctacctcccaaaatgctggggttacaggcgtgagccaccgcgcccggccaagttatttcaaagataagttttaggtagctaaaaggaaagagtttgctcaatacttaggctcttttgtctggcctaggctctgggctcccttcctccttccctcccttccttccttcatttcttccttccttccttccttttctgaatattttgttgtatttattgtttattttattataaaaagttttatttttattatttgtaaaaatttttgtgggtacatagtaggtatatatattgatagggtacatgagatattttgacacagcatgcaatgtgaaataagcacatttcagatgtctctgaggattggaaaaaaaaagcacatcatggagaatgggttatccatcccctgaagcatttatcttttgagttacaaaaaacccaattacattatttaagttattttaaaatatacaattaagttattattgacctacggaaagaatgtaaatgctcttataaaacaggtgtacacttctgccccctactggcagtgagctatttagcagataaataaccttgacctaattgcaacaatccctcgatgtggtattttatttggaatagatggttagacatattttgcatatcaacacgtattccagagttaaacaatttagttatagaagtggttaattccgttacgataatgttcaacgaaaaaagattttaggtgcctagaaattgggtatacagcccactgtatatatttacatcatttgttttatacaatagccccatgaggcagatagtattattatccccgttttgatttgagcaaatcgaggttctaaaagggatctgctagtaagtggaagaactggcattcaaacgtcaagctcctctgactcacatttgtgtcctttccgggcaggccatcaggcctccctaaagaggacgaactcatcagcaacatcaaaagtctgactcttggcaggtctgatgtaattacacattgcaccatctttccctcacttcattttcattgaaaagcaacttgcaaccaagtacactagaggagagtataagctcatgagggagtgtggagaggtgaaggctttttgtgagcagggctagtctagggggagcctacaatgatcagctgccccctgggcacgtgtccagggctgggtggcccactgagaagtctggatagctcccaaagccctgccagtgagtggggcaaaggctggcccttgctcagcttgggttttctggctgcgggaatgcccccattaggcctggaggtcctggcagtgtgaaggaacaccctctaacccagagctgatgcctttccctaatctgcccaaagtcatggcttgtgctagcagtggcaccatataaagcatggcaggatgtctttacctgtttgcatgaaattcacaagcctagccagggcctttttctcaggcaaggcagagggcaccagtgatctgattccagtcaatccccagcaccactaccatcagcatatttagagaatgactcatttaactgggtagaagggagaaggagggagacaattagtcacagttggaggtaggagggcaggagagaacttctttggaattttgggatccaagaagagagataaatgacgccgagcttctttgaggtgatcctggaaatccagcaagcctcacaaagcagctttcatgcattgcagaaaggagtgggcattgagtggaaatggcagcctgatgcaggctggagagagatgactaatttatctgtcaaactggcaagtttaggtatttagaagttcactggaccccagagtggggcatggaagtcaccaagaactacaggttctttaagggacccagggccaagaggagagactccagaagtggcacacagcagactgtcctctgggggctgaaacagggtgcagtgacatttcagcaagttgctgcagtgaaggtggtaggaggcaccctgacaagctgaggagggcattataatgcaagtgggagcatagaaccaatgacaaccaaggctaataatttcagaccttttctccattaatccgcaaagggctattgtatcagatccttcaggagtttagagtaaaccctgtaagaggaagaaaaatcagacaagtaacaccgaatagaatggagttttcaacatgaatgaatgaaccatcactagggtcccgcgagtttacttgagagtggccagatgcagttgttggcatagggattggaggcaggcattgtacggtagggacattttggagtgtgtgatgtgaactccacatccagcacatactgttgcagaaaatcaaattgagcatgtggacaaggtgttcttcactgggtgaggctttagaacagctgacgtgggaggcttactgggtggcagaatgacaagaatcaaagctagagcaggaataagtgagtcgtggtgcctgagtgctgaatggaatgagcgaaaatcatttgcagttgagtaactgaggattagaagggcaaacgatttgcttaaaggtcatcaatgaaagggcaggattggaacttctgtcttccaacgagcaacccactgtttcatacctttccacatttatctttttgtgaaaacacacagacacacagcgagcacaagatcatggaaccatagaaacgaaaggaaaattttatctagtcctgtctctcagccgacttagtattatgttttacaatcatcttggcaaccggtcaaactgcctcagctagaacatttccagtgctgggaaattctcatacttttggacacagcttagtctattcatccattactggacaaactggcaatggagttctttatagggagccaacatctgcctccatgaatccaactctcttagccctgccctctagttctgcacataatcaatgacttcctcttccaaatcataatgaaaatcactcactaatcaaggacctatggtgtgccagtcacaaagggtggcattatgcccaccccagggtctctggttcatgttccagatatccctggtctttctgcacctgtatcgttcttctctggactgtctctagcttgggaaggtatagaatccattcttcccttccagatcctctaggccatttatttaagaaagtaaatctatttgggtccacagagaaagtagttatgattttaaaaatataaactaattttaatgtttaagccaactgtactaacactaattgatataattagcaaggtatacttgtcaaggatcacacaaaagattccaaattgcagttggagcaattgttgacctagatcatcaattgaaatggaaatgatatgtacatgccctttcctcagtttcaaacaaatttagcataataatgcttattattatcatcaccgtccctaattcttacagaatgtttcaagtgaatcaggctcatagtgacaactctatgaattggatacgatgatcatttctagctttttgaggaggaaactaaagcccagagaggtgatggaccttgcccaagatcgcatgtctagaaaacggtaggcttcaagtcaggcattctgctctaatgactcagtggcaaagctgtttatcagctgtgccagctgtttatcagcctgccatgtactggcattgacccatcagtgaatgtaaatttggtcacacctagaggtctctctcccactaacctacaatcatttcttcctttcttcttttttgttttgtttttttagatggagtttcgctcttgtcacccatgctggagtacaatggcatgatctcagcttactgcaacctccgcctccttggttcaagcgattctcctgcctcagcctcccaagtagctgggattacaggcaggtgccatcatgcccggctaattttatacttttggtagagacagggttccaccacgttggtcaggctggtctcaaactcctgacctcaggtggtccaccgcctcggcctcccaaagtgatgggatcacaggcgtgagccacctcacctggcaacctacaatcatttcaaactcacccgaagtctgattctttctgtgaataactcccttgcaatatttttcagaattagatctataacagcagcatgcctggtactagcaggtcctttatacacatttattgaatgatacaattagtggccctggccctgttagttttcaagtcccaggtaagatcagatgcttttgagtcctgctgtggggatggaggcaggcagaggaagagggtaaatggcgatgtctggtccacatgcccccaccctgatgccgttcctccgctctggggcctgctgtgatgaggtcacctttaaaccctgtgcacagcagactgctcctgcctggctctgagcatctgtgccttctctttctaggagaggattgcatctctctttttatctgctgctctcagtgaggctccaacaccagtgatgcagtcatctcactgaagttggttttctccaggagaagctgagccaaatggaatccaccaagcccagccgcagccggaagccctactcctcccttaccttgcccagcctcaaaaatacagaatctggatcccccggactgactccttcttccttctcctcctcctcctctttctctctctctctctataaatataaatatatatatgtatagatatactacatccatatatatatatatatattttgagacaggttctggctctgtcacccaggctggagtgcagtggtgtgatctcagctcactgaaccaccgcctcctaggctcaagccatcctcccacctcagcctcctgagtggcttggactacaggtgagtgccaccacactgggctaatttttgtacattttgtagagatggggtttttccctgttgcccaggctggtctcaaactcctgagctcaggcagtcttcctgccttggcctcccaaagcactgtgattacaggcgtgagccaccagagccaccatacatattttgattttagagactacctccctccccaactcccatcctcccaggtaccttctgattcttccctcagcctgatgtccactgtcctctctcagtgcattggagcatctgaaacccaattatgtagaaaattccagcttcttcccgtgttgtttctggttctcatttacattcgaggatgtggttgaacaatcaatttactgttcctgacaatcagggaagactgcctggaatacacagaaagacctgatcattggagatgaagcccaatttcactcacttcgttctgtccaagccagtgtaacctattaagctagcacagtggctctcaagcttcatcattcactagaatcaccaggaaagcacatttaaacatgggttgttggacttcaccatcagtgtttctgattcagtaggtcgggactcgggggaggcgaaaatgtacattgctgatgaattcctaagtgatactgaccctgctggtccgggaaccatgcttggagaactgaagcctagagtgacttcactgtattagcctggattggtttaggagattaaaattactgctactcattatttagtttctggttgttcaaggcaggtcctggtgggaatgtcttagttcaggcttccataacaagtaccgttgactgggtggctcacaaacaatagaaacttcttcctcacagttctggaggctggaagtctgagatcagggtgccagcatgcccttttattttgaaataaatcagtatacttttcctaagaacaaggacattctcttacataaccagtacaatgatcaaagtcaagaaacttaacactgataaaatactattatctaaaccacaatccctatatacagagttcatccattgtctcaacgatgccctttgtaagtaattattattctggttcaggatctatcatcactcagtgcatttagttgtcctttttagatttatttaatctcaagtatttctttagagttttctttccttgactgtcaacagttattttatacaatttcctcagtttggtttgctccgatgtttccttatgatttgagtcaagtaattcattttgggcaggaattccagagaattgctgtttttttttgtttattgttttttgtttttttttttaacagagtcttgctctgttgccaggctgcagtgcagtggcacgatctcggcccactgcaacctccgactccctggtacaagcaattctcctgcctcagcctccagagtagctgagattacaggcacgttccaccacgcccagctaatttttgtatttttagtagagatgcggtttcaccatgttggccaggatggtctcgatctcctgaccttatgatctgcccaccttggcctcccaaagtgctgggattacaggcatgagccactgcacccggctttgctgtgttctcttcagtgcatcgtaataccaggtaatatatgtcagtttgtcccactattggtgatgtcctccctgactcaagtgatcctttcacctcagcctcctgagtagctgggacaataggggcatgtaccacacccagctaattaatttttttgtagagaccggatcttgccttgttgcctaggctggtcttgaactcctgggttcaagcaatcctcctaacttggcctcccaaagtgttgggattataggtaagagccaccgtgccccacccaaagatcacgttttaaatgggtgccccacccaaagatcacattttaaatggcatgagcacaagcaataacataggtgaccaaaatctaccaaagactttctcatttctatagagcaaactctttgcccctccctccataagtccttccagagtgtcttagtggctaggagaaagtttgagctgggagagagcttggatttcatacggttccctgttttccaagtatgggatgcttactactggtgagaaaaagatgattttttttttgcacatttatattgggttaaattgtgtcacttagtagcaaaggctttgccatctcaacaatcttttcaatcttctgaacacatcaagtaggaaggctcagttgagtgctattccgtcttgtagcctgtcttaacaatctcaaacagttgctaatttccttccttcccttcctccctccctccctccctctttctttcctttcttccttcctttgtttacaaagaaagggatggttttgggttcagagtctttggcagtatatagtaattagtatatagtaatatagtaatatatagtagtatatagtaattcaatgcctttaggtcaatatattttccatttttactgtgcatacgcatatatacaatgtattttaaaagttggctttacaatatgtagttttatcatttggtttacaactaaatatattgtgaacattttctcttctacaacagttaaaagaattgcatagcttggaggaaacataatttattaagcagtcttgttggggacattgaggtataattttttttttataaggagacttcattctttttacaacacctttgggaaaaaaattggagtccttgtctcatatagctttctatagatgacggaaacttacccttccatttagccttttaactttcttctctacacccacctaatcaccatcaagtaacccattttatgttttccaacctctctctcccatttgcttcctctttcctacccagtctccctgcatacatgcagatgaacttccattccttcagccctctgtttcctccccttaaagaggctttctttccatttaaagagactattttaattgatttttatcaactctactcaaaactgtatcctaaggtccacattaggattggtctttaataatctgaagataatattcaattgtttaaaagaacttttaagaagaccttggtagaattacatgtatcaagaaacatgacttaggcacaatggagatatggctgactttcttttgaaaaaagaagtagtttttgtggggagggcagggcaaagaggtaagaagtatttggtactacaaggaaatgttagagaccattttggaaatgtattcattattttaaggcaactaacaaatgatcatctttcagttaggacattatagcagcagcctttactggtcatgaaatttgaatgatatctaaaatcatatttctggaaataggtcaatgtcaattaatagtaactttgtatagaaaggcagatgccagctagcatataaaagtggtgcatgcagacggtggtagttctggagtcctgggagccatgaggtgctcatccatcacaaggccatcacagccaggtagaaatgcctgaggaaagcagcggagctgcccgtgccagcatttacacatggaacacttcttgggcagccgggtgtcatggggcacagacccacaattctctttgcgtacaccgtgctcacagttccatccatagaaggaggggaggcaggcacaaaaggaccccagcatgcaggttcccccattcaggcagcaggttctgtttggctccttactgtcctgtatccccatggggggcacaagctgggaagaccgaggacgaattgcaggctcctcctggggctgaatgctgtcatctctgaaggccaggtctccctgagatggacgcacaagttcccgatggctcagcctttaacaagcaattcaacgcctttaaaaaattgcctttacttttacagttactggctgtttactgaaaatttcatataattttaaatttagaaataaaaacttcacagatggaattaaatttcatataattttcagtaaacagccagtaactgtaaaagtaaaggtaatttttaagattacattttactaagtgaagtaaaataagtgagtcaatctagagacattttaagaacttaaaacttaggtatggatctctggaagaggtaaggagagatatggctcatagttgcgcagataacacaggaatgactcaagtttgagaaattccagttgaggccaaattccttaaaggaaattgacaagctggttggctgactctgtctctccgcaggctttctcatggaaacgtggcaggcaaacaacgatgctggcaagaaattggacaagccgcatgaaggcctggagagttttaagcccaggttgagagcacaggtgtaggctttctggtgtaggttccgacgcacctgccttccattcccgcctatccatttaggctgcgacctctggtagttctccactttctctaattctgagttacttcatccttaagaagtggtgcataactcacaccttgttaggattgtatgagtatgtgtgcatacaccgtttaaagcaatgtagggcacagagtcaggaaatgcaaaatattaagttgaggtcatttttcttttgggaggacaaggacagggcacgggctggggccctagagtagtaattagcgatgggcttttcctcccagccttccttttgggaaacgcagtgtgctaaaaaagtgcatgcagcccaggctgtggcctaggccgtcggttcccggccatgcctagctcctctgaggtcgcccttagtgaggacacgaggtgccctcacctctttcactctagacacctccagaacactcgccccccgcgcgccggagccccgggtcgccaccaaccgcccgcggagccagacctcccagctctgcgccccaggaccgcgcggtgcaacctgcgcatgcgcacccgcgtcccgctgctgtttagccgtttccaaggctacgaagcccatcggccggggataagagagcaagaaaatgaagctcaagagcctcctgctccggtattacccgccaggtacgcaccagcccggccccgtcatccccacgtgggaccctgggctcccagactgggagggtttggggcggaggagggcgcagccactgaaaggcggcggggtccccaggtggggcaggaagtcgggcacttcccaacctgtgcccctcattccttcagatgctggactcttcctcaaaacattaacaattactcttttaggaatttaaagagtttagcttgactgtgcatgtcagtctgtctgcatttattgagtgcctactgcgtacacgctttgtgctctctgctatggacctttaaagaagttcatagtgcttgatttcaatgagtgaagtaattatgaaataaattacttaactattacttagtaacataagcaatacattaattacctaatccttgcctaactctaattttaggtgaggacatggtcacctttaaagaataagtgacacccattgatcacccagcttcttagggacagaaataggagtgcaattcttgggttctaattcagaactcgtcttctgaattagaaacatctgcaaaaaaaaaaaaaaaaagaaaaaaaagaaaaaaatctgcaaaacataccacaaggcagaagataaccaaatacacttgcccaatgaagtttggataggaagtgtcataaagatttcaaaggagggtaagatactttggaccggttttgttaagaatagctttatgaggggtgggacttgaatttcaggttgaatatctcacttttccctgcaacacatccaactgcttggtcaacatcgccgatgaggtatcgcatagagatctcatgatttcttttttccagtcccatcccaatcctgctgcttcctcaaactgtgccctgccagtagaaggcatcatcacccagcctgttttttgccagaaacctaggtggtcactttttgtttctctcctgtgatcattcactgcctcccccacccccccaacccccggcattccgttatcattctgccagctctaagtccaaaatattctgtgaatccatcagattatccctctttccatagcacagatttcttggtctaacatcccttccagctgccaacctagtccaaccctccattccagccaccattccctttggctgagccactccagtggcttttcaactggattcctggttttcaccctcatctcctacaatccatctgccactaggagccagtgggatctgaattcaagatctccaatagcttcctatcatgcttagaatacgatccgcaacctgtgggatttggctcattctgtgctgctgacttctaaaacttcacttgtctaccctcactatacttctgacttctttagcttgttcttctaagacttaagagagggcctttcactcattcgttttttggacccagctttccctagagctaggaaaagctgcttccttttcttcattcagtttcaatcaatgtcaaccacctgaagagactttcctacctattcaaagtagcctgcactgattttactctatgccataaagtgcttaaaaattatatttgtcatcatccaaaactctacttgttttgtttcaaatgtctgcccctttcccatttaatgtaaacttcgtgagaactaagatcttagtgtggtttgatcattgtagcaccctcagcttctagaagagatttggtgacacagaagatcaggaatgtttgttgaatgaatgtatggataaatggatgtgtttgatgagaggtcaggtatggaaattactgaaaataaacactgaaaatcttaagggatgctgcttctgcctccctggaagaccgatcctggacagctactttctccaatgggaagttgacatttgtagaaaagacatgcattttctccttcatagaattccagttaaaataatatgagaaagctatatatatgacagtatctagataaatttattttatgtaattaattaattaatttaatttttgagacagagtcttgctctgtcacccaggttggagtgcagtggtgcaatccaactccacctcttggattcaaatgattctcatcccttagcctcccaggtagctggaatcacaggtgtgcactaccaagcccagctaatttttgtatttttagcagagacggggtttcaccatgttggccaggctggtcttgaattcctcacctcaagtgatccacctgtcttggactcccaaagtgctgggattacagatgtgagccactgcatcaggctgagagtatctacgaaatttaaattaggcataggtagatagtatatagaaaatttaaaattaagactaatagtctgtttcctttaagtattccataattttcttttggctctttttgcccataggcctgtgctggttcccatagatgtaccaataaatgaagctcttgctttcatctctttgttgtggagtgtaggttaagaatatgagctctgggttcagaataacggcttctcaccatatacaataataaaaaaacttgggcaatttgttttattctatcaaagcatgggtacatggtgacaacagcaccacttcacaggtctactagacccttccagcttcttatcttatttgattctttctcttcagagtagagaaaatttttggaagaatactctccccaagtgctgtcctcccttcctatcatgttttcacgcggattgccccactgaaactgcccactttaagatctccaatgacattcacattgctaatctactggccaagccacagtccttgcctgccttgacctgacagcagcattcaaccactctgcttttctttggcttccaggacacatattctattttccttcctgtctcacgtcacttcttctgtgtctatcttgttggttcctcttcttctttttgattatttaatgttggagtgccccagagccccaaccttggatttctcctttctatctacactcatacactatgcaatctcatccattctcaaggcttaaaaactatcctgaactgaggtcaggagttcgagaccagcctgcccaacatggtgaaaccccgtctctactaaaaatacaaaacaattagccaggtgtggtggtgcgggtctgtaatcccagctactcaggaggctgaggcaggagaatcgcttgaatctgggaggtggaggttgcagtgagccaagatcacaccaatgcactccagcctgggtgccagagcaagactctgtctcaaaacaaacaaacaaacaaacaaacagaaaaacaaaaaacaaaccatcccgcatagtcctgagtacctgagtgcccacccgacacattcatttgaatgtccaccgtacatctcatgtgggggtctcccatggtcttccccatctcagcaaattgcagctccatttctccacttactcatgccaaacattttggactcttccttgtctctctctcatctccacatccactaacaaatcctgctagtcctgcctccaaaatatatgcagaatccaacaatttctactacctgaccactaccattctttttagcttgaaagcttccttccacccttgcccctcttcagtctatatggcaatgggatggctctgttagaacataaatatgaccatgtcactcttctgctccagccctccaatgacttctcagctcgtttaaagtaaaaggaccatgatccccaaggccctgcaaaatctcaccccctgttgcttccctgacctcaccactttcgacttttccctccagcaacactcctctccttggtgttccttgaatggggcagaggtgtccccacccagggtctgcagttggtgttctttctgcctcgaataatctacccatggacatttgtatcactagtgccccatatttttaaagtctttcctcaaaattgtgtaaagtgaagacttagatatctcctttctgagcatttctatcttcttcccatgatatttcacagcccctttccctggtttgtcttttctccttggggctatcttaatccaactcatcattgtttcactcatttattttgcttattctttcccacgagaataaaagattgacgaaggcaggaactttgtctattttgtttgctccttatctctagcacccagaggagagcctggtgcataaaatgacattaatgtttttgttgaataagtgagtttaatgagatgatgtgtgttaagcagaatgcctcaaactcttcctgaagtgtgaaagggccagataagtgatctttgatctacttcagctctaaatgcctaggattctctctttttttttttttgagatggagtctagctctgtcacccaggctgtagtgcagtggcatgatcttggctcactgcaagctccgcctcctgggttcatgccattctcctgcctcagcctcctgagtagctgggactacaggcgcccgccagtacgccaggctaattaatttttttgtatttttagtagagacggggtttcaccgtgttagccaggatggtcttgatctcctgacctcgtgatccacccgccttggcctcccaaagtgctgggatgacaggcgtgagccactgtgcccggccaagcctaggattcttaggctcacgtaattctcttgactcatgtttgcgactattgccttaatgcttatcttataatgaggtcatattacttagcatgcttgacatttaatttctgaattccagtctttggtgagccaaatcatatgcaagtttccaagatactactgaatagcaggtgggtgtttcaataatagcattatcagataggaaaaattattccactgaatcattcccgtgctacctttatcccttctgcatatagagcagttttgttttgcctcctaatcctctaattttcgccctcccactttcttttgaataacgtataggtcaggggcattgtcttgctgctatctactgaattatccctctccctacctacattcccaaaggctaaatgtacatgccagtgacatggctaaccaaacatgggacattccttttcatcttggtcacatttattaattcataagctctttgctttggggagagtgggtgttgactatgtgcttttcagctaactcagttatgacaatttttgtatttcatttattgtgtgaagtccatagttctcagaccaggagaaggaattaagtcaacattaactaaactagttaacattctgagcattttaaaggtttctgttgattgaatatataatctaagtaaagaatactaatatcatttgaagcatgcccttttaatatactgaaaaatttgaggaatagaggcttcttacctaagtgttttgggaattatatttattgaataatgcacaatcaagggaaaatcaagattattaagatactgtgggaaacagtcactgaagaaaagcatgtatttctggcagcatctttgtttatttatttttatttttgagacatagttttgctctgtcagccaggctggagtacagtggcacaatcttggcttactgcaacctctgcctctgtctcccgagtagctgagattacaggcatgtgccatcacacccaactaattttagtatttttagtagatatgtggttttaccatgttggccaggctggtctcaaacttctgaactcaagtgaggcacttgccttggcctccaaaagtgctgggattataggcgtgagccactgctcccggactctttgttttctgcttttattcttcatggcacatatcacagccttttgctcatattggagctcagtaatcatgagagggatgaacatattgcctagatcaatgttacacaacctttttggcaccagggactggtttcatggaagacaatttttccacagaccagggggatggttttgggatgaaactgttccacctgtgatcatcaggcattagttagatttgcgtaaagagtgtgcagcctagatcccttgtatgcacagttcaccatagggttcctgctgctatggaaatctaatgctgctgctgctgatctgacaggaggctgaatgagctcaggcagtaatgctcacttgcccgccactcacctcctgctgtgtggcctgggccctaacggccacagactggtactggtccagggcccagtggggtcgggggacccctggcctagaggttttgtcacagcgaagcagtcaaacgtacatgtttcaattttgtagtgtattctccagatccatttgtacagcatccccaccaatttttagtagtcagcttgaagacttcgaacctttttactttattacaaacaagtagtgaataaagaaagcagacttttgttaacttatttgctaaaatgttaaaaatgcatttccttagggtattagatcatactctgtggactgccaagtgctaattctttccaacctttctctgagttacagattattattttattgcttattcattgtgtacatcatttatttactcaagcatttatttcctcaataataaatagcacatagtaaataccctcatatataatgcaaaaaatctaaaattatagtacagaaagaaacactcccttgatgatagtgacaccttgcattgatacagaacttgtatgtttaaagtatgtatctttcttgaattttcaaatagctttttagggatcttgatcttcaagggtttatattctgataatgttgatcaactgggcatggtggtgcctgcctttaatcccagcactttgagaggctgaggcaggaggatggcttgagcccaggagttgaagaccagcctgagaaacatagtgaaatcttgtttctacaaaaaattaaaaaattagctgggcatagcggcatgggcctatagtcctagctactcaagaaaatgaggcagaagaatggcatgggttcctaggagttcgagactacagtgagtgatgattgtacaactgcactgcagcctgggtaacagagcaagactctgtctctaacaaaatgaagaagaaaatatgtcgatccctatcatttttttctattttcttgtttttctcttactttttaaatttaaatttaatttttttttttttttttgcccagggtggagtgcaatggcacaatctcaactcattgcaatgtctgcctcctgggttcaaatgattctcgtgcctcagcttcccaagtagctgggattacaggcatgccaccacacttggctaattttttctatttttagtagagacagggtttcaccatgttgccaggctggtcttgaactcctggcctcaagtgacctgcccgcctcggcctcccaaagtactggaattacaggcatgagccaccatgcctggcttctcttacttttataaaatatttatgtatagtcgaataatgaaaaatacatcaaggaatagctaagatgagcctcatccccctgaagatgcggtcatgccttgaaaggagccacctaacacgtgacagtgcctgtgtcttcaagctgctgatgtggaatattatcagtctttgtaatctttgctaatttgatgggtaaaacttacatctattttgttttttattttttcttaataatgaagttagggactttttgttttggtttgtttattgatcattgtctgtctttgtaagttgaccgctcctgacttttgtccaattttctttttaaaaatcatttttgtagttctttatattaagttcttaaaattttgtggttatggttgaaacttctttgctgattattatttgcctttaactgtgtggtatcttttattgtacagaagcttataatttattttagacgaatttgtcaattttttcttttatagctattgtatttcatgtacttacaaaggtgattacaggcactaagagacaaatccattatattatctagaatattttatattttatttttaatattaaaatttgtaatcaagctggaatatttttgtacattgtatgtggcagaaatctattttattaacttttcaaaaaatccaactgattattacatcatttattgaacaatacattctttctctgttaatttgaaatagtattacatcatttattgaacaatacattctttctctattaacttgaaatattaccttcactttatttttaaatgttgatgcatagatgattttattatattgatctaattttgtatcaaaaccacactttattgttttatagttcattgtaatgtctggtagagtaaattttcacatttcaaaaagtaaaatcattataattacattaacttcgtaaatatgacatctttacagcattgggttttctcatccagaaatgtgtctcctcgtttatcacaattttcttttatattcaatagtacatttaggatttgcacatttcttgttaattctatatttagatattcagtaattttctttgcaattaaatgtggtcttgccattaactgtatcttcaatggatacagtatctctttcttatcttcttccagtcttagctttttgtattctatttatcttttgtaagcaccttaaatcttttttatagcatgtggcatacagctaggtttaaaaatattttaacaatgctgtaatgtccatattttgctgaaaagtttaatatgacacaaacagtcttttttttttttttttactctagggaaataagtactggttggctctccacagaatctttctttttttctttttagtttgcttttgatcctagagtttggtttcaggtctttagtacaaaagaactacttcttggggggaaaacaacaaaacaaaattatgccaaactatcctctaactagcatttgcttgctgtgctgtagtgttctgggcagtttcttgagtcactaaaagcatttttaattacttttctgttctaaaatcttgcagttcattacgcaacagctgcttagattacctgtttaggtttcagcacatccgcgcagcaagacagggttgagaaaaattccctctgagagatcatagctgtgcagctgagtgggtagtgatgtccaacactgagcaggaaactccagaggagaagcagtgttgaaggagaagatcctgaactctttgaggtgatagggagacatctatgtatctggaactcagaggagatatagactggagatttgcaattaatacttagcatgttgatggtaattaaagacatggtaccgatgaatttaatgtaaggtgagacgagaagaatctgtagacctgaagtttaaagatgcttagtgtttaaaggtcaggcaaaagaggacaaaggagaataaaaaataacaaagtgattggaaaaagagaaagaagagattttataaaaagcccaaagagggtatatttgaggaaggaggacatattgtttatagtattgattatttctgaaaggccacgtgctgtaaggacagagaatgtccaatgcattaagcaatttgaggacagtcttcccatcatctaccaattagttcatgtattcagcaagcactgctagagcattttgaaagatcatgaagatactaggtaacggcaggcactgctgatagagaaatggaattcagagagggatctgaatgtgttgctcgtacttgaacctgaacacaaatcacaggcctgctgtgcttaaatcatgacttgccctgagaagggtctttttgggaatatagggaagcatatagcatggatatgtttccttcttcaaagatgttacaatctcactggaaagagaaggcataaatgcaatttaagtaatacaaggtgaccatgtagcatatgccacaaggtatcatttgattaatagctagaaaataagcactgttcattgagactttatgccaggttcttcatatacatcttatttaatctcaaccagcaaacttataggttcatagatgagaaaattgacatttgccagatcgtgacataaataaggggttgaggatctatctgatgccaagtatacactttttaactctgccacattctttttttttttttttttttttttttttgagatagagtttcactctgtcgcccaggctggagtgcagtggtgcaatcttgtctcactggaacctccacctcctgggttcaagcgattctccttcctcagcctcccaagtagcttggattacaggtgcctgccgtcatgccagctaatttctgtatttttattagagacggtgtttcagcatgttggccaggctgatctcaaactcctgacctcaagtgatccacctgccttggcctcccaaagtggtgggattacaggcgtgagccactgcacttggcctctgccacattctttctcaatggctcagtgcttttgaaaagtaaatagagtgttttggcaacatttcctattttcccttgatctgaaatactgctagaattatatctgttatatcaaactatggtctatagcagtgattctcaaactgtagaggactcctgggaacccttgaacactttcagcagggtctcaaggtcaaacttatttttcataataacaataagatgttacttccttttctacactgtgctgacattgtcactaatggtgcagaagcagtggaaggtgaaactgctggtgccttactacaaatcgaggcagtgacaccaaactctaatagtggtcactgtatttattcttcactgacacacactcacaataggaaaacatcaaaaaaatcccaacagaacaacctagttttgcttgaggatttccttgatgaagcagtaaaaattattaatgtagcaaaatattaacataggagtgcatgtattttgagtattccaggtgatgaaataggaagtactaagaaagcacttctgctctacagtgaagtctgatagttgttgatatggttaggctttgtgtcctcacccaaatctcatgttgaattataattcccataatccccacaatccccacatgtctagggagagaccaggtggaggtaattggatcagggggaggttcccccatgctgttctcatgatagtgagtgagttctcacaagatctgatggttttataattgtttggtagttcctcctgcattcattctcttcctgccaccttgtgaagaaggtgccttgcttcctcctttccttccaccatgattgtaagtttcctgaggcctccccagccatgaggaactgtgagtcaattaaacctctttcttttataaattacccagtcttgggcagttctttatagcaatataaaaacaaactaatacagttgtcttaaggaaaatataggtggttgcttgaattacgagatgaaccaactttttttcatggaaaagcatttttacttgaaagagtgactgagaaacaacatggttttcagactcagacattttggcagacattttcttgaaaatgaagaatgtgagcccacaactttcaagcaaaaataccagcatttcttgctagtgatgtattttagctttcaagcaaaaagtataagttcagaaaacttttgtttaccaccataatcttgacagcttaccaacagtaagagttttcttatgataaaaattggtagtgaaaatggtaaatgttactttctgatattgtgtgatgaaatatgtcaacagttacaatatatgcataacttagtagatcagtatttttcaaatgtccagtgcatgattatgcatggaccatgcatgaataaaagatccatcaaaagtgtgaaatagaccaatgaggtttaatgcaagtatatggaaaattcactaatatggtttcagattctatattgcaactaattttaagaagttaccatttgttgagttttaatatcaaaaaatgttcacaatgatataaaaaggcaattataatactccttcatttttcaactatgtatcagtgtctgactacattcttttcttatactttgtctaaaacatttagcagaagcttgaatgcagaagcagagatgagaatccattgtcttaagccagatattagagatttgttaaagtataaaacagtgctactcttcttactctttttaggggcaagaaaatatagttatttttacaaaaactttataaaaataacatgctatgaattactgttgttttaaaacaacttaataaatatttaaaaaatttctcaattttagtttttaatatggaaaaaaaccaaaaactctttggtgtcctaaataatttttaagagtgtaaggtgatcctgaagccaaatttttgagatgtactagtttatatccacaggcagaggcagtagagtaaggtggttaggaggctctgtccagtttttattagcgctgggctgttcggatggaatatattctatggatccatcttcaagttcacagattctattctctgtcatctctacttttgaactcgcttagcaagttttttattttcattatcatatttttcaattctataatcctcatttggtttaataaatattttctgggattttccattttttcatttgtttcaagtgaaattgtaaatgattattgaaggatttttataatatcttctttaaagtccttgtcagatgattccaacctctgattcatcttggtattggtgtttgttgattgtccttggtataataggtgatttttaaaaaattgtatcctagacgttttgattattacggggatccttgatcctatctaaaccttctaatttggcgaaatctgcttagatttgtcatatgtgctcttgggctacttttgcgggcgttggttacaatggtgtctgtagtttcctaggctcttgcaatgttactgtcctttgttttttcgggtactgctaaggctcctgctcagtcactgctggcgccacctgcagggcgcagaaggtacttccctagtaggcctgctgtcactgagtggccttcctggtcacttcccggcctgattatgctgctggctggaaggcagggaaacgcagggctttgctgaggctgcctcagtgcctggttgtggaatgaggtctgagacatccctggatgtcaccgttgccccttttgcaagtggataggactgtccaccaatggcctggctgtggagtggggtctgggaggtcccaggactttgttgatggggctgcagccagatccaactgcctgctggggcccagaatgtgcactgggaactggaacagccccaagcttccactgggggatcagactgcttgcaggggccccatttgtgggtcagggaatagggccctcttgtcctagttttggggtgtggaatgcggtgataaaaagaaaatccgggaatctcaccatgtagtcgttcctcaagccctgaaacctatagccagtctaccttcttccatccaactttctattattttttcattgtctattggacaatttcaagggtatttagttatatttagagggaaggaccagggaaaagtttgtctacatgatcttgttttggaactagatatcactgcttattttttgttaaaaaattaaaaattttaaaaataaaaatggaaaaaactgtggcaaggtaggttaacttttgacataggtggttatcgtaagtgttttataacatgtttgtttatttctataggaattatgttggaatatgaaaaacatggagaattaaagactaagtccatagatttgcttgatcttggtcccaggtaagtaagctgtaggattcaacaaataaatgttcactgggaagccttgacacagagtgatgtgtggatgagctgcataaactgcagataatacattatgttttaaaaattgttcttctgtggtgtgttagtttctgtttgtttcagggagttgtatctgagggtcttgctgaatgaagaggaagtgggaaaagggttatcactcttttcttttttttctaaggtcttaaaaaaataaaccttttagtttatgattttagaaaggccgtgaaggtagagtttccacaccccgattcccctgatgttaacatctcagattagcggtgtacatttattaggattaatgaaccagtatgatacataattattagctaaggcccactttattcagtttttcttagtttttccctaattcctttcttctgttccaggattccatccagaatcctacatgacatttagccatcatgtgtccttaagcttccttaagctgcgaccgtttctcagacttcccttatttttgctgaccttaatttctttctttttctttccttttttttttttttttgagacagagtttcactcttgttgcccagtctggagtgcagtggctcgatctcggctcattgcatcctccgcctcctgagttcaagcgattctctgtgcccaaccagtgacctttacatttttgagaagtacttgttactgagttttaagaatattactgagcctgttattttcttattaaatacttcatagggctgactgcatatgttcctcctcattaattgtcatggggcagaaaagggagacctaatctctattactgaagcttggtattagcccagaggaaacctcttgtgatgtaataacacccagagttcattctctttagtaaatctaatgcaaatagctgggcgtggttgctcacacttgtaatttcagcactttaggaggccgaggcagcagggtcacttgaggtcaggagttcgagagcagcctggccaatatgaggaaactccgtctctactaaaaatacaaaaattagccaggcatggtggtgcatgcctgtagtcccagctattcaggaggctaagggaggagaattgcttgaacccaggaggcagaggttgcagtgagctgagatcgcggtgctgtactccaacatgggtgacaaagtgagactctgtctttaaaaaaaaagaaaagaaatctcatacaaaactccacttcaaggccaaggccaagtgtggtggctcacacctgtaatcccagcatcttgggagatcgaggcaggaggatcacttcaggctaggagtttgagaccagcccgggcaacacaaaatagcaagactctgtctttgtaaacaaacaaacaaacaaacaaacatcctacttcaagagagagtcagactagtgattatcctgtgagagcctaagttcagataaggtgaaaataatctcaatgggtgaaaatcacaaaagaaacaaaacaaaaatgttgtgttttaggtttgtggcctgagaccgtaagcaaaaggagctttcttatatgggctgctctctagttttataatgagtccacttgacaccgtaactgatgagagaggggctctcttaatcctggagttgctgccacttgagaggtttgatgtttctgggagcacgtgtctagggtggggctggggcatggctcagaggatgatggtctatgtagggtccaagtcttatttcgggtgcttggcacaaagaaggtagtcaattgatatttttttaaaatcaaagaatgaacagtggcacagatagtttcattgaatacaacaatctttgttattttcagaaaagatgaggcctaatatcaaacccaacctgtgatttttgtaaatggaacatgttattgatttgtttgatgatgctagcatgcaggaagtttctttgtgagacatttgtttatttagtcagcaattatgtatatgtaccttcaacacatatgtaagaatctaatctgggttagattctataagaggctataaagatattactcataatccctacacttgataggctttttgtctagtttgagaaacaacttgtacaacatagaacatcacacaagtggtacagataagcttctatatgagagaataacctccagctagacattctgcaaaaccacagatttttatatctaagaagtatgaattattaggtgatttcaaaaaggacttgtgggctgtgaatccaggcactcaacactttgaaagtcttcatattaactatagtcactcaatcgtgctgtgctttcctgaggagatataaggcatagccactcataaacatgaccttttggtgatatgagaaagtaaataaatgtctcaaaaaagtgtgaattttatttctagttttgtgcaagaatctggaagtattgtgcctgtaaaaacactggcaccatagatgacatgctggaattattgcatgaaaatcctacagggttggagcgtgtagattatctggttaatttggatcttgcgaggaaatctgtttttatataagttgttgaaaacgtttcaaaggggcatttttacccttttaattgttatgaaattaattatctttttgacaatgaaatatctcagggtttatccaagttattattatggatggttcctggttcatttttgttcaaaatattcactcctaatctaatagattatgtttcttgagagctgggaccatatcttttacacacccagtgctaaagcaatagtaccaactcaataaatgtcaattgaatgagcaggttcctagctcggtgccttgcacaaaactggagcttaatgtttgttgatgaggtgaagagggggatacttatcaggggccacattcatgggaattggatactgagacagaagtgggtgagtcaaaggtttattgggcagtgacacttgtgacagtccagggcatgaagcagaagcaggatcaggcgggaggagccatctgacctcgatgaagaaggcgggacaacagaatctctgccaatctggaagagctcaggagcaaaacttgccagctagaggagtgcctcacagggagaaacggccaggctcttgctctgcccctgctcagctgtggacggagagccaccagagaagaggcagccctggcctggaatgccaaggtacagcctgaaagagctgcagctagaagctgtcaggcaacaaagctccaaccctgactctgggcttgattctttcttaaaggtgggggaatctgcatagtgcatcttctggacacgtgtgtgacatgatttgtgaaatggctcttttttggatgcttcatggtgtatatacattgatacctttttttgaacgaatattattctgtgccagcaacatttttcagaatttctatgaattatttgaatgctagagaaaatttgaatctatctgtatatttttcagaccagttatctttcagggaaacaatattttagtctataataaatattaatattagtcttatgatgctttaaatttatggttaggcatttttctcttttcctaaaaatattttaaatctaatctttctgaacctcagtttcttcatctctaaaataattatgataaaagcattacattagcagattgttacaggattaaataagagaacatatgtaaagtgaaaagtatgctgctgggaacattcaatacatgttcattcaaaagaaacaggaaagaaagaaaaagagctcatgttcagaactagtatggactaggccttcctaggtgtcttcattcattttgtgctgccataaaaagaaagacctgaaacagggttatttgtttctcgtagttctgactgagaaatccaagatcaaggcccctacaagtttggcatctgatgagggctgcactctgcttccaggatggcaccttgatgctgcgtcttcacatggcagagggcagaagggcaaaagggatgaactctctttgtcaagccttgttatcagggcttctaatcccattcagaagggctccaccattgtgacttaattacctattcaggccgcacctcttaatgctgtgacattggtgaacatgtttcagcatgaattttagagcggacgcaaacattcaaaccacaacactaggtgagaacattagactcttggcacaccctccatgaaacaagccttagctttggaaaaatatgttgtagaaaatccaagcttcttgctttcctgccatcatctatttactgatttgtatgatcctccccgccccacccccagatatctcttgggaaagataatggtgtttttgacattttataaatgtgcttcatgaagcaatacaatcaattcttcatgtaatataggtatatgcaaattttgacataaaataaaagaaactcttttttgggtgtatttcagcactgatgtcagtgcgttagtagaagaaatccagaaggcagaacctctactcacagcttcacgaacagagcaagtcaaacttttgatacagaggttgcaagagaaactcggccagaacagcaatcacacgttctatctttttaaggtaatggatttaaaaacaatcagatagaagaatttcagtgaaatgattgatattttattaatttttctttccctaaaaatattttttcatgaaaaaggcatgtcagtgattgattgtagtgcctcacatatgtttgctaagattgtcccaataattatttgttaaatgaatgagtgaaatccaaaacacttattccttgagaggttaaataaagatttcagctcttcatataatgataaatttaaagggttattattattaagatagttttaagttatggaataactaaagctttttttctagttaaagtaacgttaagaagttgtgttttatgacaaatcaacatttcgtattttctgctttcatgtgaactaaaccatatttcagtaaattatttatttgtatgacatataattttaatgtgatgtaaatatgctttttaaatagtttttttgatgattaaatatagcaaatatagtcgtttagtacttcaaggaaagcttttaattttcctttgtcattaccttagaattacttcatattacactgcttttatcttttatgatttaaatataattatgatagtaacatataattattagttatagactcacctgatacaaaatatccaggcattcgtttctggaagaggatgttatagtcttgtaacatttctttgtccagtaggtggcactgtttaatttcaaatatgagctgtataactagcgtgtctcaatttattctccaaagggaacatttttgatggtgaaagtagatgctattcatagttacattttggtaacagacataacttggactgtcccagcccagccaatcactcttaatagattgtccaatttatgtatatgcattcaataaatattcattaaacattcactgtatgttagatgttgtagggattgaaagataaggaagacatattctgacactaaaggagcttcaggattcataaagtcataatacattgtcaaatctttattgaaacatatttagtgtatttcctacatacccagtttatacatgtatacaaaaccacatgccatatgtaaaagaaaatgttacaaattagtgctatcaataagatgccacatagcactgtctaaaggtaaatcagatattgcctgtttctgatgtataattaagaaaaaattgaatgtcttcattggtttgaagttataactaacaaatttaatttggtttgagtctaaaaaatggtgttttctttcactgaaggttctcaaagcacatatattgccactgactaatgttgcacttaacaaatcgggctcatggtaagattctctttttatgtctaatttttagcagtgaaacaaatttctgtgtttatttatcaaagattccagttagataagtacataatatattcatttttctgatttcagtactcccttggatactgaggagaaatataaaccctttctcccactcttctaatctgagttttctgtcgtatttgtgctgcagtgaatgggaggcatattgggttctcagcaaatgtagctactgaagaactcaactcaggaatgagtcgggcagggtggcctcatatctaacttggttggttgtgatcagtctattcagagcaggcactttccatctaggtcagtgatttggggtatggcaaacagcagcttcaagtctctgttgagagcatggctgtgatcagcttgggagctgacgtgctaggtaggagagatgagggagaagtctcgtcttgacctacagacataaaataaacacaaactagacataaaataagcagtttgctaaggcttccataataaggtagcacaaactgagtggcttacacaaccaaaatgtattgtgtcacagttggggaggttagaggtcagaggtcaaggtgtcatcagggtcagttccttctgaggccttgggaaagaagctgttccacagctcctgtagcttctggtggtttgctggcaatctttggtgtggagaagcatcaccctgagctctgccctcatcttcacatggttttccctgtgcatgtctgtgcctatatggcctgttcttataaggatgtattgaactagggcccaccctactgcggcatgatctcatcctaacttaataattttttttttttgagatggagtttcactcttgttgctcaggctggagtgcaatggcacgatcttggctcactgcaacctccagctctagggttcaagcaattctcctgcctcagcctcctgagtagctgggattacaggtgcctgccaccacgcccagctaattttttgtatttttagcagagacggggtttctccatgttggtcaggctggtctcgaacacctgacctcaggtgatctgcccaacttggcctcccaaagtgctgagattacaggcgtgagccaccacgcccagccgtaacttaactattaataattatatctgcaagatcttatttccaaatacattcacattctaaggttctgggggattatgacttcaacatataaattttgagggcatatatttcaacccataaagtatctatagtatatatgtgtatagttgcaaatgcgagtttgcatctgtccaaaggtagaagaagtctgtgggagaagatggtagaaggaaaatacctaggagagaatcaaagataccttgtcttgtcaacctgcctgtttagttgagtttcgctattagacttttcttcaccttttcttgttaccacttgacattcagactggcttttcaattttgtgggttgttttctgtgctggggaaatatatttttgttatacttttgaagcaatattttgatttcagagatattttagaaagaaagtctctttcttaattgaatattgaaggaatgattaagatgctgctattttacattacactctattcactattcctgtaggagaatagctatgttaaaggaaccattcatttgtttattaaacagaatataggccaggtgtggtggcgcacgcctgtaatcccagcactttgggaggccgaggtgggcagatcacgaggtcaggagttggagaccagcctggccaacacagtgaaaccccatctctactaaaaataaaaaaaaaaattagacaggcatggtggcgcacctctaatcccagctacctgggaggctgaggcaggataatcgcttgaaccccggaggcagaggtggcagtgagctgagatcgcaccactgcactccagcctgggtgacagagcaagactctgtctcgggggtggggtgggggttgggggagggaacaatggaatatatcccaatttagacattgttctcaatttaactttttgttctgcacacatgatttccattgtaaaaagcataataggccaggcgtggtgtgtcacacctgtaaccccagcactttgggaggctgaggcaggcgggtcacttaaggtcagtagttcaagaccagtctggccaacatggtgaaaccccatctctgctaaaaacacacacaaaaaatatagccaggcgtggtggtgggtgcctgtaatcccagctactcaggaggctgaggcgggagaattgcttgaacctgtgaggtagaggttgcagtgcgccgagatcacgccattgcactccagcctgagtgacagagcgagactccctcttaaacaaacaaacaaacaaacaaacagcataataaatagagttattatcctacaggtaaaacatgaagtctttattaacacactgccattcttccctgcaacgtgtttatattccttgtgttagctttatcacaggaagctatgatcggacgtgcaagctctgggacactgcgtctggagaggagctgaacacgctggagggccacaggaatgtggtttatgccatagcattcaacaatccttacgggtgtgttcatcccttcacttatttgtttattaattcatttattcatccctccatctgcttggggagaaagggaagaagacaagaggtctaaatttattgagtgcttggtatgtgctttggaagccttttaaatacctccttcaaagcttaaaagggtctttgggttagctatcactatccgcatatagaatacaaggtttaaggctgggcgtggtggctcacgcctgtaatcctagcactctgggaggccgaggcggtggatcacttgagctcaggagtttgagaccagcctggccaacgtggtgaaaccccatctctactaaaaatacaaaaattagctgggctaatgtatgtaatgtatggtggcgcatgcctgtagtcccagctactcgggaggctgaggcaggggaatcgcttgaacccaggaggcagaggttgcagtgagcccagatcgcaccattgcactccagtctgggcaacagagtgagactctgtcttaaaaaaaaaagaatacaaggttcaaatatgcttccaaggatcgcacggtagtaaagaggagagctggagttcgtgctcaggcaagacttgactctcaatccttgggagttccgacaggcactgcctattgatgttcacagctctgggctggtgcctctgggggaatgtgacagacacacacagcatggtttacttcatttagaagttaatttacagtcttgccaggcaggaaaaaaatgtgtgtggtaacatgctaaataacaataccaagtacaacagaagtatttttaaaccaacctctagataatgaacaggagattgcacagtgtcttctattcttcctcatgacacactgctgattcccatggcaccctgaacatctatagcagtgaacatacccgccggaatgggcatcctcctcctgctggttaggttctaagctgatcaagagttagttgtatttgtcaaccaatgcgcttatgttggttgtactttcaattgtaattgtgtaacataacgtgtaatttaactaaatattacataaaccaataaaatatgagtgtgaaaagaaagctggtcttttctagggaagcataaataaggcaaatctttgaaaaattgtttcacaactaaatgaagttgtggaggagatcaatgttcaattggaaatcacactgtcaaaatctagaaaaattctgtactcagattgttctgcacgtatgtttaagttctttaagttctcattccacttgcaagaaaagaaaactagatattgtagaggtttgatacgatttctgaaagacagatggtgaactccacttagctgacacacagtcaaagaaagacagtggcctcttgtgaaaagattggcaaataaatatatatttatatctaatggaatataccttttttagacaagcaagtattttttcatgattgcacatgctaaatgaatttttccataaaggaagctggttctataaatatggttcatttactatagtgttatgatgactagaacaaaacagtaaatgatttaacaattaagacaagaaagtgatcactgtgatttctcctggtaagagtctttggagatggtgtgagccgaaagaagatgccagaaggatggagggtggtgagcagtggagaggacacacggggcaaagagacctcagcagctcagtgtctccaggaggggattcatcgggcacactcagtggccagtctctgtagtgactcagtggccagtctctgcagtgagcatttcatgttgaaaaacagaagtgcgtgaggtcagagcattcagtggagtttaaactctgtcctgtgggaccaagttgccatcaaggatttgggaacaaaaaggggaaaaatgaaagtgatgttttaaatagaaggatagctctggcagacagaagaggtcagagggtttggatgtgagaagaaacaagacacaaggaggtcatttaggatgcagatatgacaatacactcatgataccataatacactcattgcttgggaaggggcaggaagaatagaggaatttcataaaaatttgatacacttagaatagacattttatactacagttaaaaaacttgatatctaggttgccaatataatatcttttagaaatgtagtaccctttcaaaacatgttaattgtgatggcaccaacttaaattggtacattaaagtgattaagcgttccaattaagttttagaaaatttaactttgatctatgcatttttatattccagagaatgacagtttttataataccttattatgccagcttatgaaaagataaagattttattgaaattataaatgacactattttacatctggtataattcctactttcactgcaatgctatttaaaggatattctctataacataatgccatatcctttaatagtctacttaacaaacatgatgtgtttgggtgtctatctgagaatgaagttttctcttgttggggaggtgagggatactttttgactcttcaactgaattctaccaagagcccctgatgaaaaacccacgtgtccaatcagttatcttcgcctgatgatttatgtatgcgtgaatgcagtgtttctcattgcactttggggtcattggggtttcagtagcataaattcaacacaatcaccaaagaataagagggagtgtgtgtgtgtgtgtgtgtgtgtgtgtgtgtgtgtgtatgagagagagagagagaaaggaaaaacttcaaccaatttactgtttatctgctttataccttagggcaggagtaagctttgactcaataaagtaattctcaacacattgacatgagagatatcttctataatgtggtgtcatgtggatatagagaacagtttgtgatagaatagatatcagtcaagaaacaacagcaactccacactcatgtttgagggccaggaagaatggaaaaatgaattgagggaactgataaagaatgtacatagtgagacctcatctctacaaaaaataaaaaaaaatttagccaagcatggtgacatgtgcctgtagtcccagctacttgggaggctgtggtaggaggactgcttgagctccggaggttgaggttgcagtgagctgagatcgcaccactgaattccagcctgggtgacagaataaaattctgtctcaaaaaaagaaaaaaaaaaaaaaaaaagcacagggctttgagcttatcttgagcacgtattggaagacatcagcagctgaagtaaaatgccctgggctggaaaccagaggagaaagctaggtcagacactctgttaggaagctttgggtgggtgagtgtttgccagtacaagctgcccttggagcattgacaaagaggatggcactttgctttagtctgagagaccacctagacactatagaaatatgggtgtcctgggacaagggggagaatcaaggcatcaatgttagtttggataaatatacatttctagtctgctttaggatatatgtgttgggttgtgagatctcttacactttgggaaattgagcttgtactgtaaatgataatccaattgggtgaacatcttgaagagctggtgtaaaagacagttgtaagccagggttaaaagaaaggttttagttccaagatcaaaggccaaacagggtaatctactcttgcttgttggttgttgatgttagctctgccccgcagtcaatatgagaagcctcttagttgaaagtgactgaagtctttgtatttcctttctaaaccctcttacaactggaataatataggcattatttccttaagaggacaagcaccgtctaaattctcaaaaccttattaaccatatttttaatgggatttatcttttttcatttctcttttatattcaatgttattcttttccatatacttattaacataatttttctatgtttacacagttcatactatacattatttattttaatttgtaagtaattttctaaactaaaccttttgctacattcattaaactcattttaaaaattattataatcccaaacaaatatacctataactttaatataaaacctttaaaattaaatgtgtaaatcgataccactcaaaaattagacttttattttattatccactgaaacaaatttaagattgcttatagctttagaagtgaagtaaattttttactcatgtattaatatctcatcttagttcagtttattatataatgtgtctttttttaaataatctacatttcttttaaatcttagtgacaaaatcgccactgggtcctttgataaaacttgtaaactctggagtgtggaaacaggaaaatgttaccataccttcaggggtcatacagcagaaatagtgagtatatttaacaatttattattattttatgtatatatatatattattttctttgagatggagtctcactctgtcacccaggctggagtgcagtggcacaatcttggctcactgcaagctccgcctcctgggttcatgccattctcctgcctcagcctcccgagtagctgggactacgggcgcccgccaccacgccccgctaattttttgtatttttagtagagatggggtttcactgtattagccaggatggtctcaatctcttgacctcgtgatccacccgcctcggcctcccaaagtgctgggattacaggcgggacccactgcacctggccttattattatattttatgttgctgtttctttttaggattctattataaaagtagtggggctacttttataattaattttcaaattctaccccatgtttttagtctgcctatatttatatggtggtaccaatacaatttaaaaattactctagttaatatcttgcagattctgtaaagaactgtatcctacattgactaagtagacacgtaatatgataaatttataaatataataaccaatcttactttttaattggcttttctttaaagtactgactcaatgagggtcaattaagttatgaaaacagtttttaaaataatttttaaactactatgtgaaatatttaaatatttaggctgattgttttctgtatatcattagagctcaaatttgcctaaatagtctgatactcgaaacagctttcactattgggaagcccttgtccttgaccaattctgagacatatctgataacaattagtgcaataattggcattccataagaacagatgatagctcttaaaaataaacaggctgctgctcctaatgattagtaataccttaaatctttttaatcaaagatttaaataaggaaaaattgatctgattttaacaaatccccaagttatgttttggtctgttaatggggatcacacctttccctccatttctggccttcattaggtagaatgattctttagatatttaactcactaactttgttgtactttgaagttactcttaagtggataataccaaaagagaatccacaaatagaaggtactcactttaccaatgcagtagtagtataaaaataatagagacttttgagggtcaaagagagaaaaggctaaagcaggaaacaaaatataaccacctctcctgtaactgtcagtagggaaatatagctcagtactttttgaattgaacagagacataaaaagaatgtgctaataactattagtagatgaagagaggaaattgataacaaagagtgacaggtcttttaacctcaatattcactggaaaaaaagatacctgctgtgaaccagaaagagcaaacaagaacatacaggggtggagggaggaaaagcaagccacagtggcgacagcttttgtgaatagtcggtgacagccgatctgccagcagtgttcaagtgctagcacccacacccacccctggaacttaggaacaagatacctagaacagactgtgaaatgcttggaaatatgtcttgaggataaggaaagtacctggagatgggaaagggtcctgtattctgcttatttatgtacaccttaaaacaggaacaaaaacaagctgcttattttagaagtaaaatttatttacactcatcctaaaaattcatggtatattcatccataaagaactcatgctatgttgaagttactttgctagtgactggaaatactgcagtgaaacataactgaccctttgacagcacttgctgtttgagaggcactgtcctaagcccctttacatagacaggtattagcttagttgtgcctcatagcaaccctaagaggaaggtattttcccattttacagagtagggtactgaggcattgaaagcttaagtaacttgcccaaagtcaaagaaaaacataatgtgtgtccttagagtgtgaccatttttgcacactcctttagattttggggaatattttctttagatataattcctagggagacattcatctttttcacagtcaacaacatccatctaataaatatttattaaatattgactatgtgtggagccctggcctacatgcttagggtatctgagagaatcagacacaattcttacaattcaatagaaggagtaaaagtgtcaatggataagttcaaagatgtgttgtaagtgtcagaagtggatggggatttcagtgtggacacagagggagcagtgtggcctcctgagccaaggaaaggtgttcaggaaagacttcccagaggggtggcatgtgcattccaggcagaccgagcagccctggaaaatgctgagaagaggcatgcaacagtgatgtgtgcctgaaactcaggtggctctgtgtgatcagagcagagcttcctgaccctccatgtggtggcatgtgcagaatatgtgaatgtggatttgcagcacactgaagggagctgcctgctgtgcatggccagaggtgatgggcaaggattcctgctgctgcccagctgcctgagttaaaagtgtccatgccttggcacacctatagcccattcaaattcaggtcacagggtgtgagcaattaaagtaggagaggcaagcaagggccatagtatgcaggaggttatatactatgctaaggaattggattttattttgtaggtaatggcacactgttgagactttttgactaggagatggtatgatcagctgtgctctttggaaagattatttctgtggcactgtgaaaaagaaatgggagggtggtaaaatccgagttatcagccagttggggatcttgctgaaatccacgtgaaaaatgatgaagacctgttgtaaagatagatgaagagaatgtgagtagaacttggttactaagtagttatgaggcataaaagaaaaggggaacccaggatggattccctgattttgtgtttgcatgatgggcagtgccattcaccaattctgtgcataaaagaggagcaggtttgcatctatatgacttttgtgtcttagattgatataagctgcctgtgtgatagccaaacagaggcatccatttaacagttggctctttgggactggaactgagcagtgaggtctgggaaagagacttggatgcatgagtcactggcatctgggtggcagtagaaaccaatgagcaattgaaattgcccagaggaaaatatagagtatggagagggactgacagaatcttgggaggatggagaagagagaacttcaaatgatacaaaaagaaaaaagaaaaacaagaagaaagggagggaaactagagaacaaaggattcagtgctgcagatatcagggaggttaagcgggatgaccgaccaaacctggattgggcatttagctggagtggtttcagaagagttgacgagtgagcagaagatggacaaaaatgatggtagactgtttcccaagaaatttggttgtaaaggaggaagaagagttgctaagaggggtacataagatcaagggaggatttactcaaacatatttacaggccactgaaaaggatctagtctacagggaaggaaaagttagtgggtgcatctcccctaggtgtacagggaaggggttcttagaatgggcggaaggatgcctctacatccgagactgaggggaaggaaagtaagatcaggaagttcctacctgacaggagagttttctcagggaagtggaaggaggccaggttgtctgttgaggaggggtgaggatggaagtagaggcaggagtggggaacaggagaatgtatagagccagaagcatcttaagcaaagtagggaacagtgctgaggactctactgaggacagaggcatgaaagagcaatactagtaactttctgtgctgttctcttaagctaccttggctgggtgatgaggcagggaagcaggtggttggataaaatccttgcctgataaaagttaatgttagcagttggtacggaaggtgcatcagatagataggggctaacagtgtcgaggatactgggaggagtgatgcttccggggtgtcagttgaatggggaggatggaccaggagaaaaggcagatgtctcaatgagatgaaagatcttctgggggaggggagtgggaagggaaattttgaccctggattggtgaattggtggtgaatcttctagagaagataatactaaggtccatggtgtggccatgggagagactactgaacagttgtccggggcatgggtctgggggaactggatggattgcccacgtgaaggccacctaagacttggcattgagactacaagccagtagtctcttgatgagtgaggggctgtgattggaaggactgtggtgacagcagcaaggagaaggagagccatatagcacggatcttaaaggaggtgggcttcacttttgttcttgttcttctgtggtctggaagtggcaaagggagctagtgcccctccaagccttagctgggtgctgtgggagaacaagcagcctcttttcaagaggaggactctgaaggactcaacctgggggtagcaggtcacacatacgtggggttttgtacaaagaattagatggaatctggtaaggtaattgcatctggaagattttctgtgtataattaacactttgaaactctgtcttcctaaaatttctcccattttatgtaatttaggtgtgtttatcatttaaccctcaaagcacattggtggcgactggaagtatggacacaacagccaaattgtgggacattcagaatggcgaggaagtttacaccttaagagtatgtcaataatgttaataagcctgttatttgtgttcattcttatttgtgtttttgttacaaaatgagctctaagttggaggttgttgagttgctggttttcaaattttagtggtgaaagagtgtccctactggtttcctggctattccaaaagacttgggtggaggtgctggggaagtccaaggagctttttattttgactaactttagtctgcaaaacacataaactatatcttagaacccatcaccatctctctggctaaaaggaaagcaggtggaggctggcacttttggaagaggcagaactggagaaccatgacaagagaatccttagagcaatgactgtgagcacactctcctctgcccgctggtctttcagccatcctgtatcacaaaagtctgaaatgacagaggggcaagtgaccagaggggaaaaggccaaagggctctgcccacagagtgagtgctgtggggcatgctcttgtgtgtcaccaccatgtgcccagcacctccccgccatctgtcactctccccttcctcccaccctccccttcctcccaccctccccttcctcccaccctccccttcctcccaccccagcccaagtcactgcaacaaaactagagtgaccctatgttgtaatcagcaggaacagccagatgggaaattcagtttccttgtcctttcaaaattataagtacatttttaaaaacatgatttgtttcctcagaaagctttttctaagcaagttaaaacatggactgcaaaagaaaaaaaatcaccattttaaaataacagtaatggcttttctttcttaaatctgagtatctagcattattagtgtaagtatactctttctgttctcagttcttttttcgttttttttttaaatcattactatctcttccttcaggcaaatgtgcagggaaaggtccccattaatgccacactttcaactaaaatgactccttttacagacgtgcctaagagcactcaatgggaggggtcctgcttggcacacctgtctgcgccagagagtgaatttgttttgcgtacttagaattcgaatattcaactacatttcattttgtcctttgaaatcaatcagaaaaatcaagttataattcaacttttctaattctttgtattatttaaaagtatacttatgttaatttactaaaataatgaaggaatcaagggatatatgtactccaaccaggatccccttatcagagttccagaatctgctgtggagagtggtttcttcccattatcttacagtttgattcactaacactagacagtaaccagctgaaagtcaggccaaaggcaggaatttatcaatcgatttcatgtcaagttatcttaataatttcctttttaaaagtaattagttttatttcatacactgtttacttttgcataccatgtgttattagcccatggcatcccctgctctgtagtgtttccaaggcagtgtaaaggacgtcctctagtttccccaaatacaacctctttcttttgtttttaatcaatattattaagttaaatgaactagctgtgtgtaagtcactaatttttagtaaactcacagtattgtgcagccattaccaaaacctagttttcaaacctttccatcaccccaaaaagaaccctgtgcccacgtgcagacactccccatcctcaccccagccaaccgctgacctccgttcctagagctcggccttctccagcatttccttttagactatgatattgtacgcttgcagaaattgttttatctgcaggtatacttgacagtatctgctctttttctagggacattctgccgaaatcatctccttgtcatttaacacctcaggagacagaatcatcacggggtcttttgatcataccgttgtagtgtgggacgctgatactggaaggtaattcttagttcttaagaattgttttaacctggatcagggggttcagaaaaccctctgttattttttagtttaagctactatctattaactctgctttggattccataaaaataggacatattgaaaatgtaaattaattcattctttaatgatatttctgattcacaaaatatgtgcattctttgaattctgagcaaataatgacaaacagcaacataaaaggagaatgttagcaatagtctggttatatagctattatttatttcatggataatcagatttcaatggcttgtcattatgttaggcaggaatatcatgtataaataaaaactcttagttaatttcccaaattaatttagtccaagaacttcaatttccttcctaatgatttttggtcctagttgctaggaagttaactaaattagcatatttgtgttggaaaactctactcttggatttgtctgtgatttaatagaggggctaattatcaggggtgccaaccaagatgtatgcaacaagaaatgatagaggaagaaggacctttcagttacttgatgtgtagtttctgaacaaccaggggtgcactcacccggtgtaagactacttcttacggcctttactatttgttacccatgtctttttgaaatgttgccttaagtagcattattttgatagtttaaaatctaagtacatttttgttgaaatgaaattatttatttagttagttagtttttgagacggagtctcgctctgttgcccaggctggagtgcagtggcgtgatctcggctcactgcaagctccgcttcctgggttcacgccattctcctgcttcagcctcccgattagcagggactacaggcgcccaccaccacgcctggctaattttttgtatttttagtagagacggggcttcactgtgttagccaggatggtctctatctcctgatctcgtggatccacctgcctcggcctcacagagtgctggggttacaagcgtgagccaccgtgcccggctgaaatgaaattattggtagcttctttttgagcaatagtagagccatatttgtcatcaaatatattattttgtaaaaaccagattttagattagcttacacagatgggcttggcctcattattcatgtgcatatactgaagtaagatatctttcactagttttaattatttttgtgttgtaggaaggtaaatatcttaattggtcattgtgctgagattagcagtgcctcattcaattgggattgctctctaatattaactggctctatggacaaaacctgcaaggtgagcaaaataaataaatatctttgctttatattgtgtctatactctttactgtgtcagatatccattgtaacattaacagatttcaaagatgatataaaattaagatattaatttacaaaaaatagttggtaatttttaaaatttctagttttggattttccaaatttgaaggaattgtgatgtagtaaagcaatttgaattgcttcaagtatattaaatatcttatttgagaaggcattttatttttatttaatatcccactgttcatttatagaacttcaattagtagagtgaccctcaaggagcctcaaacacagtgtttccttgtccctaagtttctatacttaaaaaatggttactaagagattatactatggaattatcatttgtttatgtaacaaatataatcttataatgtactttccattttctgacattgtagttttatatcaagctcctaatcatttgatgtccttcctataaaaagagcacaactcttcaccaaccagtaaagcatacacgttgagatattttttctttctttaatgtagtggcagattctaaatgtctgactttggttttctctgtgactagagtgtgccttgcttgatggttggctgtggtctctggtcatgaatcaaagtaaatctaactgaacatgcatgaattacacaagtgatttttgcacagttatttaaccagccataagcatgtcatgaagaccactggccatcttcacacttcagacagaaagtcatagtctttttttttttgttttttgttcttttaattgtagctgtgggatgctacaaatggaaaatgtgtggcaaccttaacaggccatgatgatgaaatactagacagctgctttgattacactggaaagcttattgcaactgcttcagctgatggtaggtgatctgttcattcttttaatttttggagagatttatgctttgcttgataaccatgcataattctacactatgggtcatttctttgatgaccagctatgataaaaaaccatgtctcatctctatcgtgaccatgtatggcacaatagtgtgtctatatcatatacctgataaccacatgtaatgttatgcaatgtctgtgtcacctcctacataacgaggtatatgaggtctttgtcatcttcttaatatctgtatatgatgctatattctgggtcatctccctgatttttattattattattattttgagatggagtctcactctgttgcccaggctgcagtgcagtggtgcgatctcggctcaacgcaacctccgcctcccaggctcaagtaattttcctgcctcagcctcccgagtagctgggaatacaggcatgcaccaccatgcctggctaatttttgtatttttagtagagacggggtttctccatgttggccaggctggtctcgaactcctgacctcagatgatccacctgccttggcctcccaaaatgctgggattacaggcgtgagccaccgtgcccagcttccctgatgattacatatgatgttaccctatgttggccttgtcaacttaattaccatcaatggtgctataatctcctttactataaccacatgtgctgttccgctatgtctactgcatctttgtgataagcatacatgatgctatgctatacattgtctctttgattaccactgtgattctacactatgtgtcatcttattgataaccatatatagtgctatcctaggtgtgcttcaatcctgtgacagtcacatgtgacactacactatatctgtcatctccctgttgctcacatgtgacatgatattgtgtctgtcttatcgcctaaggatcatgtttatttctacactgtatctgcatcatcttgttgaaagttgcatattatgctatactgtgttttcatctactcctttaaaaccacatttgatgctgggccatatctgcatcatatccttgataatcatatatgatgcaaaaccatgatcatcttgctgacaaatatgtatgatactaacactctgtccacgtcatctcgttgaagccacatgcaatgctatatgatgtttttattatctcagtgacgaccatctgtgttggtgtactatgcatgcatcatgtcctggataacattttatgatactgaacaacaagtcattcccatgacaaccatatatgatgttatattatgtgtcatctctttgacaaacatatgtgatgattcattgtgtctgcactatttccctggcaagtatttatgatgctactctatgtctgcagcatattcctgaaaaacatgtgttaacactatacaatttctacattatctccctgacaatttcctattttacactaaactatgtctacaccatatccttgataaccacatggtactatactatgtctccatcatcctatgtctccttggcaagcatatgtgatgctatactaagtctatgtcatatcgacatcacataccatgcgtgatgctattctgtgaggcatagaatttgaagtatgaactatgtgtcatcttcctgaagatacagatgatgctaaactacatcgataccatctacctgatgaccacgtgtgaagctacaccaagtctgttatctatctgatgaccacatatgatgctatattgtatctatgtcatgtatctgactatgtttaatttacactgtttttatcctctttataataatgtatgatactatactgtatctttatccaattatttataaccatatatgatactattccatatcttagtatttcttagaaatccatgtatgatgctatagtatttatacctcattgccctggccaacatgtctgcagggtccactatatcacatcaccacctttagaaaggtggtgatattatctatctatctatctatctatctatctatctatctatctgtctgtctgtctgtctcctattggttctgttttatactatatataattttatgtattttttatattatatatttgtacatttttatatattatatatttatatgtattacactatatatactatgtatataattctgtttatagtatatatagtatataaccaatagtatataaatacacacacacatatatatagtatataaccaatattatataagtatacacacacacatatttatatatgaaggctgagaagtcttgccatatgccatctgcaagctggagaatcaggaaagtcagtggtataattcagtgtaagtctgaaaacctaaaaacttggggggaccaatggtgtaactcttagtctgaggccaaaaacttgagagaactgaggagggcactggtgtcagtcttggagtctggggatctgagaaccagaagctcgatgaccgagggccagagaagatggatgtcccagctccagaagagagaatttcatccttcctccaccttttgttgtatctgggtcctcaatggattggatgatgcctgcccacattggtgagggtggctcttatttactcagtctaacatcctcacagacacacccagaaacaatgttttaccagccacgtgggtatcccttaacacagtcaagttgacacataaaattaaccatcacaatgccgcactgtgtgtgtatatcctgttacccacatatgacattatactacatctgcatcatctccctgacaaccaaatacaacatcgtgatgtttctgaggtatcctaaaacatgtgttatgcgtaccttattctttgatagtcatatatgatattgtactatgacaatttccttgatgatcatgtatgatgctatataatatatgcatcatggccaggtgtggtggctcatgcctgttatttcaacacttcgggaggccaagattggaggatcgcttgaggccaggagtttgagatgagcctgggcaacatagtgagaccccatctctacaaaattaaacaaaaattagctaattaaaacaaaaattagtcaggtgtggtggcatgcacctgtagacctaactactcagtaagctgaggaaaataacctgagcccaggaggagttcaaggttacagcgaactatgattatgccactataatccagtctgagtgacagagtgagaccccatcttcttgatgaatatatttgtggatgaacacacacacacacacacacacacacacacccctcatattctagacagccatatgtggtgttacattatttgaaatgtattggacaatgatgtgtgatgttatattattactatatcacccctttaacaaccccataagatgctatatgttactttatactatttcggcatcatattcataataaccatttattacactaggctacaattaatctccaggacctacaaatatgatactacactatgtccatgccatttggaaaacagggtatgatgatacaatatttttgcatcatttccctgactactatttatgatgctgcagtatgtctgcttcattttcatgataagcacctgtgacattacaacatatctgtgtcgaatccatggtatcttcatatgacacaaaattatgtgtcatcacccagatactttttttctgcatccaatcatccatgagaccctgatgtcttgtatgaaactatgctatgtgtcatctccctgataacatataacaccgccctatatctgcattatctctctgacaacctaagtaagcttatactattttttgagccatatccttgacaattgtatatgaagctatactatgtctcatcatgtttttggcaatggatgaaactatactatgcttgcatatatttaagaatcatgtatagttatatatatatgtatacacatacatatatatgtgtatatatacatacatatgtgtatatatacatatatacatatatacacgtgtatatacacatatacacgtgtatatatacatatatacacgtgtatgtataagcatatatacatatatacatgtgtatatatacacatgtgtatatataaaattatacatgattatatatattatatatatattacattctgagatattgtgaattaggacttcaacatatgaattttaaaaggacacaattcagcatataatagcacatatgacatactgtgtgtttgctgcttctgcctgacaactgcatattattttatgtttttatcatcttcttgaaaccacttatattacactgtaacttcatcatgccctatacaaagggctgtgctataccttatgggtgacatggcctagttatttaaggatgatgctataatatatttactttgtctccctgatgatcattttatttgtaagaacatgttttcatcctctccttggcaacaacttataatttctccactatgtctgtgtcattgccttgataaccacatgtactttctgtatcatctttctgactaccacatatgatgctgtataacgtatgtgttatatccctgatatccacatgtgatgctatcttatctcttacctctctttaggacctttatgagattacactatgtctacatcatctccctgatgaccacaaatggcagctacattacatatgtgccatctctctgacacttatgcccctatactatctgattcatctttctcatgaccatatatcctgcttcactatgtatagatcctttcatgacaacaatatttggctctgtgctgtgtctgtgtgtctatactgtgctacgctatgctctactcttctatgccataccataccatactatactgacttatgtgtgtacattgtcttttctggaaccaagtataatgttacattctgcctcatctccatggtcaacatgtatgatgttatgctatatctatgtcaccttctttctctttttctttttttctttgagatggagtctcgctctgtcgcccaggctggagtgcagtggcacgatcttggctcactgcaacctgcgcctcccaggttcaagcgattctcctgcctcagccgcccgagttatgtcacgttcttggtaatcatgtttgatgttatccggtgtgttcatctctttgatcactggacgtgatgctaaactatgcctgtgtcatctgctgtcaacaatatggtatgctacatgctgtgttccttatcttcttgatgatcatatataatgctgcactgtctagtatgtctgtttcatatcactggaggtctggacattgctacactttgtgtttgtcatctcagtgatgaccgcctattctgcttcatttgtattcttcatttccttgaaaacaaaaatgtttccctatgtctgtgtcaccttgttgaaaaccatacataagctatactgctgtcatcccctacctgttaatcatgtaggatggcatattctgggttatctccttgatgatcatataaaaagctgccatgtgtctgcaatgataaacatgataattgtggattgtgctctcatacgtttgcatctgtatgtcttagacaactatgtatgctacactatcactccaaatttccttggcaaccatatatgatgccacattttgggtcctatcactgatggtcatgtttgatgccccatccttgacagctatatgttgtacaatattatcactgcttatagcatcataaatgttacaaaggagcttgaacatttggcaagcatgtatattgctaaactatttctctgtcatctcctttacaatcgcaatcatgtatgagtctgtactatatctgaatcatctcctagataacaaagtgacatgcaattttaggattcatctttcagaacctcgcatgagaagatcatcttcttgatgatgatttgtgacactatcctttgtttgggtcttgatatcaccacatattgtgttaaaacatgactacataatatccttcatatcgacatgtgatgttatattatgtgtacttcatttccttaataactatagatgatatactaagttaccgcctttataaccatgtgttatatctccctatttctgagtcatcaccttgataaccacatgtgacattatactgtgtgtttcatcatgttgaaaatcacagataatgcttttctccttgataaccacatatgatgcctgatatttatatggaccagctcctttgtgacatttatgatgccataatataggttatttccatgaggaaaacccacagtgctgcattcatgcatgtcgtctccttgatattcatgtataatgctatcctatgtgccattttaaaattcccatatgtgatggtactctacatgcacatcatcccactgataaccatgtgatactatacatgtgtcatctccttggcactgtgtatggttctaaaatcaatctttgtagaatccttgtacaccacatatatccctgtactatgcatatgtcatgctctttatggccactgagatgctacagtgtctctgtcatctccctgatcatcatgtatgacattacaacatgtctacaccttctgccagaagacagtcatcatatctatctatctgtctgtctgtctgtctgtctgtctgtctgtctgtctatctatcttcatcatcatcatcatcatcatctatctaatctattgagagagagagtcatatatctgtatctctctctctctctctctctctttctttacattaggtctattcatgttcctaaaggcctttataatgcaacaatatttctgtggcatttctttgataaacacataggacctcacatcacatctgtgtctacctcatttgtttgataaccgtgagtgatgctgtactatgtctgcaccacctccttgataaacaaatatggtgctatactgtgtcttcatcatctatgatcctgtactgaggattatcttatattttgggtcatttctctgaccataatgtatgatgctacaatatgtctgcatcttaaacttgataaccgtggctggtgctataatactatatgcaccatctccttgataaccacctatgatgctatactatgtataccaaatctcctttacaaccattgatgatctatgttatttgtcataagtagtgatctatgttacttgtcataaatagtgattactacttatgattctacgctgagccatcatattgatatccatatgtgatgccactctgtgtcatctctttggaaaccatgtatgatgctacactctgtgcaccttatatccaagaagattacatatgacgttacactagattatgtcatcccccttatgcccacatttggcattgtattgtctgcctcatctcactgatgatcacttatgaggatacatgatgtctacttcactgtctgcattaacatgtattgtgctacatcttatcagggtcatcaccttgaaaaccacctatgatgctacatgttttcatcaccatcttgaaatttatgttggaatcaatatgatatctgtcttagataatgtcgtactaatatatgtcatccttttaatcacatgatatgtttacatcattgataatcatatataattctaggctataggccaccatgacaactacatgtcatgctatactatgtctgtatcatcttttaacatactacatatattggtacattatgactttttcacctccttgagagccatgtatgatactgctgtactatggctaaactccctgatgacagtgatgctacataatgtctgcatcatacccttgacaaaaacatatggtgccacactctgtctgcatcataattttattaagtatgtgttatggtatagtattactgcagcacactttgataaatatatgatgctctgcttttattcatgttgtgtagtgatgtaaactatatcttcatcctttacttgatgatgatatatgatgctatactatgattttattatttccacaatattctcaaatgacaatctattatgggtcatctttttgatggtaatgtatggtgttactctatgtatgtgtcatcacttgtgtgtcatcaacttaagtactatgtatatgctattctatatttgcctctttttcttgatatccataaagtatgctattttatgggtcagtttcctaatgaccatgtttgatgctggaagatgtctgcattatctctttgaacaccaagtgggattaatactataactatgtcttttctgcaatgaccctgtgtgatgctaaactatttctgtgacacctccttgacaataacctctgataatcatctccttgagaatgatgtgtgatgctgtaacataccctgtctgtagtaaatcctatggtactagactctgttttggtcttcttaataacactgaatatatgtactatgtttcatctcactactcccatttattgtgctaaaatataattgtctctgtcagccatatgtgatgctatcttatgtgtcatatccttaatagccatatataatgctacactgtatctacttcctcttcttgataaccacatcaatgttatactattgtctatatcatgtccttgaaaattccttatgatattatgccgtagttcatctcatttaggacaatttataatgctacaatgtttgtgccatcaccttgaaagttacatatgattatacattatttctgcatattttcatgatagctattttatcagtcacatatttctaataaacatctgtggcatttaaatctttgtgatttccctgataaccatgtatgatgcaacattatgtcttcattgtcttattgagaccctgtatgactattaccctgaaaataatgtactgctacactatatctaatatgtaatcatctccttgacaaccacttatggttatatgctatgtctgcattgtttttaacagcagtacattaatttatactatgtttacatcaatttaaaaatacttatgcatgatattatgagtaatctcactgatgacagtatttgatgctgcaagatatctgtgttatcaccttgacaactatatatggtgccacactatatgtgcaaaatctgcttgagaagtacatatgatgctgttatgactgcgttgtctctttggtaactatgtatgatgtttaaaccaaggtcattctctttgatagtcacgtattatgaatgtcaatgtgcatgtcatctacttgaaaaccaagtatgatgctatactatttctctgtcatcttcttgataaccttgtagagtgctttactattttgcatcatcttctagaaaattacatatgataaccatggatatatgtcatatccgtgatggccatgtatactatattatttgggtatcatcttctgtagtccacatatgacctgtgaagtctccattattttcttgatgatcatatgtgatgctacactatgtctttttcatctacctgaacttgacagtgatcacacatcaggctatactatgtctgcgttatctcctttaaatcctcatatgatgtacagcatgtctatgttaacattctgactcctgtgtagatactactatacatctggatcatcttattgatgatcatgtatgatgctacactgtgtatgtgtcagctccataattctgacctatgtctgtataatctccttgtcagcaatgtatgacactacactgtatctgcatcatctccttgataaccacatttgaccctacactatgtttatgttatctctctgacaacatgtgacactaagctatgtctgtgtcgtctccctcatgaccatgcatgacagtatctatctatctatctatctatctatctatctgtctgtctgtctgtctgtctgtctgtctgtctgtctatctatgtatctatccatctatcgatcgatctatctactttttcttctttattggaattattctgaaggctgatttttttgtttctttttttttttttagatggagtcttgctctttcgcccaggtgggactgcagtggcactatctcagctcactgcaagctccacctcctgggttcatgccattctcctgcctcagcctcccgagtagctggggctacaggtgctcaccaccgcacccggctaatttgttgtatttttagtagagacggggtttcaccgtgttagccaggatggtctcgatctcctgacctcgtgatcctcccgcctcggcctcccaaagtgctgggattacaggcatgagccactgcgcccagccgatttttttgtttctttagttgtatccctatctgtaaaaaaattacagtgttgcaggccatattatttctgagttttctgaagtttagacatatagttttataaaacttagagtgtagatctgtgcaggacattctctttcatgttattgactctgaaaccaaattggtcacttccctttaaggcttttgaaatgtccaaccgaatttcaagttatatattttttaatcacattaattctaaaatggcaggttttgtcattttttgtacctcctcatgaagttgacattgtcagaaaggcaagtaaaaaatttattatgatattttacttttctctggatgcaaatcaagtacctacaattttgtatccttgctatattttactactatgtaatgctataatcagagatttaaaaaagcagtcttcatctggcaaggcaaattgtaagttttcttctaacaaaaattttactactcatgtttttcactttcaatacttatttatttaacttattcatcctttactgatgaggaaatgtccatagtacttattccatccatttctccatccatccatccatccgtccatccatccatccatccatccatccatcatccatccatccatccatccatccatccatccatccatccatccatccatactacagctatttattgaatggctaatatatgcttggcgcttttggcgctggaggcagagcaggaaaaaagcattctattagctttttctgtagaaaagggtttttgaagcctgttttttgcctgttgagtagcggctgatgctccttcttgggatgttccttgtgtaccttgcagaaactcagactcacacctagtgtatcatgctggtcttgctgcttatttcatcacctgcctcttgaaacttgctctaattcctctttttctcttaaagttttttctttctggattcctgcttcttggtctcttttctaccttggaatacattatttcttctaataagctcagggctaaagaggagctccctctcaccctctcctgcaatgggaccagcaggcatttagagtattaagtatctggctctcaacacaggcaagaagatgaacttagcacagagctcgtgtgtcagggggatatatatttatacaatgcaaagtcttttatccaaagttctgtatttaagatgaatttatatatatccccacccctctcaaaaaggaacagcaagaattttcagtgctgccacaagaaaatgcattgccaaactggaaggtcatgaaggtgaaatttcaaaggtgagtcgctttctcatttggaggagtttatttactttcaaaaaataaagagcagggcccaggtgcagtgcctcacacctataatcccagcactttgagaggaaaaggtgagaagattgcttgaggccaggagttcaagaccagcctgggcaacatagggatacctcatctctacaaaaaacaaaaaaagtcagctgtgcatggtgttacccacctgtagtcccatctactgtggaggctgaggaaggaggattgcttgagcccaggaggtcaaggctgcagtgagatgtgattgcaccactgcattccagcctgggtgacagagcaagaccctatctagaaaaaaaaaaaagaaaaaaaaaaaaaaagcatgctcagtataaataggtctattggaattgaagtactaagattaagatttgttctattgtctcatgtttttttctagaaatcacttacctaaagactttatttttaactgtgccctcaaacttagcataataaattatttctaaaacctcttaaaaagtatggaacagcattcgcctccactgtcagcaaaagatttagttagctgaagatatttaatatggcaatttaaggagcgtgtaaactgcttttcctggttccggtaaacacataagtttatgttgtgcgaaaaatatgctgggcagcaagtatcaagtgttctgtaagttagatgcaattgaggaagtagttcctggaaatatgtaaaattataattaaaattaaattataaaattatccattttgaaactacaaagctgtgttttaggattttgtataaacttcccccaaaggatcattcacggagcaggcccacccagtcagtgatctgaagtttagatgtgtcatcagaacttcgtagagtaggctaggattggtggctctcacctcccagctcagcacaatcccttggttccctgtctgagatcagatttgttcctgctttgcaaaatatcagcttgatgattttaggtttctaaaggccccttctagaccctggaactccgccccaggctgtactctcggcctttctgcttctgcacctacagctggtgatcattgccctctggctggtcagtggtggtctccagggcatgcagactatggcctcttcataagctgggaggcttatggatggcaggaggggatggaaaagtggggtgtgggaggcaggatgaggaggaagcctggcccatgtttctgagtgtctggctaggtagctattgagacatctgtgtgtctcctccataagtaaacatctattttcatgaatgagtgaatacaaagaattctctagtgctattttattacattttatgctttttaaatgaacatattacttattgaattggcatctggtaagggcatttctatggggtgcaaagctaaagtattcactcattcaacaaacacttttagagagtgtccactgtgctgggcattgcacagccactggtaacagagtgataaaaacagatacggccctgccctcctcaaaccttcagtcattgaggagatggcccgaatctctgtcttctggtgattagagggggatgtaagtgtgacacccaaagggatgcaggactaacaggttcctttgatggtcactcagatgccagttggcaacacctggcacacgggaggcacagaagcgtatttatggaaaatgctatacttggggtggcagtagatgagaacatcctttcttgtaggttctacattcacttattctatggcacagattagagaaggatctgtgtgctttttaaaaaatttttatttatttatttttattttttattattttttttgagatggagtcttgctctgttacccaggctggagagcagtggcatgatctcagctcactgcaacctccacctcccaggtttaagcgattctcctgcctcagcctccccagtagctggaattacaggtgtgtgccaccatccatgccaagctaaatttgtatttttagtagcgacggggtttcgccatgttggccaggcggtcttgaactcctgacctcaggtgatccacctgccttggcctcccaaagtgctgggattacggtcctgagccaccgcccctggcccggatctgtgtgcttttgaccacaaagatgacaccagggtttggctacgaaggatcctgactcgtgtgttcatccacaccagggccctgcatctttgcacagagaagggcatcgtgcatctttggaaagaagctgggtggggaatactcaaattataaggatgctttggtctttattcttagaaatgtgaggagtaggcaattacattttctctctggattttagtttccatgtactagtccctgcaatatttttttccattatgaagaaattgttctatgcaagaataaataccagactaggaaggtgacatgtgctgtaatgtccttttttttttttttttttttttttttttgctgataagaaatgttttgggaaccattacacaaagctgtgatcatttttctttctcttttgcagatttctttcaaccctcaagggaaccatcttctaactggcagctctgacaaaacggctagaatctgggatgctcagactggccagtgcctccaggttcttgaggggcacactgatgaaatcttttcatgtgctttcaactataaaggcaacatagtcattacaggtatggaagacatcaacaccatagactcattttttcttgattggctgttagagttcccaagctgaatactaacaggagttcatccccattccctacctcttttctggagtcactagctcatcttggcctgccctcatattttcattatttaattttagttttatgaggacccacaggagtgagcgctgccattgactgtagtaagcctttgtgaactttgaattttatttgctctagataaggtaacaatttgatagcctgccttacaggttactaaatttccccaggtgttttctatcaattgaatggttaatatttagtcagccaggcgcattggctcatgccaacaatctcagtgctttgagaggctgaggcagaaaaaatgcttgaggccagcctgggcaacatagtgagaccccgtctctacaaaaaaaatagagcattagctgggcatggtggcgtacacctgtagtcccagctactcaggaggctgaggctggaggagcacttgagccaaggagttggaggcttcagtgagctatgatcaggccactgcactccagtctgggtgacagagtaagaccctgtctcaagaaaaaagttgagtttatgtcagtaagtgttagtaaccaaaacaagtcaggatcaaaattctccccagttggctttacagcccattagagatttattctttgagcagagttgttttctcccctgctaaagcactaatgtctggggggaaagaacatgtattaaccatttttcaaccgttaacagtttatggtgaattaataatattagcaacatttcataagaaaagggtagtttagatcgtggaaaggggagaaaaatgacaagatgatggtatcatgttagtggagtgcctcgaggggaggccttggcagggaatgggtgccacaatagtgtggagtagggcaccctaagtgagcacagaagaccagatctgcctaagtaccagtgattctcatcatgttgagcaaatttaaaaattactagtctaataagttaaatgccacaggcccaaggctggctttacatattggccaattaggtggtttccttgtcagataacttcaggggtgctgagaattatctccccttaccacctaaaatgcctccccagtctacttaatgatggacagtttccgaaatcacagggcttacgatcttcaaaatctttgggcttatgattttcaagtgttaactaagatgtaggtactttgaaagcactgggaaaacaagccatagatttttgttgtgaacacaatatcaaatccttctccttgatgagaaaagaggtgaggggctatgatggagggcacagggcgctcctgcagggagtgagaaagaaggaagaccagcctttcctagtccacatggcctcatatgaggctggctctgcagtacttcttccctcaaccagttttcacagaagaccctggagagtttagcaaaagaatttttgttattgtgccttgcgttggtgccagcacatacattcctgagctctttgaagataccactgattaatttagtgtatcccaaagcaccaaagtgcttaacattggctcactagacaacagagcttattagattggggtgacacttttctcttgccatcgatggagcagtcactttatttgaaagaatctactctattttccgagtggaccctggtgtgataaactgcaggcattttgtagtggcctacctgaggctggatttagaatcacaaagtaaatggcagaaaaatagctggcatgaccgttacatttgttaaaacatgaagtgtcattttgtgggatatggtttttataggctttcctaattcctaaggcactcacacttcttatattgatgttatgtgcctggtccctgaaggtgagaaaaccagtagtgcccactgatgatgagaaaaaccccctaaaattttgaaatgttccaaagtggtatgtcctgcctcttcctaagcttatcatccaaacctggagatattcaaagttgctgtatttccactgggtggtgatgtttgaggggacggcagaggggatggctgaggtggctgcattctcaagttctctcccattctgagaagccatgaatcttgctagtgtaagtaagcaggatgcgtacctgcttaatttacaactagctggtatcgtgaaaaaaaaaaaaatcactactttaaaaatgcctgagctgctcagagactctgcagctaggcgcggagaacctagcccatttagcaagttgttaattaccaatggcccagaaaatgtcaacttgtagaaagagagaatgaggtgaatgaaatgaagaaaaaaataactgcatgaaatctgttttattaggcagcaaggataatacctgtaggatatggcgttgactgaaggaagctggtcagtgagcaaccttgctagcaatggtaatcaagaactggaacttcacagacagcagctctcttaatatttcttatactttctctttttctgcaagtcaactatttctacaactgtccttcatttcacagatatgaccattaaacatgacaaagttatgccactccaatattattatttgatggcgatggcaggacacagcataatgtttggctaatgccaccagttatttcagttgtgtttgttttttaaaagcattatgatactgaaaaaggagaccagaacaacttaacaacgtgtctcctggattttactttgaagcctattgttataatttctgttgaataaagtgtttggaggaaattccttgtacatgtgtatttatgatgtatgtttttagggtgaagtaagggaaataatgcggatctcatttaatggcaaatatcttctgtattgatacattgagaaaaatgttggcaggtttatttctaaggaaaagttaaacagaatattcagactattgcatttaaaaatctgggtggggccgggcgccgtggctcacacctgtaatcccagtgccttgggaggcagaggcaggtggatcacttgaggtcaggagtttgagaccagcctggccaacagggtgaagccccatctctaccaaaaatacagaaaaaaaaaatcaggcgggcgtggtggtgggggcctgtagtcccagctactcgggaggctggggcaggagaatcgcatgaacccaggaggtggaggttgcagtgagccgagatcacgccactacactccaggctgggtgacagagggagactccatctcacacatacactaaataaataaataaataaataaaatctgggtggaaaacgattgaagtatgagagaaaatgatcaaataccaacctgaatactgctgaaatattttaaaatgttttttaaaagcttggtttgtgtaaaagtacccaaatgcatattaaaattaatgttaaaagtacaagcactaataaggcctgaatctgaagcaagagaatgcctgaaaatcttatgaaatcattttttaaaaagagcttcattgatatgtaatcaatatataaaatattgcatatatttaatgtatacatcttcatgagtttgaacatagatgatgccatcatcaaaatcaaggtactaaatatactcatcatcttcaaccatttccttgtgttgttttgtggtttttgttgtttcctggtacaagctctttaaatgagctctatcctttgagcatatttcaaggtgtataatacttcattgtcaactataggtactgtggtgtacagcagatccccagaatgtgttctagaactcattttcttaataatgtgaataataccaatatggctaagtgcttaccatgtgccagtaatgcccaaccactttacgtagaacatctcatttaatcttcctaacaactgttacaaagtagatacaagccctgatttaaaaatgaggaaagtgagtccctgagaagttaagtaatttgccaagggcatctggatattaggtggtgatgttggttttagaaaccagggatgctggctccattacactgtgttcttaagtagaaaagatttaatatgggagaggagagtcagatgtataggtaggatgaattgaagtgagaattacttcttgggttatctatagatgttaaccctcaagaagaaaaaaataaaacaaacacaggccgggtgtgctggctcacacctgtaatcccagcactttgcaaggccgaagtcagaagattccttgagcccaggagttcaagaccagcctgggaagcatagtgagaccccatctctacaaaaaatttaaaaattagccaggtttgattgtgcaggcctgtagttccagctacttgggaggctgaggtaggaggattgcttgagcctgggaggttgaggctacagtgagttgtgattacaccactgcactctggcttgggcaacagagtgacaccctgcctcaaaaaaaattaataaaggaaaaaaaattaagtaaacaaacacacaaaaaaataaaccaaacctttgttgggactgttgggaagaggaggttccaatatgatgaagccaagaacttagattggagaaaactttgccaaaatttggctgcttcttttttttctaaaagcaaacctcttaagctttattagttttttcagctttattgaggtataactgacacataaaaattgtattattcaaggtatacaatgtgatattttgatatcacaaaatgaaataattaccacagtcaaactgctaattaacaaatccatcacctcacacagttaccttttcccccctgtggagagaatacttaagatctattctagcaaatttcaaatatgctttatttttaactgtagtcatcaagctgtacattagatctctgaaactaattcatcttgaaactgcaagtttgtaccctttgacaaacctctccccattttccccactccttgacccccggtaaccactcttctagtccgtttctactgagttttacttttaaaaattccatatgtgagataatatggtatttgtctttctttgttgggcttatttcactttgtcctctaggtcatccatgtttttgcaaatgaaagaattttcttctttgtccaggctaaatgatattacatatatctttatacaggcatacctcgtttaattgcaattcactttattgcacttctcagatattacatgttttaaacaaatttaaggtttgtgataaccctgcctggggcaagtctgtcagtgccattttttccgatagcctgtgctcactttgtgtccctgtgtcactttttggtaactctcacaatgtttcaaactgttgtatctgttatggtgatctatgatcagtattctttgatgttactattataattgctttggggcaccatgaatcatgcccatataaaacagcaaacttaataaatgttatgtgtgttctgactcccccaccaaccagccgtttcccatctctttccctttccttgggcctctctgtttcctgagatgcaacaatattgaaattaggccaattaataaccttacaatggcatctaagtgttcacgtgaaaagaagagtcacatgtttctcactttaaatcaaaagctataaatgatgaaacttaatgaggaagtcatagtgaaagccgaaataggctgaaagctaggcctcttatgccaaatagccaacttgtgaatgaaagggaaaagttcttgaaggaaattaaaagtactgctccaatgaacacatgaatgataacaaagcaaaacaacagccttattgctgatatggagaaagttttagtggtctggacaaaagagcaaacaaaccacaatatttcctttagccaaagcctaatctagagcaaggtactaacgatcttgaattttatgagtgttgagagaggtgaggaaggtacagaagcaacgtttcaagctagcagaggttggtacattaagtttaaggaaagaaactgcttccatacttaaaagtgcaaggtgagcagcaaatgctgcagaaagttatccagaaggtctagctaaaatcattaaggaaggtggctacattaaataaaagagtttcaatgtaaatgaatatcctttcattagaacaaaatgcatttaggactttcatagctagagaggtcagtgcctcacttcaaagcttcaaaggatagctgactctattgctaggggataagatagttggcgactttagttgaggccaatgctcatttaccattcctgaaatcctaggtcccttaagaattaggtgaaatcaactctgtctgtgctctgtaaatggaataacaaagcctggatgacagcacttctgtttatagcatagttcactgaatattttaagtctactgttgagacctactgctcagcaataaaaaagatttttttttcaaaagtattacttctcattggaaattcacctggtcatccaagagccctgatggagatgagcaaggggattagttttgttttcatgcttgctaacacaacattcattctgtagcctatagatcaaggagtaattttgaccctcaagtctagttatttaagaagtacattttgtaaggctatacctgccataaattgtgattcctctgatggatcttggcagggtagattgaaaactttctaaaagggttttaccattctagttgccattaagaacattcatcattcatcttgaatgatgaatcattttggggaggtcaaaacatcaacattaacaagggtttggaataagttgatttcaatattcatggatgactgaggggttcaagatatgtggttcaaaatagcaaaagaactagaactagtattagaaggtgtgactgaaatgctacaatgccacaataaaacttgaatggacgaggagttgcttcttatggatatacagagtggtttcttgagatggaatctactcctggtgaagatgctgtgaacattgttgaaatggcaacaaaggatttagaatattatataaactagaaggatttgtttatataaagcagcagaagggtttgagagaattgacttcaattttaaaagaagtttactgtgggtaagatgctatcaaacagcatcacatgcaacagagaaatctttcatgaagggaagagtcaattgatgcagcaacctttattgcagtcttattttaagaaactgccacaggcatctgaactgaacctgcaatatctccaaggtctgcctgcaactatgttatacatctgcacacctgtgttcattgcagcattattcacaattgtcaggatatggaaacaacctcctgagtgttcattgatgaacatatgaataaataaaatgtgatatatatgataaagatatatacgtatatgtgtattagattttcttacattacattgtcagataaagagacatatatacatatatattacatttctttattgatatagacatatatgtatcactatatccatatggatatatagatatcacatattctttatccatcatccatccatgcacgcttaggtggtttccatgtcttggttattgtgaataatgctgcggtgaacatgggagttcacacacctctttgagatactgattttattccccttggatatatatatatctagaggtgggattgctggatcatatggtagttctattttcaattctttgaggttctttcatactattttccataatggctgtaccataactccttatcttacatgtagtttgcaaatattttctcccattctatggttgccttttctttctgttgattattttcttatttgtggagaatatttttagtttgatgtaatcttatttgctttttttttttgcttttactgcccgtgcttttgctgtcatgaccaaaaaaaaaaaaaaaaaaaaaaaaaaaatctttgccacaaccaactctgtggagctctccccctgtgtttccttctgggatttgtttttacagtttcaggtcttatatttaaatctctaatccattttgagttgattcttgagtatgatgtaagataaggatccaatttcatttgttctatgtggatatccagttttttcagcatcatttattaaagagtctatccttttcccattgtggttacttcttttaaaactccaaaaaaaaaaaaaaaaatagaagcagatgctgactcttgcctgtctaactctttgattgctttagggaagggtgatatgcttttgtaacatcattcaaaagagtcagccaatgtatggcagtggagatccaacatcccatagaccaatttaggtggaggaaggccttggccagaaaatggcttatttctctagtttttatatgttgaagaagtctttcttaatatttattatggttttcagatattccaacctacttaaaataggtgtttgaatacttagaatcataagaaaagtgataatatgcccactttatttttgtttgcaggaaaaggcattgaagagttgtagtgtgctatgtgtggggtctggaagtcagattgcctgcatgtggattctgattccaactcttaatcattaggcaagttacctgaccactcctctgtgtctcaatttccttacttaaaaagtgatcataatagttctcttctttaggattaggaatacctggcacgggctgggtgtggtggctcacacctgtaatcccagcattttgggaggctgaggcaggaggatcacttgaacccaggagtttaagaccaacctgggcaacaaagtgagaccctgtctcaaaaaaaaaatggaatatctggcacataataaacatagtaatcaacatttactattattattatttgagacagggccttactctcttgcccaggctggagtgcaggggtgtgatctgtaacatctgcctccagggcttaagcaatcctcccacctcagcctcccaagtagctgggactatagacacatgccatcacgcccagctaattttttgttattttttgtagagatgagggctggccatgttgcccaggatggtcttgaactcctgggctcaagcaatctgcccgcctcagcctcccaaattgctgggattacaggtgtgagcccctgtactggtcaacatttactattatttttatgaataaaaacttagtcatcttatttaaacacatttctccagaaaaaattcggtattatttcctcagaaatcatacttgagatataactgactttaatgtgttataggtattgtaaggagaattatctagatcaattttttatcaattaaaaataaaagttaaagttcttagagtattatccttttaaaggttctgtattgaacagaggaactgagaagtaaagaaatcatcaatatagactattatgatctaatccatcttcttcatatgtttagttttcttatgtgagtctatgaaagaggattattcttataaaaagaaatagtttctaacagctcatatataaaaatatattagctcatgatttagcataattcccattttaaaattaaaataaatgcacttttgaactaaacaatgctttttatacacgtatgtctcacgttgccatgtaaaaacacatcaatcatcttaaattataagtaaatttatcttctgtgttttcgctgctactgttactctaaaacaatttatctttttaagtttccaaaggagcaaaatttgaagttaaaaaaaaaacctgttatcttaccaagattactttatattttgctgaattcaaattcgctgctgtcttggttagaaatgcttttgttgcaagcaacagaatacttgccatgattaaataccacgattaatatcatgattaaaacaatgtcagtcccaaaggtggctatgcaatggcatgaggactcaaggacccagagtttggtgactttccacttttccatccttagcatgttggcttctgtcctcctgagtaaccttcctgcttgcaagattgaggacagagctttattagcttaagcatcttgccatctattttaatctcatcaaggctaaaagagaactgcttactctcctccctattccttccattttctgtatcatctcagcaacgctatttctgctaacaatagaattatcattccctttttcctttattttctctatctatcccccaaatcataaagatttccctcaattaaaaaatcctagttatccagtcttattccattttaatctagaatctagaatctcattatcaccctggcactagaaactgaaacaatcctctagctaattgcccgagcttcctcctgccctatcaggttacttctttctaatataatcagaaaaaattccaaatatctgtatattttacaatttacgagacttttggataactagttcatttaataataggaacaaagtaggaattcttagagccttaatttaagctgacaacacatgtttaggaggtggtataactttgagtcttttatccctttttactacccgcccccaccttcttctccttgcctttcctctggaacaccctggtctatataagaaattcgtaggatgaatatcgattcagcatatgaaggggaagtgatacagttgtgaatgctgcacatcagagcaaaaccaccagtttctctctggtccgaaattttctgtcgtgctttgcagtttcgggttgtgttacttagaagcttaaaaatgagtatatgggtacttgtggccatgcaaacaatgggaattccagaaaggctctatgagagctgtaaataccatgaaggtgaagattgctctttgtcataccttttgggaaatgttggatggactgctttgaaaaaagttgcctttgctattattttcttgggactatgggatcttaagtaatcaccacaacaggccagatgttcatgtatttcacttaacaacgaagtgaatactttttactgctctcactaatgaaaactagaaaatgtcacagttttaaaagtgcataactttgcacatttttgttagttctcttactcagcaggtggcagtgttcatctttcagcaggtaagtaagcgcttgcttcttttcttgcagctacacattaagaataaagagtaacctttgtattgtgtcccttacagatcaggtttatgagtggatacataacaatgctcagattgtggtacagttaaacttaggaccacactggcagattggggcaaatgacatgtcttcttagtcctgatgcactgtagagacatcttctattctattcgtgaggacatagaccaataaggtgagtaagtgatagttccatttttttccataggcccctctgttgaaagccatattatgatcatttattttacaggactgctgttcaaattaaaacatgagaacaccctgggaaatacttttacccttaatatttttttaaggtatttgatgaattcgctctaatttttcttataaaaatactttatcatctcaagtactgggaggaagatttcaagatttgtcagttgctcttaattaatgatatttacatcttccttctcatgaacaatgatttccattgctgtgcagaatggaggaggcttcttaacctacttagaggtttagagatttgcaaaggggaaaagttactataaagctggattgattcagagtcatggctaccacgtgtggtcagggaattcaacactcaattatgtcttttaatgttaatatctgatcagagtatgacatggattatttttgttttaataaagtttattgtgttttcagtagattcagtgtgtaataattgtaagtactttgaatttgattacttttacatgattataaacctaaagggtcaaactgatttctgtttggttgtcacagacaaaagtaagtctgagaccagacagggaaaccatctgctgtcacttgcatttcaacaggcgatcagaggttcagaggagaatctgttttattgagtaaaaagaggaaatgtgaggcagcctctcattaacaagcattctatgaagacaggagctttggaagtggggtgattttctaattggtcttcaggtacatttggcagtttctttaaggattgctcaatgctatgggtggaaggttttctctggtggccattttctggaataagtggaggtcaatggtgctttgttgacatcaaactgtcataatggtttttatttgagaggaggggtggctgccatgacagcccatttctcacgagtgacagcattttggtgattgaaaataccgactctggaatcagaatgcctgttttaatatcctgctccacgaggttttggttctgagaccttgagaattcagtttgtgactcagttttctcacctacaaaatgaccttccctttctccattgagaatgtgccatttctaggctggaatcagttctgtctgtgtgacaggagggaagatcttgcatgcactgcccttcctgcaaagtgcaagggcagctcctctgcctttctaaagaccattcattgctgctgcagcagatcctttgtctctccaatgtgcttctgagtcactcaggttttactgactcccttggggaaagcaggtggtctatatttagaatagcgttagctgctttcccaagaatttgagctaatacttaatgagtattaatccaaacctttttgtagcattggctatatgtacatttcagataatctcttgctatctataagatcttcctcttagggttggtttgaaagaagaggataaaaataggagaatgtggatatctatatatatctatatatatctgaaagcgagtttctttagagggaaatgttgattgctgcaaaatacacattataacattcaaagataatttatttgtaaatgaatcatgttagcatatttaaccttcaattttgaaggttaaatgagtgaagtatgtcatctcaggtgttcatatagctcactatctaaagaagttcaagtttcccattcttatattcccaggtatctgtgagctgatcctaatctgcatttctggccccatctttcctgctcctgtatatcccagatgttataggttgagttgtgtccctcctaaaattcatctgttgaagtcctaacccccagtacctcacaatgtaattattagaagatagcatctttaaagaggtaattaagttaaaatgagaccacgggggattggggggggggggttcctaatgcaatatgactggtactcttttttttttaatccatcccctcaagtatttatttatttatttatttatttatttatttatttatttattttactttaagttctgggatacatgtgctgaacatgcaggtttgttacataggtgtacatgtgccatggtagtttgctgcaactatcaatccatcatctacgttttaagccctgcatgcatcaggtatttgttctaatgctctccctccccttttaccccacccccccgcaacaggccccagtgtgtgatgctctcctacatgtgtccatgtgttctcattgttcaactcccacttttgagcaagaacatgcggtgtttggttttctgttcctgtgtttgtttgctgaggatgatggcttcaagcttcatccatgtccctgcaaaggacctgaactcattcttttttatggctgcatagtattccatggtgtatatgtgccatcttttctttatctaatgactggtgttcttataagaaggaaacacgaggcaggcaaatgcatagaggaaagagcatgtgaggacacagtgggaaggtgccatctgccagccagggagcaagacctcagaaggaatgggagcaccttgatcttggacttctagcctccaaaactgtgagtaaacaagttgtttaagccacacagtctggtattttgttatggcggccctagtaaactaatacagcagatagactactcactaggtctaaaaatgtgccatgctttcctttctctgtgattttacttttacctaactactctaaaattccttttctatccctacaactggacaattttaccccctcatactttagaatttactgcagatatcattattttcttgtactcttttttgagtttctcccaccgactcttgccctccacactggaaaagataggcttccaaaattccattgatgcatgcctattaattatcctcctcttgcaaatgtagactagggttttcagaacttgggctggagatggaaaaggtgaaggaaccatggatcattggaggtaattgtggtttgtttttagaatgaaagaggctgacatctgactgagaagatggtcctaggggaaagagaaatgaagaatcagaagaaaattggtatttgctgaagccagttgcttaaggaggaagaggagggatgaaagagcagacagagagggaggttgacattataatgagaaacagctcctgttctgagactggaggagaggatgtgaggaagacaatggtcttgctaaattttctttgtttttatttctaaaatcattaagagcatgagctccggagtgtgagacaaactcacccgtccaaacccaaaggatgaactcggagacctggagaacagcgtgagacttttaatgaggaccttgcaagatcgggtgtctgataggcaggcacacccagcacagtttccacaagcaatttaacccctagagcacaggtccctcccctggttcctccctcgtaggctgagtactatgggggtcacagtcttcccagatgtcacctattgttgcacaggggctccaggtgttttttttttttagggttgtcttgctgcattttgttgcagcccacaatgcattgcaatcctagttagctcaagggctcttcaagtatttgacttatgacttaagtagctgggcaggctgataacagacaaaacgagctattttgcaggctagtaaactttcatcttagactaaacttcttcggtttgggtaaaggcaactaagttgccgcgggggaagggggaggctgacaagcaggcatcggctatccaagcaggggcctagtatactctgtttcttctgtagtttgctgacctaagccggttcaaggcactttgtcttggaaatggaccactgtatacattatttcattcaggtgccagactcctgtatccctctaccctttatgctggatctgtgacttggatggctttttttttttttttttttttttttttttgagacggaggctcgctcttttgcccaggcgggactgcagtggcactatctcggctcactgcaagctccacctcccgggttcacgccattctcctgcctcagcctcccgagtagctgggactacaggcgcccgccaccgcgcccggctaattttttgtatttttagtggagacggggtttcaccgtgttagccaagatggtctcaatctcctgacctcgtgatccgcccgcctcggcctcccaaagtgctgggattacaggcgtgagccaccgcgcccggcctggatggctttttatttgattcagtgttagtgtttccatgtctacaatgggtacaaatcctcactatcatcaaaggattaaatggataacacatgtaaattacatgtgtagtacagaacccaacaaaagcaatttttttttttaaataattcttgtcaatatcccccagctgaagaccaccaggaccatgattatagttgaacaaatttggttgatgccgccttggaaagaaaacgcactccctgggaaagcatggagtgtctcagagaattttagagagaatttattataggatatgagcttgtgttaggttaggtttagggactttgctctatattggacgctatcaggaagtgaggataattctgcatcatggggtacttcataaattatccatagggacagcagactagagcaagcctaacatgactggcaaaggagcagctgtcactcatatcagccaagagatggggttgtttcgtcatttttatggattggacaatgctcacgttctgtctgttcagacatgattctagcgtgctcttgtttttggtcttgatctccatcatgatcacagagtagccttgtttatgttgatgttctgtgaagttgtgttcaactggaaaacaccaaggcctggctctgagtatcaggccagtagaaacaccaagacccgagtaattaatgcctgatgactttgctttctggtgatgtctgctgagaatgaggtgttttttgcggagagaatagtcactgaagagaatcatatagggctgatgggcagcatcagcggtgcagccaaagttggagttgatggagttactggagcgatcggcattctgattgtgtgattctctcccatagggctaggctgtgcagcactggtgtggagaaggcacatcctaacactggccctgggctgggggtttacaaagagatcaggacaaaggacaggagttcagagttgaaagtgccagggagcacagatctgttggttccctgtgaggaatgggctattccatgaataaagacagaatatgaaaagactaaccaccaagaaaagaggaggctagatatcttttagagaatgttctgagctgaagccctgctgggtgatgggaagatcgttggctggaaagagcctaggccatttggaaataaggaggttggggaaaaatggaaaatcttgcaagaaggtccacgaaagtagactttgaattctccttgggactctgtggatttgtcaaacatcctgctttttccaagacaggatgcaggtgaagtgacaagtgcttctatctctgtccactgggatcatcaccttttcctgtttggatagataacattttctcatattccattttaaaaatcttttccacctcaagtgccttttggcactgctttagcagtttgctgtgtgggctgtacagcagctttgctgctgccccaatgtttcatagagatgtttgtgatggagcactatgtttttaacttatcttcccagggctgtggcccaagttcacggaggagagatgaggtcgggaaaaatgtggctagtacacatctacagtgttcacaacagtctgcctcctctgtcagggactcattgtctttggaataagccccataggacctggaggctgctgctggacctcagtaatgtccacaaagacctgcaacctcaggagtgttattgtcccttttcaatcaggtcctaccaccaggagacgaagcttctcttcttactcggagcttctccaaaatgtggcatgttagagtgctctaaatagtgaattaattgattgattgatggagtaaatacatgaatgaatgaatactaacatggctcatgactttaacattgattttcaaactcagctttatggagtctcagctatttttcaaagctcagtgagtgaggagctgagtacacggaatcctgtcttccacactgcactttagccagaggagtgccattaaaaacactttttttgtctttgattttagcctccaagtaaaaagcatttgaagaaaaattttttgaatcttgagatagagagatagagagttagatagatagatagcaagaaaccactggctgcaagaatgaagttctgcatttaattgtgcaaaatctggtcatgatctattcgtccacacttgttttccctcactctatcacatgaattctttgtttagtttatcttgtatgatgtgtccagatatgccctttctaatctctacacttttgttcccccacgctctatcctttaaccccaggtcatattataaatcttctctgatctccatggccagatgtgctcactccttacgctgaattccaatagcatttattgtgtctcaaggcccatcctttatgttgcatgttttacctcttcaaccagattgttcctccttcccttccccttccttccttccttctttccttccttcgttccttccttccttccttccttccttccttccttccttccttccttccttccggctttgctctttgctttagatggaatactctcaggaagtgagaataattttatatgattgggtgtcttcataaattatccattgagaaagcaaactagagcaaggttaaagttgtaattggtaaaggagcagctgtcactcataccagccaggagagggggctgtttagtcactttcgtggcttggacaacgctcatgttgtgtctgttcagatggccgtatggtgatttttttgttttgttttgtcttttgtcttggcccacatcatgatcacagagtagccttgtttgtgttgatgttcactgggtgcctgttatgggccaggcgtgttgctaggtactgggattcataaaagggaagacagacatctctccctcacggtttacaatttagtgagggttggggagtatatcaatcgaggttcaaacaatgaacggagtaagtagaaaacataaagacatttactgtaaggaattgtcttccaggattctgaggctgactaggcaagtctgaaattcttagggaaggccatcaggataagtgtcagctgaaacttttgccacaggcagaatatctcattctcctgagaggcttttattcttctctttagatctttcagctgagtgaatcagggccattcagactgtgtacgataattgcccttacctaaagtcagctgattatggattttaatcacctctacaaaataccttcataagacccagtacagtggctcatgcctataatcacaacattttgggaggccaaggtgggagaaatctgctgttaatcagataggttttcctttataggttacttgatgctttgcctcgtagctcttaagattctttcctttgtcttgactttagataacctgatgacaatgtgcctaggcgatgatctttttgtgatgaatttcccaggtgttctttgagcaaggccggggaaagttttttcgattattcccccaaatatgttttccaaacttttaaatttcctcaggaatgctgatctttctcaggaatgccaattattctcatatttggtcatttaacataatcccaaacttcttgggggtttgctcattttcaaaattcttttttcttgtctttgttggattgggttattccaaaaaccttgtctttgagctctgaagttctttcttctgcttgttcaattctattcctgagactctcaagtatgttttgcatttctctaagtgtgtcctttatttcctgaagttgtgattgttatttatgctacctgtttcactgaagatttctcccctcatatcttgtatcatttatttgatttccttaagttggacttcacctttctctggtgcctgcttgaatagcttaataattgaccttctgaattctttttctggcaattcagatttttcttcttggtttggatccattgctggtgagctaatgcgactttttggggtgttaaagaaccttctcttgtcatattaccagaattgttttcctggttccttctcatgcgggtaggctatgtcagaggggagatctggagctcaaggctgctgttcagactcttgtgccacggggtactcccttgatgtaatattccccctctttccctagggatgtggctttctgagagccaaactgtagtgattgttatttctcttctgaatctagccagcaagcagggctgccaggctctgggctggtactgggggtgtctgcacagagtcctgtgaggtgaactgtgttcagttctctcagctgtggataccagcacggtatttgagatgtctcctggatcctgcaggaggaatccacttccttcaaagggtctgtggattctcttggcttttctggtatactcctgcagtagtttttggagcaatagtccacaatgctagtctccacattctgctctgtctatccagagtgggagctgcactttagtactgcctcctatctgccatttttttttcagtcacctgtcagttgagaaatgtgtttctattttcctttggataactggaagctaactaatgttaagtttaatttttaatttaatgtttaatattaagactacttaaaagacttatcccaggagcttaatgcaattattaaagtcattgaatctgaaactagggaactttaaaaataccagtgcctgggctccactgtggaccaattaaatcagaatctctgacagttagggccctgaccttggtagtttgaaaatgttcccaggtgattctgatatagccaaggttgagaataaatgctctaaatatatttgaattttttggttttcctgttttatacatgttttgatattgaaatgatcattctatcatctttggaaataaatgccttcataaattggaaataactaattatttcggtaaaaataaatacatgttattaaagccactgagacacttgaaatcaccttcctagactgtaagcacatggagggcaggtaccacgtgttacttagacattcattaggataggcaaggttgtgctatagaaacaaacaaacacgaaatacacaaattgctcccctctcaattcttagatgattcacaaaacagaagtttatttctcacttctgtaaagtaagcctgctgtgctctaggtgactcttcaggccaccagttctctgtggatgactcatgtgctgctccacatcaacacatggtctcaggatcactgagacaagggcagagaggttgtagagttcagaactgacaactgacacatgacacttctgttcagtttttttggtcacctagccatacataacttcaaaaaaagggggaaagggctgtgcacagtggctcaagcctgtaatcccaaaactttgggatatcaaggtgggaggatcacttgagtccaggagttcaagaccagtctgggcaacatagtgagaccttgtctctacaaaaaaaaaaaaaaaaaaaaaaagaaagaaagaaagaaaaaaaagaaaaaaaattagcgaggcaggtggcatgtgcctgtagtctcagctattcaggagactgagaggtgaggattacatgggcccaggagtttgagcctgcagtgagctatgattgtgccactgcacttcaatctgggcaacagagtgagaccttgtctctataaaaaaggtggggaggaatgtaatcctttgagtacatggaagttgaagaaaaatagatactgattaacattagtaatatctagcctgtttggttttatatttctgcacttaacctaataactctcatagtgtgagagcttactagatattcaggaatccacattaagttaccctctcttatccttacaggatatgttccagtcgccagtggatgcctgaaacctatatatataatattgagccctgtatatactatgtttttcctgtacatgcatactatgatgaagtttaatttataaattaggcacagtaagagactaacaatgataattaataataaaatagaacagttagaaaagctatcacaatatactgtaataaaaattatgtgaatgtgatctgtcttttccctcagctactaagtgacggagggcaggtagtgtctacagtcacatgctggtcaaagggatgattcgcttcccaaatgggacagagtgggatggcataagatttcatcatgctactcagaatggaaagcaattaaaaatatataaattgtttatttctggaactttttactgattatttttgggtccttggttactcaaggaccacagttgaccttgagtaacaaaactacagaaagtgaaattgtggataaggggaaactactgtgccacattttcttcactgttagagattatgcatcattgtgggtgttcatgcatgtgtgtgcatgtgtatttttctctccaggcaggtgcatctcggcatattggctctgcgagtctatagctctgcagatttgctatctctgggagtggaagagcagagctgggattcccatacctatagctgtgagatccaaggtgacctcaaccacaatgatagtgccaccacagacactccaactactcattgatcctcactcacgttttcagatttttctcatttatactcaataaaaaagcaaatagaacttccagagtgtttaaatgactggggacaatagccttgccaagtagacacataaaactgacccaccttgggaagaacagtgaacacattattcaaaaatatcacaataagtttcagggaggagacaaataactctattttctatagacaaaaaaaaaatcattttgcaacaaacccagataagttctgttgtgagtcagtaacgtagttcctggattgctcccctggtcagatacataccactggctagtgctgtccctgcatccccagatcggcatagctctggagaatggggacttgactagaaagggaaagacaggctgtcctgaggtcaaggcttttcaagaaccttaccagtgacctgccaagcttctgcactttccaaccccagctgttcaggtatcaccacctcaaaaggaaggttcacttgacagagacttccacaggacaaactcaccagaaaccctctttcctgagaccaagtagagtgagagcattttcatagtagagagaaaatgaagacagactcatatttattcagacactaaattttcattggaaataccctgtttgtatttaggttttataaaattcccagttgaaaaactagattgtgatccaagttgttccaaccatgttgtaaaaattgtccaataactaaactgagtagcaaataatcatttttctttaatagtcacacctacattgacaggcctggtatatcttttttagaagaattgttttttttttgttttgtttttctttttgtttttttgagacagagtcttgctctgtcacccaggttggagtacagtggtgcgatcttggctcactgcaatctctgcctcccaggttcaagctaatctcctgcctcaacctctaagtagctgcgattacaggcacccaccaccatgctcagctaattttcatatttttagtagagatggggtttctccatgttggccaggctgatcttgaactcctgacctcaagtgatttgcccaccttggcctcccaaagtgctgggattacaggcgtgagccactgcgcccagccagaattgatttgaacttaaagcaaaagtatctgtttcaaaactacatttattcgagttaaataaattcagtaattcttatgtcaactcaatatgattaacatcaaattaataaagtgaaaatgttagttctttagtcacaccagccacattttgagtactcaataaccatatgtcaccagtggccaccattttggacagcatggatatagaagatataataccacttctgcataatgcagtcagatatatttatagctgtaactctagccacatcaaggcaatggccaaggtcagggcagtgaacagcatttgcttttcctctacctagcttgtaagtcttatactttatgggcatatttgtaatcacctgatgtgttcttgcctgctgcacagataagcccaattcactgagacagtgtgatcgcagtaaagaaagagtttaggccaagtgctgtggctcatgcctgtaatcccagcactttgggaggccaaggcaggtggatcatgaggtcagatcgagagcagcctggccaatatggtgaaacctcgtatctactaaaaatacaaaaattagccaggtgtggtggcacgtgcctgtagtcccagctactcgggaggctgagtcagaagaatcacttgaacctgggagtcagaggttgcagtgagctgagatcatgccactgaactccatcctgggcaagaaagtgagactctgtctcaaaaaaaagtttaattaacttaagcctggtcaagcagaaaggctggattcattactcaaatcagtctccctgagaactcagaggctaggtttttatgttttggtgggtaaggggctagggaatgggtgctgctgattggttggtgattaaattttaggggtatgggaaatggtccttgtgtactgaatctgcctctgagtagaggtgggcacagcaccagttgagtcacgagtcacaggtctgggtggggtcaatcagttgtcagcatgcacaagtctgaacaacatctcaaaagaccaactttaagttctgcaatagtgatgttatctataggagcaattgaggaagtcacaaatcttgtgacctatggccatgactcctgagcgataagggattatagaaactatgcttggctgggcatggtggctcatgcctgtaatcccagcactttgggtggctgaggcagcaggatcaatcgagcccaagagttcaagaccagctgggtaacataatgagaccctatctgttaaaaaaaaaaaaaaagaaagaaaaaaaaagaaaaaggaagaaaagaaaagaaaaagaaatgaaaagaaaaaaaagagaggaaaggaaactacactgacattttagcaaaattcagacccctccaataatactaatgctatagcttttcattagtaaagaggggttaggtttagggagggactattatcatccttgcttcaaaattaaattataaactaaattcttcccatggttagcttggcctacaccctacacacaggaatgagtgaggacagccagcttgcaagggtagaagtaagagtcagccatgctaactttctctcattatagtctgcaaaggtgggtcatactgactctaattgattgactgccagactagactccttgctagtccagggccttggacgtatcacccaaggcctttctgtgaaagacactcaaatatttgttcaatgatttctaattgtatccattacttatttgtagcttcaaaaacaacgtttgaatcttaacttgtttcaccttgagttaattttgtttctatacctcttcaaagaaaaggaagattgaaggggtctttaacgcctccattaactcctgcaacgtgaatttgatatactctcttttgcatgaattcagctttgtgatttctgaaatggtatcacctgaaagccacttaaggccagaccaatgaaatgttacaggcaatatttgaacctaggactgactgtttttttttggctctgctcatgtctcttccaattctaaaattttatgatttaatgattttggaaatgtgtcaaagagagacttagtgtaattcaaaataaatttcaaatctgaggtgtcttgttttccttttagatatttagcctgacaaatataaagttttgaatcttaaatataattttcatgttttgctctatcaaaaacacaatggcaaaataacagatggaaatgcatttctcaaacgaaactgccctaaattacttcagcaatcacttttgataaatctttagccacctgtgtatattattaaaacatcaaccagcaggaagcgtataattttatttgggtggaagtctttagttttaaggtaacaaagacaggtgaataacagcgttttcagatacagcctattctgaacaatgagctttgacagaaccctgctagaaatttattctttgcgcttgagtcttctgatgaaagtttccagcttgaagcaatggattcaggtactatattatttatgcttctgccgtaattctaaatggacccttttaaatcaagagctagcacatcttcataggaaacctcaaacttgtacacaccaaccccccataccatctaattataaaattgaacattatcaaagagaagaaaagaagataaaaagagtttctttagtacttaacagatgaaccatttgactagtctctgtgtattacagttttttgtttacaagaatgcttttcagtggagcagggaccttgtttatatttggtgttcccaggatgcttgggtacagtgatacttaataagtgcttttctaacaaagtggcattcaagttaaagctcagtcgggcagccaaattccccttccaagcattaagctatacttacagtgtacttaaaggatattttatgtggaattataaaagttaacacttctggccaggtgcagtggctcatgcctgtaatcccagcactttgggaggctgaggcaggcgaatcatttgaggtcaggagtttgagaccagcctggccaacgtggtgaaaccccgtctctactaaaaattcaaaaaataagttagctgggcgtggtgacaggtgcctgtaatcccagctactgggaggctgaggcaggagaatcgcttgaactcaggaggcggaggttgcagtgagccgagatcgcgccactgcactccagcctgggcaactgagactctgtctcaaaaaaagaaaaaaaaaattttagcacttctattcttcttttgtctgggtctaactatctttagactttgtctctttattcatactgagatctggataagaggcacatacaaatcacactttctcttctattgccagaaaaggatcttcaaatgttaggcttcaactctaacacgtttttctccttcactgaaacaatcgatgagagttgaaacgactactgaataagtattcttataagggcctgttgttttccatgaaagaaaatatatttgcagacctgttaccaccaagggattgcggtcaagggaaggctaaagctttcttcctccaccaacggattgcttaaagcccctttagacaaacataaaagactcaaagtcagtatgcttcacttcaagcacagctttttcctgctaagctgctcctactatatggaaattctgggggtgtcaatgtttgtatgcccaactgagtatctgttataaaacacacttttcccaagcccccacattaataatttctgacacataaaaaattaagagttcagatttaattaattgtggacatttaggaaggctaatttgaaagtgtataatatggttaagctttgtgtctccacccaaatctcatcttgacttgtaatcctgataactcccacagtccccatgtgtcaagggagagaccaggtggaggtaattgaatcatgggggtagtttcccccaagctgttctcatgctagtgagtgagttctcacgagatctgatgtttttataagaggctctgccccccccccccccgctttgcttggcatctctccttcctgacaccttgtgaagaaggtgccttgcttcttctttgccttctgtcatgattgtaagtttcctgaggcctcccaagccatgcttaactgtaagtccattaagcctttttcctttataaattatccagtctcaggcagttctttatatcagcgtaaaaacagactaacacagtaaattggtactgaggtagtggggtgctgctgtaaggatacccaaaaatgtggaagcaactttggaactgggtaacaggcagaggttggaacagtttggagggctagaagaagacaggaagatgtgggaaagtttgaaacttcctggagacatgctgaatggctttgaccaaaatgctgataatgatatggacaatgaaatctaggctgaggtggtctcagatggagatgagggacttgttgggaactgaagtaaaggtcactcttgcaatgcttcagcaaagagactggtggcatattgcccctgccctagagatctgtggaactttgaacttgagagagatgatttaaggtatctggtggaagaaatttctaagcagcaaagcattcaagatgggacttgaatgctgttaaaagcattcagctttattcacaaagacatggtttggaattgaaactcctgtttaaaagggaagcagagcataaaagttcagaaaatttgcagcctgacaatgaagtataaaagaaaaacccattttctgaggagaaattcaagcctgctgtagaaatttgcataattaaggaggagccaaatgttaattgccaaggcaaagggaaaatgtctctagggcacgtcagagatctttgcagtagcccctcccatcacaggactggagggctagaaggaaaaaattgttttatgggtggggcccagggcccccctactctgtgaagcctagtgatttgtcaccctgtatcccagctactttagtcatggctaaaagggtccaaggcacagctcaggccatggcttcagaggtgtgctgcaggggtggagccctcatgaagaacctctgctagggcagtgtggaagggaaatgtggggtgtgggcccacacacagaatccctactgggacactgcctagtggagctgtgagaagagggccaccatccttcagaccccagatggtagatccactgacagcttgcactgtgcacctggaaaagccagaaacactcaatgctagcctgtgaaagcagtgaaaaagggggctatacactgcaaagccacaggggtggagctgcccaaggccataggagcccacctcttgcatcagtgtgacctcgaagtgagatgtggagtcaaaggagatcatttcagagctttaacatttgactaccccactggatttcggacttgcctgtagcccctttgttttggtcaatttgtcctatttggaacagctgtatttaaccaatgcctgtagccccattgtatctaggaggtaactaacttgcttttgattttacaggctcataggtggaagagacttgcctcatctcagatgagactttgcacttggacttttgggttaatgctggaatgaattaagactttaaggccaggtgcagtgggtcatgcctgtaatcccagcactttgggaggccaagacaggcagattacttgagtcaggaatcaagacaagcctgaccaacatggtgaaaccccatccatacaaaaatacagaaaattagctgggtgtggtggtgcatgcttgtaatcccagctgcttgggaggctgaggcaggagaatcacctgcagctaggaggcagatgttgcagtgagccaagatcatgccactgcactctagcctgggcaacagagcaaaactccatctcaaaaaaaaaaaaaaaaaccaaaaaaaacccaaaaaacaaaaaaaaacttaggaggactgttgggaaggcatgattggttttgaaatgtgaaagggacatgagatttgggagggtccaggggcaggtggaatgatatggttaggctttctttccccacccaaatctcaggggggttgtttcccctatgctgttctctgatagtgagtgagttcttatgagatctgatggttttataataggctcttccctcctttgctcagcaccccttcctgctgccttgtgaagaaggtgccttgctttctttttgccttctgccataatcgtaagtttcctgagacctatccagccatgctgaactgtgagtccattaaacctcttgcctttataaattacccagtcttgggtggttctttattgcagtatgaaaatggacttttcattacctaaagtggattccaatttgaaacttgccatgttgatgctgaatactcatttccagtgatgctaggtaagcaccagaatgtagttactgctgggataaataagtgcactgtagttctaggaagatatgctttgtggagcatatttccacaagtaattattagtaaatatgtccaaactggtcaggatgaaaatataggagagcattacatttgcattttagcatgtatgtcttttctaaataataaaaatttgtcatttatgcttaccacatttatattaaaaaaggtttagcaggagggaggtgagggttgaaaaattacctgttgggtacaatgttcactattggggtgacaggtacactaaaagtccaggctccatcactacacaatatatgcgtgtaagaaacctgcacttgtaccccctacatctgcttttaaaaaaataatctgagaataatctactttgggaataggagagaattatccttttcctttttaattaaattagaacaaaatttattagttaattatctcaggtttgtttgcttcaattttggaatggtgtgaccaaataaatcaatgctcctggactgttgcattggttttctaaaaatggagtgaagagaagtaagaggacttacatttctattgctttaattttttatgcaatagtgatgttgatttttcagagcatgtctcctcaaaatagtccagattttctgtcattacaatcctaattggagaaaacttagagtttaaacatctttttaagtttttgattctgagtgatatggtttggctgtgtccccaccaaaatctcatcttgaattcccaagtgttgtggaagggacctggtgggaggtaactgaatcatgggggcaagtctttcctgtgctgttctcatgatcctgaataagtctcatgagatctgatggtttcaaaaagagaagttctcctgcacaagttttctctctttgcctgctgccatccgtgtaagatatgacttgctcctccttgccttctgccatgattgaggcttacccagccacgtgaaactataagtccaattaaacctctttttttttttgttgtaaattgcccagtcttgggtatgtctttatcagcagcatgaaaacaggctaatacactgaggaaagggagaagtaaagatatttacatttgcctttaaatgtctaatatgtggcaagtggtttgtaaaggttatcacttttaaacttcgcagactgtctggaatttaagaacctagctaaccaaccctaaatgacccaactagtgatgacagagcacagatttgaaccctgaaatgtctgccttaaaatcttatacactttccaatatgctgtactacctccactagttaagaatcacccctcatgttgaaatttaatatagatggccttgagatgccaaaaatgagatatctataactatgtctatatctatagttttttagtgtttaatacattttttcttaatcttacaacttcttgaggatagagtcaatatttcatgctctttatgtctgctgcaaacattgattagacttgtcaggagcacagtgccttgatggtatctgatagactaattgcttacagttcattgttaatccccaggcttcttcatttccttagttcaaataaggtcaatgttaataataattgctcaaattccactgccttcttatcttcacttgtattctgaaggatctcaatttaaaatctctcctaatgatttctaggggcccctggagatgtttcatgtcaatgcagagtttagttaagatgtttagttctagactgccttgattatgtccttggactgaatctgagaaataccactcaccctgtgatatggtttggctctgtgtccccacccaaatctcatcttgaattatactcccataattcccatgtgttgtgggaggggccaaatgggaggtaattgagtcatggggactggtctttcccatgctattcttgtaatagcaaataagtctcatgagatctgatggttttaataaggggagtttccttgcacaagatctctcttctcttatctgctgccatgtgagacgtgcctttcactttctgccatgattgtgagatctctccagccacatgcaactcttaagtccattaaaacctctttttcttcccagtctcaggtatgtctttttcagcagtgtgaaaactgactaatacactctgcaaatcattcagtcacctggtattttaaatttttttttctttttgatccaccactaagagtcatggcagccagtatttgcatgtgtgttttttctttttctttattttattttattttatttttgagacaaagtctcacgctgtcacccaggctggagtgcagtggcacgatctcagctcactgaaacctctggctcatgggttaaagcaattctcctgtctcagtttctggagtagctgggattacaggcaagcatcatcacatccagctaattttttgtatttttagtagagatggggtttcaccatgtttgccaggctggtcttgaactcctgacctcaagtgatccacccacctcggcctcccaaagtgctgggattacaggcatgagacaccatgcccagctgcagccagtattttttaatgcctccatagtatgtgatacaggtaccagttactgggaatgggtaaagggtaggttttccagagtttccaaagctgcaagtcctgataagtggccttttccttatactcctgtgtctcatgaaacatgaacgtagcttcttcagcttttatctacaacctgccctcttcagggcttaaatacctgtttgtgagaggtagagtaaggagcaagtattttactatcctctataaattcctcactccttgcaaatcatctccactaaaacttcaccattgcatcaggtactctcagacatgcttcagtctctaggtaccttggtatctaggttttagatatctagtatattagatctagatatccaggtatgtagatatctaatgtattgcaaaggaaaggtttcaacatgtttgacttggggcaccatattgttttatacaattaagttggcatatgttttaattcccccaactctcatttaatattcctatccagctttacaatgtatctgccttcttcctattcaaagtttagcattgccttcatctaggagcttgttaaaaatacagaaatttggtcactactccaggcctactgaattggaatctgaattactgttgtcaattccactagttaacatcaaagtaattcgtattcatgttaaagttaagaggttatgatctttattagtctaccatgccctgaacttattaggtaacgatgagctaggtagtttgaacaaaacctccaatgaaacaactaaaatgaactggataaaatataaaattatcttaaggaggtctcagactgaaagatttctcatgtgcctggcagaagcaaacaaaaattgccacaagagaatggtttcatcatcacaggactaaaattacttgtatagatagttttttttttttttttaaatgtgagccttttattaaaataaagaaataaaactttactaaataaatggaaatatctttctagataaagttgtacaacacttcaaaatgcagaattaccttatttgatttatattttataaacttgctttgtatttttcaatgtaaaaaggaaaaacaaacatgtaaaccagttcacactctccctggcggaacagattggtccagggataattgctgattatactggaacgaataattgtaaatacatttcactttgctagagatagcaagaaacccaatatactaacagaataatatgctacaaccaaacaaattataacataatgaaagaaaagtaataaatattaatctaaagaaagttagaaaaaaattaaggtaaaaacacaccataaataataacaaaaaatattcatattgtcaataaaacaccccagcttttaaaagctttatattaagcatatttctatatttctatctaaaatgaggtttttttaatcttataagatagtttattcagtttataaaagagaaataggcaaaatatatttgtatgacaaataacatttatatgattatttcagcacttggaattgattcaataaaagctaaagccctttcctcattaaaaaaatttcatttaaaaattagatatgaagcattgtaagtttaacagaataatgatcactattagctgttaaaacggtcagctaactgctatactaagacgtttggatagcaaaggattaagcttggtctctgaagatagacactgatcctttccttctcacgttctaccatggaccagttgggtaagccttagcaaattaccatattgcagttccttcatcagaaatatgttcataaaaacagtacctcctctaagggttttctccaggattaaataagttaataaatataatgctcttaggataatccttgctacatattaagttatctataaatgcaagcttttagtattactatacttaaatatagaactatcagaggtattgcagtaaaaataggaaagaaaaaattttactgttactgctataattatcatactgctcacagtctatgatactacaaattttaattaaagctttcaattgaataggtttttgttaaaaccacaatcacattaaatgtatataacaactataagatttcacctatatttcaaaagtgttaaagtataagaaagtacgttaggatgtaaataatatgttaatattggcctgaaaatgtagcaggttataaaaaaattgaattgaaagaatacataattgttattctacgtcatataaattcatgtctagtatcccaagaagactaatttaaaaaatgcgaattaataagagataagcaaataggaaagtatatatttgtaaaaataaaaacatttataataactatcaggcaactattaaaatcacatttaaaatgcattcattcaattaatatactttcccattattatttattcatgcattgttttatatagacatatgtgtgtgtatatatgtatatatatatatatttgtattcatttgacattctcttactttactaatacctttagatctgaatttcaattttctttttttttttttgagttgcacaaaatttttattttttttattttttattttttattttttatttttattttttttaattttttttattatactttaagttttagggtacatgtgcacattgtgcaggttagttatagtttttaaagtagatatctaacatgctatcaaagataccagatgctcagagaacataggggacatgaatgaggtccagcaaaacaacaggccacagcaatagactttagatcaagaaattattagacacaaaccaaaagacaactgactatgcttatttgaagaaatatttaaaatatctaaacttgggttcagcctccatgagtcaaatctgtaatctcagtactttgggaggctgaggcaggcagatcacttgaggtcaggagttcgacaccagcctgcccaacatggtgaaaccctgtttgtactgaaaatacaaaaattagctgagtgtggtggcgcacacctgtagtgccagctactcagaggttgcagtgtgctgagatcatgccactgtactctagtctgggcaacaaagggagactctgtctcaaaaaaaaaatctatacttggaaatgtatttagtgaatagagagctgtaataaaaagtgacataatagattttttaaaggaccaaatagaacttctacaactgaaaaacagtaactgaaatttagacacaattgatgagtttaacagcaggctaagctgaagagagaatgtgtgaactgaaaaatggtcagaagaaattatctagcatggagagatactagaagggtggatgaaacactgtggaaaaatctgccatgtttaattggagacatggaaaggaaggagagagtgagaagggtacagaaatggctgagaattttccagaactatttaagaagctaaccacagattcaaaaagtttattaaatcctaagtataattttaaaaaaccatatctacacacatagtagctgaaacgtatcaaagaaaaatcttgaaatctattcttgaagaggaataaaggcaaatattcctgttactatgtggcataacacaccactgaaaacataatggcacaaaaaaacaaccttatgctaacaaattctgtggcttaggaatttagataagacagagcagggttagtttatctctgatcaatggcatgtgtgagtgggatggatgacttgaaagacaggctttcctgtttacagtcctagcgagcctacttggtttctccaacatggtagtttcaggctgatctgtttggttttgttttttaaaacatggcagatggattctttcatggtgaacacccaagagcaacaggcagaagatgtactgtgtttgatgacctagctttaggagacacattacctcacttcaaccaaacacttgtgtgtgaagaagtcagaaccccacctaaattcaagcttagcggacatagacactagtcaattggagaagtgtcgaaaaatcagctgcattaaaaaaaatcaccttgggctgggcacagtggctcacacctgtaatttcagcactttgggaggctgaggcatgtggatcatttgagcctaggagtttgagatcagcctgagcaacatggtgagactccctctctaaataaaataaaataaaaataaaaaaatcaccttatcaaaactaggaaaagctgtatgcacactaaggacaaatctccttagtagcatgaattactgcaataacttaaccaagttgtctgatatgattttcatggtgctttattgaacacctattttaatagatttatggagctaccggttactagaggagatatccctggcttatgcaaatttcattccgcagcaaaataccaagacttcttggagagacttttaatcactttaacttaagctccaatattagttgaactatataaacagatggtcagaatgatcttcccaatatttagaaagaaatacattttagtcccaggaaaccctaattcaatagaaccatgtgaaatgccacaaatacttagtgaacaagttagaaaaatggaaaataaaaataaagaaaaaagcccatttatcctgaccaatcaatttaattagaccacaatagtcaacaaaatctagcccaaccctctagatttggtcatatgttcactgttaaatcaaccccttgtccaaagaaatataatgcagtgactggtctaatctaggtacatatctacccctctaggctggaaagccattagtttccctcttaagcaagcagatacatagatgaaaattagcagtcattgggatgtgacaaatagacgcaagtagagtcaccttcaagtgtccatgataggagaaggtgtattccaggcagagaaacagcttatgtaaagttctgcaagatcattgatcatttgggggaaaatggcaaggaagtgttatgactggagtaaataatatctaacatccttggccactgaaatcacaggaaccagactataattatgtcacactaaaaggagattacctaattgtttcattaacaacacattttcaaaataaaccagagacctgtattcttatggaactgagataggagaaatctcataaatattctctggaaaaatatagagaatgagagggtacaatacaacgtattatataaaggcttaactcttaaaaaccttatttatgttatctaagatcttagtaactcagcttcaagctaacgttgactaccctcaattatagactctattcatgggtccatgaacctgacacttgaaagcttcccttgaaaattacctgtcaaaaatatgctttatccaagtgaaaactaggtttataaatacttcagcctgtttttaactctgtctctttagactaatatgtccttttctgagcagacatcatttagggtgaccttttcaaaatagagtcaagggttcaggaatcacactggctttgcaccttgctgcttacaaagtgtgtttgggaatgttgttgtattgattacttacaacaaccctgtaattgaggtatactgataccccttttacagaaggataaactgaggctcaggaaggtcagtaattttctcaaagatacacagatggtcagtgacatatgaggatcaaggtcacatttcctaccccaagtccagcactcctttggcaggtgctgtttcctgtcatcagtaaagcagatgttagccaggcatggttgcttacacttgtagtcctcagcactttgggaggccgaggcaggtggactgcttgagaccaggggttcgagaccagcctgggcaacatggcaaaccccatctctacaaaacatagaaaaattagctgggtgtggcagtgcatgactgtggtcccagctacttgggaggctggggcaggaggatcacttgagcctaggaggcagatgttgcagtgagctgagattgtgccactgtactccagcctgggtgacagagtgagactctgtctcaaaaaataaagcagacatcactagagcttctcatttatcaaagtacaatttgaatcacagaacccacatcatatattaagctactctatgtaactggaattatggcaatagtttgtctatacctagaatactagaataataaaaaatacacattacctatttttattgtataattgacccttgaacaattcatgagtcaccagtgctgacccccaggacagtcaaaaatccatgtataatttttgactccccaaaaactttactaatagcatacagttgaccagaagcctaacaataacatagtcgattaacacctattttgcacagtatatgtattatatatggtattctcataataaaggaagctagggaaaagagactgttgtaagataatcataaggagacttcacagcctttagaactgtaagaaataaagctctgttctttaaaaattaaataaaaagaaaattataaggaagataaaatacatttacagtattgtgccatactttttgatacaatatgtttatgcaatctgtttataagatgaattgtctgtctgaaatagtgggcaaccacagttgtagacctccatctatgacacatatcaagaaattcaactttttcttgtaatgttatgacttttctctactttttgcaaccacttccagcatcactagtggcactttatatgagtcccatgctgttagtgaaggtttacagtactgaattaaatacaatgaaaaatctaagagagatcattttttactgtgctttgcaatttgctggagagatgaactgctcacacagagatgattggcatcacacggctttttaagaggctacttgccacacttgagctatttcaataacaacaggaggtgaacacaaaattgttatggtagcacaataaatactacggttatttttatgcggttatgattcaatactgcatctttatgtttgtttacatttttcttgatggtgaatgacatcacgtacaatctgtgtgcgtaagttttgataaattttttataataggtttgtgtatattttatgctaacaaatgatataacaagctagtatttatatatattttatgcattcataacatacctgacttcttaattgtgtccatatttctaggttatgcagtttgcacgctttttcaaattgtagcaaaactccaaaataaatatattttccaatatttttatcgcatgggtccccgtataagcggacccatgcaatttgaacctgtgttatttgagtcaactgtaatttttagttgaacactatagtttcaataaagaaaattatcaaaacacatacaaaaagcaaagcaaaacaaaaaccacacaagtgtgaataaaacactgcattgtatggatggatcctacgttcttagctgtttgttcaaggctgcctacatttagactccaagcacttctgaatcatgagtcttcccattctcccactctctgtgtcctatattgtctcagctttgagtccccctactgtgacttacactctttcttttgtatcttcgctacacctcttccatttctgatttcctacatctgacttgagctttcaggctctagtcattaatagactctaacagtaactaataatagactctaacagtcattattccccactaatccctcagactatctcactgtaactctatttatgtctaatctttgtctcagaatgtgtatgtgatgagagcaaggcagatggcagcttcatggtttctctggcgtaattcataaattacctttttatttgtcttcaaaccaagcttcttggcttaggttgcagaagtaagtccagcactgccaaccaggccagatgattcttaattggttaaatgtaactttctataagaggtataaagttatttgtttacatatcttaataatgctgccaaaatgtcccccaaagctttagcattctgcatttccatcagcattgcatgagagtgcttgtttccctctacctttgctagcactgaatgttatcaatgatttaaattgttgctaatcatatcttagttttatttttatttgcatattcctgatggctgaagaagcagataatttttctgcatgctttttggtctttttctttcactatttattaattgtcattattatcttctgtccagttactgtggagatttttttatttatcagttgtagagcattaaatagcatgatttgtttttgtacaatatgatatacattataaatatagtgttttgttacacagtttataacatattaactaaatttacctaactatacaatttaactgaatttatttagttaaatatgtgcttattctcttgtatcatttaacaggagtacctctgacaatataactcaaatttaaacaataacttccattactttaaagatatttgaaatatttacattttattcaatatttttcattttttatggataactgtgatttggttatcaattgctgagtaacatactgttttacccccaaacttaatggctttaaataacaccatttattttttctcatgatttggtggatgaggaatttgagcaaggctcagctgattagttcttctgctccatgtggtatcagctggtcactgtgttggcagcattcagctgacaactgggctggactgggatggaagatacaagaatgagtccctcccatatttgtcacctcggtgctccttcccatgacctcttttttcacgtgaccagcttgggcttcctcatagtatggtggtctcaggatagtaatactgttacagtaggtagtcagacagaagcagggcaggagacagcccccctccccccacccgacaactccaagggatgtctggcaaccatcaggtgatggtcaggtggtcgttaaactgcctctctgaaataatagttgggtcacagctggtgccagggaaaggtagtctcccaatagatagaaacaccaggaacggatgatcagcagcttccagataagatctcaggaaatgggtgagtaggctcaagcatatgcactaagagacaaaatggcggagtttaactggtaactggtaacttgactggtaagggaaaaatgcctcaagggaacacgtgcataacttcagcaagcactgtgcacgaggcccctcccaagtgctagaaggccacagtgcatgtggacagcccaccctaaggggagaggcaggggagaagagatgcaaccccctgcacccatgccaaggtataaaccacatgtcaaaggtcaaaccgtgcacttgatctctcaggttgcccgcttggccctgttccaagaatactttactccctttgattcctgctctaaagctttttaataaactttcactcccactttaaaacttgcctcagtctctcactctgccttatgccccttggtcaaattctttcttctgagatggcaagaattaacgttgctgcaaacccgtgtggattcaccgctgctgacatactttggtgctgcgtaactcggatacatttccctagtgctaacaatacttatattgctgctagttttccccaagagaatatgaagattggcaggccttttgcaggccacaatcagaactgtgtaacatcatttccattgaattcaaaaagttacctcactgaactggtaagcgagggacgaataaacttacattactttgaggttcattttttagagtagttaatgatactaaaatatatgtatttctacttataaaacaataatgaagacttttatgattttatataggtagacatagggcagctctgagcagggtaagttgagggtttagatctgatcctctgtagttttctcagcagtacccgtccccaaattttcagtcttgaccccctctacgtacccactcatgcccagaggaaactgtttaaaggcattttgttctttcttgtcttccttgtagtttgtagatgagctgataaattatctaaaatgttatcacaagttgcatttcttaaatgtggatattgtcctcaaactgatttcatgcatttataattgggtttattaagcaatatgaactctgcaggctacaaacatacaagtatttaattgttgtccacttacctttccaaaccaattttaaatacctgtcttactgcctcctcttatcactcaggtttgattatggcctgaaggaactataaggagaagagggcatggttttatttgttcctttacttttccacaggcttcatgggtgtgctgcccgtgtagccacctaggccctacactttgtgaaatcatgcacttggtttaatgctttgctgttgccatcttgaaattcttaataattttagaaaaaggggccctacactttcattttacactggggcttgctgattatgtagctgtgctgttttcttggttttaaatttctccaacaggttggagggaaagggaggcagaagaaaaaagaacaaaattctacttatctagccaattttgaaacactctgtgtcacggttgtcactgtttctctgaccattgacagtcttctctgaacattgatcctgtcgacctaagaaagaaactaaggcaaaattaatataagtagagggtttatttgggccaaatctgaggaccacaacacaggagaaacagactcaaattgccctgaatatattgtccaattagcagcagttacaagtgggtgtttaaaggaaaaaataagggacagttctcacattgattcattaaaatagcataagctattgattggctatacactgttctttgtatcacaaatttcaggaacatgaagataatgggtgagggtcactttatgcaactctaagacaataaacaacaaatgcctttaaacaattgaccctaggcataggtgtgtatgtggagcgggtcgagattcaagtctcttacttatgccactctgggcatgatacatttctcatacctcatgtagctcagactgctttgagctaattttcttttctttttttttaatttattatactttaagttctagggtacatgtgcacaacatgtaggcttgttacatagatatacacgtgccatgttggtttgctgcactaattaactcatcatttacattaggtatttcttctaatgctatcccactccttgcccccaccccacgacaggccctggggtgtgatgttccccaccctgtgtccaagtgttctcattgttcaattcccacctatgagtgagaacatgcggtgtctggttttctgtccttgtgatagtttgctcagaatgatggtttccagctgtatccatattgctacaaaggacatgaactcatccttttttatggctgcatagtattccatggtgtatatgtgccacattttcttaatccagtctatcattgttggacatttgggttggttccaagtctttgctattgtgaatagtgccacaacaaacatatgtgtgcatgtgtctttatagtagcatgatttataatcctttgggtatatacccagtaatgggatctctgggtcaaatgatgtttctagttctagatccttgaggaatcgccacactgtctttcacaacggttggactaatttacgctcccaccaacagtgtaaaagcattcctatttctccacatcctctccagcatctgttgtttcctgactttttaatgatcgccattctaactggtgtgagatggtatctcatcgtggttttgatttgcatttctctgatgaccagtgatgatgagcattttttcatgtgtctgttgcctgcataaatgtcttcttttgaaaagtgtctgttcatatcttttgcccactttttgatggggttatttgtttttttcttgtaaatttgtttatgttctttgtagattctggatattagccctttgtcagatgggtagattgccaaaattttctcccattctgtaggttgcctgttcactctgatgcagtttcttttgctgtgcagaagctctttagtttaactggatcccatttgtcagttttggcttttgttgccattgcttttggtgttttagtcatgaagtccttgcccatgcctatgtcctgaatggtattgcctaggttttcttctagggtttttatggttttaggtctgacatttaagtctttaatccatcttgaattaatttttgtataaggtgtaaggaagggatccagttttagctttctacatatggctagccagttttcccagcaccatttattaaataggggtcctttccccatttcttgttttggtcaggtttgtcaaagatcagatggttgtagatgtgtggtgttatttctgaggactctgtcctattccattggtgtatatctctgttttggtaccagcaccatgctgttttggttactgtagccttgtagtgtagtttgaagtcaggtagtgtgatgcctccagctttgttctttgtgcttaggattgtcttggcaatgcgggctcttttttggttccatatgaactttaaagtagatttttccagttctgtgaagaaagtcattggtagctggattgggatggtattgaatctataaattaccttgggcagtatggccattttcacgatattgagtcgtcttatccatgagcatggaatgttcttccatttgtttgtgtcctcttttatttcattgagcagtggtttatagttctccttgaagaggtccttcacatcccttgtaagctggattcctaggtattttattctctttgtagcaattgtgaatgggagttcactcatgatttggctgtctgttattggtgtgtaagaatgcttgtgatttttgcacattgattttgtaacctgagactttgctgaagttgcttatcagcttaaggagattttgggctgagacaatggagttttctagatatacaatcatgtcatctgcaaacagggacaatttgacttcctcttttcctaattgaataccctttatttctttcttttgcctgattgccctagctagaacttccaacactatgttgaataggagtggagagagagggcatccttgttttgtgccagttttcaaagggaatgcttccagtttttgcccatacagtatgatattggctgtgggtttgttataaatagctcttattattttgagctacgttccatgaatacctagtttattgagagtttttagcacaaagggctactgaattttgttgaaggtcttttctgcatctattgaaataatcatgtggtttttgttgttggttctgtttatgtgaatgattttgtttattgatttgcatatgtcaaaccagccttggatcccagggatgaagcccacttgatcgtggtggataagctttttgatgtgctgctggattcggtttgccagtatttcattgaggatttttgcatcgatgttcatcagggatattggtctaaaattctctttttttgttgtgtctctgccaggctttggtatcaggatgatgctggcctcataaaatgagttaggggggagtctatcttttactattgatcggaatagtttcagaaggaatggaaccagctcctctttgtacctctggtagaatttggctgtgaatccatctggttctggactttttttggttggtaggctattaattattgcctcaatttcagagcccgttattggtctatttagagattcaacttcttcctggtttagtcttgggagggtgtatgtgtcgaggaatttatccatttcttctagattttctagtttatttgtgtagaggtgtatatagtattgtctgatggtagtttgtatttctgtgggattggtggtgatatcccctttatcatttattattgcgtctatttgattcttctctttttcttctttattagtcttgctagtggttctatcaattttgttgatcttttaaaaaaaatcagctcctggattcattgattttatgaagggttttttgtgtctctatttccttcagttctgctctgatcttagttatttcttgccttctgctagcttttgaatgtgtttgctcttgcttctctagtttttttaattgtgatgttagagtgtcaattttagatctttcttactttcttttgtggacattttgtgctataaatttccctttacacactgctttaaatgtgtcccagagattctggtatgttgtgtctttgttctcattggtttcaaagaacatctttatttctgccttcattttgttatttaaccggtagtcattcaggagcaggttgttcagtttccatgtagttgtgtggttttgagtgaatttcttaatcctgagttctaatttgattgcactgtggtctgagagacagtttgttaagaattctattcttttacatttgctgaggagtgctttacttccaactatgtggtcaattttggaataagtgcaatgtggtgctgagaagaaagtatattctgttgatttggggtggagacttctgtagatgtctattaggtccacttgatgcagagctgagttcaagtcctgggtatccttgttaacttttctgtctcgttgatctgtctaatgttgacagtggggtgttaaagtctctcattattattgtgtggcagtctaagtctctttgtaggtctctaaggacttgctttgtgaatctgggtgctcctgtattgggtgcacatatatttaggatatttagttcttgttgaattgatccctttcccattatgtaatggccttctttgtctcttttgatctttgttggtttaaagtctgttttatcagagactaggattgtaacccctgcttttttttttactttctatttgcttggtagatcttcctccatccctttattttgagtctatgtgtgtctttgcacgtgagatgggtctcctgaatacagcacactgatggttcttgactctatccaatttgccattctgtattttaattggagcatttagcccatttacatttaaggttaatattgtcatgtgtgaatttgatctggtcattatgatgttagctggttattttgctcgttagttgatgcagtttcttcctagcatcaatggtctttacaatttggcatgtttttgcagtggctggtaccggttgttcctttccatgtttagtgcttccttcaggagctcttgtaaggcaggcctggtggtgatggaatcagtctaaacaacatctcagaaagccaatcttagattctacaatagtgatgttatctacaggaacaactggggaatttacaaaccatgtgaccaaagccacatgactcctgagactacagaaactatgcctacattttagcagaattcaggccccttccataaatctaatcttgtggcctttcactagtcttacaaaagcaattcagaccaggcatggtggctcacacctgtaatcccagcactttgggagaccaaggcgggaggcatcacttgagccttggagttcaagaccaacctgggcaacacagtaggaccctgtctctccaaaaagaaaaaagaaagccagtcatggtggcacacatctgtagtcccagctacttaggaggctgaggtgggagaattgcttgagcccaggagatcaaggctgcagtgaggtgtgatagcgccactgtactctgccctgggtgagagagtgagtctctatctcaaaaataaatacataaaaaataaaaggtgattccagccctggaaaagggaggtaaattttttttagggagggactttattattcttgattcaaagttatactataaattcctcccaaagttagctgggcctatgaccaagaatgaccaaggacagcttggtggtcagaagcaagatagagtcagctatgtcagatatgtctgtcataattttgcataggtgatttcaagaaaatggatatctttccattccttcacctttttgttctattcaggccctaaatggattgggtgatgcctgctcacattggtgaggtggatcttcattatgcagtctgctgattacaatgcatatcttttccagaaacactgtggcagacacatgagaaatgatgttttccctatctgcatatcccttaatccagtcaaactgacacataaaattaaccatcacactgtgcttgagaagttttgtgggtatcctgcccaagagggctgcctattgggtattgggggaaatgggagatggggattgctgggtcatcagctgcagggataaggggtaaagctggagttggggtagtgtctcccacatcagagaaatggtaaaaaagtgaccccacagagccctccacaaaatgcatacacatattcatgagatggcagacatttcgctttccgtcccaaggagaacatagccagcaattgtattaaccagggaagcaataatggctatcagagaattgcagttgcacttccagataaagaaagaaatatttgctctatttcccttctgtccccccagtgcccaataccagtggaaatagaactagagaaggcaggagaagaacaaaaccacagacaccgcccctcttcctatttcgagctcctcaagccaaagccagccaggtgcttaggaaagggagacaagagcgataagctgcttgcaaaagccaagtctataaattggattagactgactgaagattttagtaatgcaagtgaccagaagatatgggatctgccatagattcataatacaatggcagaaaagagatttgacagaatacagttggccttatagttggtgagatttaaaaatgcatcatatttttgtctgcctcacataattcgagttgtttaataaaccatttacatttgcaagctgactgctgaggaaatgattccctgttcagtattcccagggagttggagcaagaggggaaacagagagagagaaacacagagagagagagaaagagtgaaagaaacagagagagacaaagagagagagagggagaaagagcaagaaccttctgtatgatttcttcccttcagatcggggcaatttaggtcctatgtctatttctgggctaaatgctctgataagggaagactctggtgggcttggtccagcctgcatccaccctgggagttgggatacagtcagcttctcttgcatcacataggttatgtgcaggaaggtggatgcctaccaaaaaaaaaaaaaaaaacggtaaaaaggagagagagaaggcatgctgctgactaggggacaaaaagcctctactacacggtgtcactgtatgtgataatcatctgcttccactttggccatgacccatgtggcccttggcagtgtaaccaattttctttggattgcttcacgccaaagatcccctccatcactcacagtcactatgaatgcccagattgggacaggacagttgtcattttcagtgtataattagtgaccaacaggtctgtgtactgtggtgacgttgtgcataccctctttccatcggcctgtctaaagggaagattcctctaactcctagacgtgtaatgaattcacgttggcatttgttactttgaaaaataacctcctgttactttttctcttttctcgttgcctcctggagtcaagtttaaaaggagaatttgaaagtcatctcccagtgtgtttaggattcgttcattcttcccatgctgagtgtttggctcgcgcacgctccctctgcgatccactgaaaaattctgctttttggtttgctgcttaattttccattttgaacagacgaatggcacagcattattcattgagtatttaatataatatagcgttttaaaggatacatataatatagcattttaaaaatacttctaaaagcattatgagggaagccaaacatttttttttggtgccttatgaagaaacttttattttaaattgtaaatttcaaagttttggataacataacctggtgttcttccagattgtgggcatctttacatgttgcggttaaatgcagtgtttgcctggaggcagcttatatgaatggtctagaagtagaggctcctccccagggatgctctcaaacagtcaacccaaccatataaatagccatcagctccactttcccagccttaattgtgctcaatgtcaagtaaataacacagttttattcactgttctctcttcttactttagaagagtcacggtggctgagaaaatacataatacaatcgagaaagaatgatttgtgggttatgactctgcttctttttctctctgcattgtccgtcctctgacctcccttgcttttcatgcctccaacttatgccaattaacaaccttgcagcagaagctaagagtgcagcctctgaggctcatctgcctgggatcgatcctgctctgcctgtttctggctctgtgaccttaagcaagccacttattctctttgtgctccaagtttttcagtaacgaagtggtaataataatacctatttcagggagttatggcggagagtaaatcagtcaatgcacgtacagcacttcaaatcatgtctggaacatggagcaagtgctcacataaatgctagttgttgttgtctctgcttccttgctcaggtcctctcaaatctctgcatcttgatttgcttacctataaaattacattcaattttttcccccacattcaaataagtacgtggacctgaacaaggagcacagaggaagaaatcattaataaaacactggctaattagcattggtaagcttcttgtcaaggctgtcctgctttccagaactattagaagttgacccttctcggacttctgtgagatactcattagcggatgtcactgtcttaactgaagggctggccaaaacctccatgctgagtcaggaaacttcattttcttccatgaataaatttatttatttatttatttattatttttttgagatgcagttttacttttgtttcccaggctggagtgcaatggtgtggattcggctcactgcaatctctgcctcccgggttcaagcgattctcctgcctcagcctccccagtagctgggattacagacacccgccaccatgcccagctaatttttgtatttttagtagagacagcgttttaccatgttggccagagtggtcttgacctcctgacctcaggtgatccacctgccttggcctcccaaagggctgggactacagagtgagccactgtgcctggccaaatttgtttattttaaaatgatgtttattcatcagtcagggtagttccagcgatgatggtattgcccttgacattctgaaggatgagaccccatgactcaggcaacctgcgcttctgtgtcacccacccatgtggcagcgcaggacaaacgaatgcagcatgcagggacagaacgtgctggagacagctggaaaatgtcaggagagaataaaggtgggaaaaatacatcaccaaagagacatggggctgagaggaaaaactgtccaaagaatagagatgtattggctccgtgtacactactgtcctttgatatatagtttactctttcaaccccgcttccagcattgttctcacggttataacaagcaagcacagaccctctcagttgatgaggtgcaggcaatagctggctttctcaccacctctttacttggtaccaataatcgcatgctgagattgactagtgagtcagtcctcagggaccatctcaagtgtcactctttgacttcttcaaaaactttcacatttactcaaaggcccttggaaccactgaggggaggcatgacctaaatgaacacttttcactaccctttaaaccttactctgcttttaaattaaagttttttttctagcattttttattgttgctatatgcccaactaagttttatatattattaatatatttttgttatggctcatcatttatgtcctttactagagtggaaattctcaaatgttgaaaaccctctctgctctccattgcatttctttgtgtcatctagaacagtgctcagcatgcttggtgttgaataagtattggtggaacgagtagctaatgaatggaatgagtttttctccacaaccttgccagcatctattattttctgacttttttatttttatttttttgagatggagtctcaccttgtcacccaggctagagtgcagtggtgcaatctcggctcactgcaacttttgtctcctgagttcaagcaattctcctgcctcagcctcccaagtagctggaattacaggcacgctccaccacacccaactaatttttgtatttttagtagaaacagggtttcaccatgttgtccaggttggtcttgaattcctgacctcaagtgatctgcctgcctcagcctcccaaagtgctgggattacaggcctgagccaccatgcccagccctgactttttaataatagccattctgactggtggtatctcattgtggttttaatttgcatttctgtaatgatcttcatgagaacatgctctacacacaccaaaaaacaaaaacctttaaagtagcattacttctggtcagaatctgagttttttgatctgccgtcctcataaatgagggtgggttttcttcaaacaaataagaattgacgataggaaccagaggcagggtctggaaggtgaaagcaaatgaagaagacatgagccctactattcagaaactagaaccgagttatgtagaaggcttgaacagctccctgaagttctaccaataacccctaaattttgtgtatttgcagctttcctcaggttttcaaaagagccttgatatggtttggctgtgtcccctcccagataatcttgaattatagctcccataatctccatgtgttgtaggagggacctggtgggaggtaattgaatcatgggggcagttacctccatgctgttctcatgatagtgagtgagttctcacgagatctgatggttttataaagggcttgtccctgctacttcactctacgcatctccttgctgctgccatgtgaagaaggatgggttcttcacccatgaaggatgggttccaccatgattgtaagtttcttgaagcctccccagccctgcggaactgagagtaaaacttctttcctttataaattacccagtctcaggtatgtccttatagcagcatgagaaaggactaacacaagcctatgccataaaaatgttaagaattatagctacattttttctttgtctcactcaacactctcagagttttcctcacctctttgggaatagttgttcaaaatttgatttctctgcctcttgccagaggcatttagaaaacaaagaaacaaactgttcctggatgtttaggagcaagcttcttctaaccttcacgttgtttagacaccgcaccccagacaattgctttgttccttccttggtatcatctctctgctagacagcaatatacaaaatgttcagttagaaatggtcttatatatcagattattcacgacttgttatattaaaacatacattaaaaaatgaagtatcaaaagcatttggtaaatatattggagagccggagagcctagaactctccaatactatatacctgcaatgaatatttaaaataagattctgctgtcaaaaatgcagagggtaatgactgatctaattcagtgaggtgggtttttttttttttttttttggcatttccgtgcatttcataaaaggtcatcatgtggtctactgccctgattagtaaaaatattgctaggtttaaaataattgggtcctgttgcttgacacagtcggcaagagtatccttcacaaatgtcacacatgggcctggagaaggatccatggcacttaaagctagaggctgtcttggtttcatccgcctttattctgtctcaacaaagagccattaattctacttttctctgtaagaacagaaactcttgtttctgttttatctgtcctgcatgttgttgtttgtgacatactaatagagagacaggttgtgtgtgtataaatatttgggccagatgttcagcccaaggacatcacgatttgccataaaacaatctttgcacctgggttttgagtgctcagagcatcattgtaaaatccggagtccctaccatgttctagatcagaaactggcagaatgaagggtatagtaatgggatggagttcaacaaagtggtgggaatcttccaaaaaggaataaaaacatgttgataattgtttaatggaaggccatctccaaggaatggaagggcttcccttagctttttgcagaaaggagctgtgaacactgaacagaagaatgggaaattagaggactttcaagagggcatttttgaaggaactattcaggaaaaatttagttggttaaaggatctttgcaacaataaaaatagattaacattttgtgcacaaacaagttttgctgggagcaagggaggctcaaagaatgtttttcttcctctgttagtttcattcgaacctgcctgcacttgattggattccaagttctgctggtaatgtcctggatatcacttaaattcattctaatacctctaaaatagtctcagttttgtggtattaaaatattttacgtcaaacattcttatacaattccaacaacatgcaaatgtttgtagaacgcttcacttgcctgaatccaaaagtaatttcataagaaattctgagcagctttatatgccaggtagcagtctctaataagctaagaagagcataaaaataaaactgtagttttagaattaatggctgaactttatcagatataaaccaaggcctcagttccccaaggtctattagttttccaggtctacataacatccgctattgtgctagggactatggcagaattcatagacgagtaaaatgtggtttcatcctccaggaattcacaatcagcaacagagaccacctgtacgcaatgtgccatgctagaaggcagatggtgataagtgcttgggcaggaaagggttaactcatgatgcctgggttgtttcaaccctgcacattccccagagaggtctatttccaggactgacttttggctggttcctaagagctaagcattgagccttgggaatgttctgcctggtaagagtgttttgcatgcctgaggccttgggccatgctgtaccactttggccacataatttactctaataatgggatgtatcataaacatccatttttggtgtgtagtgggggctggagcatgagtagccaaggtccgtcacgtgggtgctgcatgcctacatgactgacctccagtaccaaacccggacactaaggcttccctggttggcgacacttcgcgtgtgttgtcatgtatcattattgaagagttaagtgcatcctgtgcaactctactgggaagggacacctggaagcttgtatttatttctcccggactttgctctatgtgcccttttcccttgctgagcttaattcattcctttttgctgtgataaatcataaccatggatacatggcttctgagtcctgtgggtccttccagcatatcattgagtctgaggttggtcttggagaccccggatgcagagtgctgtatgagaagaagaaatcatatcatagaactgtggggaacccctctacccatgaacatgcccatgaacaaagctgtcttccatggcattgtctcaaatgtaagataaaactcagtggcccacacatgtattcacatatataatttttcttacatgtacatctgattttctatctcctttgattaaaaggattcgtgctcaaataatacattttgggacaaatagaggggcttatgcttgtactctctgcactttgggaggctaaggcaggaggattgcttgaggccaggtgtttaagaccagcctgggcgacatagcaagaccctgtctctatgggggaaaaaaaaagaatatattttggactcctttgcatagatggggagcctcttaaaatgtggctttgatttctattcccagcttcacacctggtgactccctcagctcatagctgtgttacaattacatcaaatttccagccgtgtctcaggctgcatatccagactgctgctaattatctttctgctctgaatgtcttctcttcagcagtttggggtctcttctccctacttattaaatgactccttcataccccaaaagctgagctgaaatattttctccaccacatagcaatgaatattccccagtgttccctgccttgccagtccatatagagttgcattatagccattattatattgttctgttagactttgatgtgtacatttcccctatagtctgtgagctcctaagtgccatgccgcgtgattcagctcttcattccaactgtctagcatggtgcccagcacccagtagttcctaggaaaatgtttattaaatgaagggacatgcgcttacactgtgaaaggaagacagtgggccccaagaagatgtcaaggacaatggtttcctaaggactatctgctgagtctttgatatggacaactgagatgctggtaaacagccatggttagggaaattcccccaaccagtatgttctagaaatagcttagtgcaaggaatgatctttccacagacgacttaagactcgtggatcactctctggtttacttctaacaaggccagacacagaccctccaaattttcgttttttatctcataattagccaagctgtatctattgaccaactggaacaaaggtttgtaactaaactttagttaagcttctctcccttccttggttccctgaactttggccccttctcagtataagaagagacccctcctgagaccaggctgatctcaggataaaacattctctaatctactgtgcgatcactggctcaccctgtgcatcccattccccacacctggttcattgtagccttatttactcctctttctaacaaaacaaaacaaacaaacaaaaaactcctttttgcctaacccttaacacatttgcagatcttgtggttggagcattcttgttattgcaatagttctattctccattgaaagagtcccccaaccccgcttgccataacaagagacccctcctgagaccaggctgatctcaggataaaacattctctaatctactgtgtgatcacgccacctcactggctcaccctgtccatcccattccccacacctggttcattctagccttatttactcctctttctaacaaaacaaaacaaacaaacaaacaaacacaaaactcctttttgcctaacccttaacacatttgcagatcttgtggttggagcattcttgttattggaatagttccatcctccactgaaagagttccccaaccccgcttgccataatctgtttaaataaagcctctctttgccaatgtccagagtttgtttttatttaacaatatcccctgactgactggagaattcaaagcatgttcatgcctccttattagtgaataaaacaaagtgcccatgattctcaatgttctatttgcatatattctaatagtttatttcctgaattcaaagagcatcatccacttacctctatccctgatgagtttactttgagtttacttgagtctaggttagttgatccccaggtttgtagactccttgtctgtcttgtgcctctttctcctattccccagatttaaggtaaaagccacactccatgggccttgggtagggaaatgcccggttttcaggctccttatggggattccctaggcggctgaaggcacgtcctcctttaacacctcatagagactcaggccctggtccttcaatgcattcttgacaacagtggtcctcaaccagtgatgattttggcctccaggggacatttggcaaggctgggaatatttttggttatcacacctgtgaggggttagttactagcatctagtgggtagaggccagggatgttgctaaacatctcacaatattcaggataaccctctgcaacaaagaatgaggtggtcccaaatgtcaatagtgccaagtttgagaaactgatttccatgaatattactgattttaacaaattaagccaagaacatttactttttcaaaaaaatgaaagcaggacaacaaaacttttctaagggatatataggcctttatacaattgtactgggactgttttttctatgaggtgcttaaagctcttccagaaaaaataatcaacaatctgacaacagagatttattgattaatttgcaatgttaggtacaacatagataacttcatcacatggttacaatccagtatttgagctttgtaagataagtaaacatttatttgagcacaacaaaagtctacacacagtattctgggattgtttaaaaaataagtgtattctattccatttgatagcacaaagaagcacatttcagcgtgaattgatggatatattttaaaactgggcatttagttaatgtgtcaaattaagcataataacctaaatttggactatctgaataagaaatgcctaatgagcactgggcaagtatcctaggatgggagtggggaaggaagtatggcttacaagggagctttctttgcatttcaaaatgtggatgatagagaaggtgaggccagcattcatggtatgggaacctgttcacatttaaaattactttgtgatctttaaaaatagagtaaaagtatagttatccagaagtccttaataaacacctctttgatcaagaaaataaaagtccgtgtaggtcatttagttggaaggaaagaagacttattagggagacattagatacctttatttttcaaaagagtaaatctctgttattaaaataactaaaatgtgtcaaagtcttcttttcccccaattcaaggctaatatctacgagtcagggaaagtctatgatcctaactgatcatgtcaaacacaagaccattaccctgcttctgtcattataaatgtcactggagcggcatgtctgctgtacaggtagcagcacatacgtgatgaaacaggccactgagctcaatgtcaatatgtgactttagacaacaatctcttcatattttaggaagcttgaagctaactcaatatattatttaagacaataatctctttataatttacaataaaataaagtgaaagtttgtatttcatattattcaagacacaagcagattttatctgaaaagacttttttttaaatatgaaagctttctcttaggataagaattatgtaatcatgttacacaagtaatacagtgatggaaacaagacaatcttttatcttcctcttcttcagttgaatgacaatagttttctgcttagctgggagtccacatactatttgggagaagtgagatatttatcagtgggctgcagggaataaatgaaatcacctcagtagaggatgctgctatacttttatcaatgtctactgacattgatttgaaagtggaaatcttttgtataaaagtctggggatttctcacccatatcttaagtatttctccgggctggcagccccttaatataatcagaaaagtaaaatataggttacggaatactcttaaaaattattttgaccactgagtttgtttctagttgattcatctaattagagacattacaaatcattttatatgattaaacttatgtgagtgttgttttcctggagattgggtctcattataagcattctaatttgggccccattgaattctctctttgtccagcccttctaatccaagctctttggaactcacccacaagttgtatgaatttggacagacctatattttgcttttcctctgacttattctgtatgcagtggatctgagtagcagatttttttttatagttctgctaatgtgatgtgatgttttgagaatgtttagagcatttagaacaaaccactgtaatctaagttggaataaagggaaggaatgatctatacggcagactgccttattatcccagttccaagagccagtcaaagagactcagtctcccatccttctgctcctcatgcattttgcagtactggacaactgcatggaagatatcacccactttccaggacttccgatgaaccagctgcacgacatctagaaactaaaataaaacggagagttagggctcacagagcacagagggtcctcaaagccacctcattcaaccaccctcgcgaagccaatggctctccagtctctgtttaaatgtctctagtgtcagaggactgttttccgggataatctattttctttttaagaatttcagattattaccgaacttcatcaagtgaattttttttttttttttttcacagcagtttgccattcattgactgcagaggattaggtggaatgagactaattcttttttttttaagagccagtcttttagatatttagtgttttcttgggtctgcttttttctcagttagactttctgtaataggattgtgtattacagctcccagtcccttctatttctatcacaaataagatctcattgggtgtgtaaatttaggccaaataaatcaagtggtaaactttgatgcaggaccacctattgattcttcattccatcctgagaagcaactccctcaccctccaggctaaaatcaaggatcaagaaagcctggctttccacagccacaggatcaggaaagatggaggaaacaccttagatttgtcacctgggtattggtaccagttctattggccacagcctagagagaaagtctggactgcaagtgaaattgagggcttgaagggaggaaaaatggagaaataattataagtcattctcttcatggaactgatgaagtccagtgtgaaggactctctaactccttaggtacttttttgaggaaagatgtaatgaaagccaggaactgtaggaaatattttaacacatgtaacctcattcaattctgtcacaactctatgatgtgagcatttgcaatgaaaaagatgtgggcttgaaagatgaaaaattgtcagtaggatcatggtcttctaacacttccgtacaatgctctttctatcaccgcacctttctgcattttggtggcaaaagaactatgcctgcacatagtaggggctccatgcatatttgctgaacgacagaagggttgcaagaccaagcgtgagtcaaatacattcaaagatctcaagaagactgttgggaatatggataagtaaattctatgttcttgatatttacttggagcactgggagaaaaaataggctggaaatttggcattgttttaggaggaggagagccttagttgctaaaaagatgaggattgtggttcagttactatttcttcaattttttttctaggattttttaaaattaattaattattattattttttggtatttgtttgctcagacttcagagatcagccaggaactggaatgctaatttctttccagtttgagtatgttaattcacttcagttactgagaagttgtctcatagagatccgctgttaaatgatgtttcttctcccagctgtgatggtaccaactatttgcacagttacagtaatcagtgctttattgtactcatttggcttgtattggctgaatcaaaataaagcaatttcctaggctggaaaatgacatccttaacttttaatacctggaaatataaacattgtcttaaagagtgttaggatgttgtgaaaagggagacagatgggaggcagatggcaaccatagacagcaatctcccagcagaaggacatcttagccatcttttcatatctcgtgcctgcacatagtaggtgctccatgcatatttgctgaatgacagaagggatgcaagaccaagcgtgagtcaaatacattcaaagatctcaagaagactgtttggaatgtggataaacatttagcatcattgaggacgaactttcactaagtattcattcttgagttttaggtaatgtattttcgcatatataatttcaacaggcatatcttgaggctgttgctcgataattttctactgcaggagtgctccttgaaaatgactggaggttatagatctaggaaaaggctgaacagagcctggagtaggagagtggtgggcaagcagcaaaataaaagctggtcatggggcacgtttcttatcacgtggtgactgagtgggaatatacgttgtgggggtgagatgtggggctgcttcatgctcatggtaacagccacggtgggccagctcattcactcccatcagtctcagtgttagaatttcagagaggctgggttcggtggctcacgcctgtaatcctggcactttgggaggctgaggcaggctgatcacgaggtcaggaattcgagaccagcctgaccaatgtggtgaaaaccacgtctctactaaaaatacaaaaattaaccgggcgtcgtggcatgcacctgtaatcacagctactcaggaggctgaggcaggagaatcgcttgaacctaggaggcggaagttgcagtgagctgagatttcaccactgcacttcagcctgggtgacagagtgagactccatctcaaaaaaaaaaaaaaaaaaagaaagaaagaaaaaaattttcaaagaaagtattcattgcctgggacctctcaccacccttcttagcttcttgtctacctgattcttgacattttaggaacagactacaaaccctttaggttaaggctttgctaatgaggaaaatactcttgggaaggggaacatttcaagcagctattagtgatttatggagatacataaaaataattttgtgagctgttacttatatctaagagtgtatgtaagatccaagccatgattttgattgaacaaagggatgatgacatgcggcttcggaatagcggtcttgaagggaatgaaggggagaaaggctaaaatgacagcttttgtatgattccactaagcaggcttttcctcactctccagctcttactggaaatctagaaagtagagttcctggtgcagaaggcctggacattgagtttctgaggtctcactgggagaggctcacaggttgttgatttgtttctcgagacttctctaaggtatccccagtagtcttggtgcctcctttcacttagcaagtctgtaaagattccactgatggaaacatgacatttgccttggctcctttctgtaaaccgtggcttacgggaccaccaccttatccccaacttttatctctgagtcattttctgggtgggggaagaatcaaagctctggagcagatgccaatatttgctaaactcttcccagaattctctctgcctcatacctttctggaagccctaacaccagcttctttccatctatttggggcctgtgaaggagagtctctccaaagttgtcaaaataactcaccagctaggccactctgtgtatagtttgtggtgtggtcacaagctggaatctgtcataatttctaagtccaggctgatatcccagtaaagtggcatttaaaaatggtctggccccactaaatagagcatgctctgaggccgtgacgacttaatcttggatattgagacctggaaacatctttggggctgatgagcaagaagaactcttcttttcttttcttccattaaaaaaaggtaagaatgaaaaaagattgtgaagaagtcagaaaaggacattctagttctttaccgggcttttaaaaccatgttttatttagcagaaagtcctagagctctcactgtgcctgttcatgctattgcctgggtattttcacaatcagctttagcaagtcacgatctgagtttttctttccgctgcattgaaaaataaaaatgaaaataatttcattttctgccatttcacaatcagtaataattaggttccctacccatagatcatagttggcatttctttgagcaaatattttgtcttaagaaactatatgatggtatatcatctgtagactcatttgaagaaaagtataagataggagataacttttatattcttaggtgcatttaataaattagattaattgtttacaaaactatatcatgaaatctatgggagttgttgcaagttgtgcaattttttggaaacagtcaacttagatttctgaaagcaactaccttcttttgctccaaggcagaattagattgcattaagcataagtgagttggtccctatattgctctgcaattaaggcctgtagagctatcagtctgagccttggctgcactctggaaccccaggcacctttacaaaaccctgatgcctgggcagcatccccagagaagattctgatctaattggtttgagcattggagttcgtaaaacctccccacgtgactctaacgtgcactaaatctgactaaaggactcagttttaaggcactttcctatgattacagatgaagcgcctcagtatcaaattcttctaattttccccttcctttccaatgagtttctttgaagctgataaccttaactgtagtttttttgtctttgtatttgcaaaggtaagtcaaaagtcaataccatcaaattggagactattattctaagttaagtaactcaggaatggaaaacctaacatcgtatgttctcactcataagtgggagctaagccatgagaatgcaaaggcatatgaatgatattatggactttggagacttggggcaaagggttggaggcaggtgagggataagagactacaaattgggttcaatgtatactggtcgggtgatgggtgcaccaaagtctcacaaatcaccactagggaacttactcatataaccaaataccacctgttccccaaaaacctatggaagtaaaaaaatttgttaaagtcaataccatcaacattttctccttcatttttcttccaccactttgtatgtaaaatagaataagaaattagagggaggcactcctcttctgacgcccactttcttaggaaggtaagcacatacccatttcctccttgggcacattcctttctctgcactgcccccatagaaaggaaataattctcaatgcaggctcaaagatgagaaaaataccaatttactgtgagaggcaagtcatcagctaccccagctcagagaagctcactgaattcaaacagagaagagctggagagcaatgatctttggatctaaaaaaccaggaccattagccatgtgcgtgtcttttattggccttggattaattacattcaagttaactgatgtcaaggtttacaaagtgttttaaattattggatgtaggattttcagcaatctttcccctgggatttaggatactttaaggccacctcaaattctgctgcttgtctaagatatttctctggaaggaggtctcaaacttcagtgtttatcagaatcacatcacttgtgggaaattgttaaaaatgcatatttctaggctccactaccagaaagtgatcaggtcctagaagggatctagcaatccaatttgtgaataaatgtctgtcccacatgactgtttcatgcccacatggctcatggtaacagtttgagaaatactgttctccgtgtgcttcttatttcccttgtccagaaaaagtccccatcgtatctcaaggttgctatttacaatctgagcttctctccgtttatattcttcttacctttggtctgttctaaattagaatgtaaaatctaagagggtaggaagtgatgtctcttgctcactgtatctccagggtgtataacagtgcctggcatttgtagatgcttaagacctgatgaatgttctgaatgtacgattttcaggtgcatttagctttttaataattagataaaacacaagtgaaagggaaaatttgaaaatgaagtaccatttgtcacgagaggagtatattgggcactcagaatgtttggaatttgccttttaagttgaacaaaggatggaattagtggtgagttgcctttaggtgcccccaactccaaggccaagttcctgggcagtggtgggaaagatgagctgtttcattatgaattcctgagaccctgttccctagcacatacctcccttttcacaaggcaagaaggttagtaaattgggaacacagtaaaataaaacacatagactaattagcccaaaaaaattttaggattcacacaaattaggaactcagggattcatctgtgaatattgtccaataccctagtgacagtgggaagatgacattttctggactttgtagagacttttctttaaccttatctaagctgatgagaagctaatgagacactgctgttctcgtatgacacagcctccatggaagacgagctctctttcgtacaccacttgaaaatggccatttaactacctggctaattcaataacatccagaataaggtccccaaaagtactattgataaaagaaagattatcaaaatgttgcttaagggttttttttctttaaccagttcagtcacagacaacaaatggtactcgtattcgtggaaaagccactatgtgcagagagtcttagatgactcaaaagaaaaattaggagattttgttcctaagattacattatttagaattaagtttcttgagctggtgctaattgaatgagtgaaatatcatttaatatccttcttgataacattagcggaatgtctattttctcagaaaaatagttgtatccaaaaacaagcattctctttgagaatcgaaaatcaggtcgggataaacaaataccaagtcagggcatgatttgtgtaactcaggtgtttgtgagacacctcttacccttgtaccgaatggggatttatgagacatatattcacataacattgtttcttcaagaagatacattgtacaaacatctattccattcagataccacctgaaaatctaccatgtcatgctcttattcagggagtggcaggagatagagttggaaccagctcctctttcattttcccatgagcctgggaatgtattcctgagaatgtttttccctcctctacatagcaaggggtctttgggacagtgtatggcatgggggtagggtcacacatgattatgcttttttattgcaccctttgctgctgagttgtaaggtcagaggagaatttatcaaatagtgaaccgctcaacaccttgtaaatgaaagtatgacaagtataggaaggtgcctagaataattttgggtagaacagcaggcagacataggcatgaagggaagtgttaattaccagttggaaaaaggttgaagtgagaaagggtatgaaaaatgaattaggtctccttttcaatttttcctgtagtcgatcccatggactagtgatgcagaaatagagaagctgttctaactactgtaagcagggacaagaaggtaaagaacatttcatttcaggctgctagattttggcactgagaattaaaatgcaattacacagttaaaaaaatccagattgtaagcccaaggtcatttaacttgagaaagatccttttaaaataaagaactactgggaagtattttatggagaaaacagggcacaggggcttggcctgggaaatcgctcatgtacccgatttgctcctagtcaaaaagggacaataatatctgttctgttttttcacaggcttgttgagaagcaagtaggatgaggcacatggaggcactttgtgacaataagacatgaaaatcctacctggtggcttgataggcaggatcctaaaacagtactcaaggtttttcaccctaatccctgggaccatgaataggatgcgatatcatgcccttattacgctaccttatatggcaaaaaggatttatcagttacctttgagttaatcagaaacctatcaggtgattataatctaatcacacttattcttttttgagacaatgtctgactctgccacccaggatggagtgcagtggtggaatctcggctcactgcaacctccacttcctgggttcaagcgattctcctgtctcagcctcccgagtagccaggattacaggtgcctgccaccatgcctggctaatttttgtttttttttttttttttaagtagagatggggtttcaccatgttggtcaggctggtcttgaactcctgacctcaggtgatctgcccaccttggcctcccaaaggactgggattataggcatgagccactgcacctggcctaatcacacaaactctttaaagacagagctttttctggctggtggctgaaggtatcagggagattgacaccaaaaggacataaaggagccatgtgacagagaatgtaggtggcctctgggcactgagagcagccctctgctgacagccagcagggaaacaggacctcagtcctacaaccacatggaactgaattagcacaacaatctgaacaagcttggactctttctcttccccggaacttttggataagtgcccagtcaggctaatgccttaatttccaccttgtaaaacctaaagcaaagattacagtagaactcaccctaactttggacctacagagctgagtgctgttttaagctggtaaatttgtgacagtttgttacacagcaatagaaaactagtatgttattattaatttgaaatcttttaaaacgagtctacttttaaattatggaaaattgagcttgaagacattgggagacagattcatgccttactcttaatagctaagattctaccgcagttaatggtaggtcttagagatatagaattagagtgatagttactattaattttgatgttggccaaggatctcttccctagctttatatttctggtaggtggagaataataaataaaaagtcttcctaacacgaacctgtttggaagggaattaaaaatgccttctcttggcctgttttagatgtcagtgtggcctcactttggtttctgttatatatcaggttcttctttctttcttttatttaaaggatcactatcaagaagtttgtcccagagcaagaaaacaccaaaaaaataacagactctaaaaaagttcccatcccctcaatttacttttctcactaccacctactagccaagacaaagtaaggatcaaagaaacgctaagtatattatatttacacaggtggaagatttcaatgttctagccgcaattttaagatcaagaacagtcaggatcaaataattcaaatggacaggggtttactgagcatttactgagtttccagtggtgatgaaaacacaaagctttcttgttttccaaacctggtacatgataccttttcaattctgttttcctgagatttcttaaagtagatggtgggaatccccagttcagaggcagctatccactgcagagtggctcggagctcggcatctggacactctggctccaggtcaaagttgatcaccagcaggctcctctgggggctggctgttcccgtaggcggtccagatgcaggtgctgagaacagacacaaccacagccttatccttctttccaaagggacagcccaggcaattgtgtgtcaaaagtatgggaaggtggcttaccctctgtgctttctgactgtcctttaagaatcttcttttcttctactaattcactttgggagaaaacaacagtatatggttggtaatgtttagaagaataagctgtaaatgaaagatgaggcgatgggtcttactgatctaaaagcttctgaagttcattctggatttattgtttttgtagagtagagtaatgctgggaaaacaccaatgtggctattatgtaagatcactgggtctgcaataaatgtcctcctccaacaacaacaacaggccagataactcaagttactttagttaggatagctggtgtgggagactgagagatgcaaccttctcttcaacctccttaccataaactttcataggtttaaacaatgaaagagagattttgtgggtaactagttctgatttggagatttattcttttgcattttactttcatcttaatgaatcatatgttcccatcttgtcacaattttttttctatactacaatagcaacatagcttttattttatttaaaaaataattttacatgtatatggttatttgatctgaaataagaaaaaagacaaccaacaaactgcagaacttaaatttgacagcaaaatatcacaattaaagtttttctttttctttcttcttattggggaagtgtagcaggctgggtggtttagaatgagggactcataactgaagtatttcattagatatggtagagtttaatattggaggtgttttcatatggtgtgtacttattacagaaccttgcatgtagtgggaggacttggtaaatgtttctaaagtaagaacatatggccagcagctgaaaggaagtggctatcctgggaagcctgtggttgtcctatatttttgtcgtgtctagaaattagagtacaggagccctcaaaaatgtgttgtttgacgatagatgattctctcattctgctactgctaagatatggctgaaaaattccattgtgttcctgatgttgagagaaagagtatagtaattctttcattcatacttatttatttgcagaaatgctaatttttcaaggatctagattttcttctagatctctatgcaagtgacatagggggtatgacaaatgggaggcacagtttctgctgttttggagctgcaggatgctgaccatggaggtgattgcttggcttcctcagaatacagattttccctggggttgtagggtcataggctcatattgcagagaaagttgggaaaagtagctaaataaatgtttcctgaaagagaaaaataaatttaccccaaggtagtttttgtttgttttggtttttggtttctccttaaaacaaaagaaaagaaaacaaaacaaaacaaaaaaacaagataatgtgtatgctcatctctacttgtgaataatggctgtgtggagccacaaaggaaccactgtcaccctcaatcactgaggagcacaactagttaaatggtgaaataaaagtgctgtagttatagatagtgattgagaaaataggtcagggaacaactttagcctatacttatttatcattgctctgaaatttcagaaatctccaaatcataagctaaatcacaatggtcaaaaatagatttcaatcattttaattttccagaataaccacatattctagaagtagtcccgacctcatgctgccctctctttttgcgccatattttaggatgtatgtacttcctaaaagtacctgtccttctctaagtccttttttccttcttaaggaagtccccatattgtggagagcatagtcacggggtgggaatgacacatatccatcatgacaaccatgtaatattagacacatttagtagtgataatcccaggtttctacatgtaaaggaaaagccattcacatttgattttattgaaatgattatgttttatagtgaagactattgagtagtcctctttagatggcatggtataatttaaatgggttcttgcttctgtttctaggtaggtaaaatgacatacacttcagattatattgataagttttatctgaaatgattatttcacagggggcagatttgaaacccagaaagcaggtggtggtagggcagggcctattctaggcttgaattcttcctccagtgacatggaaccacagcagtacagacatgatgaggtcagtggttgggcacaacctgaatgatcaaaatggattgccagatggaattggagtagtggtctcacaatcactgcatctcagtggctacttacttaatcatgggagaagatggcatgctttcctgataaatgtccagatccataatgccaagactgctagtggcactactgttgccattgctgacaaagcaaaagtttacatattaatgcccgtctccaccctctaacatgctgctgacagtgatgttccattgttgtacaagctccttcctttggtccccagaaaaatatcgctttgtgcctaggacacctcaattcatatttatttctgaacaaattaagagaaatcataatgagacataggcctaaccagctcagcagataataataatactactaataatttgtgaataataataagttgtgataccactttctgaagtggtatcacaactggtagatcacacctagggggtaacaatcagtctgcctcttttcttcattctagttacggtgaaggtatttatctatcggcaagagatttcttgctgctggggacacctgcagagatgaaggaacttctgaaaacatgggctggcaggaaccagttttgacagaaaccagtggactcatgttctccctttgacatttgggggattttctcagggacattccataggatttcataggctgagcatctggcttgctattttcccatgagactacagaaccataagtacaaagctgggcaatgtcaatgttttatcactcctttatcttacaatcttcaagaaagagcaacacctggtaccttttttactgtagagagggaggaccacagattgcatcatgttcataggctgcacagtcaacatatggtctagttactagcctggaacttactgactgaaacacagcaaagttgagccaatttttaggctctgtttgtgcttgtgaaatgaaatatatccaattttaccaaaccactcagtctcctcacaccttctctgtttccagtgatgtctctttcaagcaagtcttccaaagggtgagtggtggtgcgtcgtgtagtgggacggctttctcctggatataccaagagtagatggtactctaaaagtagaaaatatcaactggatgccctcgaatttaaattcttgtcttagcttttgaggggggcaccaggcatattcatgtattgaaacctgatggctcaaaattgcactggagataatcaaccctataaaccttattgttgagtccaaagattcgagttctctttgctttttgtttctatcttgtaatactttccgctagttttagaagttttgacaaactctttaacattgtgaaatgttaagtctaaacagactaaactcccagaaataaaactttccaagagtcatacatacacccagatgctgatcccattttccatttggcctctgtgcaaagtttgtggttcagtatcaaatgagattttgggcagaaacacagggagtcttttagaggttccacctcagcaaggaatagattttagttaatgtctcctgactggcttgagcccttccaaatctgatgtctcttaatctcctctctagctttttgggaggaacaatacagagggcaggggagatagagggaggaacagtcaggccaaacaatacaacacagtgtggaaacacttgcctcgtgtaaacccagcctgtgttgcatctgaaatacaaatgaaccagagacagagtatcaaacacaccaggtgtaaaagcagctcaccatttaaaaacatttacagttgtcatcattgaatgttctagctggggcttgcagggaagggaacacagctcattcttaatcacggccaaagtaatttaagccataactggatattaagatacctctcagcacaaatcatgacaggcaggcccctcgacatagtgggaactttcctttttttgttctctccttctctctttattagggaccctttgcagagaaccattaaaatgcatttttagaatctgtgttgagaccaatttccctgggaattcaagggaagagcaggtacctcatggatcgctcactgagctggagaaagctacttgtgtcatctgggttgtcttcctcattggcaagctgggtccagctgcctgtgctctcctcgctgctgcttggagggttgggggcctcatcgggggctctggcttctgtggaggcttcagcctctggtacatctctggtatcaaggctgtcactgtagagggcaagatattattaccaagagaggcagcacacacacacacacacagaaacttcacagagccactttgtagagtcccaataaacaggatgtcactggacacaggcagagtctccctgggctgatccttctgctggtgccctaggtcccatttgccttttcaggattactccccatcagccagcttttccatctcttctattaatctctttctactgactccctccaatcatttgaaaaacaggttgaatgtatgtagcctggcctacacacaaaagaattattgagggacaatgatgtttaaaaagaagatacacaaagcattcacccgagagattatgattcagtgtttctggaaggaggtccacaaatctgcatttttatcaatcactcctggttgattctaatgcaagaggatcattagaaaaatacctaccccgtttctggtgctttttaccaagtcattttgcactgacttggtaaaaagcaagacgcctctatattttgatatgcatgcctctgtattttgcacttgcactatattttgtgctgtattttaccctatctcctccctctgaaacccctgatttatatcagcaccactcttctggatgagcacttgcatttttagaccaaggagctctccagagcatttaacccttgatctgacaggcctttgttcttgaagcttctcctccctggcctcctgtgaatttctgtctctctggtcccttcttgcctggaacccagttgtctgtttttcctttaagtgtagctatagctggctctgattgatttcctgtcctcctttccacagtcggttcctaagcaatctcatccacttgcctgtctgtgaaaatagcttccaagtctggatcccagccaggacccttcttctggattctgggctcctttacaagcgggtcttctgcatatctcattaacatctcaaaatcaatacatctaaaacgaattctaattgccttcccaccctcttcctgggcttcttatttccattgacttttctgtgtgcctaggcttaaaatcttgcagtcttccaatttctcctctttgccctttacattcaataaatttctttgttcattcagttccaactcaaaagctttcacaattacttttaatggcaaaaccctcaattactgttacaccaacatactttaatttgtctttctaaattgctataattccagatttggaaggaagatttcctgtagatgaagatccagaagcccagtgagattggagggcttatcctgaaacaggagttggtactagacatttagaccttgtgtgcttgcctggactatagtgcaccagccttccaacggttgtgcttcaactagtcatccactttcaaaaccttcttaaccctggtgccagattaaagtacctaaagcatattgttggttgctcttgtcaggagccttcaggaacttcctgaagccaaactctatccgttgtgggctccccctgcttatcaagtttcatgtgcctcaaccctaatcactatttaacaaacaaaactatctactgtttttcaaaactgcagggatttcttgcctcccagcctttgcctagttgagtcttctgaccaaatggtggagaagtgtgtgcttcgagcatacattctgccatccaactgctgtagattcctgttccacgacttgtcacctgttcaacttaagttaataaatctctccaagaaaagtaacaacatctcataaaggtttttggaagacataaattagaaaaaaaatcatttaatgcatttagcttagtgcctgtatataagtatccaataagtattcttctttattaataaattatataattcattaagtctaataacatgcttttgttaagaatcacgtctaataacacgctgttttgatctttgcttctcactacccctcaagcctcagccaagacactcccacctccccaaggcctttcttaatctttttagctggagctctctcccttgaatggttgaagcaatctatttttctttctttttggtgaaatggaaggcttcctgagtcacattctagtacatatagttatttgtgtatataatattcgttattaagagtgtttgcacttgtttgtattttaagaacagagctgtgaacacataaactattcttcagatgaatatgttattgctaaaagtgtctagtttcataagcagagccacactcttagtctagagagctccacttgttaagttgtaaactgtgaaagatctgagatgtggcactacttgcaagctggtagttttttgtttgtttgtttgtttgtttgagacaaagtcttgctttgatgcccaggctgaagtgcagtagcatgatctcagctcactgcaacctccgtctcccagatataagcaactcccctgcctcggcctcccaagtagctgggattacaggcatgtgtcaccatgcctggctaatttttttatttttagtagagataggatttgccatgttggctgggctggtctcgaactcaagtgacctgcactcctgggcctcccaaagtgctgggattacaggcatgagccactgcgcccggcctttagggttaatattcaatcaccctttaattcaggtatgagtgccctttgctcaggaaactctgatgtacagaaatgtaaacgtgttcatggaaatttgtctgcagactacttacaaggtcatcaaaaactaacagtatttatgtttttgacattaacagacataaatgactacaaacaaaaagcaacagcatattttgctattgacagtaaaaacagtcacttgatctagtagatgctggattgttttacttcaggccatggtaccctgactgtggagaatacaggctgctgactgtacacactgggaattaccctcagtgaaggaattgccttgccaaggttagaccctttcccggtgaggatcctaatgtctggctaacatagagatacaaaatcccactccttgcttccatttgcatcaaaactgacagaccatcccatcttccgggtttcctgcaggatgtgccgaggcctcagttgcagacacacttgggaaggacctctcctcttggccaatcctgcctttcccacttccttacatgggtatgcatatatttctgcagagaactccctgacaaattatctgcctgcagctctccctctcagagtctgttcccagggaatacaacctaagacaggtggcctctttcatttaaagtaaaatattggctgcagaaaggtctatgtaattttcctcaatcttagaattagtactgttatccgttctctgagaatggttatattttaaaaatttaaaaaagttctcatatagagagcagagtttcaaatgcataactttttgagtgtgattaaaaatctcctttttgatgtgtgaacttgtcacctaaggaattttacaaaaggctttggatgcttgatcctgacagtccttctcacagtgttctgggtaggtttggcattgaggtgtggttatttccagtatgctatgctgctaacactttgtgaaagaaggtccttgcttggtttttcttgttgaaatattgagatttttccaaatcatgtagggaggaaggaggagaatggtgcagccaaagaggcagcatggacttaaattcaaatgaaaaaaaagttcattgatgacaaatggaaataatacatatatccccaacacagtgcaaatgagccaagaaccagatacaaaggagaagattcccaaaccattcacttgcctaggtaaaaagtcatttcctggaccaatttcttattaagttagaatctcatgttattagaaacatttattccaggctatttcttactaaagaagttaaatctcagtgattgacatccaacatccttattaaaaaatgagtctgtcagtgtattttactttatctcaacttcatgctctatttaaagtaaatctcacattccatgtcacataactaggagttcagaatgaataatcattatccacaacactagttttcattttgagagaaattgaaatttacagttctgctcatttatttatgaataatgcacagaggtgttgtgcagatgcatgcagatggcttcccccttcttatcttacatgtcatccacagagattcagaagactatgtcatatcaaattccatcatagaatctaatctctcagttggcagagattttagagaccatctagcctgtaatttccattagggttcactcttgatgttgcatgttctatataggctttgacaaatgtataatgactaatatcatacagtataagttcactgccctaaaaatcctctgtgctctacctgttcaaccctcctgccctctaacctctgacaaccactgatctttttattgtctccatagttttgcctttcttgagactgtcatatagttggaatcatatagcatgtagcgtcttaagattggcaacgtttggccaggagcggtggctcacgcctgtaatcccagcactttgggaggccaaggcgggtggatcacctgaggtcaggagttcaagaccagcctagccaacatggtgaaacactgtctctactaaaaatacaaaaattagtcggccgggcacggtggctcacgtctgtaatcccagcactttgggaggccaaggtgggtggatcacgaggtcaggagatggagaccatcgtggctaacatggtgaaaccccatctctactaaatatacaaaaaattagccgggcatggtggtgggcgcctgtagtcccagctactcgggaggctgaggcaggagaatcgcttgaacccatgaggtggaggttgcagtgagccaagatggcgccactgcactccagcctgggagacagtaagactccatctaaaaaaaataataataataaaaataaaataaaataaaatacataaaagattgacaacatttaataatatgcacttaaggttcctctgtatcttttcatggcttgacagttcttttttgttagtgctgaataaaattctattgtttggatgtaccacaatttatccatttacctactgaagaatcccctgttgcttctaagttttggcaattctaactaaagctagtataaacatctgtgtgcaggtttttatatgggcataagttttcaacgtgtttgggtaaataccaaggaacaggattgctgggtcgtatggtaagagtatctttagttttgtaaaacactccccaaatgtcttcaaaagtggctgctccattctgtattccaatcagtaatgaatgagtttctgttgctccacatctttgccagcatctggttttgtcagtattttgaattttgggattctaatatgtatgtggtggtatctgattgttttgatttgcaagtccataatgacataatgttgaacatctttttatatgcttatatgctatccatacatgttctttggtgaagtgtctcttcaggccttttgatcatttttcttttatataaacatatatatatatatatatacacacacacacacatatataaatatatctatacatatatctatacatataaatatatctatacatatataaatatatatacatatataaatatatatacacatatataaatatatacacacataaatatatatacacatatataaatatatatacataaatatatataaatatatacatatataaatatatatatgtatatatacgaatatatacgtatatataaaaatatatatacgtatatataagtatatatacgtatatataagaatatatatacatatatataaaaatatacatatatataaaaatatatatacacacatatatatttattatactttaagttctagggtacatgtgcacaatgtgcaggtttgttacatatgtatacatgtgccatgttggtgtgctgcacccattaactcgtcatttacattaggtatatctcctaatgctatccctccccgctccccgcagcccacaacaggccctggtgtgtgatgttccccttcctgtgtccatgtgttctcattgttcaattcccacctatgagtgagaacgtgaagtgtttggttttttttccttgcaatagtttgctgagaatgatggtttccagcttcatccatgtccctacaaaggacatgaactcttcattttttatggctgcatagtattccatagtgtatatgtgccacattttcttaatccagtctatcattgttggatatttggattggttccaagtctttgctattgtgagtagtgccacaataaacatacgtgtgcatgtgtttttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctgtttctccacatcctctccagcacctgttgtttcctgactttttaatgattgccattctaactgctgtgagatgatatctcattgtggttttgatttgcatttctctgatggccagtgatgataagcattttttcacgtgtctgttggctgcataaatgtcttcttttgagaagtgtctgctcatctccttcacccactttttgatgaggttgttttttttcctgtaaatttgtttgtgttctttgtagattctggatattagccctttgtcagatgagtagattgcaaaaattttctcccattttgtaggttgcctgttcactctgatggtagtttcttttgctgtgcagaagctctttagtttaattagatcccatttgtctatgttggcttctgttgccattgcttttggtgttttagacatgaagtccttgcccatgcctatgtcctgaatggtattgcctaggttttcttctagggtttctatggttttaggtctaacatgtaagtctttaatccatcttgaattaatttttgtataaggtgtaaggaagggatccagtttcagctttctacatatggctagccagttttcccagcaccatttgttaaatagggaatcctttccccatttcttgttttcatcaggtttgttaaagatcagatggttgtagatgtgtggtattatttctgagggctctgttctgttccattcgtctatacctctgttttggtaccagtaccatgctgttttggttactgtagccttgtagtatagtttgaagtcaggcagcgtgatgcctccagctttgttcttttggcttaggattgacttggcaatgcgggctcttttttggttccatgtgaactttaaagtagttttttccaatctgtgaagaaagtcattggtagcttgatggggatggcattgaatctataaattaccttgggcagtatggctattttcacgacattgattcttcctacctatgagcatggaatgttcttccatttgtttgtgtcctcttttatttcgttgagcagtggtttgtagttctccttgaagaggtccttcacatcccttgtaagttggattcctaggtattttattctctttgaagcaattgtgaatgggagttcactcatgatttggctgtttgtctgttattggtgtataagaatgcttgtgatttttgcacattgattttgtatcctgagactttgctgaagttgcttatcagcttaaggagattttgagctgaaacgatggggttttctaaatacacaatcatgtcatctgcaaacagggacaatttgacttcctcttttcctaattgaatacctttatttctttcccctgcccgattgccctgtccagaacttccaaaactatgttggataggagtggtgagaaagggcatccctgtcttgtgccagttttcaaagggaatacttccagtttttgcccattcagtatgatattggctgtgagtttgtcataaatagcccttattatttttagatacatcccatcaatacctaatttattgagagtttttagcatgaagggctcttgaattttgtcaaaggacttttctgcatttttgagataatcatgtggtttttgtctttggttctgtttacatacctgattacatttattgatttgcgtatgttgaaccagccttgcatcccagggatgaagcccacttgatcatggtgataagctttttgatgtgctgctggatttggtttgccagtattttagtgaggacttttgcatcgatgttcatcagggatattggtctaaaattctcttttttcattatgtctctgccaggctttggtatcaggatgatgctggcctcataaaatgagttagggaggatgccctctttttcaattgattggaatagtttcaaaaagattggtaccagctcctccttgtacctctggtagaattcggctgtgaatccatctggtcctgggctttttttggttggtaggctattaattattgcctcaatttcagagcctgttattggtctattcagagattcaacttcttcctggtttagtcttgagagggtgtatgtgttgaggaatttatccgtttcttctagattttctagtttatttgcgtagaggtgtttatagtattctctgatggtagtttgcatttctgtgggatgggtggtgatatcccctttatcattttttattatgtctattcgattcttctctgttctttattagtcttgctagcggtctatcaattttgttgatcttttcaaaaaatcagctcctggattcattgattttatgaagggttttttgtgtctctatctccttcagttctgctctgatcttagttatttcttgccttctgctatcttttgcatgtgtttgctcttgcttctctagttcttttaattgtgatgttagggtgtcaattttaggtctttcgtgctttctcttgtgggcatttagtggtataaattttcctctacacactgctttaaatctgtcccagagattctggtatgttgtgtctttgttctcgttggtttcaaagaacatctttatttctgccttcattttgttatgtacccagtagtcattcagtagcacgttgttcagtttccatgtagttgattggttttgagtgagtttcttaatcctgagttctagtttgattgcaatttgctctgagagacagtttgttataatttctgttcttttacatttgctgaggagtgctttacttccaactatgtgaattttggaatagatgcggtgtggttctgagaagaatgtatattctgttgatttggggtggagagttctctagatgtctattaggtccacttggtgcagagctgtattcaattcctggatatccttgttaactttctgtctcgttgatctgtctaatgttgacagtggggtgttaaagtctcccactattattgtatgggtgtctaagactgcctgtaggtctctaaggacttgctttatgaatctgggtgctcctgtattggttgcatatatatttaggatagttagctcttcttgttgaattgatccctttaccattatgtaatggccttcgtctcttttgatctttgttggtttaaagtctgttttatcagagactaggattgtaacccctgcctttttttgttttccatttgcttggtagatcttcctccattcctttattttgagcctatgtgtctctgcatgtgagatgggtttcctgaatacagcacactgatgggtcttgactctttatccaatttgccagtctgtgtcttttaattggagcatttagcccatttacatttaaggttaatattgttatgtgggattttgatcatgtctttatgatgttagctggttgttttgctcgttagttgatgcagtttattcctagcattgatggtctttacaatttggcatgtttttgcagtggctggtaccagttgttcctttccatgtttagtgcttccttcaggagctcttgtagggcaggcctggtggtgacacaatctctcagcatttgcttgtctgtaaagtattttatttctccttcacttatgaagcttagtttggctggatatgaaattctgggttgaaaattcttttctttaagaatgttgaatattggcccccactctgtagagtttctgcctagagatcagctgttagtctgatgggcttccttttgtgggtaacccgacctttctctttggctgcccttaacattttttccttcatttcttctttgatgaatgtgacaattatgtgtcttggagttgctcttctcgaggagtatctttgtggcgttctctgtatttcctgaatttgaatgttggcctgccttgctaggttggggaagttctcctggataatattctgcagagtgttttccaagtcggttccattctccccatcactttcaggtacaccaatccgatgtagatttgttcttttcacacagtcccatattttttggaggctttgttcatttctctttattcttttttctctaaatttctcttcttgcttcatttcattcatttgatcttcagtcactgataccctttcttccagttgatcgaatcggctactgaagcttgtgcattcatcatgtaattctcgtgccacggttttcagcttcatcaggtcctttaaggacttttctgcattggtttttctagttagccttttgtctaatcttttttcaaggtttttaacttctttgccatggtttcaaacttcctcctttagctcggagaagtttgatcgtctgaagccttcttctctcatctcgtcaaagtcattctccgtccagctttgttctgttgctggtgaggaggtgcgttcctttggaggaggagaggcgctctgatttttagaattttcagtttttctgttctgtcttttccccatctctgtggttttatctacctttggtctttgatgatggtgatgtacagatggggttttggtgtggatgtcttttctgtttgttagttttccttttaacagtcaggaccctcagctgcaggtctgttggagtttgctggaggtccactccagaccctgtttgcctgggtatagcagtggaggctgcagaacagtgaatattgctgaacagcaaatgctgctgtctgattgttcctctggaggtttcgtctcagaggggtactcagccgtgtgaggtgtcagtcttcccctactgcgggatgcctcccagataggctactcgggggtcagggacctacttgaggaggcagtctgtccattctcatatctccaactctatgctgggagaaccactactctcttcaaagctcagttggaaatgcagaaatcatctgtcttctgcatcgctcacgctgggaactgcagactggagctgttcctattcagccatcttggaactgcttttgatcatttttcaagttttgtactatccttaatggacaaataataattacatccatttatggggtacgatacaataatttgatatatgtatatactgtggaatgattaaattggggtaataagaatatccatcatgccaaatatttatatttttgatgagaacatttaaaaccttctcttttagctattttgagatatatcatacattattattaactgtagtcacctttctgtgcaatagagcaccagaacatgttctgtctaactatagctttttacctattgactagaattttcctttctctgtccacctcccccagtccccagcctctggaaatcatcattttactctctccttctatgagtttgactttttaagattccatacgtgagatcagactgtatttgtctctcagtgcttggcgtatctcatttaacataacatcctctaggttcattcatgttgtcacaaatgacagaatttcctgatttcaaaatatattacaaagcaatagtaattaaaacaggatggcaatggcataaaaacagacacattgaccagtgtaataggatagagattccagaaagaaacccacatatctatgatcaactgatttttgacaaaggtgccaaaaacacataatgaagaaaggatagtctcatcaataaatggtgtaggaaaactggatagccacatagagaagactaaaaatggacccttttctcacctcttatataaaaatcaactaaaaatggattaaatacttaaatgtaaggactaaaagtataaaactactagaagaaaacatagctgaaaaactccttgacttaaactgatttaaaaatgagtttttaaagtttttatctttatgttgttgagttttaagagttctttgtatatttcaggtaatagtcctttattagatatgtattttagaaatattttctcccaatctgtggcttatctcttctcattctcttgtcagtgtctttcacagagcaaaagtttttaattttaataaagtctattttatcaagcctttcttttatagattgtgcctttggtgtatcaaaaatgtcattgccatacccacaatccatctagatttttctcctacattatcttctaggagtttttttttttttttttcctgcgagagagtcttgctctgtcacccaggctggagtgaagtggtgcaatctcagctcactgcaaactctacctctcaggttcaagagattctcctgtctcagcctcccaagtagctgggattataggcacaccatcacacccaactaatttttgtatttttagtagagacagcatttcaccatgttggccaggctggtctcaaactcctgacctcaggtgatccacccaccttggcctcccaaagtgctgggattataggcttaagccactgctcccagccattccaggagttatatagctttgtgtttacatttaggtctgtgatccattcgtgttattttttcaaatggtgtaatgtgtctggattcatttttttttttttgcatgtaaatgtccagttgtttctgtactgtttattgaagagactatcttctcttcaatatattgcctttgtttctttgtcaaagatccattgactctatttgtgggtgtctattattgggctctctattctgttccattgcttgattttgccaataccacactctcttgactactatagctgtagagtaaatcatcatgtcaggtagtctcaatcctctaactttgttcttcctcttcaatcttgtgttcaatattcttggtcttttggtctccatacaaactttggaattagtttgttgatatctgcaaaataacttgctgggattttgattgggattgtaatgaatctatagattcaactgggaagaactgacatcatgaaaatattgaatcttcctattaacgaatagcctttatttttgaaggaatttttgctggataaagtatactaggctgacagtttttttctccttcagcatagtatagttgtcatactttgtcttttatcttacattgtttctgataagaaatctgcagttttatttgtgcttcttagtatataatgtttctttttctctgggctgcttttaagacaatttctttatgatttgcttttaataatttgattatcatgtgccttgatgtgattttctttctgttgatcctgcttagagttatatttcttaatttgtgagtttataactttcatcaagtcttacattcgtgtgtacctttaaatcttttggcatatttataagagatatttaatttctttatcatgtttgtttcccttcgttcaaagtccttgtctgctaatttcatcttctctgtaatttctggatatgtttcttttgatgattatactccttataatgagtgatatttttcttcttctttgtgtagcattttttgcttggatgttacattgcaagtttatgttgttgagtactagattttgttgtcttttctttaaacaatgttgaactttattccaggttaaattagtttcagttcagcttgatatttttgatgcttgcttttaagttgtgttagaacaagtgtagattagcctttatttttagggctagtttagctttaattctatgatgtgatgtttttagggtctctactaagtactgtgtgtatgtaacatggattcttcactctggctagttgggactaaacatcttccagtactatgcgagcttgtggcattgtccagcttacaattctctagcgtcatggggctgtacctatagattcatgcctcagtgtccagcaacaggtcaagaggcttcctgtgcagattcctcttctttctctgcatatctccctctagtctgtgtctcctcacctcattgtgcccactgaactctgctcaggatttccctcttggcattattgtctgaaaaggcaatccagatacaaagtgagggcaattatagggctaatcacgtttgtttcccttcgctcaatgtgctgcttgttgtacaatgtatgaaatcagttgtttaattctgaccattaaaaaaattattcatggatgggccaggcacagtggcttatgcttataatcgcagcattttgggaggcagaggcaggtggatcacctgaggtcaggagttcaagaccagcctggccaacatggtgaaaccccgtctctactaaaaatacgaaagaaaaattagctgggtgtggtggcatgtgcctgtagtcccagctactcgggaggctgaggcaggagaatcgcttgcagctgggaggcagagattgcagtgagccgagatcgcaccactgcactctagcctgggtgacagagcgaaactccatctcaaaaacaaaagaaaacaattgttcacggatggagggcaagttgagtttcaataacttcattgtgagtagaaacagaagacctttcacatttatctttaaagctctctctgtaggtatgccattgtggttttgatttcaataattaatacgtttttctatctagtggtttttaatttcattatacttttcgtctttgtggtagtattttattgatttttatatctaccttattctattctgatggtagtttgtttcttgctcctattttgtatgtctcattttttccaaatattaaacataagtactttacattctgtatttaataattccagtgtctgagaacttcgatagggctaattctgcctcttcatgtttgtgctgagtctttcttacagtgccttgattccttgtgtgtctttcagtttaagactctgagcttatacttgatggggctttatttgttgaaatcctttaagactgggcttaactctccagagattttacttttgtctctgccaagctctcacagggttgttaacctgagattgctttaaggtaacttaccagcttgggatttcctggaccacaagtataatgcaaattagaatgacaaaaatgcattagggtaagctgtggttataaattctcaaggggattgttttctcctcgtatccagagcttgaaccctcaaagatgccttttttttttttttttaatcagttcactcttctggtgggtgaactttttccatagttcacacctttactgaggttgtaacccttcaggatgtggaagtctgcctcagttccaagtcttcaccattcgcagaccctcatttcctggtttccactagcctttagaaaatgaatttttaggctacagagactggtagatgccctcaagggcaagcacagagtcagctttaatttactaccttttcaaattctttccttttttaacctctgaaatttctataattactattgttaagattagccttgcaaataagggtaaataaaataattcctgagaatatagaaatgagggtaaatcataaatggcagacagcattctgtttccatctctccagataagggttcttaggggctgctgttttagacaggggtaccaaacatccaaatccatggggaatatatcacacttgcttgtcaatttttttaattgacagtaattgtatctattatacggggtatactgtgatgttttcatatagttttactttgtggaatgattaagtcatgctaattaaaaaatctagcacctcacatacttatattttgttgtggtgaaaatatttaatatctaatcttttaacagttttgaaatatacaggccaggcccagtggctcacacctgtactaccagcactttgggaggctgaggtggcaggatcacttgagcccaggagtctgagaccagcctgggcaacagaatgacatctccatctccacaaaaaaattaaaaaattgggcaggcatggtggtgcacacctatagtctcagctgcttgaaaggctgagaaggaaggattgcttgagccctggaggttggggctgcggtgagccatggttgcaccacagcactccagcctgggtgacagagactctacctcaaaaaaaaaaaaaaaaaaaaaaaaagaaagaaagaaagaaatatacaatgcattgttatttattacattcaccattctgggcaatagatcactaaagcttatttgcttgtcttccttgcttgtcttcctttaaaaaaaaagatcagcttcatacctaaaaggatgtttattatacttaatccaggatttctaggtgattcatagtgggaacatttttcgggctggctagatcaccataatgcttaaaatgcaagtctttcactctagttcttctcacggctggcaccttctcttcgtttaggtctcatctcaatgccaacatcctatctaagtagccactttccctaccagtcatttgctaccacattattttttattttttctcatcacactgtacaataatatttttttgaaaggttttcctatgtactctccctgtctctcccactagtgtgtaagaactatgagagtagatatcaagtctttctattttcttctgtgttttcagccccaaggccaactgcttgtcagaataagcactcaaatatttgttggatgaataattttttttcttgaagcaaatataaatggatacagcacctaaaatatgtttctaaaacttaagattatgtcagtaagtatagcatgtgaatgctcagaattgtcagtttgttgtttatactttgtggtctcaacttatcaagaagtccaataaattctgaagttgttattcttttatcaaaaaagtaagaaagtgatttttatttcagtatattgagcgtaaataactttttttaaagtaagaatcatgaaaacatgcctaaagaaagtagcctaaaattattttcaggacatgacacctccccatctccaaacaaaattaagagtgcatatgccacttaccttgtttgtgtataagggagtagaactgtttcacagagaagtgagttttgtacttagctatttgactaatcaaatcccataacatctctgagcttagaaaatgtaatctaaatatggttaattttccctctagcaaatcctggaaatcctcgttttaataaaatcttcacagtgtttgtaagatattcctttttcttttttttgagacagagtcttgccccgtcacccaggctggagtgcagaggcacgatctcggctcactgcaacctccacctcccaggttcaagcaattctctgtctcagccccccaagtagctgggaaggtgccctccaccacacctggctaatttttgtatttttagtagagacagggtttcaccaccttggccaggctggtcttgaactcctgacctcgtgatccatctgcctcggcctcccaaagtgcttggattataggcgtgagccaccatgcccagcttttaagatacttctttcggaaaaaatttcctggaataagggtaatcatataccctaactccaaacagcaatgacaacaaccaaaaagcaagcatttattacaacaggcgaggccctgagttgagagatttatgtgcatttccttattaaaaccttaaagatcctcttataagataattattattcctacctataggtgagtaaaccttggtaaacagagaagttgctcatagttacaaggttagtgaaatccatgttctttaataattctttatattgttccacaaagaaaagcattttcaatatttagtccttatgttttggaagcagatgtaggtcttgaatttctagggtggatgactccacattctttcctgttttattggtggaaaaccaaaccagaaatcatgatttgagagggtgtgttcttgggccattctatgtaatacaaacctaagtcatttggggactttattcatacatatttccagtatattttggaaaaagcattgaattgtacctattttaaggataatatcagtgacatttaattcataattgtattatgaattttattcaacttcagtgacaattgctatttgatctcagcctacaatcataaatcttgttgaactactatttcatgaacattccctaactagccactctttggttaaaaatcttagctgggtttaagatatctgtgttaaagaagactccaagtcaggcatctggattctctaagaagggttttccattttcttgtatttcaggttaagggaattctaaagaattacacatgagctaatttgtttttttaactctgatcactttaaaaaatttgtaattctccaaacgacctagataaaatgctttgataaatattgtctataactggagaactactgatgtataaaaatgtgtctttttggttagctctgcctacctcatttgatttagctttgtgttcttttgcttttacgttttcatgctttctccttattcttccaggatttcatccaattggaaagttaagttcttagtactgagtggctaaaaaagaaatatttaaatccacctagacactatgtaccaaatacactcaaccataaccacaccagtaatgatgtcctctaatggggagcactggtacctgaggatgaatcccttctccttccctggtggaagtggaaaagtatcaagaattttcagaaagctgctgaaatttgatgaaggctgtgttcaacttgttggctgccactcttggtaaataataaacaatataggcatatgtctctgaaaagacttctccaacttaggttttccaagcccagtagcttaattttttattttgttttcctgttttttaaatttaattttattattattatcatactttaagttttagggtacatgtgcacaaagtgcaggttagttacatatgtatacacgtgccatgctggtgtgctgcacccattaacttgtcatttagcattaggtatatctcctaatgctatccctccccctcccccctcccccacaacagtccccagagtgtgatgttccccttcctgtgtccatgtgttctcattgtttaattcccacctatgagtgagaacatgcagtgtttggttttttgtccttgcgatagtttactgagaatgatgatttccaatttcatccatgtccctacaaaggacatgaactcatcatttttttatggctgcatagtattccatggtgtatatgtgccacattttcttaatccagtctatcattgttggacatttgggttggttccaagtctttgctattgtgaatagtgctgcaataaacatacgtgttcatgtgtctttatagcagcatgatttatagtcctttgggtatatacccagtaatgggatggctgggtcaaatggtatttctagttctagatcctgttttgtttaactacaaaccaaagctaaagaaatgatacaatggtctcatattcaagaatcttataaattttctacagaaaatataaggtgtaaaaggaatggagagttctttaagcagcctcagagaaattattaccttgcgtcaaattcaaaatggattgtcaactatgtcataattttctggaaaaagctgtttaaataacaatacttcagtgttgctttgcatttacactgctagaattataccaggcatctaaagggcagcccttctaggacacagtgtccttggcaagatctttagaaaaagacaaaaaacaaaaacagaaagcaaaacttgaaaggagagactctatggagaagaaaaatgagaggagagaaaaatgatgccaaaatatttaatgtcaaatgccaaaactaatatttatttgactgttttcaaatgaataagttgcatcatttattattaatattattgcatcatatactattaatattattatttgcttaaaaattgccatgaatgaattttaaaaggtaggaaaccgtaggagattaattttaatgggaggaatgatatcttacttctttggttatatagatgagtttagttagttttggagattttaagaagagatttactttcaactctctatcataaatgcatattaacctaggagatcattttttttttattacactttaaattttagggcacatgtgcacaacgtgcatgtttgttacatatgtatacatgtgccatgttggtgtgctgcactcattaactcattttttttttttttggtcttgaaaatttagttcttgcaccaatcaaatcctttatgtctaaaatttagactaaacactgattaagacgcaaactccagtcacatgcaccctatgtagtctgagacgattcactcacctatggatttgacaagcgctcacggctgtgtctccacctctcaccacatctgggatgtttttgtcattcgaatgcccttctgcttcctctaggaggctgcttttggaaaggaagggttcaggttccccagcacaggcttctctctgatctgtttcaatctgaatcaaaggcacttccctcgagcaaagtgatcgccttttgtggtttattggtacagggtcctggcacgaggaagtttcttttttagaatctaaagggctgtggtttgtaagagaagcagttttgctcaaagatgacactgggggctgtttacattcggtaacagagtctttcctcgggcaatcgagagactcctgaacaagcagagttggcccactgcacatcctgctcgcagctaatctatttgcacacttctctgcttgcgagggagagccaccagaaacaggctcagtgtcagcttcctctgcatcatccacaatgattttgttcttgcgcatgagagcctcaatggagctagcccacgtttcatgaattaacatgttggtgatgtggtcagtcccacctctccgatacaagcaagagtcagatttgcagagaccggatgaggacgcgctactgaccggctgcacgcttaggaaatcttgtgggcagttctgagcaaagccatctaaagagttggctttgatgggcacattcactgtcagcctggagcatggggatctgctgtctggcatggacgactgtctgtggcacactggggatcgcagagaaggagacagcaggccggctgtccaatcctggctgctccgtctggaggaggcactttctctgctgtctctttcgatgtccctcagcatgtacctgtagaactcctcagtgatgctctctgtgctggactgcttagagggacagctaggcctcacactgaggtggtcacttttccggcacgcctgttgcatggctgagttcagaatgctgctggcgttcttgccagcatagtaatccagcagtaactcaaatcctctcccttcattttccatctggttcaccatgaacctggaaaactcatcggtgatgctctcacagctcgactgcttggagacagagctggccctgctgaccggctggctcagcgtgctcattaagcccaggctgttgacataggccctggcctcggagtcttcctcaggaatgctttcgcagctggaggccttcagccggctccacctgtcgccactcagtaaccgattccggggatagccctgcgcctgccacatgccgtccaccatagagaactccgttaggttcatgatcttggctgccacttcattggcaaaaagattgacagaatctgggacatcttcaaggttcatggactcatccacaaccctgttcatcagcttttctttaagctcagggtgctcgtccgtcttcctcttgatctcactgagccggggaggcttgtgtttcctcacagcggtcccgctcccctggctctctttcttcctcttcaaggatcggcagggtacgttgggtgtcatcagaaactcactccctcttttccatgcacaaaaccagggttgttttccactggagttgtcaaggcaaatcgctgcaatttcagttgccatggagacgaccgtgtctgctaattcttccgcaaagtctgtaatgcagtagatgtctggatgctttgtttgaagcgtggattgagcaggaagcagcaggtcatcccctaacaaggacaggttgacttgaacttcgttgatgcgagatgtggcacagttgtacttttcttgggtgtttgggtggatactctcctcagcctcctgggaaccacttctggactggctgaccgttggggacctttgtccttcggaagaggctctgcattcattctcactgtgatgagggctttttgtatcctctcctgctattcctttcagatatatttccttggaggatgttgtagcagttgaagaatcgggcactctgtgactacgtgataattgtgactgcagcgtggggttcttgaagaggcctggcctcactccacccttgtcttgttttgaatacatgccatccacaagattgttgatgacaagactcgtgttgtgtgaattgctaagtggagagctgctggaggattcagtggcttttgtccaagcttgactagcacccggatcagatggctggcagcttggttctgtctccctccttctgatggtctccttagaaaggacagcaggacattcaccaagccgtacaatatgactcatcttcttgaacgtgaagcatatcacatctaaaagcagttgatttgtactttccattaaggtgtccagaatttcagatgaatgcctgttgtcattggggtcgattatcatatttttgtggtgaacttcatcaatggaatgcctcaggataacattggacagggtatgtgccagttcattcctgacgacattttctgagcacagggtctgagactttgaagcagtttccatgattctcctgttcatggagtccagaaagtctccaatgctgctgtaggtattaggccttgttaaaaccagagcagcctccttgagcaatcccttggcaatggcttccttgccaagctccatgcttgctaaaccacaaagtgggggcatggcttcagaagcctcagctgcaggcgggaggctaccacttggagccactgagcatgtcacctcttctctttcacccagaccacagacagccacggcactggccacctgagtcatgccacacaaagcagatggaaaggagtactcattgatggaaggttccttgagtccttggggtgcttgagtttgcagtgcaccactgctccctgggggaaagttcgagaccacttgctccattttgagtctttctgtggcctgtggactggaaatagttccaatcacagtggctgcacaagctaacgccacttctagagcactctggggttgtctgctggagttctctccagagaggatgcttgaggtttcaacagagacttccatctcaggccaggaggagatgcctggctgtggggcagcatcactgccatctggactctgaacaacgacgattttggggagctcattccatgaccgagaaaccactgtatcttttgtggaatagcaactgggaagcagagaacttcctacagaaacactgactgcagattcctggggtaatgtggactgagattgagataatctaataaatgcatcctgcagcacggattctgctaaatttgtagcatacttgccagtggtgacttctccatcttgtctaggagggagagcgtttcttgtgtcttcatggtctcctgggtttaggttgcttctctgctctgccacagcacatgcagaaggtacatctttatccatcatggagaaataagcatcttttggaatatacagtgcctgtgatttttccatttgacctttaaaagcttctgaatgataataatgtgtggcttgtctcccattccccacagcttctcttttccactgtgatggcttggctgagggatctagactctgcaaggctgtgttctttgttaggttttctggagatcgttctgttttaatcaatggtgtgggatatttgttgatgtatttgtcttccaaagcataaagccacttttccttgttgcaattccattccacctgggtggctccctttagctgtttactttccaaaacattggctgagacatttatattttcataatctagtgaggagaaaatgaggggcactattactttttggatagcaggttaccataagtcttaagtaataattactttctaaaaataaaacatcaataaagacacatgcacacatatgtttattgcagcactattcacaatagcaaagacttggaaccaacccaaatgtccatcaatgatagactggattaagaaaatgtggtacatatacaccatggaatactatgcagccataaaaaaaggatgagttcatgtcatttgtagggacatggatgaagccggaaaccattattctgagcaaagtatcacaaggacagaaaaccaaacaccgcatgttctcactcataggtgggaattgaacaataagaacacttggatgcagggtggggaacatcacacactagggcctgttgttggcggggggagtggggagggctagcattaggagatatacctaatgtaaatgacaagttaatgggtacagcacaccaacatggcacatgtatacatatgtaacaaacctgcatgttgtgcacatgtagcctagaacttaaagtataataaaaataaaataaataaataaaaataaagcattgactttttttcccccttcaagaataacagtttgaatggttttcctcaagaaaaatgaatctgaaaaggctttcaaatttcatgatagaatgccacccaacaaaatggctttccatatgggatacaaatgcaagtaggagatgtttgagggctgagggctgccaccatttttcaggggaaagcaacccagacagttgcatcttagagcttcccagtgggtacagaaggagaagggaggatgtttacggcaacctcagtagtgggacttgctgcaaagatttgttctaaagtttgcatgagacttgtcccagggacagtggcaacaacatctggggtaccccttcctctgtggctaaaagtggggaggaggaacgcattgttcattgagctctgtgaatgggtcaacaggaagagctgaataaatgggtactaagcactttcctggattatctctttctgtcttcacaaaaatcattagctataggcatgatcgtactcccaaattagacaaacaaactaggctaggaaagattagataactggcgccagatctcacagcctcaatgtggcagtgctgggattcaaatccaggctggtccaacttggcttcaactaatatatggcttttatggaagtcttagggaagttaactttcctcccagtgatagcctccatctcttggcaggcaggaggattttcctttaaagtacacaaattcccttcagtatgcctaaggcatcttttgggagtctggatccatccaaccattaagtccgctaagtgagtttgtcagtatcttcaccagtgttctcatatcctccttccttccttccttaaaattcagcaagtaaagactgtgatgtgtcagccaaactgatgtggcctggaacttttctgaaatctcaccaagacatttttatacggggactaatttcaggaggcactaattggaaagttctcaccgttcctagattcatccacctcgctttcctcctccaagtgctcagaagcggtgagaaagtcttcctcgattgaagataaggaacagttcgtgtcatcctccagtttcaagatgtttgtttccaggtggagctgtcgctcctgcaccagttccagaccaatcagaaatttgttgatttcaaagatgatgcagttggtactgtttggtctgttccctcttgcacattggaccaagcagatatctggcagccaagggcactaaaagtggagagaaaagaaggcatttattcaaaagggaaaataaaagactattgcctctgagctttccttttccaccaagctctcctgttaataggagtggggacctttaaaatatttgaaatgtcttctggaattatattaataaactgcttgaaaaaaattcaagtgatgtttggaacacaaggtacctaggagaaagcctgacttagggaaaaatagatcggctgtatcacatattttaatttcccttggtcaaagcaaaaattcaactgggtaaagttaaacaggcaaagaagatttttatttgaggctattaaaatagggaagagaggccagaattaagttggaccacaactccactgaaacaaaaggcaatagggtttttaagggctagagtgatgggggagatcataggtcatctgtgtttgataattggctttacccaaagaaacagtaaactttcttgtatctttatgacaggaggtagttttacaacctggagcaagatgcccagtgaagttaggttctcatgctcccataaagactggggactttaagggaactatcttccttgatgattacatttcaaagagacagctcccaggtccttgagaaagacatttctgggtataaagctggcaagaggcttttacaaaaggatttacatctcaaaaaggcacaggaggaatttacaattataaattttctagattaaatgctctaagaaaagggaagtcagggtctagagtcaggaaggagcctgtctaaattttggtcaagctgaagggaatgtcaacgctgtcttggttacctctcttgattaaattgagtcccagtttctcagatcagtatctttctctgccttgaagatactcagtaaaacctctactactagtacttcagatgtacagtaagtgttctatcaactacagttagattctataatttgtattgcttatctgaagaagcagtcaacatgaaattaaatgaaatccataggaagtgaactaattatctctaaaagaccagcgtatgggaaaaacagtgataaagaggcccaaattatagaatcatgtactagtcagacctgttaattctgttccgttctagggttacaaaccatatcctcattctccactacacattgtcactattcatattatttattgctcattggaatcgtaataaaaggttccaataattctaggagagatgattataaaatgaaaaattcaatccttctccaaggggtttaggaatcccctgggggctcaaaaataaaattcccctaaatgcatatgtgattaggtctatttttcaaagaaggtggtccattgccttgcttttctaagtgtgggtatggacctgcagccatggcatcaccagggagcttgttggaaatatttactctcaggcctcaacccagatctactcaatcagaatctgcatttccaatgaatctgttggagatgtgtacatgcattagcatttgagacccactggtccatagcttttattgaattcacaaagtatctgtgatcccccgaatggagaggaactgctgttgtagagtaagcagaagttggcttaattttctttccactgagtttagacacactacactaagctgaaacttacccagtattttccgagtgcctattgcatgcaaattatgcaaggaggtgcattttccgagtgcctattgtatgcaaattatgcaaggaggtgcaaaaatgaatcagacaattgctctggggagaagggcacactatactatcagtgagtcaacctcagcagagtccaagtgattcacacggagttgattcacttccagcgccaggggtgatcatgtgacttaagcctggccaatctgaataatgcattccttgggtcatagtgattggttcagaaatgggcatgtgacatatgagagccaataggatgcaatgagacttctgctgaaaaccacctggaaatgacgtcccattcactctttcccgacttgaacccaaaaagatattgcttccttgtgggaggagcttgtctgataatggggccaacggaaagaaaacaggaaagaggccacaagagaaaaatccatgtgttgatgacattgtttaagtctctaatctactcctggatttttctggttacatgaaacaatatgttctctttttgcttaagcttattttctgccatgttaaattaagaatcctaactgggattaatcagggtctagtaagttaaactcaaggtcaagtccaattaatgtcaataccaattttcatagagatattgaaagaaagctggaatttctcagtaatacctgtacttgccaaaagctaggaaaagtgttctataatgcagaggcagtttttttttttttttttttaaatctgtgaattctagaaagaaaacgggaataaaatcttcactctcaaagacataatgtacaattatttgacaagccacaaattacctaggattcatgtaaaacttataggacacaagccttgttagtagctacaaagtcagggagatgtgattacctggaaataaagcctcctcgtttattaattgatttatcacactgtattatgtttcttgaaatttggagacttttgggctttttgagattttgaagagttgaaggataaaagaagactttaaaaattgacagtgaaattaaaacccaaggaagaacaatttgtggaaaacaaatgctcatcattttaatctggagctgttacatatcactgtaatatactttatgtgtatttttcttgtaaattaattaattaaacaattttacttacatatctttaaataaataatgttatagtgatttatataataggaatgaacatgagtgcacggaatgataatagtagtattttagttactgtttatttttaataacgtttgttttggaggagggatattttatttattgggcccaagacactctctttccatccttgaagctgccatcctggatttactagcttggctagtttggtacctcctaaggaatacataacatctgaaagatgatattgtgggattctgaaatagaattttcatactgctcctaaaagagaagatgattctgtttttgtttatccagtagatttgtagaaaaccaagctaagtaaccaatgcctactctatctgctctagttcaaatacaacttaggaatttgagaagataatagaaattaggagttgatgtaagaaaagctctgtcaaactctaagtggctctatttaagagaaatacaaatgcagacttttctcaaatataaagacactttgattcctatgttacagaagcttatgtgtagcatctgtttggggtttacactgatctgtgctgagctaactatagatgtaagtaaatggcttatcaagaacttatgtcttacctgtgaaacttcaaaatctgcctggagatttccagaggctaacccacttaggacaacaatttcattttcttttggttgttggacattcatggaactgataagttttggaagatctggtgaaacgttgaccagtttctgtaaagcaagaatctttattagtttagctgatttcttttcaccaaatactactcacaaactactttaccttcagaaataatactcataactgctcatacatatagactgcttaatctaccaagattcttactagaagaaattttataaaatggaagcatgcaagtttagattgaaagagaaaatataagcttcaaaaactctttagttctacattttacaaaagtaaacattttacaaagtaaacataaagtaaacattatgatagtaattactatcataccacaggtataaacagtaacttggaaaaattttcccttttaagaccttgcataaaacattttttgttttaactaataatcttccgatatggcttggctctgtgtccccatccaaatctcatcttgtagctgctataattgccacgtgttgtgggagggacctggtgggagatgattggatcatgggggcgagtctctcctgcactgttcttgtgatagtgagtgggtctcatgagatctgatggttttaaaaagtgggaatttttctgcacaagctctctctttgcctgctgccatccacatgagatgtgacttgctcctccttgccttccatcatgattgtgaggcctccccagccaggtggaactgtaaatccaataaacctctttcttataagtccaataaacctctttcttatgtaaattgcccagtatcgggtatgtgtttatcagcatcctgaaaatggactaatacctcttcttttctaattgtgaataataataattataataaaattgtgactagcattgattttactctgtgtactaagcactatgctagagcctgtatatatgttaaatctgactacatttaatcttcacaataaccctacatggattaggtaccattattcctttcatgttatacacaagcagcctcaggaccaggcccagtaacttgcacagttcatatagctaaatcagtgccaaggtgtctgcatgctcttagccatagcagacaattatttcaaatcactcacgtaaactcttcaaacacactactcttagataccaacttgctttggccctccctgctctttgatggactctgcaccataattctatcaaatacaattgtatgtgtaatttcttttgaaaatcccatagtactacacatatgatgatatttggggctcggtgaaaatttgtaatcaattagctgtgtgggaaactgggtttgagaagcttgaagtgcagcattgtcaatatgggaataactgtcagtaaccgagtaattgcaggtctactgttctgtgaaaatcaagtggcaaatcgtgtgctgttatacattaaacagtattacaccaaatggtaaattcaaaccattgtcaggttttagcatggaatggcaaccttattacagcacttaattcttcccattgtatcagcaggctcttgttccagaggactgaatagatcttcaagtccttgcatactgtcaagcatttacatcagggccctcactgccttggatgcacttggagaattttagctgcaacaggatgcaaaaagttcaagccaagggtacaggtaaagcatttgatgaaagcagcaggaagaagcaaatctgagagacagaggggagggttggctggtatcagcaggttttggaaaattcttagaaaagtcatctacaaatagtcattttaaggcactgatgggcaagaggatgtgtgcctgtttggacagttctgcctacatgggagagcaagtttcacaaatgtaaaaagggcaaacggtagagggtaagtgctagggaaagggtcggggaaatggcctgtaatgaaactatctaactaaagagtctcctacaaaatgagcattatttacagatgaaatcaagttgaatagtccttgtaatgacctcccggtcagcttgagtttcaaatgttacctgttgcaggtgctctgtgctgcattcatccttgttcacatcaagattcacaaagcagacctgggaaaagagggcaaaaatagtacgttaaagtcaaaaacctgactgtctttttagaagaaagaaagcaggaatcagttggggcaaatgctttgggagtcttccacatcttagacagtttggcatagaaatagtcatttcagggcgggcgcagtggcttatggttgtaatcccagcactttaggaggccaaggcgggcagatcacgaggtcaggagatcgagaccatcctggccaacatggtgaaacactgtctctactaaaaatacaaaaattagctgggtgtgttggcacgcgcctgtagtcccagctactcgggaggctgaggcaggagaattgcttgaacccaggaggcggaggttgcagtgagccgaggtcatgcccactccagcctggcgacagtgtgagactgcatctgaaaaaaaaaaaaaaaagaaaaaagaaaaaaagaaatagtaatttcacttttgagcctccaaatagctctccaacaccctgctcagcttcccactggtcacaacaaatgcccgcttcctttcatggcccaacatactaaaaaagtctgcttgtattagagccaatagaacagttacaacaaaatcttcaagtttataaggtgttatcagatctcatgaaataggaaaaataactttttatgctctaagcctctgtttgtaattgcaataaatacttttctctattttctcctttcctcttctcatttttgctccttttctctacccacttttaatgtagtgcataataagccaggactcctctttgccacattgttttagttcattttactttatttaaccttgttatacaatttgcctctttgttagctatgttggataaatgtctgaatgggttagtctaaaaacaatagccataatattaaacaataaatctgaacaacagtgaaacattgttataaagtcatatgttgcataatgaacaacattttggtcaagaactgatcacatatacaacagtggtcctttaagattataataccgtatttttactgtttttaccttttctatgtttacatatgtttagatatacaaatacttaatgattgtgtttcagttgcctgtggtatttaggacagaaacatgctgtacaggtttatagcctaggagtaataggttataccatataacctacaggtacagtaagctatgtcatctagacttgtctaagtatagtctatgatgttcaaacagtgacaaaatcacctaatcatgcatttctcataacatgtccctaacagtaagtgactcatgcctgtaatttaaatcccaaatataccacatagttagaaaactactatgagcattcagatggggttggagaaaagaaagttaaagttttcaaagaggttagctatgtttttgaaagataaaaagacttttgttgggtagggaatgggtggggaccatcactagtgggttggacagacagcatgattaatactttgaggtgagaaagtgtaacgctgtcaagccacagggaataagagaatctgactgcaggcaggcctagaggaagggaagtgttggtaattaggtctagttaggtttgggctaaatgagaaaatgcaaatgaggttctctaatactttgctagcaatcatccaaaggtttttatttctaactagttgatttgatgttacaaaactgagaacattaattacctggaatttagttagacatttgaactttcagatgcctgcaaatatatggggctttctgatcttagttactttttgggatcatggtttcttagtccatcttttttctttttgaggttaaaaaaataatggaaaggttttgagaaagatcttaaaaactgaaatagaagtgtaaagatcactactgctttagtcccaaagaataggagatttcttcaagtttcatggactcacaagatccttgaagtgcaaccctaggatgcaccatctgcctgttaagaataacttgatgggcattagggggaagaaagggcatgaaaggacccacactcccattcagaagttctttttgctctgggttaataagatggaaaaataggaagaaattggcatgagtccctttgcagacagtgcaaatggaagcataaatagaagatggagctcagaagcagttcatgatctagggaagtttgataatattcatataataattgaaactttgcccttggaaaactagttcaatatccatcagtcctcagggacttttaataacatgcagctggcactggtggtattgaattgatgagaagattttccattcaccttaaagaaaggcccattaccttgctcctgggcatgacaaagcttttattatcatgcatcacagtggcagagggcaaagcagagatcagagagcaaagaaaggcctctatagtagcaatttgtctgccctccaacattttctttagttttctgaggatgaactctcttttcacccattttaggctactatatgaaactctacctacacctggaggacactctccacatttgctacctgaaccaagataaaaacaaagcaagacacaaaccaacttcttgcttatacttctcatgcacatcttgcaatatcttcatagtaggggatgatccaggcttcttaaggcctgatgtgcatgcaatgtggggaggccttctttaagaaatggaataacggccgcgtacggtggctcacgcctgtaatcccagcactttgggaggccaaggtgggcggatcaagaggtcaagagattgagactctcctggccaacgtggtgaaaccccgtctctactaaaaatacaaaaaacagccgggtgtggtggcgcacacctgtattcccagctactcaggaggctgaggcaggagaatcgcttgaagctgggaggcagaggttgcaagtgagccaagataacgccactgcactccagcctggcaacagagcaagataccatctcaaaaaaaaaaaaaaaaaaacaacaaaaaacaaaaaaaaaaaaataaaaaaattaaaatattctaaattaggtgtgagactgaatatttacttctttagaaggaaaaaaggaattacaagaaagctagaacttaaaagggctggcaaatactaaaaacataaaaactgccaggaatatgatatctaattgactgcccaatgcacctccataatatttttttttttttacatttttgactaactactctttggtcacctcttcatgtgaaagcaatattgaaatattgtcttctctagagaaactagaaaaataagctagttttcctctgacatggttgactgattttttaacttccagatttttattgaaaatatgttttacgagggtggagccaagatggccgaataggaacagctctggtctacagctcccagtgtgagcgatgcagaagatgggtgatttctgcatttctatctgaggtaccaggctcatctcactagggagtgccagagagtggatgcagcgcaccgtgcatgagccaaaggagggcgaggtgttgcctcacttgggaagagcaaggggtcagggagttccctttcctagtcaaagaaaggggtgacagacggcacctggaaaattgggtcactcccaccctaatactgtgcttttccaacgggcttaaaaaacagcacaccaggagattatatcccgcacctggctcagagggtcctacgcccatggagtctccctgattgctagcacagcagtctgagatcaaactgcaaggcagcagcgaggctgggggaggggtgttggccattgcccaggcttgattaggcaaacaaaaatgccaggaagctcgatctgggtggagcccaccacagctcaaggaggcctgcctgcctctgtaggctccacctctgggggcagggcacagacaaacaaaaagacagcagtaacctctgcagacttaaatgtccctgtctgacagctttgaagagagtagtggttctcccagcacgcagctggagatctgagaatgggcagactgcctccttaagcgggtccttgacccccgagcagcctaactcggaggcaccccccagtaggagcagactgacacctcacacggccagatactcctctgagacaaaacttctagaagaacgatcaggcagcagcatttgcagttcaccaagatctgctgttctacagccaccgctgttctgtagccaccgctgctgataccaagacaaacatggtctggaatggacctctagcaaactccaacagacctgcagctgagggtcctgtctgctagaaggaaaactaacgaacagaaaggacatccacaccaaaaacccttctgtacatcaccattatcaaagaccaaaagtagataaagccacaaagatggggaaaaaacagcagaaaaactggaaactctaaaaagcagagcgcctctcctcctccaaaggaacgcagctcctcaccagcaacggaacaaagctggacggagaatgactttgatgagctgagagaagaagtcttcagacgatcaaactactccgaactacaggaggaaattcaaaccaatggcaaagaagttaaaaactttgaaaaaaaattagatgaatggataactagaataaccaacgcagagaagtccttaaaggagctgatggagctgaaagccaaggctcgagaactacatgaaggatacagaagcctaaggagctgatgcgatcaactggaagaaagggtatcattgatggaagatgaaatgaatgaaatgaagcgagaagggaagattagagaaaaaagaattaaaaaaacgaacaaagcctccaagaaatatggcattatgtgaaaagaccaaatctacgtctgattgctgtacctgaaactgacggggagaatggaaccaagttggaaaacactctgcaggatgttatccaggagaacttccccaatctagcaaggcaggcaaacattcagatccaggaaatacagagaacgccacaaagatactcctcgagaagagcaactccaagataattgtcagattcaccaaagttgaaatgaaggaaaaaatgttaagggcagccagagagaaaggtcgggttacccacaaagggaagcccatcagactaacagctgatctcttggcagaaactctacaagccagaaaagagtagggaccaatattcaacattcttaaagaaaagaattttcaacccagaatttcatatccagccaaactaagcttcataagtgaaggagaaataaaatactttacagacaagcaaatactgagagattttgtcaccaccaggcctgccctacaagagctcctgaaggaagcactaaacatggaaaggaacaaccggtacctgccactccaaaaacatgccaaaatgtaaagaccatcgaggctaggaagaaaactgcatcaactaacgagcaaaataaccagctaacatcatgatgacaggaccatatacacacataacaatattaactttaaatgtaaatgggctaaatgctcaaattaaaagacacagactggcaaattggataaagagtcaagacccatcagtgtgctgtattcaggaaacccatctcacgtgcagagacacacataggctcaaaataaagggatggaggaagatctaccaagcaaatggaaaacaaaaaaaggcaggggttgcaatcctagtctctgataaaacagactttaaactaacaaagatcaaaagagacaaagaaggccattacataatggtaaagggatcaattcaacaagaatagctaactatcctaaatatatatgcacccaatacaggagcaccaagattcataaagcaagtccttagtgacctacaaagaaacttagattcccatacaataataacgggagagtttaacaccccactgtcaacattggacagatcaacgagacagaaagttaacaaggatacccaggaattgaactcatctctgcagcaagcagacctaatagacatctagagaagtctccaccccaaatcaatagaatatacattgttttcagcaccacaccacacctattccaaaattgaccatatagttggaagtaaagcattcctcagcaaatgtaaaagaacagaaattataacaaactttctctcagaccacagtgcaattaaactagaactcaggactaagaaactcactcaaaaccactcaactacatggaaactgaacaacctgctcctgaatgactactggatacataacgaaatgaaggcagaaataaagatgttctttgaaaccaatgagaacaaagacacaacataccagaatctctgggacacattcaaagaagtatgtagagggaaatttataccactaaatgcccacaagagaaagcaggaaaaatccaaaatcgacaccctaacgtcacaattaaaagaactagaaaagcaagagcaaacactttcaaaaactagcagaaggcaagaaataactacaatcagagcagaactgaaggaaatagagacacaaaaaatccttcaaaaaattaatgaatccaggagctggttttttgaaaagatcaacaaaattgatagaccgctagcaagactaataaagaagaaaagagagaagaatcaaatagatgcaataaaaaatgataaaggtgatatcaccactgatcccacagaaatacaaactaccatcagagaatactacaaacacctctacgcaaataaactagaaaatctagaagaaatggataaattcctcgacatatacaccctcccaagactaaaccaggaagaagttgaatctctgagtagagcaataacaggctctgaaattgtggcaataatcaatagcttaccaaccaaaagaagtccaggaccagatggattcacagccgaattctaccagaggtacaaggaggaactggtaccattccttctgaaactattccaatcagtagaaaaagagggaatcctccctaactcattttatgaggccagcatcatcctgataccaaagcctgacagagatacaaccaaaaaagagaattttagaccaatatccttgatgaacattgatgcaaaaatcctcaataaaatattggcaaaccgaatccagcagcacatcaaaaagcttatccaccatgatcaagtgggcttcatccctgggatgcaaggctggttcaacatatgcaaatcaatgaacataatccagcatataaacagaaccaaagatgaaaactacatgattatcttaatagatgcagaaaaggctttcgacaaaattcaacaacgcttcatgctaaaaactctcaataaattaggtattgatgggacatatctcaaaataatgagagctatctatgacaaacccacagccaatatcattccggatgggcaaaaactggaagcattccctttgaaaactggcacaagagagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaaatcatgagtgaactcccattcacaactgcttcaaagagaataaaatacctaggaatccaacttacaagggatgtgaaggacctcttcaaggagaactacaaaccactgctcaaggaaataaaagaaaatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaacaaaaaaagagcctgtatcgccaagtcaatcctaagccaaaggaacaaagctggaggcatcacactgcctgacttcaaactttactacaaggctacagtaaccaaaacagcatggcactggtaccaaaacagagatatagatcaatggaacagaacagagccctcagaaataatgccacatatctacaaccatctgatctttgacaaacctgacaaaaacaagcaatggggaaaggattccctatttaataaatggtgctgggaaaactggctggccatatgtagatagctgaaactggatcccttccttatgccctatacaaaaattaattcaagatggattaaagacttacatgttagacctaaaaccataaaaaccctagaagaaaacctaggcaataccattcaggacataggcatgggcaaggacttcatgtctaaaacaccaaaggcaatggcaacaaaagccaaaattgacaaaggggatctaattaaactaaagagcttctgcacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccatcaaaaagtgggcaaaggatatgaacagacacttctcaaaagaagacatttatgcagccaaaaaacacatgaaaaaatgctcctcatcactggccatcagagaaatgcaaagcaaaaccacgatgagataccatctcacaccagttagaatggcaatcattaaaaagtcaggaaacaacaggtgctggagaggatgtggagaaataggaacacttttacactgttggtggcactgtaaactagttcaaccattgtggaagacagtgtgtccattcctcagggatctagaactagaaataccatttgactcagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacacggatgaagctggaaaccatcattttccgaaaactatcgcaaggacaaaaaaccagacactgcatgttctcactcataggtgggaattgaaccatgagaacacatgggcacaggaaggggaacatcacactctggggcctgttgtggggtgggaggaggggggagggatagcattaggacatatacctaatgctaagtgacgagttaatgggtgcagcacaccaacatggcacctgtatacatatgtaacaaacctgcacattgtgcgcatgtaccctaaaacttaaagtataataataaataaataaatagataaaatatttttcagcttattgtcaaaatcagtgggaaactactgtacagtttctttcatatatgagttgttataggcatactcactctttttagtacctttacagttttgtactctaaagacataatttggattgattctctttggtgtgatttccatgaaaaaaaatgcatcatgcatttctgattttcaatgctgtactatcaaatgaatgcccacaaggagaaaatttctggttgactgggcatcaaagaggacccaatcttgcacttaagttttacatgtctgatgattggaagaattttacacagaatagcttctgatatgtaaaccttgtttcctctcactgcctacatatttttgtattggaaactgtaggatatgctcacaccatccctgacctggcacattcatgttgcaatgtctgcttgagttaccactcttgatggtagaagcattcctggaagtcattcctatatgtggatggctagcaatcacttaactatatacgaaagtgacctgaagctacataaatatatctcatgtaaacagaacccccctcaatttcccttaagccagagcccaataacacctgtggtcactccaatgactctcagtttgcggggagataagaggtagtaggagtcgaaatggaaagagataagcatagttaaaatatcttactttgaatattttacaaaaacacataaccatgtgaatacattgataggccctgtcccaagggccttgaaactggggcctatgcacattaacagccctgaaacctaaattttggtagttttacagtaaatccacttcttgatgaaatagacaatgtgactggattgctcttagcaagttttcaatctctacaagtttgggctattaattgagatttaagcaaccactaatgctgaagtccaagtagagaatacaggaccagcctctgtctagtagagctggggagtggtgagcctggattaggaggctttgatgaggagactgaacgtttgatgaggagatcgaatgtcttcaaagtgcttggtgtcaatgctgggtgctgagaagacaaacaatacaaggcattgtttttgctcttgggagttatgatctgtctgaaggcaggacatgtccttaaagtgacagaaacatcatgggccacgtgtgctggagaagggagttgggagaactggatcaatcatgaatggtatccaggagaaggctgaatttgaggtgagcttggaggtcaggggacatgtttacagtgttattacaggaggaaacttttggtagtgggaagctgaaataaagtttttatttttttttgcaggggcagttagggtgaatgttatgtgtgactaaaatgataaaacctggaagattctgcattacggttgcatgagctggagagaaacctgtcagtggggaggctagggctgcatgctggagccaccagccaatggagaacaaggcataattactgtgctcttattgcattctctgtaaaatgcctgcatgagcaaatccaaatatgccaaatgacctaggaaaggatttttttaagtatgtatttttacataattatccttttttcttgaacatagaagtagtggattttcctgcagtcttcacatcctgttagttcatgagggcaggccctgtccatcactggattcccagtgctcagcatggtgccaggcatctggcagatgctcaataaattctcgttggtgagtgcaggtgacaggtgtacaagaaagggacatttgtaataatcatttcccttatttatagaatgaattccaatgaatgtagtcaataaacagttttcttcccataaaggtacagggaatacgtacagaagctacaggagaattaaatgagctaataaaccagctattggctaccatttccagtacttagattggcttcgttttctcacaaagaagcatttgctaaaaaacagacaaagacaaaatgttgagaatcataattggtaataaagacccataaaaggtgctaacatttttcttggaatggcagctcctttctcttcacataaaatacatttcttttgtgtgtttgtgcacgtgtccttactgagaccatctgcagacatacttagctgaagcagatggaaacacacatcatcccgaaagaacacgagcacttcttctcttgcttcctgaacagagctaatcttgtggttgtactccaccttttacactctaatgctgctcttctatcactattatggtttttaaacaaaacattgcaggaataaatgtcactgagaagatgatgccaccttatgattttgactttaataaaatattcctcacaactacttacatacaataaaatttgaatgtctataggaaatacacagttttttttagtattatgggttattagccaagtaatcacagtgattactcttatttatgactctcttttcataaatgaagttccatgtaggcatttgtaaaactaaaattttgttgtgaaattttattaactagtgatataaaatatatttttgtgaaaagctaatgtgaggaagaggatgacatgaaaatctagtattcaatacaaaacacagtcatttttaagtgaattgtaattcacagcaacttttgcgaggcaactgtattttctaaacagttttattttgacagataaagtcagacaaaatcagtgcttttatataagataaaaatgagtttgactttttgaattaaacacatagaaagaactgatgatgacaattgttgggatcaaatccatatcataagtgcagttttatgttttcatgtattaattttagtcaacattttagactattctgatagtgaaatgcaaccatcaagaaatgtcattgtattctgcgtccactagggggaaatcactgtgcaaggggtcagatgacagcagggttttagcctaggaggtgagccctttgatttcctctgcttgattttttttcatttttcctaaagttagctaacatctactaagaaaactttttcagaaaatattaaccaaaagcatgatgtcaaattgccttaaaatctaggcatttgaatgttgaatatgaccaaatatttactaacagtttttcttagaagaaaaccaattccttctttgagcagcttctaacaatgcagccatctggccatgtgggatatgacagcatctcttaatttgatggcatcaaaatgctgattcacaaagcgtctaaagaaaacattgcctcctttctttttctaaccaaaaggcttctgttagattcaggaccctggaccaaaattaccttctaaagaatatgacattttctgcctagtactgtaggcaattttttcatcaacggtgttatgccacccatgctgtggacattccggaatacattcgactgtttgagaaaatgttgcatttatatccagtcattgctttgaagtgattgcaacaattacacaaaatgaaatataaagttttatttacatttaagactgtccagcttctctttttttattgtcagcattaaaaataattttgaactgcaattctgggggaagctcttcaagcagtttgtgataagagatacagtaaaaggagtacaaatatctaaaatactagagatcttttaactaaacctacctgaagccaattgtattgacagcttaaaaaataaaattaaaaaaataagtatgcactcaagataattgtctattttgccataaaaatttagtgttattgtcttagacatttcatttgaatcgaggatacacttatatgtaatgtctgatgtacatttactagatatgtaacacattatatttattttagatttccattttaaagaactgctagtagcaagtgtttccttcctgaaagtaggccctaagtaattatgtggactagaagaaaactaaagaatcagtagaaaaatgtgtttctacatttcacctgcttggaaaaatgtgctctgggctatataaaaataaagcggtaatagaaaattaacatattaaaaatacacaataccataagatgttttcctatatgattttttaggaatagctttcttgtgttttatcagccactggcagtttctctagtgtgactattctctgttttccatcaatcagcaattttttgttgaattccactacatgctaacactagactctaagtttaaggcagatattccaggcactaatttttttctcggggctaaacatttttacctccaagggctcttaggaaagttaaatcaggattctccaagtatttgttcagaagacagttctgggctgggcacagtggctcacacctgtagtcccagcactttgggaggccgaggcaggtgcatcacaggaattcaggagttcaagaccagcctggccaacatggcgaaaccctgtctctactaaaaatacaaaaattagccaggcgtggtggtgcgtgcctgtagtccagctactcaggaggctgaggcaggagaatcgcttgaacccaggaggcggaggaggttgcagtgagcagagatcgtgtcactgctctccagcctgggtgacagagtcagactctgtctcaaaaaaaaaaaaaaaaaaagaaaaaagaaaacagttctacattctctgaaatcttatgatcactagagggtataaccttgtcttagagtaactgtattactctatgtaatacagtgcagatttgctgaatgaatctaggtggtcatgtggagcggaggacactggccgtgggaggggatgtgcagactctggctctgctctcagctcctatgctgttgtgaggaaaggagatgggagccatgtcctgtgggttgtgaattgtcaggtgagtcttagaaacagagcagctaatcatctttactagtcggcagtcttaaggccgaaccataactatgaggactactcttgtttcctggaaaagggagaagaaagtgaaagtggaaattaaagggcccaagtaggagagagcagaagaaaaagaaacaaacaaacaagaacaacataaaaacaagcaatcgtgcaaacaaacaaacaaccaatggagcatcacaggtactggcttactcctggaaggagctgcatttaggtctgaagaccaatgggctctgtgagtaggagcacttaacctgcctgcatggcacatcagaatcatctggacggagttcttacacttgtatgttcctgcgctctgaaccacaactatttaatcaaaatctcgggttggggcctgaggatatttactcaattatttatcaattcttactattattatatatttattttttaaagataatggctttattcagatctaatttacataccatatgacgtatccatttaaagtgtgtgattcaataacttttagtatagtcatcatttctaaaagaagctatatccattagcagtcattcaccatttccccaaaatacccttttcccagccctaggcaactattaatctactttatatttctatagatttgtttgttctggaaatttaatataaatagaataatatgtagttttttggtgactgagatagaatatttataaagaaccgtcatttctgagaacataaaacaattaaaatttggctccttgcctgtaattattttttctgccacccaatttctatttacttggcgtaagtatttatttctgtttaattatataaatgttatctactgacctaagacattaaattgccttttctaaacctttattacttatgtataagaaccaaatgttattttgtttttcagggctatggaacatttaattaagaaaagacttccatcttgttcccagaggtgtttatgacttaatggatataaatgggtgccagcattatgggtgctgcctgttatcatgtattataataccagggaatgattgcaagagatgcgcaataggtatccaactacatacatgaaattacaaaaagactgcaatttaaaacggaaatatagacatgttaaaaatatcaaccatttcctagtcattattgctgattaaatttcaaaaatgaataatgctgagagaacttatagacctgcagacaacagatcctttattattagagaaaaaaatattggatcagaatgagcaaatgccagcttgtatgtacagatcaaacccgtgaatccaaggcataatttcaatttctcaacacaatgtatgaaaggatatataggctagctttaatttaaacatttaaaagagttagttgaggatgcactttttcgtttccttttgttttgagatggagtctcgctttgtcgcccaggctggagtgcagtggcacgatctcggcttactgcaacctctgccttccaagttcaagcaattctcatgcctcagcctcccgagtagctgggactacaggcacgtgccaccatgcctggctaatttttgtatttttagtagagacagggtttcaccatgttggtcaggctagtcttgaactcctgacctcaagtgatccgcccatcttggcctcccaaagtgctgggattacgggtgtgagccactgcacttggccaaggatgtagttttcattgatgttaaaaagctaatcaaataattgacaaaaatcttcctcaggtacaatgagacaacctaactttgactatggtgtaagaaaaagtgccacagacgtgataaattgaacataatattgcatgctttacaattttgtagaattttatgttttaactcttccactaagcttccattaaagacttttttcacctttaaagtaataaaacataataacatctagtggttgctttctcccttttctgaaagtcatacacatttgcacagagaaaatatgaaaaaagaaaaggtagaaagtcatgtttgtaatctgaacagctcaattattttagaatagataaaagataatttatatacttagaatcatggtgaataagtgatagtgaacttaatttaaaaatacaaatagtttatctaaaccaaacatctaacattcatctctcatatgtttgacaaccaaactactaaataactccaaacttaacctctccaagaagcctcaggtataattgagcaaacactttgtacatctttaataattaagcatgctgcaatctcattggtataggtaaaatttattaaaaatcccaacaactcaaagcaatgactaaaggcacaacttgagtgactctacatagggaagtagaaaaatatttagaggatttagtcctaaaatatagttgcaaatgcaggagaggtgcttctttttttaacggaattatccagattgaatatctatattaataaaagacatcaagtggttcttagtttcacgggtactctaagaaccactctatttggcctgctccaggtctgcatatgaaaactttagcccaaggcatgtatctgaattactatccctatagattggatgctttaggaactcattaatttaaatcttctaacagactgccaagtgttgagaggtaactcacttttcaaaaaaaatgaccattaaattcaagcctttgaaaaatggaattctgcaaactatagttgacacataatgaataaatacatagaaaaagtaattggagaaaaacaaaacaaaatacaagagggaacatctattacagtgagtaggataacaactagtttttcatatttgtttcctttgacaatgatgctaattagttactaaaatagaatctggagagtgaacaggcaatctacagaatgggagaaaattttggcaacctacttatctgacaaagggctaatatccaaaatctacaatgaactcaaacaaatttacaagaaaataacaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacgatgagataccatctcacaccagttagaatggcaatcattaaaaagtcaggaaacaacaggtgctggagaggatgtggagaaataggaacacttttacactgttggtgggactgtaaactagttcaaccattgtggaaggcagtgtggcgattcctcagggatctagaactagaaataccatttgacccagccatcccattactgggtatatacccaaaggattataaatcatgctgctataaagacacatgcacacgtatgtttattgcagcactattcactatagcaaagacttggaaccaacacaaatgtccaacaatgatagactggattaagaaaatgtggcacatgtacaccatggaatactatgcagccataaaaaatgaagagttcatgtcctttgtagggacatggatgaagctggaaaccatcattctcagcaaactatcgcaaggacaaaaaaccaaacaccacatgttctcactcataggtgggaattgaacaatgagaacacatggacacacgaaggggaacatcacacagcggggactgttgcgggattgggggagcggggagggatagcattaggagatatacctaatgctaaatgacgagttaatgggtgcagcacaccagcatggcacatatatacatatgtaacaaacctgcacattgtgcacacgtaccctaaaacttaaagtataataataataaaaaaaagaaaaaaaatagaatctggaggacattatgctagatgaaataagccaggcacgaaaagataagtactgtattaactcatttatacgtgaaatctaaaaaagccaaactcacagaagcagagagtagaatggtgattgcatggggctgggggatgagaaaaatggggagaaattggtcaaagggaataaactttcagttttaagatgaatcagttctggagatctaatgtacagcatggtgactatacttaattgtactatattgtttacttgaattttgataaagagcagattttaactgccttcatcccaccccctacacacacacacacatacggtaattatgggtggtgatggctgtgataattagattacagtaatcagtacacaatgtatacataggtcaaatcaaggtgtataccctgaatatatgcaatttttgtttgttcattaaatatttcaaagtaaactaaaacaataaaaatccgtgtttcaaaacattttctgcatgctgaatactgttgttattctttttttttttttttttttttggtctctgttggtaaaaacgatgtatatcctgatttctgtgttcttcatctaatttactcccttgaacttcacttgttttaggcaatgacttttaggaaaatggcctttacgatgcaagcagtagcttaagcgagctcagggtgctaagttgtggtgaataaattttgcacttaaattccagttgtggaaccaagtattaaaaataaataggtgattcaaaaagcttgccaacacttcatattctttaatgctaccaaaaatcattgacagctacaggatagggaactgagttttttgtttgtttctttcatatttcaatgtttctgactttattccctgaagcactcattaatctggctttagtatattcagaaaacaacaacaacaaaaagaataaagaaaaattctttgtaatatcattctattttcctgtctgagactgagaattccaggaggtaattgaaggatatgtgaaccctctattcagggccttcagaaaagcctcaaaaagacccccctccttgggcaagaagagacaacactatctgggcaagggcagctgagcattgaagtttatccttttggcattccccaacctcattatgattccacatgttaacttctagttaacattttcccacttgaaagcagaataaaagcataaaaaatattcttgggcttcaaatagctcttgccaaatacatttttaaatttcagtatcagtacctgaatgagataacaaacaaaagtggaataactctccaaaatataagtgagtatatgtaggaaaatgtgtttcttgtatttttatttcaacataaaatcacagaatttgacaacaagaagttactttaaaaattacctggttcaggccaggtgcagtggctaatgcctgtaatttcagcactttgggaggccgaagtgagcagatcacttgaggtcaggagttcgagatcagcctggccaacactgcgaaaccccatctctgctaaaaatacaaaaattagctgggtgtggtggcaggtgcctgtaatcccagctacttgggaggctgaggcacaagaatcacttgaacccgggaggcggaggttgtagtgagccgagattgcaccattgcactccagcctgggcaacaagagcaaaactccatctcaaaaaaaaaaaaaaaacaaaaaacaacctggttcaactctctcatgttatctgtaaagaaactgaattacagataagttaagcaaaacatgccaagccccacagctacttcattcattaatttgtgtccattcattcattcattcattcactttactcactcacttatccctttaaagaacacttaaggacagcccctctgtgctcgcagagctaggtgtggtatgcagtgatgagatgaacgagatggtcatggttccttgcagtttggtgggctaaactagtctaactgtttgatgatctgaaacttgaaatcagacagctgtaaatgaagacagactccagtgagtgctacaacagaggtacaaactaaaaattgatactgaagtctggacaaaagaaaatgggtgtgctctaagatatggaaattcagaaagaccagctggggttttgaatgagttaatctaggattcaacgtggaaaggagagtacactgggagagaaagttggtaggtgaagagtccattgtcttgataagattctgtgctttccgttttaaatactggggagtgacagaagatttacttctaaagacaacgaggaggagaaaaaagttgtatcttatttttgcctaattgtccgctggggctgaaggggacaccatgctccttgaaatcccttttgattacctttaattcatcagttcgctgccacgaaattggagcaccctcaaaagatttccacaaggttagcttgcttacaggagatcaaccctgacgtaaaactcagtcacttctttggtttacatagaaaaataaatcattcatttcaagtctttgagtttagcaggttatctgaataccttttggtgaaacgggggggtggagatgggtggggggtatttacctatttaccattacccttttcctctttaatctttcaactccacctcatctctcacctactccctcctggctagtccttgacctctaaattctcttctctttatcatgtagaactgtttctttgctgaagtacagtcatacacctcataatgacatttctatcaatgacagaacgcatatatgactgttcccataaaattataatactgtacttttactgtaatttttttaatgttcaggtatctctagactcacaaatacttaccattgtgttacaattgccaacagtattcagaacagtaacctgctgtacaggtttgtagccgagaagcaatgggctacagcatatggcctaggtgtgtagtaggctatgaggattagtaatgttgttcatttcttcatatgtctgtgggccacttgtatgtgttttttgagaagtgtctgttcatatcctttgccctctttttattggggttgttttttcttgttgaggtgttgcagtttcttatagatgtgtgtaagcgcactctatgtttgcagaatgacaaaatcacctaatgactcaattctcaggatgcattcctgtctataagcaacacgcgattgcactgacaccaacctagaccgggaaagggagtgtgggacggtgcttgagagcccagctccaatcccagctctgctcctattgattgtgtaaattatgcaaccactaggaggctccatatccttgcccataaaatggggaaaacaacagtacctatctcaggatttttggaagggtttaaacacatacagcttacaaagtctaaaacacaggaagtgctcaatgaatacttttgttgtgttactgttacttctccaaacacttatcaatgtatgtttaaacataattacctttaaaaaatctgtgctatttaaaatcttttaaataactatgtaagtaatacacatgcacagtttgcctcttaatgaaaaatatctgccttctgccccacattttctaaagtgtgattcccttcccaaactaacttctctttcttccagtatactgttgtttattgatcacaaatgtgagacattgctgcattataaagaatgaggtttttagcacttcaaattatttatgtattatttacaataattttggcttttatttcagatttaaggagtgcatgtgcacctgggcttactgcatgacactaaggtttggggtatgaatcttatcacccagctagtgagcataagacctaataggtagctttgtgagcccttggactcccacctctcttcctgctctagcagtccccagatcttcccattttttatgtccatatgtacccaatgtttagctcttacttgtaagtgagaacaagtggtatttggttttatgttcctgccttaattcacataggataatgacctccagttgcacccatgttgctgcaaaaatataatttcattgtttttttatggctgcatagcattccatggtatatatgtaccacattttctttatccagggtaaacagaaaacctacagaatgggagaaaatcttcacaaactccaacatccaacaaaggtctgatattcaatatctataagaaactgcaataactcaacaagaaaaaacaaataaccccattaaaaagtgggcaaaggatatgaacagacacttcttaaaaaaacacgtacaagtggcccacaaacatatgaagaaatgatcaacattactaattctcacagacatgcaaatcaaaaccacaatgagataccatctcacatcagtcagaatagctattattaaaaggccaaaaaatagcagatgtcagggcttgaaggaaaggaacacttagaaactgttgatgggaaaaatacattaattcagccactgtgaaaagcagtttggaggtttctcaaataatttaaaactaccattcaacccagcaatcccattgctgagtataaacccaaaggaaaataagtcattctgccacaaagacacatgcacttgaatgttcacagcagcactattcacaatatttcctttacctacaatttgttcttaccgatttaatttttaccatatgcggatggaatcaccctaggtgctcatcaatggtggatttgttaaaaatttatttttactgatacatattagatgtacctgtgtttagggtacatgtgataatttgatacattcacataattaaatcaaagtaactgaaatatctatcaccttcaatatttatattttgtttatgctagaaacatttgaattcttttcctctagcgattttgaagtgtagaattgattaatgttaactctagtcaccctactgatctattgaacaccaggtcttatttcttctatctaagtgatctaagtgtataattttacttattaatcagccttttatattcccccactccacctttatttatttatttattttgagacagggtctgactctgttgcccaggctggagtgctgtggtataatcttggctcactgcagcctcaacttcctgggctcaggtggtcctcccaccttagcctcctcagtagctgggactacaggtgccaccaacacaccaggctaatttttgtatattttgtagagacagggttttgctatgttgtccaggctggttttgaactcctgggcccaagcaatcctccacctcggcctcccaaagtgctgggattataggtatgagccactgcacctggccacccactccactttctctacctcttctcagaattgttatatcacaattttgggcaaatgaatatttagtgtttgccttgttgtgatcaggtaattattgttcagtagggactacattgtatattgtaatatttcctttacctaaaacttgtttttattgatttaatttttgccttatgcagcagattgacttattgttcattcaatattcattcttttctatatccataggaaaaaatctacttttctgccccttaactttgagtttggctgcatgacttgctttggctaaggggatgttaatcaatgaaatgcaagcaagaatttgaaatatgcctgtgtggtggacttgtcctctttgtgcttatgcctgccattgccctgataagaacgtgctctgaggctagaccactggttcaagtggggttgaaagacacacagaacacccagatccagaaacgcctgcctagcctaggtaagctgctcccctgaccccactgtaaaacaacctgaagacccaggtgaagtacactgctgtctactgctattattagaactcaatggttgattcttgtcttagtctgttcaggctgctataacacaataccttacactggaaaatatttaaataaaacaaatatatttctcagagttctgaaggttgggaagtccaaaatcaggacactggcagatttcctgtctggcgagggcctggtcctcataaatgccttcttgcttcatcctcacctactcacctagcagctcccttaggcctcttttgtactggcacaaatcctattgatgagagttcagccttcatgacctaatcaacccccaaacgccccaccttctatctccactgccctggagatcattttgacatatgaattttggagtgacacaaacatttagaccataccaattctagcccaacaaaagcgagctccaataagtatttttctctattttctgtttcaatataataaaaggtggtgtggatttgaagattatgagagccaaaaatgtaaaatttaattgaagtattggaagataaagtcaagggggattttccagaaagaacaaaaagaaaaaaaaaagaggaaataataaaaaatctaaagcccaattcaagaaatccaacatccaatctattttctactggcaatggtagagttagaacattggaaatagaggggacagaatgaataaaacataagaaaatatttcagatctgaaaagttttgcttaaaagagctcacaaaataggccaatgctaattcttagcatcatgaaattctagaataccagggataaagagaggattatcatggcttccagtttaaacaacagccacacaaacaaacaaaaagaatcagaacaatataacactgttcaatagcagtgctggaagccaaaagacatcagagcaatatcattgaattttgagtaaaataattttttttgcaacctggaagtctatacgagtcaacctatcaatcaaaagtgagggttagaatgagactcttttcaaataagcaatacctaaagctgtctcccatccacactttttaagaatgataaacattctagatatttctttatttgtggagaggttacttttttccctaaaactttttctctttctttctttggagtcttgatgttttgttttattccttttatgttagagagtttaaaaactctgtcctttgttatacatttatatttaagaatgatgaacagatttgaggcccctgagtggtgcttgttaactaatggatttctctctaggttgattggaagggacccagtcatatccttagaagacttcttactatagtctgtatagtaagagctaatctgttcaggctgccatacaaaatataatatattagatgagcggcttaagcaatagaaatttattttctcattgttgtggaggctagatgtcctagatcagggtgcctgctgacttgattcctgctgaaggctctctttctgactcgtagacagccatcttcttgctgtgttatcacctggtggaaagagagctcttatctctcttccccctggtgtctcttcttcttttcataagggcaatctccctataaaatcaggaccccattctcataacctcatttaacctttatcaccacccaaagcccctatctctgtacttgatcttagacaaaaagctgagaagcaataggccctatttccaaatacagtcatgctgagattagggctttagcatattaatttcacaggaatgcaagcattcagtctacaatgtataggttgtacttcctgcaacaaatctgtttgtccagagaggaattctttaatttattgcctgggcatgtgtgttaaaatctggcttacagcattcttggatcttggtggtacacaggggctggggggagtgtcttagtggatagattttcacttaaactcatttttcaggcctataatttcccctacctttctctggatgctggccagcattactatggaataaacctttagtccctctgatttattgaaaaactactggttgagtcctggttatgtgcctgctacttcactaagtctaaaacctattttcaaattattagttatttcctggatttttagatgtgaaatgacttggcatttccctctgaagtcttgtaatgtatttagcattcttatctgtgctacaatacatttggtttccattttctgaaaatttcacatctctcatccattgtcccattttctttgtcctttgtggttttatacattgtttgttctactttaagtgtggtttcaggagggaacagagataaattaatgtatttaatcacctatgtttagtgcattgcttcaaacatttctttccatcaaagacaagatttcttcagaatgtaattctggtgccagctcttaagctaatacatttttcctcatttattgcattgaaatgattgtcttggcagtgatggggaaaaagagtacaaaggaaatcattggatataggcagtagaagtggccaaggtaatacaatagaagagagtaagcagacctttcagagacaacgtggagaggatttgattatcacatggtgagagaaaggaaggagtggtcaaaaagttctatgcatttggaaaaatcctgaattgtttcgataataatatttccctttagataaagtgcatatgagggtgagaatagggtattttctctggtgggagaatcatgtagatgacaatggaagagcaaaatttaagaaaatggtagggtttgggcaagagacattgcaatgggttgaggattgccaggagaaagtgtagaatggtatagaatagaagtatagaataacattttgagaagtttggcaataaatcacttaattacagacttgcaatcagataattttagggagtcaataatttagttgtcctcaactggggaagggaagagaggagattcagaattctccagggagattcataaaatacacacgtttggttcactaacctccacaatcagaatttctaaaagtgggacttgggcatgagagcaccttggaaaaggtcccaggtgactctgatgtgtatttggagttaagagcttatctgctgatagaaaagcaaatggaggctttgaactattaaatgtcttgcccaagactcattgagtgtggggagagttgggacggttaattagtatactgacgtcttacctaccattctattctagatggagtgaaaacttatgatataaaaagtggtttgcctgtaatctcagcactttgggaggctgggcaggaagatggcctgaggtcaggagttcgagaccaacctggctaacatggtgaaaccccatttctactaaaaataccaaaaaattagccaggcatggtgttgcatgcctgtaatcccagctactcaggaggctgaggcaggagaatcacttgaacctgggaggcagaggttgcagtgagctgagatcatgccattgtactccagcttgggcaaaaagagtgaaactccactccaaaaaaaaaaaaaaaaagtggtttgaaagattgtaggatcaagggacagatagaagatgattgaagataaagcaaatttaagcctatttgtttcctagaatgaccatgtcaatgaggagagagaaatggagaagataagaaaggggataaataaatggtagagtaataagagtaacagataatgagcatattaaaactaaatggaaaacaaagcaaaatgatagtatgagtatgaaatgccaagtaattaacagcatcaccaccttttcccccctcactggggaaggttcattcccaggtccttggttcatgccattacttcccttatatctgtagaggaagccctaagcaatgaagtgtctggtgggggagactccaaaaactaactgctgcttctggcaccttggagattcttgctcctccctgcattcaccatgactatagaaagtattaacagtgatgacaacagattctcaagtgagagttccagctcagaggttaaggggagctggcgacccctttcttagagagtgctattgcatactgatgacagctgatggcattgggattcccagtgatggcagcctcagctgccatctaaaatctactactcccatgaaagctgtgcttaatggcaaacctcctcctgcaaattccgacagtatttttaaaaacttaagcatgaatcttcaagacaccaggattccagattgctcctccagtttcattgggcatattgctgctactgtctccagcaatccacagatcccaggggtgagaaatggccgatgccagtttgatgagatagttctgatgttgctatcaggatggatttttgtgttgtgcgcaacagatccttgctccatcttcaatgacaggatgaagcttagaaactgtgatgcatatattccttctcatctttcagaccttctcttaagtgctatgccctcaaactaatctttctgaatcactctcctactattgtctctcacagcagcttgagcctctccttcatcaccattatcacaatttatagaaacggttgtttaattatttcctgctttttctcaactagaaggtggactcatgaagagaggggccatggtctgtcgctatgtgcccagcacctatcaaagtcatggcaccctgatgatcagtaaataactgctaattgaagaatggccaggtcacagaggaacatgtagagatattgaagtggccatatcaaatgtcccattttggcccatgtctgtgtttttgggaccatcccttctggttgtctttggttgggagctatgttatggtgaagtcgtggcataacctggaggtacctgctttccctaggcactgagctagcaatactcattctttctgacttgagaggttcttaagtgtttctttttcagttcaaaatctgaacaaggggataaagtaaatgagcaaaaaaaaaaaaaaatgtatctttgttctccaggaagtatgacataatgtatgagcacgagccagaggaaatcacacttccacagggagtaaatgcagtcaataaaagcttgtttatagagtattggcaaatgtgcttttaaaccaactatcagacaactttaaagtatggatagatagaattacttttatactctttgcagcttgtattgggaaggcctcttttcttttttggatggttgcacatgtatatattcaggcataatttaaagtgggttggcctaccagtgttcctgagagtagcctggatggtctccaggtttgggaaaggaagaaaatcatgaatcaccagtgctcaagaaaggcatatctgacttgttgaatggactgagaaaattgcattaaatatctgcatttgacaacttaagcatgcgctctcaaatgccactgcacaacaaggaagcgaggcatggctgaaagcaaaacctgacttgacattatccctcacttctttctttaaagttctcttctataccacgaatgaagaaaatgtgatgtcctctagaagtattctataataccttaaaagagcatagcattaaaatcagatactataaatcatactttagctaatgattattaaatagttctttgtattcatgtaactcttatctattatgaactgaaaatgccttgacataatatcattgaagtgatgatatttttattgaggatagtaggcaataaaatattcaaatgtgaagcaaaactctatcctttcctggggttctgtgtttctacatgattatctgcatctcaaaacttatgcagtgttttattcgtcacttgggaaaatatctgaatgcctatgagagcaataactgagaaatcacaactacaagagagagtcttcagggggtgtgtgccagaggacactgaacgcaaaaaagaggagaggagaggaaagtttgagcacaggtttgagggtcttggaggcaaggtgggggcaaggactgagaaatgcatggggagcccataagatggagagaggtttccaggtagggaacaaatagcatttgccaaggctttgtggcaagagggagcatagcgcatttaagaaattgaaagaaagagtggttgaatgcagggactgaacagaagaatggtggatattgaggccagtgggatgaacaggtttcagattttgctgggaaatttcctacaaggaaatttgaagagcttgtctttatcttggaagcactaggaagccaatgagaagaaaggccccatcggtcggaagctcttatttggtttggagctttgttatgatgaatagtgacataatctggtggtacctgctttccctaggaaagttgacataattgtgagggcagtttcttttctctccactctactcctgtccccatccccaacaacccattaataattggtcttatttagtctcagttccttgtacatctacagagctgctgagataggactacatttctttttttgttcctgctgactgcttaattcagaacttcattctgtgaccagaaacaaaagcctccagttgacatccaccactccagctaccccattctagcccattctgcatcctgcatctcccagcctgtcaagcttccatttttttggcaatgtctagagaaaacttagcaaagtcactctgcatgctaaacgctcatatgtacaatgtctcattatacacacattaggttacatgtagtattttttaaccctcaggctcattatgccattatacctgcattataacccacattatgcaattgaatcctcatcacttccagtcaagataggcattaacattttactgtactctgcttgtcaaccctgcaccttaaattatagccaaaccagaccaacagtgtttcctgaacacgcccagggttttctttcctctgcaccccgatcccgctgttaacgttgctggagggatctgttacctgtgccccgctccccgttcactaaccagaacatgcattaagacgttaaccaatgtgctaacttctttactacctacacacacagatttcccagcattctgtgcttgccttagcattcttttcaagagtttctatgtagcactgtggcaacaaatagaagagtcttttaaaagtaggtcataaattcccaaatagaagaatctgcttattcactttcaatgttttgttccattttgaatttacatgtagcatagctcacctttttgggcaaacagttctatgaggttttacacttgtatagattcttgtaaccaccacagtatacagaacaatactaactctcccaagaattctctgatgcttgcctttcataggcagaccctctccctcacttaaccccagcaatcactgatctgttccctgttcctatagttttgttttttccagaatgccatataagtgcgattgtacggcatgtaactattttcatactgggttctttcacccagaaaaatgcatttgcgttgtattcatgttgtgtgtatcagttgattattccccgttagtgctgtgtgatattctactgtctggatgcaccatggtttgtttatccattcactcatttgtctagtcattgcatgcaggtgtttgcatgagcataaattttcattccactcgattaaatacctaggagtgggattgctgggttgtgtgctaagtacatattcaacttctaagaagttaccaaaccgttcaccagagtgcctataacatttttcattccctacttactcacttttgtaattttttaaatgtacttgtaaataaaaggactctctataaacattttctatatcaatttctacaagtagtgaagctaagctgcagtcatggtcttgcagaggatactgcatgggttggctgaatatgccagccagtgactgcaaaggctgctataccaggagagagggagggaaagaaagataattttttctctgaaaaacagaatcgtaaagtggactaggagaagtgggtttcattgccactttatcctccaattcttgtctttaggtaacacgaaacttaaatacagcaaaaagcattcattcagatgctactatatggaagtgatggtacattttatcttaccaataaagaataatgttttcacagatacagaaggcagtctgctcagtgttacagggagtacaaagatgtagaacataggattctttccttcagtgagtttggttggcttatcttagtgccatctgtgttgattattatagcaacagtagtaataagcttcacaatttatcgcgctctatgctaagtgcttgtacataacttagctcacttaatcctcataacaaccagataagcttgaccctgaccctgtacttacacacagatgaggacattgaagggcagagaaattaattcatttcccatggccacaaaatcaacaaacagtagaactaaaagtttgaagacaattctgatgctatagtctgttcttttaaccactacatcaccatggcttccctatgaaaaagggtctgaaaagcaaatgaacagattaaataggatagaagggatatgtctactgcttgtttgtgtagaatagactgaataaattctgtattcaatactgagttcatggcttttttgctggaaaaactgtaatgggaaattattaaacataaagcaaaaacagcaacatttcttttcactcacgctggcaattcactcttggtttgctaaaattatggggtcagtgacaaaactcatatttaagtttaaaaagaataatcacacgggttctttttcccataattgcaataattaagcagtgaaagaaccattacttggaaatgagaaaacagaaatttccatttggtttaaagtggacaaatcaattttgatgagtgaaagaacctagtctcaaatggttacagtgtttttaatttgattaataattggatacattttcagcatgtctttttctgtagccaaacaagggtgtttttctttgtaactatgacttagtgataggaaagtgatatttactgccatggttctgatatatttgtagtcaaatcaatgatgtttgatgaggaatgtttattccataaggcatctaatgttgggttcaaatggtggtttgggagaaagccacagagagcctgatgaggggctgacatggagaggcagagcttggaagaggcattccccagagaaagggggagaggtgaggtttttcttaggaagaagcaaaattctcagaaagctctgtgagtataatgggtgaccgagaaaggaccatggaaataggtggttgaggaacagcagcccttgaaaggggaaagcgatggcttcatctctaagaggagaacacaggccaaagctggtgacaaaggctccatgaatctcactggatttgaggccaaacttggaacctttgggatgctttgaactactccatttcgatatgtgtgctccagatgtaatatgtgtgggttttcttttcttagtgttaaaccccctccacagcatagcataggaattggggataataacagcagatgtgctctgttggttctagacaagtatacgtgagggatggcaggatcggggataagaacttaagtcaattcactttactattattatcattattattttattttatttattttttatttttttgagatggagtcttgctctgtcacccaggctggattgtgcagtggcgtgatctcggctcactgcaacctttgcctcctgggttcaagtgattctcctgccttagcctcctgagtagctggaactactaactactggtgtgccaccatgcccagctaattttgtatgtatttttagtagagacgggatttcatcatgttgactgggctggtcttgaactcctgacctcaaataatctgcctgtcttggcctcccaaagtgctaggattacaggcatgagccaccgcgcccgacctaattattattattattggtcattattagttggattctcaattttacccattactgggtaaatagactttacgatatggaattcaaacaaagatttttgcttgacaataactataatatttgggctgaggtatttatactctgaatatccaggaaatatatatatacacacacacacacacacatacacacacatatgtatatatatatattttgaaaacaacattagctgtggccactaaaaaaaacaaaaccaaaacaaaataaaactcttttcatttaaagactaagagctcttctagctactgaatccagattctggctttattagcctgtgagataaggaatatcaccctattcctttcagaggttacaaactggtaccctcagtttaaaattagctgttaaccagcttggaaatatgtttagtgtggaataggttatgctttaagcaaaatcaaggtaatatgaaacaattggatgatttcatacaaagaaacccagatttttggctcaagaaaacccaaaaacccaaaaactggggacaatgagcttgcatttctgtaggtcaaccactcccctgacctttttttttaatttttctttttttttttttaaatcttgtctcattgcaacctctgactcctgggttcgaacaattctcctgcttcagcctcccaagtagatgggactacaggggggtgccaccacacttggctaatttttgtgtttttagtacagacagtgtttcaccatgtcagccaggctggtctcgaactcctgacctcaggtgatccacctgcctcggcctcccaaagtgctgggattacaggcaggcgtgagccaccacacccggcctccccagacctctttaatgttgcatgtactcctctgttctcccggtctccaccatttcctatcacatcttgcacactgaagtctcatggcaaatgctctttgtcattgttcttgaacagtcattttttttaaataatagagaaatatgtctccataccatgtctctattaaaaatggaaaaaaaaaataaaatgccaaagctgtgtatttaaaaaaattggtagagagctttttttattttgtgaaagtaagtcctggatccacatattgaatatgcaaactatgtctgtatttaaaagaaacaaaacaaaatcataatattagaaataatccatcatgaagaaccatacaggtataaagaaaagaaacataatgaatcaactggtgatcttacaaaagaactgaaattttctaagcatttgttttgtatgtgagtaaaataactggtgctattgcagaattagttatgcattagggaattagtaatgcattagagaaaataacttggttggtcaattgctttttacagatggtaggtttattaaagtctattgagtacagaagaaattatgtgttctgaacagaaacaagctttacaaataaagttctaggtgagaatactgttgcttggcatgttaagttagtgctaagattttactatttaatttatatggaaaaatgatttgtggcatctgctgaaagcatagatagatccctatctatctatctatctatctatctatctatctgtctgtctgtctgtctgtctatctatctatctatttacctgtctatctacctgtctatctacctacctatctgccattctattactgcctaattaattatatttgtttttggtgttgatgtcaactttgatttaacccaggaacttttggatataacacttctgattatataatatgatgaaatgacttattttgcataaagagagagggtgaatagtttactgtagactggtcaaattagtaagacatagtgttgatgctatggttggtgttaaagtctgatttactaacaaactatagagtggctacattttgcaacaatgtagaattttagctcatgtagcacattatgaactagtttttgtttttatcttttttgttaaaaagttgtaactggacaatattatgaacatagcaatgaactctgtgagctcactatgcttctataactttcatcaagatgatactgctgagtaaactggatgtgaaacacgacagagtttaggtggctttgttatgacaaagtgttgtagagagttttagctgttgaaagacactgacttattcatgcatctgtggttgcaaagattacattaatgatttgaccactttaattgccagtatgactggtctaaccactgaattgttacaggaatgcattatttcagtggtccattcatcctgaaattatgtattttgagatgtcatttgggaagacataaattggtcaatctttaagtgctaatattagttacccaaatgaaactgatctacattctccatactatggttttgagggctgatctttaacagcatcactctggtcaatgttaaacttcaagtaaaagtagttgatattgctcagttcaatttctctctcaatatttaaattgggaaggaagaactaccaatagagattacttaaagtcagaatcataagtagtagaatctaaaaatgataacattggaataccagaattctatcactctcctaggcatagcgaccctaaatgaaaacacatattaaggcttggcagttcttgtgtttgggaccagctgtttccttaatggaaagtagtaaaagtaaacatcacaaccaggcagaagaatcacgactcaacttagtatttattgcacattgtaaatagaaatattaaacctgccattatcatcgtgtgtagaataaaaagtttcagatcaatttttagtgacgtataatgtagccatttaataatgtgatgtttttactttttagagtccataattttaaatatttgatttgaaaatgttattttcagtatcacacatgtttgtattatgttaagtattttcatttctgttcagtaaaaataacagctgaggattatatttctggcagtctagctttattcctggggcgtatcagtcatttacgttacctttcttgcccctgttggtatttaggttatatttcctgatatagatgctaattaaagcatgacatcttgatgggaaagagtatttcaggaagagaggagaggctaatgcaggactctttaaatggtgacataaaggcagagtaagagaactgataaagaacacaagtagccacagaagttgccaaaaaaccaggaaagtgtggcactatagtagatgaagaaagacactgttggaaggggcaaattgccatgagccttgagcatcactggatggccttgggtctgccaaaaatttcacatcttgactgcttattatcagggtcatttctcagcatggtgtttgaagcaagtagccttgaaggatggggtacattattttcccaccttcccaaacaaaaagcacattcatttatggcttgctgtaaatacagtgatttctccaagctcaggatttcctggctgtgggttgatttctccaaactcaggatttcctggccaacttaactgtgagtgtggcatatacctgggaaccagctatgtcactgctgtgctctttgggaggcaagggaaaccaacacagccaagctaagtctcaggctactgtgtgctgtgagtaatagagtccttgggtcctttttctctggctcagaagtctcatgtctttttccaacacacatgaaacagccacagactagtttattagcttgaaagtagagcaaaatctcagctccttcacagtccttgacagaaaggaggtaccagcattgccatgaggtcaagtaaggcaaggattgaaaacaagtctattggttcttgataaacttggcaaagagcagtttctatggactgctgagagctgaagcttaattgcagtgggtttagttgctgcagtggagaccgcaagtctaaactatttcaaaaagtttggctataaaagggggcactgagagtaatctctaaaagaagaaatgggttcaaattctatttttgacagtcattttctagccatttcattgtgcctggtccccttagggttttgagtttgtgattcctgatttaaggctactactgctgatggttgtgcaaagtgtgggctgcggaactccagccagcaccatttattttctagtcatggaagaatggcagggtcatcagaataattttctagagagagacagtgcattgatttgagggaaggctgcttttgggtctgtggcaaggctgcctctggacacttaggatgaatccttcactgagcaaaccagccccaggctattgagatgaatatcctgcctgcactcaacaaaattatcatgagtcaactatgcaccagaaatggtactaggtaatgatggtgcagctgtgcaaaaacgtgtcagaacaatacaagtgagagaagctaaggagcagtgggatgaagcttcaaatggcatcctttattctgggggcagggggctgtggtttagctttgaaggatatggttcatggtggaatttaattatgtccttagagactaagagccaagcaaaaccctgtagagttaccagaaagaagagaggttcagctatttttctctaataattatacaatggaataagtgtcagagaagccccaaatggttctttttcattttttaatgttttccctgtactttgtctccaatagattttccaacaaaacacggttcattctactgttgaaataagcctgtgttctgaaacttgaaagaactgtgatcccagtgcccatgaacgtctgacttcattgtcagccacaggtcacattctttttgtaccttccagccttgtctctctctcccttgggtctcaccttgacacaaggtaattcattttctagaaaatggtaatttgtgcctatttgaagtttatcctcttttaaaaaggttattcaattaccctctgtcccctttcacagtcaagctgttagaatctgcagatgcaaagttccccttcaccttccagagagaacacccagagtcccctgagcccccggctgcgtgggggcagtggagccagggcccagggctgtaatgagcacaaagcgtcttggtctcatgttgctcaacagtgacaaatcatgctcattgcagtttccatgcaaaagggaacacttttctcagctactagagctgtttggagcaaaaggaatatccattcttccatgataaattttcattacagcacaaacttatgggatcacataatctcttcaaatttgcctctggtttttagcattcatttaaactaagctcgtaaatggaagggtaatacttcggaaactgtaaatgtatttttgatgtactgttcagtttgttaaccttctcttcatttctttattcatgcatcctgtttcattatgtttactccttaatgtaaaacagatccagaattgtctttcctcacctagtttgaaaattcagctccaccgacgtgactaaaaaagtgcagatcccaagaatatatgttgaaagactcaacaaccttggttttttatgttgtcgttgcatggtgacatcagggcagaaagccattctactgctctgtttcagcacagaagtgaaaagaactgagaaatgacaggaacatttgcatcttctgtctgaacactgcagaagtcccaattatttgaattctattgactctctgataactgctaaaaacactgatgactgctctcaattgcaacataaatagatctattttaaaaaaattatgcaatgaaagaaaactaataaaatctcaatatcaagcaaacagtttacaaaatataaaattcaatataggctacctatactgagctaggaatctgaaaaggtgggtacttcatttcatatgctctattatgatcatcttgacttgtaaattgataggctctccggagggctgaaccagaaacagccagccatcagcaagatcagagacatctgtcatataactaggggcctctggtttagagctgtgagtgaatttgattccaatcagggctctcagctttcaaatgagcacttatgcatgtctctgttttctcttttttatattgagcaggtacaggtaagattttttttttaggaaagtgttctgctgctagaagaaaaaatgacactgatccagggcgtaatcagagttttatatgaattgtttacaaacatacatgcataatcactaaacataagttattaaatatacagttggtcctctgtatctgtgggtccctatcacgtattcaatgaaacatggattgaaaatttaaaaagagtcctagccaaagcaactagaaaagagaaagaaatcaagggtatccaaactggaaaggaaaaagtcaaattattcttgtttgctgatgatatgatcttatatttataaaaacctaaagactccaccaaaaactattagaattgacaaattcagtaaagttgcaggacacaaaatcaacacacaaaaatcagtagcaattctatatgccaacagtgaacaatctgaaaaagaagttaagaaagcaatcctgtttacaatagctacaaataaaattaaataccgaggaataaacttaaccaaagaagtgaaagagctctgcaatgaagctataaaatataaatgaaagaaattataaaggacacactaaaaataaaaagccagttcatgttcttgaattggaggaatcaatactgttaaaacgtccatactatccaaggccatctacaaactcaaagcagtctctattgaaatactgacattctccacagaaatagaaaaaaaaaacaacaccttaaaatatatatggaaccacaaaagaaccagaagaacaaaagccatcctgaaccaaaagaacaaaactggagacatcatattacctggcttcaaattatactacaaagctatagtaatcaaaatagcatgatcgtggcctaaaaacagatacactgaccatttgcagtcaacttgttttcaacaaaggtgccaagaacatacactggggaaaggagagtctctttaataaatggtgctgagaaaattggatatccatatgcagaagaataaaactagacccttatttctcactacatacaaaaacaaaatcaaaatggattgaagacttaaatctaagactggaaagtatgatgtgcttttattttctaaagttagaggtttggaattatttcttttgttttagctcccagactacaaaattgaatctccatagcaaatgccctttatgcagctcatctcctgaaatatttagttttaaaagaatggttttcagttttaaggattcactttcgagtggtgagtaggtttttctaagtgttttctactgtccaagcctggccagtctggaagccctagcatctccctcacccaaaagaggcagttgggctggggttaaaactgggcaaagatcccagcacttttggaggctgaggcaggtggatcacttgaagtcaggagttcaagaccagcctggctaacatggcaaaaccccgtctctactaaaaatacaaaaattagctgggtgtggtggcaggtgcctgtgatcccagctacttgggaggctgacatgggagaatcgcttgaacctgggaggcggaggtttctgtgagccgagatcgtgccattgcactccagcctgggcgacaagagcaaaactctgtctcaaaacaacaacaacaactgggcaaagacatgatgtaggactcctgaagccaccttccagaaatattctgacttttatttatcattagtttgtccactccttgcactgtaccttgtatacagaaagtgccctattgacatttactaaatttcttttttttcctcttttttctttctttctttctttttttttttttttagagatgggggggtctcactctgttgctcaggctggtcttgaactcctgggcttcaagagagccttctgcttcagcctctcaaagtactgggactacaggtgtgagccactgtactggcctctttatttaaaagaagtttttttttttctaagaaaaacatttaattactagaaccatcaaggttcttgtttgtaaacaactgaaatgaactctggctaacactaacagcaaataaatttaatgcacagataacgggtacacagaaccagatgagggaagcctgaggaaccaagcttggaaaataggagccacaagaagctattataaatggctggatcaaatgtggattaggccataggaagactctgattaggtcctactgccattgtcacactggcagttgtgacttgcattactgccattcaatacatcgtggtgttgccaggacagagtaagttttgtgctgcccccacctcactgtgtcccagctgggatcaggaacacgtgattgggcaagcttaggtcagatgcctatgcgctagctggaaaagggggacttatctgtccatttcaacttctaaaggaagtacagttgacccttgaacaatgtgggttagggatgccaacccctgtgcagtaaaaaatccacatataacttttgactctcctgaaacttaactactaatagcttactgttaaccaaaagccttactgataacataaacagtggattgacacatatttttatgttatatatattacgtaatgattcatataataaaataagctagagacataattgtcatcttcatgtcgaatatgctgaggaggaggaggaagaggaagtgttggtcctactgtctcaagggcattaaaggtggatgaagtagaggaggcggaaggggaggcaggaagagcaggcatagttggtgtaactttgtggaaatgcatagtaaattctgtctgacctattcactttttcatttctgtaaaaatgttttgaaatgataccaattcttcttccacagtctgtcttagtctcggtgcctctatcctagaggggtccatgtcataaaagaagtcaagagcagtcttgaagaataggaactctcctgccacactgtctaatgtcaatttgttttctggcactgtttcttttataatacatcgtctttctcattgtctggcactggttcagaagcactcatctctgtcaagtcatctttgggctcaatggcttttacagctttttcaataacaacgatggcatcttcagtggcgcaatcattcctgattttcatgaagttctttttatcaggattctcttccatagcattgacaatcctttccatcgcataccgtgtgtaatgaacctcaaaggtccttatgacaccctgatttacaaactgagttagagacattatgtttgggaacaaatagaccactttgattccttcggtgttgaactcatggggttctgggtggccctgggcattgttcagtatcaaaagagttgatattgtcccttattggcaaggtacatgatgatttcagggacggagcattgatgaaactaatccagaagaagggacctcattgtctacaccttcttcttgtacaaccaaaagactggaagctggtgtctatattttttatccttctaggcttaggggttagcagctttatagtatgggtagtcctggtcagaaattcgactgcacttgcagaaaacagtagtttgcctatcccttcctgccttaaatcttggtgcttgcttcttttccttactaataaatatcctttgtgacaagttttccccccaaatagggcactttcatctatattaaaaacctgttcatgcaaatattttttgtcaatgattttcttaatggcatctgggaacttgtcggctgcttcttggtctgcaggaactgcatcttctgttatcttgacattttttaagccaagcctctgtcccaaattctcaaaccattctttgctggcactaagttctccggctttacactctttggcttccctttgctttaagttgtcatataatgacttcactttttctcaagtcatatcagtctatagtattcctttcttgtaaaagttgcattttcaatacaaaatgaagagatatttcacaaaaagtgcaaggcttgttttttttgtctggtggtatagctgcagtgatggcttcacaaatttcattttctttctttttaataatggtccttacactggattaatttaccttggagtggtgggcaactgcagctacagacctctatctatggtacatatcaagcaattcaaccttttttttttgtaatgtcaggaaggggtttcatatgccagttagctaaagaatccccaacagcagtgtgatggttggttttatgtgtcaacttaactgggccactggatgtccagatagctggttaaacattatttctggatgactgccttctacggaacctatctgtgtctgtgagtatttctggaagagactagccattgaatcaggggactgagcagcacagattggcctcctcaatgtgggtgggcattatctaattcattgaggaccctaatagaataaaaaagtggaggaagggtgaatctgctctctgactgaaaccgaagagatgaaacattgatcttctactttttgtcactccttgttctcacatcttcacacttgaactggaatctatgccatcagctctcaggcctttgaattgcactgctggctttcctgggtctacagcctgcagatcatgaaacttctcagtctccagaatcacatgaattcattgaataagcagttatctataattgtctactataagtgtctactaataatgcttttatctagcatcataactttttttttaatacgaaaaattcaagaaggtgggaacccgagaagatgagttttattcatgctagaccagacacattgagaagctacttttgcatgatgtgacactgcattttccagaggagatgaccccagtgtacatcaccccaaatccgtgttttacaatgtactattgacacgtgtctatcaggaggtgtggtcagggttccttccccttttctctgggtgggctgtgtctatactgtaaatagccctaatgacttctgaagataggccataaaatgtaacatagcttctagctggctcttggaacatgtaccttgagaatcctgagccaccatatatgaagtctggctccattgaagatgcagtgctggaaagaacacttgaagaggccacaaagagacagagagagatgcctagggatgcccagctatttgaagtctcagttttgcagcccaggtgtcagacatgtgaacgagcaagcttccagttggttcagcccgcggccttccagccaacacagctgatgccctgtggagccaggctttgagtcttccagctgagtttcagacagtatgaagtaggaacaagccacctgccctgttccctggctgaattcctcatgcacaaactgtgtgagcataatgagaggttgctttatgctactaaattttaggttaatttgttgttcagccatactaactggaacagataatcagatggaaagaaactttgaaaacatctagtcaaagcagtttattttacaaatgaggaaattagctgagaggggcagaataattgaccccaaatctaacagctcattagtggcagatcaaatgttctttccctcctgatgatgtaaggagggtgctggtctggcatggaatgccacatatgaattacagaattaggataagggcttcaaattgaataagtgttggttcatacaattccagatacttgatgaataaagtcagggccaaagagctctgaggtcactaacagacactgcctacctgaaaatacactaggcagaaacggtctagaaaaacagtaattatacggatatgtgcaagtatgtgggtgttaggtaggggatagaagatggaggaatctttccacctctgattctgccagaagtattaagtgggtagtcttgaaaaaaattgatccttaatgtactgcctgcctctcaggaagggctaaaagactataacataaacagagcctgacacttcaggaatctttgtgtctgaatgtattgctcagattttaaactgtgctgcaaccttttccgaattaaatcaacacatcaataatcacagactttcaaagcagaatgttctggtgaacccttaaaccactgttacatggtcactccactttatctgctaacgaacaaatctgctgccctcagaagcacatggactgagggtttacaagcatcagcccctctgcaagtgattttgattatgttacatttacttctatcatcatttaacatctttttttaaaagcataaaatcagtaattttggatctaattgtgtcacagtgtcatggggaggaccaaagaaaaactcccaatgacctatcaataattaggagagaaccacactgtgaaatatcagagacaatgtagaaaacaataaattgaagcaggttcaacattcagttttcaaaagtcaccatataggtggataaggataaactgctgcagacttaacctcaaggtcaaagtttccataatgtactccaagtaattgtctgcattaaggcagattgtatttttgataatttaaaaagaagtgtttgcaatgcaaaaaattactgtaagcatatactgtgattaaaaagtgtgttcaagtacacaaaatttacaatggttataaattgacataattccagatccatgatctgtactttacattaatgcccacgtattagtctgttttcacactgctaatacagatatacctgagactggttaatttataaaggaaagaggtttaattgactcacagttccacatgactggggaggcctcacaattatggcggaaggtgaaggggaagcaagacacatcttacatggcagcaggcaagagagggagaatgagtgctggcaggggaaatgccagatgcttataaaatcagatctcgtgagaaccactcactatcaccagaacagtatggaggaaaacacccccatgattcaattaactccacctggccccacccttgacacgtggggattattacaattcaaggtggggtggggacacagagccaaaccatatcagcccacgagaaaattaatcctgaattatttgaagtcttctgaagtacacccttcatagtttgtaactcttttatttcctttgagtctgcttttctattctccttcccttctgccctccttcctttgatctttcttctttataattttcttccttcctccccttcttttcttccttctctctctctcctttctctcctgttttccccaatccttctttctcactctctcattacttgacaacatgtattcctgccaatcaagtctcaacacagcatgagatacccaatgttataaaaaagaaggaagaagaggaggaggaggaaaaagagaaggaggaaggggaggaagaagagggcattctattccaagccaagaaaattttggttctgaaagggcagagggtatgtttagcttagtcaccatggtagctccagggagtagcacaatgcctattaaagcaggaagaacataattatgaaaaaaatacaaattatagaatatcatccccaaaatggacctcaaagatgagagggattttataataactgcattatttctgttgtgccacaaatgtagtaacattttagcacattgtcttttggtatatacagatgtgtttgtttctcaaaatgagtaacaccttagttaggctcaggtgtatatgcacctgcccttgttaacttatatcctgaaatctgaggcccagcaatagggaaatgtatactctgtttaccctttctttgaattaccaaaggcttgcttcttttttttttcaaaggctgaccagtgtttggtcctttctcagcattgcaaaccatgcatcgaatcttttgagtagcttttgaaatttctagtaggttgtaacaggctacagtaaaatgggatggcaaattagggcttataggactaaaaatactgttagtaattacagtttagagaaaaaaagctagatttatgtaggaaccagtatcattcttgaaaatgatgccggattactcttcagaaggaaaagaaaaagcaatgtttctctctcattctcagatgtaagtcatgcggaaatgctgcaaaacatgtaatttcttaggacactttgagtagttaaattagaagcagctaatagatgaaggaaagaaagcctttactaaagtgaaactacaataggaggatatatacaaaattgttatgaaaaggttgttttgataaaaatttcaaaacaaatcatacacttaagtaatgggaatcagagatgacatgggttggctgtgtcctcactcaaatctcatcttgaattgtaactcccacaattccctcgtgttgtgagaggaacacagtgggaggtgattgaattatgggggcaggtcttttctgcatgttctcatgatagtgaatgagtctcatgaggtctgataattctaaaaatgggagtttccctgcacaagccctctttgcctgctgccatccacataagatgtgacttgctcctccttgccttctgccatgattatgaggcctcccccaccactggaactgtaagtttaataaacactttttcctgtataaattacccagtctcaggtgtgtctttatcagcagtatgaatacggactaatacagtaaattgttaccagtagagcgaagtgctgctgaaaagatatctgagaatgtggaagcaactttggaactgggtaacaggcagaggttggaacagtttggaaggctcagaagaagacaggaaaatgtgggaaagtttggaactccctagagacttgttgaatgactttgaccaaaatgctgataataacatggacaatgaaatccaggctgaggtggtttcaggtggagatgaggaacttgttgggaattggagcaaaggtgactcttgtgttattttagcaaagagactggggacattttgccctgccctagagattggtggaactttgaacttgagggagatgatttagggtatctggtggaagaaatttctaagcagcaaagcattgaagaggtgacttgggtactgttaaaggcattcagtgccaaaagagaaacagagcataaaagtttggaaaattcacagcctgacaatgcaatagaaaagaaaatcccattttctgagaagaaatccagctggctgcagaaatttgcataagtaacaagaagccaaatgttaatcaccaagacaacagggaaaatgtctccagggcatgtcagagacctatgcagcagtccctcctatcacagaccctgaggtctagaaggaaaacgtggttttgtgggactggcccagggtctccctgctatgtgcagcctagagtcttggtgccctgcatcccagctgctctagctgtagctgaaaggggccaatgtagggctcaggttgttgcttcagagggtgcaagcctcaagccttggcagcttccacatgatgttgagtctgtgagtgcacagaagtcaagaattgaggtttgggaacctccgcttagatttcagatgtatgtttgctgtaggggcgaggtcctcatggagaacctctgctagggcagtgtggaagagaaatgtggggtcagagcctcccccacccccacagagtccctactggggcaccacctagtggagctgtgagaagagggccactgtcttccagaccccactgtccacggacagcttgcactgtgcacctggaaaagccgcagacactcaatgccagcccatgaaagcagccaggagggaggctgtacctggcaaagccacaggggaagaggtgtccaagaccataggaacccacctcttgcatcagtgtgacctggatgtgagacatggagtcaaaggagaccatattggaacttgaagatttgactgccctgctggatttcagacttgcatggggcctgtagcccctttgttttggccaatttctccagtttggaatggcagtatttacccagtggctgtaccctcattgtatataggaaataactaacttgcttttgattttacaggctcataggtggaggggatttgccctgtctcagatgagactttggactgtggacttttgagttagtgctgaaatgagttaaggttttgggggactgttgggaaggcatgattggttttgaaatgtgaggacatgagatttaggaagaaccaggagcagaatgatatagtttggctgtgtccccacccaaatctcatcttgaattgtaactcctacaattcccacgtgttgtgggaggaacccagtgggaggtgattgaattatgggagcgggtctttcctgcactgttctcatgtcagtgaatgagtctcacaagatctgatggttttaaaaatgggagtttccctgcacaagccccctttgcctgctgccatccacataaggtgtgacttgctcctccttgctttctgtcatgattatgaggcctctccagccactggaactgtaagtccaataaaccctttttcctacataaattacccagtctcaggtatgtctgtatcagcagcatgaaaatggactaataaaagagaccagccaattaaagtctcaatgactgtaagtgaagtacttcaaacacttgatgcaaaaaggacctgagagattcctcagatttagcaagaatagtcttgtgtttgtccataccaaaccatcaacacagagaagtagtatttatctttcaaagtgttggctatttgctctagaacagatgttggcagactttttttttttttttttttgtaagggaccatgtagtaagtattttcaacatacacaccgtaaggcctctggtgcatttatttaactcttctgtggtggtggtgtaggagtcgtagacaataagtaaattagtggtgtgactgtatctcaataaaactttattaacaaagagatgccaacaagatggtggaataggactctttaacactcctacacctacagaaacatcaagtcaaacaactttccacacacaaaaataccttcacaagagctatggagaccaggtgagagattacagcatccccatgtagcagagaaataagaaataagaaaagacacatggaactgtgtaggaaggacagtgtgacattactcacatcacccaactccaggcagcatagagtggagagagatacccactgagtaggagaatgagagggaagtgagcaccagcctttgcctcagacctcaaaaccaggcccctccaagtaaaacccccacagccccagactctaggccagtacccacgaacggagcctccaggcaccctccagaacctggcaggatcccccagccccaggctttaggcctatgtcacagactcagtgtttgggcctctgcattaccaggctgaccctaacggccacagcagtgatccccaacctttttggcaccagggactggttttgtgaaaaataattttttcatggaaggtcaaggggaggtggggcttaggggtgtggtgggaaatggtttcaggatgaaactgttccacctcaaatcatcaggcattagattctcatgaagagtgcgcaatctagatccctcgcatatgcagttcatgatagggtttgtgctcttctaagaatcaaatgttgctgctgatctgacaggaggcagagctcaggcgataatgcttgcttgcctgccactcacctcctgttgcatggcctggttcctaacaggtcaccaattggtatgggtccatggctctggggttggggatccctggcccacagcactaggctggcgcctatggccccaggcttcaggtctgctccagtagaccctagtggcaggctggaccccatggagtgaggttccaagaccactcctgcaagatccaggctgcaggcctagacctatccccagggactcaagctccaggcctttcccatcactgggccaacctttgtgaactcaagctctaggcctaccccggtggatgcatgtgccagggccattccagtgcctgaccagcccctgcagactcaggctcaaggcccaccagctccaggtcagcccctgtggacctagggttcagcaagtccccttgaatataggctgcaggcccatcttcgtatacccaggctccaaacccatccacacaaacctaatcatcaggttcaccccagtggatcctggcctctggcccatccttatggacccaggctcaaggcctacctgtctgctgattcaggcacaggccagccagcccctaaacgctagcagcaaggcctccctcaaaccacgccatgtgcatatccacaggcaaaataatgaaattagacccttatctcacaccatagacaaaactaaactcaaaatggattaatgattaaaatgtaagacctaaaactgtaaaactacttgaagtaaacaaaagcattgttacttgaagtaacaatgtttttttttttatatgaacccaagagcataggtaacaaaagcaaaaatagacaaatagaattacatcaaactaaaaagcttctgcaccgccaaggaaacaatcaacagagtgaagagacaacatatggagtgggagaacatatttgcagatcatgcgtctaatggggttaatacccaaaatatataaagaactcaaacaattcaatagtaagaaaacaaataacccaatttaaaaattgacaaataatataaatagacatttgtcaaaataagacatacaaatggacaacaagtatatgaacaaaaaatgcttaacattcctaataatcagagaaatgcattaaaaccacaatgatgtccaggtgtggtggctcacgccagtagtcccagcactttgggaggccaaggtaggtggatcagctgaggttaagtgtttgagaccagcctggccaacatggcaaaccccatctctactaaaagtacaaaaaattagctgggcatgttggtgggcacttgtaatcccagctactcaggaggctgaggcaggagaatcacttaaacccaggaggcagaggttgcagtgagccgtgatgactccattgcactccagcttggccaaaaagagtgaaactctgtctcaaaataaaataaaataaaataaaataaaataaaataaaataaaataaaataaaataaaataaaataaaataaaataaaaccaaaccacaatgatgtatcatctcacacctgttagaatggctattatcaaaaagacaaaagatagcaagtgttggagaggatgtggagaaattagaacccttgtacacagttgttgggaatgtacagctattatggaaaacagtatggaggttcctcaaaaaattaaaaatagaattaccatataatccaaaaatcttactactgggtgtgtatcctcagaaaggaagataaaaactcagaaccctatttcactctgccaaaaggaaaaaaaaatattaagctgaaagctgagtcatgcaagaagctgcctttccttttgttcctaagccaacagctgcagagaaaaggttatatatctccacaggtagctactctatgttcaccttatcttatgtaaagtgctgagtgcaagaaatacacaattgactattctcccacctactccttttctcttgcaacacatggattattgtaccctctctctttcccctccagcctgcttttcccctttaaatattgaagccctcaaaatcatctttggagaaaggcacagaccacagactgtttgattccatgttcttttcttctaggcatgtccttaaccttgtcaaaataaatttgtaaactgatagagatctgtttcatatacttttcgttcacaatccaaagggtatgaaataagtatgtcaaagagatacctgcaattccatgtttattacagtattattcatgatagctaagaaatggaattaccctaagtgtctatcagtgaatgaatggataaagaaaatgtggtatgtatacttaatggaatactactcagccttaaagaaagaaggaaatactctcacttggggcaacatggatgaacctggaggatattaagtataaataagccaggcatagaaaggcaaacaccacttaattttgctgatgtgtagagttttaaaacgttaaattcatgtaagtagggattagaatggtggttaccaggggctgagaatgagggtggggttgagaagatgttggtcaaaggacacaaaattttagttacaaagaaggaataagttcaagaaatctattgtagaagatgatgactgtagttaataacaatgtgtcgtattcctgaaaattgctaagaaagtaaatttcaagagttctcactaccaaaaaaaacccaacaatgtgaggtaatgtgtatattaatagcttaatttagcctttccacaatgtagacatatatcaaaacagcacgttgtacatgatgaataagtacgatttttatttaccaatttaaaaaacaaataaatactctatttacaaaacaggcagtggcccagatttggttcaaggactgtattttgccagctgcttttctagaaaatcaaggatatgaaatcataagatttcattttcccaattaatccattagttggcaggtgacatggccgggaggagattgcttggcatttgtaactggaagacctgagttcaggctcagatttcatcgctttataatcctggacaagcatttaacctttcaacaaccatgcacatttcttcacttacaatatgtattccagctacttcatggggttgctgtaaaaccttagggagaaatattagtcaaagtactttgtaaactaaagcattatgtaagtagataaagttgttattaacaggtgataagtgggcagaaaaattctcaggaaggcatctaaaatggtagcaataaaaagcatgtgcatttgtgaaatcgctaaacagtcacttttataattaagggatcctctgtctttgtataaaaaggaacaaggatattgttcagtcaccacgaagtcacagggctaaaaatgggtataaatagtgtgaagacagtgcaagaaaggctgggacactggacccctgggtggattattcttggctccactatttactagctgtatgactcagttgcatcattcaagttagccttcccagaagaaaataatactctttacccctcagagatgctgtcggaattaatgaatccacctaatgtgcttaggagagattctggcagaccggaaatattaagtaaatatcaactctttttttaattgaagtgattcatgaagtcacataaattaggagtggaagattccacagaagtcatttagtgcaccaccctccacctctgtgatatcatggctctgtgttcactctgcctctgtttgaacaatttctttatgaggaagctcattacttcatacagaacttctcagtacagataatctattcactatttcacttgttaatataggaaagttgtttcctcaaagaaaaaataaacctctcaacccaagaaagcttactgaaaagcaaaataagaaagaaaaaaagaaagcaatagatggggtatattacctcctttcactcttcctacacatttctaagcctgagtaaaacaatgggcagtgtcttgtcaccttaagaaatgatgccagaatggctgaactaatttatattcccaccaacagtgtacaagtgttcctatttctccacagactcaccagcatctgttgtttcctggctttttaataattgccatttgactggtgtgaaatggtatctccttgtgattttgatttgcatttctctgatgaccggtgttgataagctttttttctatgttttttggccgcataaatatcttcttttgacaagtgtctgttcatatcctttgcccactttttgatggtcatctaggatctagaaccagaaataccatttgacccagcaatcccattactgagtatatacccaaaggattataaatcatgctactataaagacacatgcacacgtatgtttattgcagcactattcacaatagcaaagacttggaaccaacccaaatgcccatcagtgatagactggataaagaaaatgtggcacatatacaccatggaatattatgcagccatgaaataaatgagatcatgtcctttgctgggacatggatgaagctggaagccatcattctcagcaaactaacacaggaacagaaaaccaaacaccacatgttctcactcataagtgggagtggaacaatgagaacatatggacacagggagggggatatcacacactggggcctgttgtggggtgcagggcaaggggagggagggcattaggacaaatatctactggatgcgggttttaaacccagatgacgggttgatatgggcagcaaaccgccatggcacacgtatacctatgtaacaaacctgcacgttctacacatgtaccacccagaacttaaagtaaaaaagaagaagaaaaaaaaaaaaagaaatgatgcctactagaggaggcttctagaatgcaatggtgtttaaaaaaccttctgtcatctgcctctcaaaggaatgactggaaaatccaagcccatttcatctttcataggcagtgcatgttcataatggcctcttgacattaataattagtattaaaaagttatattccaaatattactatagttaataatggttatatcaacagtagaacatgactacaaaccgaaaggtcatctctgcacaactgaaaatcgctaagtctaaaggctgcataaatttttcctataattattaacaaactaagaaaatagatccattcacttcatgtttttatacatttatatataaatattgtttattataaatggtataagttttgttttgttttcaaacaaatgatgtgatgtaaattttcatgcaccacaggaatccattaattttttatcatcttaaatgtcctgtggagctttgttttaggccatctctgaaatgttcaccattgattaattttgagaagtgctttcatatgctaaaaacccaagtgaactttccctaagcaaattaatttccccttttgtttccaggcacatgaacaaggcttgagtccagtgtgttttggccattccttgttctttagatcaaagggatctctgcttaggtgaagaatgagaaagggctggattgaacagagaaaaaatgcatctttgcagacaaatttaccaaaggaagaaaaatagtcaataaaattgagttgtcataagagtggtttgaagcctgtggcattgattgatgaatttcctttgctgttactgagataaaccaaaaatacacctctagttctttcacctcttaggtaattcaacagaatgcgtttcacagactaagtgccagaacagcagcgatctgctgagttaacagaacaccatgctgaaggtcagtgtaaaatgtatacataaaggcagaaaaatcatgctgttctcattaattaagcaaaatatcactttcttctgacactgcactgtgaagaacaatgaataagcatttggaaagggtcttaaaattttgagctcacatagtaaagtcacttgggaatttgtagtaataaatatcactgttaactttaatgtcaggtttatttttgtttgcctgtacctacctcacatgacttatcgttattagacaagaattgcagtaaattttctttgatacagatatattcatccatggatttctggttgaaaatatgtaaacattctgatgacttcaaggatataggactaagctctcttgtaggccaatgacatgattatgttggaaaaaacgaacagcatcaatagacaatttggtcttctgtccagttggtactacagagaatgactcaattttagctattcaacatttaacaccctttgacaattctcctttaatgtctaagtagcttttagctgacaattgtattacaggtcaacacatgtcatattaagggcaacattttacaaacaatttatttcatgggcttatcttgaaattgcatttttaaagttaaacaatcaatactgttgaaaaaggcttttaatggcttctctgcacattaagtgacctccgttacaggttttcagattaagactaacaaaagcaccttttgaagttggactccatgtattataaggaaccctgagttttttttttctgagagaaaatcttgcctcttttcacaaatactcacttgtcaactttatgcaaaaatgagatgttcttcctcattgacattagatgccttaactttcatgaaagaggtcagccatatcctcaatgaggctaaatgctaaaggatattacactacctctaacagaagacatgaaactgtggactctatgtttacaaaccctgcctcagttataaacccaaacatctccaaaggccaggcatgtaatatgaagtgaaaagaactggaaatggagaaagtagtgagtttcaggtctggagtgacagtatgaagagctcttaggacaagcttcccagtgaaacaacaaaaaaaaattggcaaaaattatgaaaacaagtattataattatctagaaatttcactaagggcatatagaaaatgaagaaatatttattcaagaaaatctactaaaactccgctagaagagatagtctgtgaaagttaaaccacaacccactcccttctttcccctgcctcccctcttcccagcacaacttgacagaagctccatttgggcatctaagaaggtggtgctttctctcccctcagctcccaaccaagaattactgtatctcactgggaagcagaggctactcacatttctcatcccttttagctccaaattgaagatactaaattctcaatgagtgaagccaagaagctggggactcctttttttcatataggtcctaccgataagattgaggtaccaccctagatatttcaggataagaatgccatgaccaccctcactcaaatttgctcgagggaagaggttccacactaagaaagtcaaaccggacctcggaggataccagtctacctcatgaccagagtagtggttcagagagtttgcccaggaggaaagatagtctgtgaaagagatctctgaagctctcctcaaaggaactaagtgtatttgaaacggagtctgggaaagttcaagcctaagggttctctcaaaaacaatagccccagttaattaagagcagcaaattaagccattggccagctagtgccctaaagagaaccagggaatgaaacagctaagaagagccctcagggggtcagaacaaaactcaaaggctagctccaaaagtaacccttgctgaaatttaattggatcagactgctgagcaatttatagcccagggcattgttgaaaacaatgatagcacaatcacctggcaaatagtgaggtcaaacattcaggggcataataccaaatgaactagacagccaaaaaagaaagatggaggaaagacagtcaaagagacccatgctaagaccagtgtcatcctaggtggttgtacaaagtttcaaggctatgtcctctgaggaatgataccaaaggcttcacactgcattggggaaatagacttcactaaaataacctagccaaattacaaagcaaatgaaaaattaaggaacaacaaaacaaggcctagagagaacggaatggagtcagtacccagagttgttagataaagacaatatgttatctaagatgttcagtttttaatcaaaaaaaattatgagacatgcaaagaaataagaacatgtaacccatatgcaagaaaaaatagcaggcaacagaagctgactgtgagatgtcagctttaacagacaaggacttcaaaatagctgctacaaatatgttcaaagaactaaaggaaatggtgcttaaagaaaaaaaggtaagtatgagggcgatgtttcatcagataaagaatatataaataaaaagagagaaattatttaaaagagccatatgaaaattctggaattgaaaagtataataaaatgaaaaatttaataggagagctcaacagtagatttgaactggcagaagaaataatcagtgaacttaaagagagattgacagggatatgcaacctgtaaaacagagaaaaaatagaatgaacagagactttgagaaatgtggcatactttaagttcaccaactacatacaatgggaatatcagagagagaggagaaagagagaggagcggcaaatatttgaaagaaataatatctaaaacctacagacttactgaaaaatgcatagttttcttttctcagctgtttcaaaaagcaatattttaaaaagaatatgcataagttgtattcttagacctataacatacacatttctattgtacatttcatattacatttctatgtaatacatttgacaaaaacatcacaaagaaaggggatagaactgagttgtactgcagtgaagaaaatgagaccaggtaaaataaaatcacaagaaaagtgagagagacccacaaattgtaaatataaaaaattctgtaaatatatacttcctctctattcttttcttggattctttaataggcataaaattataataatgtactgttgaatttggaatatatatagatgtagtattaataacattaaaaacacataaatgagaagtaacatttctatctttctagaaataagtttatatatatctaaagtgttatgtataccatgtattttggggtgttaaattgtaaatggtaagtattacagcaaccactaagaaaatattttaaaaatacagtaaaaattgctctagaaactaaaatgttacactagaaaatattcacttcacacaaaagaaagaagttaagcaggagtacaggaacaaacataatacgagacatataaaaatcaagaagtactaagcaatatagtttggatgtttatcctctccaaatctcatggtgaaatgtaatttccaatgttggagaaggagccttgttggaggtgtttgggtcatggaggtgaatccctcatgaatggcttagcaccatctacttagtgatgagtgagttctcagtttatatgagatctggttgtttaaaagagcatggcacctccctcttctctcttgccatgtgatgcactggctctcttttaccttctgccatgattgtaagcttcttaaggcctcaccagaagctgagcatataccagggccatgcttcctgtacagcctatagaaatatgatccaattaaaacctctcttctttataaattacctagtctcaagtattcttttatggcaacacaaatggactgacacagaaaattggcactaaggagtggggcattgctataaagatacctaaaaatgtgaaagcatttttggaactgggtaatgggaacaggtgggaaaagttgagagggctcagaagaagacaggaaaatgagtttggaaagtttgcaagttcttagacaattgttgagtggttgtgaccaaaatactgatagaaatatggacagagaagcccaggctgaggaggcctcagatgcaaataagaaagttattgggaaatggagcaaaggtcacacttgttatgccctagcaaagaacttggctgcattgtgtccatgctctagggacttgtgaaagtatgaacttaagagtgatgatgtagggtatctgacagaagaaatttgtgaggagcaaagtgttcaagtggcagcatgactgcttctaacagcctacagttagatgcaggggcaaaggaatgacttaaagttgaaactcatatttaaaagggaagcagagcagaaaagtttggaaaatttgcagactgacccagtggtacagaaagaatccaagcaggctgtggaagaaccacctgctaaagagattagcatgacaaaaaggaagccaaatgctaatatccaaggaaaaaatgccttgaagcaattttagaaatctttgaggaagctcttcccatcacaggcccagaggcctaggaggaaagaaaggcttcaggggcaggcacagggcaccactgccctgctcagccttagaatactgctccctacatccctgcctctctgcaccagccacatcaaagggccccagggacatctctggttgctgctttggagaatgtaagctgctgtaagccttggcagcttccatgttgtgttaagtctgcaggtgcacagaatgcaacagtgaaggagggttgccatcttccacctagattccagaggatgtatgggaaagcctgggtacccagaggcagaaggccttaccagaagcacccagagaaactctacttgtgaagtgctgaagggaaatgtgggattgaagtcaccatacagagtccccaccaaggaactgcctaatggaactgtgggaagggggttgctgtcctccagactcaagaatggtagagtcgccagcgtcttgtaacctcagcatggaaaaactgtaggcactcaactataacctgtgagagtagccatgggggctgcaccctgcaaagccacaggagtggagctgccaaaggccataagagcccaccccttgcagcaggacataaaatcaaggattatgttggaatcttaagacttaatgcctgccttgctgggattcagacttacatgaggcctattacccccttcttttggacaatttctcctttttggcgtaggaatgtttacccaatgtctgtacctccattgtatcttggaagtaaataacttgtttttgattttacaggctcatagctggaaacaacttggccttgagtctcagaagagactttggacactggacttcgagttgatgctgaaatgagttgagacttttggggactattggaaagtgatgattgcatttttcaatgtgagaaggatatgagattttgggggctaggggcagaatgatatagtttggatgtttatcccttccaaatctcatgttgaaatgtaattcccagtgttggaggtagagtgttgtgggaggtgttttggtttgggggcagattcttcatcaatggcttagtgccaactccttgatgatgagtgagttcaagttctcactcagttcatgtgagatctttttttttttcaaaggatgagcaccccctagcttgttctgtctcttatcatgcaatgtgctggcttcctctttgccttctgccatgattgtaagctatctgaggcctcacctgaaggggagcagatgccagcaccatgcttcctatttagcctgcagaactgtgagccaattaaatctctcttcttgataaattacccagtctcaggtattcctttataatgacagaagagcagactaatacatatggcagctgtaattcatctatattaaaaatagtagtaacatgcagctagagtaaacagtccaatcaaaagtcagagtttgtaatactggataaaaagtaatatgctattatgtggtgtgaataagagacacagtggagtttgaaggatataaataggttgaaagtaaaaggataaaaacagattaaaaataaaaaacatgcaaaaagcaagaattagaaagctagagtgactatactaatatcaaacaaaataaactttaaaacaaaaaatagaggtcaactcaagatggattaaagacttaaaactaagacctcaaactatgaaaattctagaagataacattggaaaacccgttctagacattggcttaggcaaagacctcatgaccaacaacccaaaagcaaatgcaatgaaaacaaagataaataggtgtgacttagttaaactaaagtacttctgcacagcaaaaggaatagtcagcagaataaacagacaacccacaaagcgggagaaaatcttcacaatctatacacctgacaaagactaaaatccagaatctacaaggaactcaaacaaaattagcaagaaaaaagcaaacaatcccattgaaaagtgtgctaaggacataaatagacaattctgaaaagaagatatacaaatggccaagaaacatttttaaaaaatgctcgacatcactaaggatcagggaaatgcaaatcaaaaccacaatgtgataccaccttactcctgcaagaatggccataatcaaaaaataaaaaaaaatagatgttggcataaatgtggtgaaaagggaacactactacactgctagtgagaatgtgaactagtacaaccactattgaaaacagtgtggagagtccttaaagaactaaaagtagaactaccatttgatccagcaatcccactactgggtatctacccagaggaaaagaagtcaccatacaaaaatgatacttgaacacgcatgtttacagcagcacaattctcagttgcaaaaatacaaaaccagcccaaatgcccatcaatcaataagtggataaagaaattgtgcaacatatatatgtctatatatgtatatatatgtgtgtatatatgtatatatacacatatatacatatacgtatatgtgtgtacacatatatacatatacatatatgtgtgtacacacacatgtgtgtacatgcatacacatgcatacacacatatatacacacatatatacacacatgtatacacacgtgtatatgtgtgtatacgtacacacacacgtgtatgtgcgtgtatacgtgcacacacacgtgtatgtgtgtgtatacgtacacacacacgtgtatgtgtgtgtatacatatatacacacatatacatacagatatacatatatacatatatacacatatacacatatatacatatatacatatatgtatatatgtgccatatatatgtatacatatatgtgccatatatatgtatacatatatgtgccatatatatgtatacatatatgtgccatatatatgtatacatatatgtgccatatatatgtgtatatgtgccatatatatgtgtatattatatgtgtatatatgtatatacatatatatgtgccatatatatgtgtatattatatgtgtatatatgtatatacatatatatacatatacatgtgccatgtatatacgtgtatatatatatgtatatatataacactactcagccataaaaagaaacaaattaatggcattcacagcaacctggatggaactggagaccattttttgaagtgaagtaacttagaaatggaaaaccaaacatcatatgttctcactcataagtgggagctaagctatgaggatgcaaaggcatgagaacaatacagtattctttggggactcagggaaaaggatgggaacaggttgagggataagagactacaaactgggttcagtgtatactgctcaggtaatgggtgcaccaaaatctcacaaatcaccactaaagaacttactcatgtaaccaaataccaactgttcccccaaacctagggaaattaaaaaaataaaaaagcacaatgagttacttcactcactaggaaggctataagccaaaagacagataataacaagttttggtgaagtagggagatcgaaaccttcctataccactagtgggaatgtaaaatggtgcagctgctttggaaaacagtttggcagttcctcaggcagttacatatagagttaccatatgtagtagtaccagcaattctacttcttggtttataccaaagaataataaaattatatgtccacacaaaacttgtatgcaaatgtttataacagtattattcataacagtcaaaaagtagaaacaatgcaaaccttcctcaactcatgaatgaacaaaacccacacaatgcaatattacttagcaataaaaagaaatacaatactgatacataatatgacatgaatcaccttgaaaatatgctaagtgaaagaatccagacacaacaggccatatattgtatgattccatttttatgagtaaacaaatgtatgtaaagagaaaatagccaggtgtagtggctcatacctgtaatcacagcactttgggaggctgaggtggggggaccactaggtcaggatttcaagaccagcctggccaacatggtgaaacccagtctctactaaaaatggaaaaattagctgagagtggtggcgggtgcctgtaatctcagctactcaagaggctgaggcaggagaatcgtttgaacccgggaggcggagaggttgcagtgagccgagatcactccattgcactccagcctgggcgacagggcaagactccgtttcaaaaaaaaaaaaaaaaaaaaaaaaaaacaaagctattgggacaagaagtagattagcagttgcctaggcctaaggaggatggtatgcctgggaagtgatgactaagcaaagtggagtttcttttgaggtaataaaaatgttctaaaattgatacaaatgtgagaatcttgagggtattgagaataaccaacaatctaaatatctaggtatttttttataatactaattttaggttttcagcatggattaataatgcaaatatcttaagcctcaaataaacatgataatcttataatgaataaattgtaccttatgaaacattttcttaaaattataatatttggagcggggaaccaaccggaatattttaaaagtgatgtattcactgctaagagctagtggatttaagcttcaggcctggctttactactaatttactctgtggccttgagaaatctcttttcttcattgctgttttgttttctcacctgaaaaatgagtagaatgggcaatatatcttctcaggtttatcatagctcttgggttctgcgatttcacaaatggaagcttagtcacttagtttggcagaatagaaaaacacttgtacattctatttgtttagcatatggtgcaaatacattcaccagttgatattttattttggtcctatcactaggatctgacagatgattattgaaagagtgtttccaatgtcaaaatgtgccaatgtcaaagtgtttttcattggcctggcattttgcgtgccgtttaaaaaattaggatgaagatggtgaatcagctcctttggaattaatatccagttcaactaaaaagtaagagccatggtcttgaattagatactagattgactcagcagcccctggaggaattatgtgatgctgagggtggcagttgggaactaggaatgcagttactcataccacggtaaccttaaaatatatctcggaattaggtgctgcagaggattttgggagaaaaagataccagcgactttttgaggttgctggggtctttttgtttttttctgtgtttgtttacttttggtttttacattttaaatattgagaagaaatatgtggggctttaagcaacaaaatagtgatgctggggctgaaaacacatagccagaattgcaaaatcaaaacagctttgataatcaatttaagatgaagggtgagggagaaagtgtgtttctcaggattatagattggaaaaacgtgtagattccgtagattccaaaactgtcaatagaaatgggaaatttgaaagacagaacatatttttggacatctacctttagtcatgttgaaacaggacattttggccacgtgcagatgggaatacctaacaggcacttgggcatcaagtttacagtccagagatggtagttatgaaaagatagccgtggctgaaaccaggggatatggagtgagggcagtgagcgagaagcaaccaggcttttggacagatctttgggaaacatcacattaaagtgcctggtggggaaaacagaagttcaggttagagacaaaaaagtaatgatcccaaaggcaggagaagaattaaagagagactagtgtttttaaagccctggagaaatagctaattttcagaagctgtgtgggggtgtgagttcagttctaccaagagctaagtaatataagcagtgaaaacatgtcagtagatttggtgacactaataagagaaatttcagcaaaaatggtaagaaacgtgagctagagagaagagatagtatactttttaatttttttttaatttggtagtaaaagaagggacatagtggcagtttgacagggagtgaaggtcaagaaaaatattatttatttttttatttgctttttaaaggacagttggagaaacgtaagtatttgttggatggagaactatatgcaagaatataagagtgtagtggtgaatagcactttcattaacaatgatgaccatttgttgtcttttgtgatagagcaattttgaaggagcatgatattaaagtaattgagaaaccagctgtcagttcccaataaagtaagggcaggaaattacagtaagtttccaggaattaatctgaatttaaaaatttggtgtgtctctcactgaattgtcctgaaggagaaatgctttaaagtgttaagtaatgtttaaaaattttgcatgaacatgggtggattgaaaacatcagcaagaacttatggggcagcaagtgggtaccaggggacttcagactaataaaacgtgggcaaaggaacatagatgtttgaagaatggcaagcattctaatgaaaccgggaaaagggcagtgactgggagtgagggctgatcaggaggcagtatggagagggcagatgtagaagactttgaattggatacttgggtgcaattatacctactggattaatttttatcttttggatcactcttttggttgagttttcatgaagtaaactgcttgcttatcagagtcacagtttcaacagaaatatacaccagtccctcagtgtacgttgcagactggttccagaacaaaaccaccaccccgacaagcccctctccctgcccttgagcacgctaatatctcctgcatattcaagtcccacagttggcctgggaggaacttgcccatacgaaaactgcatcccacgagtactctattttctatctgagtttggttgaatgaaatccacttgtaagtggatctgttcaattcaaacccatgttgttcaggggtcaactgtgtgtgtgtgtgtgtgtgtgtgtgtgtgtgtgtgtctgcgtgtgtgtccactaacattacagatgctgtggtgctgctgggtgccgtctggaatatgaaatgaaagcagtctctggtctataaagaagtgtaatatgtaagtttgcaaagacagaaatttcccttctgcttttagcactttctcatttcctaacaaaccactagagtgagcttgtcttatttttacaaaagaaagaaatcatactctggagtctctaaactaaaaaaaacatacatcctgggggtgtcactagtcagatccatctttaattacttctattttaaaaatttaccctgagaatctaggtgtttttcttttttaagctatcacttctaactagttttcctaagattttggaagaactgattaagacagacatgttaatccaaacaaataattttgctgaagagaaatagaaaattatgtagtcagtatccttgaagtttaaaggtattttaatgagaaacattgtttattattgtttttcttgattgacaggctttcctctcagaggataattgctataatcacaggaattgtataaaatttgaaacttgaagctattctgagctattttaataatgtactcttttgtcaaaatgaattaaaaaatagttgagaaatggtataaaaacccaagttttaaaaacacacttcgatttattcatctaattatatttctagcggcaaaaatgtccagatacataaaacatttcattatatatttgaaactaaggcttacatctcttgctattttggggaccctgggacatgcagattattgactgagcacttcttttttatttttattttggtgaaatgcatcatttattttttttcaacttttattttaggctcagtgggcacatgtgaaggtttgttacatgggtaaattgtgtgtcattaagatttggtgtgagaataatcccatgacccaggtattgcacatagtacctgacaagtagttttccatctcttgcctcttcccacactccatctctagcagtctccagtgtctgttgttcccacctttatgtccatgtgtacccaatgtttagctcccacttctaagtgacaacatgtggtagttagctcaggacaaaggcctccagctatatctgtatctgcaaagaacatgattttattccttttatagctgtgtagtattccgtggtgtatatacaccacattttctttacccagtccaccatagatgggaatctgggttaattccagatctttgatattgtgaatagtgctgtgatgaagagacgagtacatgtgtctttttgatagaacgatctatattcctttgtgtatatacccagtaatgggattgctggattaaatagcagttctgttttaatttatttgagaaatctctaagctgctttccacagtggctgaactaatttgcattcccaccagcagtgtataagttttccctttttttctgcaacgttgccaacatattttttttttaaatcttaacaaatggccattctgactagtgtgagatggtgtcttattgtggtcttgatttgcatttctctgataattactgatgttgagcattttttcatatatttgttggccacatgtatgtcttcttttaagaagtgtctgttccacatgcacacatatgtttattgtggcactattcacaatagcaaagacttggaaccaacccaaatgtccaacaatgatagactgaattaagaaaatgtggcacatatacaccatggaatactatgcagccataaaaaatgatgagttcatgtcctttgtagggacatggatgaagctgaaaaccatcattctcagcaaactatcacaaggacaaaaaaccaaacactgcatgttctcactcataggtgggaattgaacaatgagaacacatggacacaggaaggggaacatcacacaccagggcctgttgtggggtggtggggtgggggagggatagcattaggagatatacctaacgctaaatgatgtgttaatgggtgcagcacaccaacatggcacatgtatacatatgtaactaacctgcacgttgtgcacatgtaccctaaaccttaaagtataaaaaaaaaaaaaaaaaagtgtctgttcatggcctttgcccattttttaatggggttttttttgcttgttgatttcttaacggggtggttttttgcttgtttactttttaatgtggttatttgttttttgctttttgatttctttaagttccttatagattctgaatattagatctttgttggatgtattgtttgtgaatattctctcccattctgtaggttgtctgtttactttgtttatagtctctttttctgtgaagaagctctttagtttaatcaggtcccacttgtcaatttttgtttttgttgcaattgcttttgggggcttagacaaaaattctttgtcaaggatgatatccagaatgatatttcctaggttttcttctaggatgtttatatttttaggtcatacctttaagtatttaatccatcttgagttaatttgtatatatggtaaaacgtaggggtctagtttctttcttctgcatatggctagtcagttaccctgcatcatttattgaacaggaagtcctttcctcattgcttgttgtttttgttgaagaccagatggtggtagatgtgcagctttatttctgggttctctattctgttccattggtctgtgtctgtttttgtaccagtaccatcctgttttggctactgtggccttgtagtatagtttggagttgggtaatatgatgcctctggctttgttatttttgcttagaattgctctggctattcaggctctttttttggttccatattaattttataatagtttttttctaattgtgcaaaaaatgacattgataatttgataagagtaacactgaatctatagactgctttgggcagtacggccattttaatgatattgattcttctaatccatgagcataggatgattttcccatttgtttgtgtcatctataatttatttcagcagtattatgtagttctctttgtagagatctttcacctctttggttagatgtaatcctaaaatgtgtgtgtgtttgtgtgtgtgtgttgtgttatttggctctcatcttgagtattattggtgtacagaaatgctactgatttttttttgtttgttttttttgagatggaatctcgctctgtggcccaggcgggagtgcagtggcgcaatctcggctcactgcaagctccgcctcctgggttcacgccattctcctgcctcagcctcccgagtagctgggactacaggcgcccgccatcacgcctggctaatttttttgtatttttagtagagacggggtttcaccgtgttagccaggatggtctcgatctcctgacctcgtgatccacccgcctcggcctcccaaagtgctgggattacaagcgtgagccactgcgcccggccctggaaatgctactgatttttatacattgattttgtatcccgaaactttattaaagttgtttatcagctctaggagcctttttgtggagtctttagaattttctaggtatagaatcatatcatcagtgaagaaaaatagtttgacttctttttttactatctggatgccttttatttctttctcttgcctgattgctttggctaggacatccagtacaatgttgaatgggagtggtgagattggacatccttgtcttgtttgtcttgttccagttcttaaggggaatgcttccagctcttgttttttcagtataatgttgactgtgggtttgtcagagatggctcttattattttgaggtatgttactttgatgcctagtttgttgagggtttttatcaggatgggatgttgtattttatgaaaagctttttctgcatctattgagatgatagtatggttttctttttaattctgtttatgtggtgaatcacattaattgatttgtatatgttccaccagccctgcatcttaaaattaaagcctacttgatagtagtgaatcaactttttggtgtgctgttggattcagtttgctaatattttattggggtttttttgcatctatgtttatcagcgatgttggcatgcagtttgttgttgttgttgttgtgtgtttgccagattttggtatcacagtgatgctggctacatagaaagagttaggaaggagtccctactcctttattttttggagtagtttctgcaggattttggcaccagctcttcattgtacctctgagagaatggccaagcactttttataagagtggcccagagctcagcccaagccgctttctctatctgcacattctccctggttggctgatctttactttctgatggtcactctgaagaccctaaaatgtctatctcttgccctgatattgccaataactccaacttaacactcaactattttcttgacttctccatttgaatgactaaagggcatccagcatcatccccacttcctagctccagcccattcttcccctccttagtcttccccttccatacactagaagcatccatacacctaggaactcaagccataatcattgtagttattcctgatttctctcttttcttcatgtaattcattaacatatgctgtttaacatacatgtacaattttgtagcctactttttatatacagttacattattggccttaatttccatgtgcttaaatatttcttgcaaatctagtttatgaaggatgcatgagtcttcatgatgtagatgtccaaagtttatttcactattcctatactgctgggcatgtaaattctctcttaagtcttgccatcacctgctgttaagtatattgaatacttatctgatgctcactgtgtgtaggcactcttctagcattttaccagtgataacacacttaatccttgaatctatgaggtaaatacaattattatctctattttgcagataaggaacctgaggcagagaaagactaaactcactcaatattacatagctggaaaggggagcctatggggttcaaaccagtggtctgactccagtcccaggttctaaattgaaccattctgtttgcttagacataccatcttgtaccataaccatattttataccagtctgcatgcaactgtggtcatttctttaaaatatgtctctagaagtggatcagtagtcatacatttaaaatgctttgtgtgaaacatattacaaaattatcctccagaaagattatacaactttatcaacttatactccccctgtcagttgctgagtgtcctctgtactgtgtgtacattaacattgggtgtagtaatttcaaaactcttgagcaatttactcaaaataaatggtataatagttatagttgcatctctttgattaccagagaagcttatttttctcatgcgtatgctaacaattgtatcttttcatatggcttttgcaaactttgctactggaattttcattttttcatattgtagtacagaaactcattatgtattgagattaatacttgagtttgtcaaatacattgcttaccttttttttttaaacacacttgtcatttggtttttaaattatgtttatgttatttactgaagtacagacattttaaaatttgtttctgcagctgcatgatacttaaatagtcatagagacaatcacctatatttcactataaattaattttcatcctattaattattgggagtctcactctacttacttaatacttagatatatattgtaattctttgagcaagtaaaacaaagtcattgatcttaattttacatgtagaattctacctacaaccataagatctaattcggagtccattttaaataaaaataaatttgtaaaaactttttctttaatagtttcaggatccaagatgttgataaacgtatggagtaagtctaaagcctgcactccatacagtatttactgaatatactctaaattaatgctgcattgtttggcaatccacttcaagtttagccttcaagttgtttactaaaaaagttcctcaattttttttgttgtttgtttgttttgaaacagggtctcactctgtcaccccggctggagtgcaatggtgtgattatagctcactgctgcctcgaactcctggcctccagtgatctctcaccccaacctcccaaatagctgggactacaggtgcttgccaccacatccaactaatttttaaaatattttgtagagatggggcacttgtttcttttgcccaggctggcctcgaactcctgggctcaagcaatccttctgcctcagcctcccaaagtgctacgagtacaggtgtgagccaccgcaccaggccccactcttcagtttcatgtttcacttttcttggtttctgtttcttccacacaaccttcacagatgttgagtcacctggctgctgtgatgagtgactctcttctccaccgatgttctgtgtcatgcttttcccccaaccccccacagaaacctaattcattgtcttcaagtggcttgataaagtttagtagaaatttcatttgactgaaagtcagaaagtttcttctgggcctgctggatttgctgaggtgcctcaggaactgctgcaaagggaaagccacacagatgggcttggggtttcccactctgcctcactcaactgccttgctttatttgttttctctagagctggattaaggagcaagcctcccaagtaggtcccttctgcacccacgtaagggggatggacacgaaaattcttgaaaatatgttaaaatggaagaaacagaacttatccaagggtctctctcagagcgtggtactggctgaagttggcagaaataagccctctctggtgggggctgggagctgcctctcactctgccctccgcagcctgctgcttgctcaggtaactcttgatgcttaaactgattcctaaagtgagtgggtccagccgaatacaggacctttattttgctcagaggctggatgacttctgccattagcatttgataggttcttacttttctacagacagcatttagctcctccttaaaaactgttaaataagtatttaaagaattaattcagtaccccctgtacaatgggtactgaactaagattcctgcaggtctgggttcaatcctggttttatgtatttacattccacactgaagtgtgtagaaattaaggagaatcatgtctgcaatccattctctggtgtttccatttaacaaaattatatatgtacattttcacagaaacacatgtacatgcagagaaaaggataaagcaaacgtggaaaaatgttaaaatttgaggagtctggggatcctctgcactcattgcaatttttcagtaagtctaaaattaaagaagtaataattttgaaacttgatttttaaagaaaaaaacactaacagcttcttgaaaacttcataactatctgcactaggtaatttaaaatgtcctttcacagttctataattattatattatatattatataatgattaaatattatatgttatatcattatattatatattatatatatcattatattatatattatatatcattatatcatatattatataataatattaataatataatattaaataatttaatattaaaataatattaaataataatataaatatcattatattatattattatataatatataattcaaattattcaaatataatatattgtaatatttctttgatcacgtgagtctagattcttccatagaacaacttatcaactgtggtgtttgtcaaatagggcttaggtatatttggagaaataatataaaatacgaattatatgagatgtcatttgtcattgtttccactggatttcattagcacagaagactcacagagcagctataaaacatctcagttttgcaatatcatgtgaggaatgttgaaggctgcttgagagctttatttgcttgtttacaaatttaaggcagatacaacacatttttaaatactgtgattcatcaattaaagtgcatgctagaaaaaaggtataatttgtttgggggatgatagctggtagtcttcaaataaccaatacgaaaacagcctgacagtaactatgaatagaaataatgtgaatggtcaaggtaatgttaatgaagtattaaaccaaaagatgttttctgaaaagtcaaaaattaaattctagtaaacataaaaaaacagtggaagatttttaaagaactaattttgcttgctttcttttctttctttttcttttttttgaaacagggtcacactctgttactcagactggagtgaggtagtgggatcatagctaactgcagccttgaactcttgaactcaagcaatccttctgcctcagcctcctgagtagctgggactacagacatgcaccactatgcccagctaagttttaaattgtatgtagagatgggatctcactatgtcaccaaagctgctcttgaactcttgccttaagaaattctcctgcctcagcctcccaaagtgctgtgattattggcgtgagccacaatgcctggcctaatttaacttttaattaaaaaaaaagtcaagagtactgacaagttcaattcctaccacttacgtgaaggacctctatcaagataatgtctcagctgttgggttttggagattggcttccaattccattatcctacccctcatttcctttcttttaaataatgaggtttaaaaaatgccatgaaggttagtatatattttttcagaatagcaaattagaaaaagaaataaaattatattgtttgataggagactttaattagaaacacataagcacagtttttatatttgatactgatatggtttgtgtgtgtccccaccaaaatctcatcttgaattgtagctcccataattcccatgtgttgtgagagggacccagtgggagataattgaatcatgggggtggtttcccccatactgttccggtgacggtgactaagtctcacaagagctgatgtatttataagggatttccccttttgcttggttctcattttctcttgcctgccaccatatgagttgtgccttttgccttccaccatgattgtgaggcctccccagccacgtggaactgtgagttcattaaacctctttttctttataaattaccaagtctcgggtatttctttatcagcagcatgtaaacagactaatacacatagcttttgaaaaactactgaagatgtcttcagggggcttctgagccagacttcctggatagcggttcctgttccgcatgcctatcatatttctagctgctccaaactgctcttcactaagacttcttatattaaccgtgaaatgagtgcggtttcccactgaagaaatgactataactcatcatttgatgcttgagaacaaacaggggtactgaaatatgcacacaaccctctcaatattttccaagtctgagattgttcctcaataaaaatattatgtggacatcttgaattcaggaaactttgctacctctaacatactgagatcaaagaaaccacacatctaaacactagaagttcattacagtgaataccaaaccaatcacaactggatatgaaaacgttggctactaatttaggtcaggatgaaataagttaaagaagcaagaataacctggagctgggtccccccagagttatgaactggttacaaagcaataataactgaattactacaggttcctcagattctcttgtgattatatgtaaagacatttaagtttgggatgattttataaaactattcttaaaattaaactttaatgagaacattattttaaaatataatctattttccctctttaaattatactttcatttgcatgctggtgtggagaactggttttgaaaaggaattaagtccttattccttgacgattttggtcactgcttctgtgtagctattttgctcatgaattccttgtcctagtccatcacctctgtggtttacttctatttcttctgtaggtaataatttccctcaggaatgtgcaactctggacatcaaagtttcttctacccatcctagaaatatgtgccaagccagaaagacaggggatttggaaattaagaaaagcaactacaggacacttttgagagattagggttagtttttcatagggaccctgaaatttcctttaggtttagagtcctggatactttttaaaaatgttttaagttttaaattgacaaataaaattgaatatacttattgtgtacaacaagctattttgaaatatacagtgtatacattctggaatggctaaattgaactaatgaacatatgcattaactcacgtagttatcattttttttttggctgagaacacttaaaatccattcttttggcatttttcaagaatacaacatattgctactagttatcgtcaccatgttctaccatagacctcttaaacttatcccttcaatctaaattaaattttgtatcctttgactaacatcttctcaaccttccctgaatccattatctcagcccctggtaaccaccattctactctctacttttatgagttcaacttttttaattcaatttttcatttttgtggaagtttcagttattacaaactattgggagcaaatgaatcttccaatatgcctcttacttttgtataggtttttcccattttagaaggattagggagaatcataaaggtgggataaaccagctgaaccacactgataccatctgacactataaagggactacagatttaaagttagcattctcattgtaggtctgaaatccagacccccaacatatactctttgcctttcactagacaatttttagtacctcaactttagtgagttctcctgagagactttttattaggagctgttcaaatcacaactttgaccaaagcgtgtctgctgatagcttttcctctccattttacaatttatggctgtgtaactagagatctgtatctgcaaatgcctgaattttccaactcatctcagaactgaatttgcaaagaagatatcacttaaatttttgccacttaattctttgtgttttccccaaggaatcctagccagcaactaattttctggacaagggatcaaaagtacgaaaagcagcagaatcataaacttttgcctaaacaaagggattgacttaaatctattgaatggactgtatttctgtgcagtgtgaaatgtttaacatcctctgtctgccagttctggttctttagttctgctcattatatataaaaagccttgctatcccatattcagcttccttttttgtttcttttaacagaaatgctggcatgcaacttacctccaggaatagctcagagctgatgctctcaatttagtcatgcgaattacattacatttttctcctctttggaaacactctcccccaatctctgtaatcatgaccccattagagctaggtgatttcaatcaaaatgaaacatatagttttctctaacatataggaaggaacatattctacaataatatctaatcacattccaagctgaaagaattatattgtttttctggaagaatatcttttcccttggaaaagaaagttttgtatgtaaggctcagcgtcaatatattaaaatgtatgactgtttatttttttaggttgaaaagtttttttcaaggttttcaaataatgactgtaacatataagaatgatggaacatttgtagacacttttcatattagaaaatacctactagcaggtgatataaaatatactgaaaagaatacaagagagttgttgaatggctttctacttctcatcatacaattctatttctgaatctttttcgcagtcatttttgtaaatataaacattttttctattagataacttacctgttaaaatgagcaaaatggggatacaaacattagctctgaatgctattttgttaactgtccatataaacccgctatgtattttcaaaggaatattttctcaacttggtatttaatgaattatgaaacttttggtcctaaacatgggtacatgtgcccgcttccctgctttatcagacaacatcccaagaattctgtgtacttacagaagcacagttttcagacttgtcttctacaaaaccaatttggcagggcatcctctgattctgcaaccagtagtctgttgactccagcaggctattgctgcgaagaacctggaggaacccagaaaaactcagttcttattcggcaatcctttctatctaaacagcagctctctctcttttttttttttcttataaaaaaacctgtaggtgttttcttttcctcagagcttctgggtgttagaaaaaaacttgcaggatgatagcacctctaaaatgtataaaatatccaacctagaattagcttgagagaaatacattaatgttaacacagatgttctctcatcaaatccaacacctggaaatgtcaattgtgtagcttttgcataatttgcaatcaaatgattgttttgggggtatggctatgtgggcaatggggatcaaatttcatttagtgctagtgttctttcacactccataagtattttcaattaacaaaatatggggtttttcattgatggaatattgattcttcacttctttggttctgctaacttagctttgaactagtgtacaatttttctagaacacctaaggtactatgttaagtttaaaagttgttagaaataacttataaacaaattacattaaataccatttgccatttagaaatagcacggtatggcaaaaataattggaatacatgaattaacaaaaccaaatatgactgacaaatatctgatttctggtcttggattcttaaagcaaggaagaacaagcatattttggagctgagatattttgaagatgaaatattatcaataactgctaatgtctttaaattatccaaatattggctgggcgtggtgggttacacctgtaatcccagcactttgggaggccgaggtgggtggatcacctgaggtcaggagtttgagaccagcctggctaacatggtgggacctcgtttctactaaacatacaaaaagttggccaggcgtggtggtgcgcccctgtaatcccagctactgagacaggagaatcacttgaacccgggaagtggaggttgcagtgagctgagatcacaccattgcactccagcttgggcaacaagagtgaaaatgtctcaaaaaaaaaaaaaaaaaaaaaagcctaatattgtatcacattttcttcatcttttaaaagattcccagtgcttttctggtaccctctattttattagggtacgtgtctgctaatacttgactactactttcactgaagcaacataacagatttaatcagtttggttaatgccactaaaataggatagtacttcaattacatttcattcgtacaacaaaagattgtcttctctttttctgtaaagacagaaatacattacttttagtctctgaatacagttaactaaatctaattgtgacacattttagatgagtaatattactcatctaaaaataatgaaaatttattaatgataaatgttatcatttataataatataaaatataatcgcatatcaaaatatcatttattatattagtgataaattttcattaataaattttcatcattctttctcagaacagtacaaagagaccctttgtggatgagcaagtaattgaatgataaacttggattattactgcagactgacgttggctagggaacctctcagttctcttaaatattttacctaaactggttcttaaagcatgggctaggacctatcagggtccctgaaatctttcagagagtgcagcaatcagactactttgataataatactaagatgttatttgttctttttgctcttgttgtctcatgtatattctgtggagttttccagaggctacatgatgtgtgacagcacaacagactgaatgcagaggcagctaggacagctcagctgtcttgtatcaagtcagacattaaggagatttgcaaacatgtgaattgaaatcactcttctcgctaaagggttttgttttgttttggaaaacaaatatttttcttaaaaatatgttatataggataatgtgtttattattattttaaaattattttgtcaaataacaaattcttatttatttaatttaaattctgttttatttgaaaataaaataaaaaattttcttagctttaatttgtaatatggaaattagcaataagtataatctctctaaacgagagtttcttgaggtccctaatatttttcttagagtgcaaaagaattttgagttaaaaaacattgaaaaccattgacctagatgaactttatttaaagcagaaaaaggctctaaatccacttcactttatgccattcacatgcctttcccttgtatttcaggcatagaatagagtttaagagcatcaacattactggtctaactgagttgaaatcctaacttggtcattagtagcaggatgacctcaaacagatgacttaaaccctgaggttcagtttccacagctgtgaatgcaggtactactcatctggtgggatcactgagggtattcagtgagatgatatatgtgaaacactgtgccatggaaacggtaagctattctctcagaacttgggttttactgttactatttgaaggtggctgaaaaggataatagaacattggatgccttctgtctgaaatgacaggactgaaaatatttcagatgtgtgatggcaaattttctttagcaaatattctggtctaaggtgtaattttagttatgcattttgtagtattaatagttacagctactatttttgcatgcttagaatatgttgaagttgtgctaaaattttcctatatgtatatttttactttttcatttaatcttttttgcaatgccctatggtaggaattattataaagatacaaatctttacagaaattttcaggttgaaaatgaagaccttgagtctcagagagatatgaatttctgccccaaattgttcagagcctgactttggatgtgaaattacagaagagggctgtcttatatacccatacaaatgggtatgatttggggtaggtttccaaaaacttatctgcatctatttttttttgtaaataaaactacattttcttatggacttccattttaaagttagttttccattaatgaaattctgaggtgacaattttcttgaaagagaggaaactttttgtgatgtaaattatataatgtaattaatctacttggcaagtattatcagtattttaatttctcaaaggaaaggatgcttttacacctacttgagttatctttaagccaactgatgttatcatgcttctgctccttgcctttctgtgatccctagattttggaacacccatcaataaaacaaagcactcattaactctgtgtcataagaacattaaagatttaaaatacaggtatcatcgcttcttggccttttggctaagatcaagtgtaaaatacaggcatcaaatgaatatactagttaataatgtcttacaatgcagtttaacaaacattctgactaagaatcacttcttagtcattctagagctcactactcaaaattatatcctgcaccttgtctacattctaagatatttaggacacataataccatggttacaacaaaatatttcaacagagaaaagcaactgtcacttatcggtatcagccttaggaaggtgacagagttcgaaacgcaattcacttggtgctttcagaaaattggtgtgctgggtgggtacattttcgtggtgaaacacagacaggcagagggggacttgccaaaagtcatcagtctgaaacctcccactgcgaagattccagagctatgaaaggggctgtctgcagaccaggctagttgggagaagagctggctacctgtgggatttcacctgcacttaacttctctaacagagaaatgtgcacagacagattaatctgccgagtcctcagcagatattttaaagattttttttgaacctattttaaaaataaataactaaaaatatacaaagatcttgctctgtcctatcctagaagtgaggaaaatgtgaagtgctttagagacctgctcattcaatgaaaaattctagaaagatttctcatttgactcttccatttccctgggatactgtgcatctttcctaaagcacatctttgctttagaagaaacggaagcagcagaataaggaactggaatttaaaataaaacctaaatcttgccgtgcttaagaagaaatgtttggacgagagcttctttgtttggtgagaatattcatttgccacatacatgcaactttaaaattttaattttatcatcgttaaaaattagttaatctgattatatcagtaattaaaataagatatatttttccataaatttcattaacatttagatgattcattattaaatatttatattctttaattattgaccaaatagtagtacatttattgagaactgtctgggctaacatcctaacctacactattatctgaattaaatttctaggcttgtgaggtaaattctcaaggctaacatagataaggttcttaaaacagtgcctggtgcatcctaagtgcccgataggcattagctatcatcatagttactatttcctttgcccaggcttagagggatcaatactttatctagtttttgcagaacgagaatttcagtcaggctcccagacattagagcctccactaaggcagtgttccattgaaattatatagcttctcattttcagcttctaccaaatcccagtctatgcatttagccatctctctctctctctctctctctctctctctctctctctctctctctgagctcaggtgtgttcaggaggtttgaattccagtcctgactccttgttaactgtgtagttaagtccactagctcccagcctccctttgcctttggtaaacaattaaagcaaatgatctgaaggccacttctataccaaataccatgtaagtctcctcctcccttcctcttttgctcctcctccctctccctttctcaaatagtatgcattgagagccaaataagtaaaagagaataaaaatgcagacttcagtaaaccacttagcatcatatataaagcaattttagcctgtgaaaagcttttagtttcatggcttggacaaatcattaggaaaagaagaatgcttgaaggaagaatatgtgcttgagaattcaacaattttgaagctttatgaatatattctccctgctgagagagttgctttctgagaaggaaaagagaaaaactcaccaggctctcaatggctcatttgtctgctatttttagttatggacttattttagatgaagagctaataatgaatgttttgtgtgttcacaaatttgaaataataatggcacattttcttttcaaatttcatgagttcagcaaataaggttaggaagatccttttgctctacattacagttacgtttctttttatatagagaaccaagttgaagaaatttagtattgattagacagagagggagaaatagactttggacacagccccaaacatgactgagcaatgtcttaatattttttaagtaatttaaattggagaagacagtgactggtgattaatcttggaggtttggaggcagaactgaaattaaatcccatttcatcctactgaatgagcttgggcaagtcatttaacttctgtgggacttagtttttacgtctattacatgaagataattaaagacatttcagaagtttattctaaggatcaaatgagaacatgcttgtaaagggctagcctcaacagagtatgcaattgatacgtggttgctattagtatcagaaatgcaggaaaatttagacaatatctgtttcatcgaacattttcttggcctcttcacaacatttgacaattcctcttcttttatttataatttgtgatgtgccattctcatttttcttctcctacttctctactctccttcagtcaatatcagtcaaccaatgctcattgagcttttttgatgtcagcactgagaatattaagagcgataactcttctagagaaagaacaagcactctgactgtgataaaggaaatctggtgctttgatccaagacaatccaggtcagctatcaccaaggatggactggtcagttctccctggaggaggggatggcaaagggcttggcccttgactagagcgttgaaaggtggatttgtgttgtctggatgtatcagggcaggtggagaagacatgtctctcttttcctacccaggtgccataaatataagtattccttatagtttgctcatcagtgtgttggtgtttctactcccatcaatcattttccttatctccttatcgtttgcagagtctcagggaattaattaccacctggagggatgacttgctgatctgtagctccaggtttaacctttctgtagagcttggcttttcgcactcctgttagttattacttttggatttcttgctgtcaccttggactattcatgtctacacacaaactccctccttccccacttccagtgcctgaaagaaacctgacttcctgacttccctatttgcagttgatatcaggacaattctcccagttaccctggcttgaaaatttggtgctatctggaacatctctttatctatttcctgtcttacagtctgctctccaaagtttaatttggagagcaaattacttaacaattagcaattatttaagttctttcaattacttaaaaaatagcaattttttagtgcataccatggattactctccaggtaatacaacagtgagtaatatgtaaccagtctccatatttatggaacttaatatctggcatgggggccaaacagaaaataagggagcattgaagtacacacttaattacacactgtggtgggtatcatgaagaaataaacatagtgcagtgatagggaataaaagggatggggattgttatggtctgaatgtgtcttcctctctccccacccaccccaccaactcataggttaaaatcgaatccccaatgtgttagcattaagaggtaaggcctttgggaggtgattaggttaaaagggctctgccctcatgcatggaattagtgcccttataaaaaaaggcttgaaagctttttgcccttctcccatgtgaggatatggcaaaaaggcaccatctatggagaatgagccttcatcagacactgaatctgctgtcaccttgatcttgaactttccagcctctagaactgtgagcaataaattcctgttgtttgcagattacacagtttaacgtattttgtgatagcagctctgacaaactaaaacagagatgatacttgagaaaggaagttagggaaagctggacacacacaaaggtcctatgtgttcgtattgtaattctctcatctctctgtcttccttatctctgaaatccatctagctcactaaaaccaaaacaaagaataaaaatgtaagctttgaagacaaatctgatttcaaattccaattcttccattatttaactgttcaacgcaaggcaagtcacttaacttctttgagactcagttttcccgaaaatgagagtggtatttctactcacagtgaggaatcttttgcagacattagaaataatgaatgcacatagtatctgattatttcaagtgctcacaaagagcagctattgttattactaatattattactaatgttatataattctctcataagactttaacttcaattgactaactgatccaataaatatgactgaggaccttctaatcctgtcagaaactaagctaggttttgcaaaacaagacagagggacaatatttgctgtgggtgagcccaaagttttatgggctttttgccaaacaataggctagcattcaagacagaacagattctaattcagctctctcttgctaatcttttgataaacagtgactaaactccaatgtttaagatactgcattttgcccaatttagacatttcctaggctttgtctcagattatctccctccataaatgctctgctataatccacaggtttaataaacagctctaccatatagcctttatgatgcacacatttttttcatatcattccacctgctccctgaagttttcatcaatgttcttccccaaccctcaagatataactgaaactgagcctgtcccaatataaatatttctctgttcttgtaaagtctttgtaatacaaacaaaatttcttcctcagaatattggaaggtgcatgcttcccactatctatgagtattatgtaagtatatacgtattcaatttgtgtcccacacttttctccctacatgccattggtacagagcagctgcttgctgttagacatcaaaatctcttatcaacatatcttgaatacatttattagactctatacttgatgataactttggacggtgtgatgttaactttcgaatgagacacaaattattaatgaatgtgtgctggagatgtggagagaaaaagctagaggagcagtaaaataaagggagccagagaagcccattggaagaggcatgggcatcactcagaggagactctccaggctcctgttgtagttctaggctctttctagggcactcagttacattttcttacacaagaagactgcgatgtgagtggctcattggacttgaatagtgaatggtgaaaatggagaagagatgattggaatgaaggcaagtactaagacactttgacctatttgcttggcaagataatgacatctttactccaggtaacattttcttgatagagataccacattcctacagaattcactttttatgtgtaaagttctatgagttttgaaaaatgcacatgattgtgtaaccagcagccgaatcaagatatagaacagtttcatcaccttcctcaaatccatccttctccttttagttaaaggtatcctaagtcccagcccctggcaacaactgatctgatttctttcctttcctttttttttttttttctgtagaaggtgaataaagaaaattgcaaaattttattggttcattgaaaagaggacctgaataagtgaaaaatagtgacaaattaagggaaaaaattgtgacatactaagagataaaaagacaatattttagctttattctaatttattgatctgatttgtatccctacacaatattatagctttattctaatttattgatttgatttttatccctaaaatattgccttttctaaaatgttatgcagatggagtcctataatacgtagccttttatgacctgtttctttctcttagcataatgagtttgagattcgtctatattatcatatgcatgagtagtcacttgttttcttttattgctgagtagcattccattctgtggagatacacagtttttttttttttttttttttttaagccattcactagctgaaggaaatttgggttgtttcagtttggggcaaatataaataaagctgctataaacatttgcctacaggtttatgtctaaatttaaggttttgcttttcttgggtaagtacccaagaatgaaattactaagtcatatggtaaatttataagaaactgaaaaaatgtcctttaaagtgggtttaccattttccatttccaccagcgaggtatgagagtccaacttgtccctatccttgtcagtactcagtattgtcaatttttgcttttacatttattttagtaattctaacaggtgatagtggtatttctttgcggtttgttttactttccattttaagatatcttttttcttttcaagatacttttaaaataaaaaattaagcatggattccatattggctcatatcatattcaaaagtattagttagactctatatttaatgttagctttggaatgctattataaaacaaggataatgccatccatattaagttttcattcgttctttcattcgactacttgttaagcacctgctgtctgtactaggcactgtttatttaactggagcattggtgcacaaaacaagaataacaacaacaaaaaaaccattttccttttcattctgttgtaggaggacacgtcataatcacataaattataaataagcatatatgtcagataatgaaactactatgaaaataaataactattatgaaaataactaaagggataaggaaataaggggtgctattttgtaaagtatatcttggcaggcctttctaaggatgacattgagcagagatctgaatgaagtgagaagccagccacactcccatcggagggcagagcagcctcccaggcagagattactgaggaaggcaaacgttcatagcaggagtgtgcctggtgtgtttgaaggacagtaaatggctggtgcagaatgagtggtggaggaagtgatgggaaatgaaggttcccagtagtgggaaaagaatcttttatccttcattgaaaagacattcattgctgagctgggccagatattctttaatgtcttgaagcattctaagagtctacaaaacatttttagtataattttgcaaagtttagtcactggcttaattaatgcttaattgctgacttaaatattttataatagtttaaaagcctagtatacacacacacacacactctctctctctctctctctctctcatgctggactagaagtcaggaggtttcatgtaattttatacatttaacttcatgctgatttagcttacgccatagcaaactttctgagaattctatagtcttttgttttctactctgggatataaatacttttccattatttcacagggaaactgtgaaatgcctatttaaagcacactgaactactaagaagaaacaataaaagaaaatggaaataaaattattgtgtgaaagaaaaaatttggcatcagaaactgagtgagttagtctccatttctcagaaggtttaattaaatgttaggataacatttttctcttaatgatgattttattggatgactgcctgagtccttgtgtattatcctcctttgacaaaaaggagaaattgcttccaaagtatgaatattattttattattcatatgacatattctgtaattctatttggttggatgtaaagcattcatgcattataccattgacacctaagaaaatttagaaattttgtaactgattattttaaaagtgttgtaaaataatggagttcttttagctcttggaacaaaatgattctccgttatcaagaagaatttaccagatcaaaggtgtgattagttagaagggttgggaaggaaatggttattagtgagcctaccattcattctctccttttactgtgaaggggggtaggagggaagactaccagagaagagaaaaggtaaacgtgtcatcttatgataaacatacaaatgagtgaccttcagataaactaattgtgtttttctagtaggagagtccttatctatgaaatgctttttgcaatatatacctggtctaagtttgcttctggtaaataaatatggattacactgttttatggagcatttatctctgacaaatatcacataaggatataatttgagcacaaaatggagatgctttatgaacaaaagccctcctttcttcggaatttatgtccccatatatgtaatttagagactttgtatgttaccctgggccagaacgcatcctaagatggcaagaaatgacctgcatagcttccacacagtctcagatatctccctatttttcttgtgccactcaattactcatattctggaagctacactgtatcttaatgttgtcaaaagaataagagtacagaggactagttagagcttgggaactgatgaggactggaaaagaagtatcaagccacactacttctgtcatatcacacagatgtcagctggctgaagaaggctttgaaagttgatcagagctttatccatacgaatgcagtaactgcgtttgagtctcaagtataaaatgcaagagttacaaaaacagatacactcaggaaatgcaaatatagtataatttatgaatgatcagcaatggtttaagcagaatcaagttagacacataaatagaggacagctgattaattgttatttagagtcagcataatgctataatatttatactatcagtgaagggaatgtgattttaacgctaagtgaaggaaaatataagaagaaacacacatgtaggaaaatatatgaagtgcgtgaaagccttccattgactttggattattttgtgttggtatgcaaagtacaggtagtgaagaatttgccactagacaaagggacaatgaatttaatggccacgtatctcttgagtattggtgcatgcctttggactgtggcaattaaaatacaagtgatatggctggctgcagtgactccggcctgtaatctcagcactttgagaggccgaggcaggaggatgacttgaggccaggagttcaagaacaatctgagcaatattgtgaaaccctgtctctacaaaataataaaaacaaaaaattagccaggcatggtgccttgcacctatagtccaagctactcaggaggctgaggtgggaggatcacttgagcccaggagttcgaggccacagtgagccatgatcacgctactgcattccaggctgggtgacagagcaagacaaaataaaataataaaataaaataaaaaagagacagttctcttttctctgactcttctcttcttgggaaaaagctacaggaaacaactgccttttaagatgcatgcagatgggcacataatctgtgaagggatatatctgtttcttggatgctttccatcctggagagtatgagccctgatatgagtctttcagagtgagttcccttctcaaaaggcagagatgtgcctagtgaatgttagcatgcaaaggagagggctcattgtaagggatcatgagccagaaggtcccttgtagagacatgttccaatttatctgagccatgttattccttcccactttgacactggcaggactgaaaactggcactttaatcagaagggtgagtctggcaggatatgagaaagatggatgctatgaggacaggtggggaatgcagtgtctactccaggctactatgctgggaacttttcttagaggagggactgaaagaaaacagaggagaccttgaggccagtgatagggagcagggttggctagtctttttttttaagtaccgaaagataaaaaggagaatttttaatgccagattagatatattcaatgtaaacttgttgtgtttctggacagatatatttaatacacaatatataaaaggcctgggggaatgaccacaggaattcagaaaaacagatcacttgcctagttccagcagtgcagcatcagcctcaactccacaaaatgttctaagctatttgaagttttcagagtccccccttttgatttttttttaaaaagaaaaaagtaacagcctgcaggttccttccaggggctcttcacacacagtgaaaatgatgctcaaggaactgagctatagagaacagaacaaggttggcatgttggactgtcaccactgtacagaaaaaattgctggaggcaacgagaagtgagtggagttcagagtccagaagagaagtcctcaaacagactgacttcggaataagaagctgaattgtattcaaactgcaaaacaaccataactggtggcttaaaattttcccacctagggtcaccacattgacatcttctagaggatgagctgtccatgcaacacaggcagtcccacctctctgtttctgcgtggacctggttgcctttaaggcgagagaagccattcttgacctgcttttgctgaaggaagagaaaatgagcccttaatcaaaggttttattacttgcattctgtcctcagtacaaccctgatgttgatgtggctcagggcatacagaggttttcttagatggtgaatgaaatcgcctccagagggaatgtggtggctggctctgtagatgcaactgggctgaatctgaactcatggcttctcctctctgtctcccagtgcccccttcccaatggtctcagatgtaccaccactcataaacatcttagcctaagtagtcattctcctgttcagcccttacggccaaagagtcctcctgatcttgactgccaaaggtatctcacccaggtttctttttctctccatccactacccctacactggttccacctcccctctcctctgctatccctatccccatccagtattcccctcctgggatcccagattgcaagctgtctttgttttaaggaattctcttgaaaacgatcagattagctttccttaaatgtcacttttagtaggataattctctatttttttcttaaaaatatccccatttcttcaatgcttctgattactcttgcagaatggtgataaaacagaacatccagctgttttgcaaaaactggctaggccattctctggtatcagaaatcagcctgaagaccactgacaggctgctaggtcagaagagagtgtttgagacttgagagttgtttatactccagggggaaattcttgtgtcttccttctatagagatgtgaataagctcaataatgctgatctttctttaattttatttatttatacttaaagtccttgcttctttgagagaaacagcttctacaaatacagaatattatatctattttccatcatgtgaatatctagctttgaaacacagtgaaagtacttcttagcttctcagaattattggtggggctcttgtccaagagcaatgaaactctgactaataaaaatgtctctgtaggttgcctgttcactctgatggtagtttgtttcgctgtgcagaagctctttagtttaattagatcccattcgtcaattttggcttttgttgccattgctttttgtgttttagatatgaagtcctaatgggagaaaatttttgcaatctacttatctgacaaagggctaatatccagaatttacagagaactcaaacaaatttacaagaaaaaaatgaaacaaccccatcaaaaagtgggcaaaggatatgaacaaacacttctcaaaagaagatatttatgcagccaaaagacacatgaaaaaatgctcatcatcactggccatcagagaaatgcaaatcaaaaccacgatgagataccatcttgcaccagttagaatggcaatcattaaaaagtcaggaaacaacaggtgcaggagaggatgtggagaaataggaacacttttacactgttgatgggactgtcaactagttcaaccattgtggaagtcagtgtggcagttcctcagggatctagaactagaaatactatttgacccagccatcccattactgggtatatacccaaaggattataaatcatgctgctataaggacacatgcacacatatgtttgttgtagcactattcacaatagcaaaacttggaaccaacccaaatgtccaacaatgatagactggattaagaaaatgtggcacatgtacaccatggaatactatgcagccataaaaaatgatgagttcatgtcctttgtagggacatggatgaagctggaaaccatcactctcagcaaactatctcaaggacaaaaaaccaaacaccacacgttctcactcataggtgggaattgaacaacgagaacacttggacacaggaaggggaacatcacacacgagggcctgtcgtggggtggggggaggggggagagatagcattaggagatatacctaatgtaaatgacgagttaatgggtgcagcacaccaacatggcacatgtatacatatgtaacaaacccacacgttgtgcacatgtaccctaaaacttaaagtataaaaagaaaaaagtctctagagatatggatcacactgtgaaaaagccttccgatttgtatgcctgtgcctgaacacattaattaaattgctttcattaattacatcttatcaaaaagatatgagcttagatgaaagtgtattttgcagaataaaatgaaacatccggggacatccattctgtcattcttcaggtatatctttgccactgtttacagcaaatttaagtctgtttaaaggggggaatcatgaccaagaacgctcttgaaacttcataaagctgttcagatatcatattaatatcagactctgcctctgggaacctgaagtgttttcagtctgccacctttggtaagtccaagtttaaggtgcatttaattaacatgacatgaaaagagagggatattccaggtgttgatttttctccaacaagtttttcctcacatgaatcctatgcagagactcggtttcactatatcctaaatagcaaaccttcagtctaagtgaagcatagattggaaatgcccagctattgtggaaatatgacattgaatataatgctttcagaggaaaggaaaatctaacagaaattcaatataatggaggcacattgcatgctacatttacatccatttttaaatttcatttaaataaagatttcccttgtctaaaagattatttatttagaatgaactaatattcattgagcatcaattatgtgccaagggcatacacaaacctttttgtatgtaagtatcacactaaccttagagaatctgagtcagacaggttacatcaccggcctaaccacatatagtaagaagagaaacctgggatctaattcaagtctctcaattccaagtccagatttgatacacaatatcccaccgcagccctggagataacagtttttttatttattataaagagactaggaagaattttcacctagttttaaacaaatataaaagaatgacacttgtaatcatttagctcatttagtgtaaaatcccttagattcagtttagtaatggtggttgtatttttcttataaaaaggagtggttgggttgggcatggtggttcatgcctgtaatcccagcactttgggaggccgaggcgggtggaccatttgaggtcagaagttcgagaacagcctggccaacatggtgaaaccacatctctactaaaaatacaaaaagaattagctgggtgtcatggcgtccacctgtaatcccagctacttgggaggctgaggcaggagaaacgcttgaacccaagaagcagaggttgcagtgagctgagatcacgcaactgcacaccagcctgggcaacagagtgatatgcctcaacaacaacaacaaaaaggagtggttgtatgagatgggggcatcagacaatgcttatgataaatataattcaagggattctagggggagaactttagggctccctacccagcagctcttttccattttttcttataatattttgtaattctatcattttaaatgcattattttgggaaatcatgttgcatatgttaaaactgcccctgtgtctcagtgcacattaattagggtgacatagaggttagctgactttccaacctggatggattgaaagtgtttgtttagagctttgtaataagtagaattctgaggtcatgtccaggttcaataggctcaattatcaatgtcagttaagggagggggtaatagtagtagcaaacataacttaattgtcaccactccattaagcaatcactaaaacctcagtgtgaatttatctaaccttcctagctcttaaaaaagagggagagaaaagataattccgaagccagagatgggatgaccatataagttattttgtataccaaagcacttttgagagaaaatgggggtctttaacaaaataccaggacaatatatgacaattgtcactgtatggtatggtcatcctagctctggggaaaggccatctctcactaccaaaaatatatattgaagagttcctccctaagcacaccaaagtctctttcctgatgctatggctttttcagagctgcagcttccagggaccatatttctccaatactgcagaggaaatttgaggaacacaagcaattgtgtctgggtaggattcctgaaacccttagagattcattatgaaacatgtgaaagaaattcagtcaatttgcaatttttttcagaggctgattatccaactaatgcattgtcttgacccttgttttatttctctcaccagttaatttagcaatatgtcagttctaataaaaagatttgatgaggaaaaagatgacacgattacatgaaatgagtttggggaattgccgacagatttcaattatccgtgttactctcagtgaaggctgattgactgtgaagagtggtggtttatcaggacagccttgctacttctcagatgtaactgtccttgttctttttgccttttttatacagaacatacattgcatgtgcatttaacacacagaccttcactttctctgttctgtaatctgtgattaacaagattgtaaagaattagcttgcaatattatttaataataaaataattaataaaggcataaaaccattcaatgttaaatgactttttattgggtgcttttgttctggatacaaagaagaagaaaacattggtgaactactcttttgaagagaaggtaagcaatggcagccccacagtggcatacacagttactaaattgtcttttaaatgcaattattatgtaagcttgacagaatatttgaaatgaaatgaatgtgctataaatattaaaaaatatattaccaggaaaggtactgacttcttcactaatttgcagcagccctttccaagtttgggtgtatattctctttctcaattcaaatgttgatcatccttctgagtaccttctgctgaacttgccgatgtctattgcagatccaaggatgatcttggcttgtagcttttaatgaaaacaatatctgttttctatggatttatataggcacatctcagagatattgtggattcagtcgcagacccccacaacagagcaaatatcacaataaagggactcacaaaatttttggtttcccaatgcatataaaagttatgtctatattgtagtctattaagtgtaaaatagcattataaccaaaaaagtatgtagattaattaaaaatacattgtagctaaaaaaaatgctagcaatcatctgagccttcagcgagttgtaatctttttgctggtgaaaggtcttgtctccaggttgatggctactaattgatcaaggtggtggacgctgaaggttacagtagctgttgcaatttcttaaaataagacaacaatgaacgtcgccacattgatgaactctattttcatgaaagatttctctggatcatgcaatgctattcaatagcatttcacccacaggagaactttcaaaattggagttaaccctctcaaaacttgctgctgtgttatcaattaagtttacgtaatattctgaatcctttgttgtcatttcacaaacgttcacagcatcttcactaggagtagagtccatctcaagaaaccactttctttccacaagaagtaattcctcattccttcaagatctatcaggagattgcagcaattcagtcattcttcaggccctacttccaattctagttttcttgttatttcaaccacatgcattgaacccttcagtcattcatgagagttggaatcaactttcaaactcatgtttatgttaatattttgaccttcttccatgaaccataaatgttcttaatagcatctaggatggtaaatcctttctagaagattttctatctactttgcccagatccatcaaaggaatgattatctatgacagttatagccttattaaatgcagttcttaaacattaacacttgaaaatcaaaattactccttgattcatgggctgcagaatggaagttgtgttagcaggcatgaaaacattattaatttccatgtatatctccaccagagatctcaagtgaccagattcattgtcaatgagcagtaatatattttgataggaatctttttttatgagcagtaggcttcaaaagggggcttaaaatattcagtaaaccatgctgtaaacagatgtgctgcaatccaggctttgttattccatttatagaacccaggtagtagatttagcataatacataggggccctaggatttttggaatagtaaatgagcattggccgtcacttaaagttaccagctgcattaacctctaacaagatggtgtgtccttggagcagtcagagcacatacatttattgattaagttcaacatcttatttgggtgcagttcatggcttccaaaacaattatcacagtaacgtcgaagatcactggtaacagatcaccacaatagatataataatgaaaagtttgaaatattgagagaattaccaaaatgtgacacagaatcactaagtgagcacgttctgttggaaaagtggttccaatggacttgttggatgcaggattaacataaaccttcattttataaaaaatgcattatctgctaagtccaataatgtgaagtagagtaaaacaaggcatgcctgttgttgtctcacataatagtttaacttatgaattatgatatgactttttacaagagaaaccagtattatatcccaaaccatgctgtgaattcattaagggtgagggtcatttatgatctatctttgtatttctccccaagatctaacagagttttgaatgtatttaggtcgggccatacaaaattgcctatatttgatcatttgtgatctgtaaaaaagacaattcaatatggttcaatttcccagtagttattccagaaataattgtgaaatgagtcagattatgttaaaattttacattcttatttgtaaatgtatatatttatgtataaatatatacatttaaacatatgcatacacacacaaatatatatatatgctaatgaagtcatttagaattaaagattagctttagttttaatttttttcttttttttttttttttgagactgagtcttactctgccacccaggctggagtacaatggcgtgatcttggctcactgcaacctccacctcccaggttcaagcaattctcttgtctcaaccgcccgagtagctgggactacaggcacctgccaccatgcccagctaacttttgtattttagtagagacggagtttcaccatattggtgaggctggtctcgaactcctgacctcaggtgatccgcccacctcgtactcccaaagtgctgggattacaggcatgagcgaccgtgcccagcaccagttttaattttttgagtagacatccaggcccaaatagccctttcagttcagtagcttctagatggtattttgtttttaaagaaataaatgtgaccacctcttttccagggaaataactgtagctgagataacagatcataaatccctaactctctaggaatggtaatacctatatggaattattttctctgactgtatgcttgctgataatattcttctgtagagtaatattagtgatagagatctttattttgagtgcatgaagtgtgccaagcactgctgtaaacatttcacatctattaattcattgagtccttgcttcaatcttataaaatacataatactattttcttcatttttcacatgaggaaattgagatatgaagtaaagtcatgtgctcaagatcgcacaagtaatgatgaaactggctgttaaattcaggcagtctggattcaattcttcttttaaataccatacaaccttgtatcaataaacatatatgtattttaaaaaattagaataagctaaaagttatttagccctgtaaaatgtacagcatatgatgaagcatttataatttggagttatagagttcaacagagtatacctaaggttggagacctcttttataaatagttttataaactattagctcttttatgaataacttgaaatcattttgaattatagcgccttagttccctgcattaaaaagtggaatttatagcaccaattcctttgtaggaatttataagaggagaaagaataatagatcatacaacatgtgttaataagaatccttaattaattagacagttttttcacatttggttatgaatgaatggatggaaatacttttgtaaaattatgtttaattctacctttctgtaataagtatatttttcagtacagattaatttctctaatacttgaaaactagaaacttatacaaaagtcacacaagcagagaattattaatgctgcttaactgggtatacatatatatatctctacacatatatatgtgtagatatatatgcatgtatatcatgtatattacatatatacacaatacatacacataacaatatgcttagtaacagcatttgtgttaatttacatctataagaatttttataatttaatatttttgcaataaatgaaataactcactgtgattgcttctgaattgggatgagaagaaacatatacttccctggaattcagcagcaaacagtgacaaaagcattagatggggaaccaggatcgtggacattctacttcaagttttggggccttagatttgattggctgggaaaatgaggtagttaaattctatgattttatgttgttcaagggtttttgcaagtatcttagagcatagtttcttttttttttttatatcagctcttaagtctatgttctagaaaatacaattctgtttttcttaataaaataagcccagcataccctttgttttatggaaatatcaaaagcaaaacagccctaaagttttcttagatacagatttagtaacttaatataatatgttgagtcattcaaaatgcatgaacatttttctgaaaggagatgcaagaaactgttattcatggctaagtttaaaaagaagtactggtgaaaagtcttgggttgagatagtatggcagtggaggcttatgattttctatgcctgaattttctcatcatttccatgaattaaaattttaatgttatcaaggcttacttgggaaagcaaaccgtgagccattttgttgtttgtttttattgttgtttctactttaggaagagtgcttaaaatttcgaattaaatgaatattcaagttcaactgacaagaagaaagtggcgtaaggcaaggttaccttcttacaggctgtgatggagttccccgggccgcttcctgagctgccacagcctctgccctgctgcggttccaaaacgtcatacatccgtgatgactccaagttgctgtttgtgacccaaaacacaaaaacacattccagtgagtcatatctatatttggaaataaataataagtaaatcacaacatggtgtatcaaaaatcatctttttcagattgcattaaacactgcaaatccccctgctgaaatggacatttctttgttgcatacacttttgtaattggcagaaccactacagacgatcctactgtgaccatgaaagtacagcccaatgccttccacagtgctttgatggacatcattgcatctgtctgactactggccttgttagcatcttctcttaagcaagcagctttaaaacccaaataaatttttctcaattgccacattaattcagctctgaaaacaccaacacataacaaaatattcattttattttttaaaatggaggtaaaatataattttaatctggactcagaatagtaccattaaaaagaaatgtggactttagaaaatgcaggtaatgtctttaccattcctgcggctggagatagctcctcaaattctctatctccaaaattatagacttatatccctccccctgtctctgtcaaatcttcttaatgggcttgactacgtacagagctgcataaatattttaaaaatatttaaaattggctgagcatggtggctcatgcctgtaatcacaacactttgggaagctgaggcaggcggatcatttgagattaggagtttgagaccagcctggccaacacggtgaaaccctgtttctactaaaaatacaaaaaaaaaaataagccaggtgtggtggcatgtgcctgtaatcccagctacaaaggaggctgaggtatgagaatcgtttgaacccgggaggtggaggttgcagtgagctgagatcccgctattgcattccagcctgggtgagaccctgtctcaaaaaaacaaaaaacaaacaaacaaaaaaggccgggcatggtggctcacgcctgtaataccagcactttcggaggccgaggccggtggattgcctgagctcaggagtatgagatcagcctgggcaacacggtgaaactccatctctcctaaaatacaaaaaattagccgggcatggtggtgcatgcctgtagtcccaactacttggtaggctgaggcaggagaatagcttgaacccaggaggtggaggttgcagtgagctgagatggtgccactgtactccagcctgggccacagagtgagactccatctcaaataaataaataaataaataaataaataaataaataaataaattacttctacattttcaacacgtgataaaaatgaaaattattatcaaacttttaaaataatatgactggaaactcaaaattaaacctcatgtaaatataaaaaattatctaaatgttatatgcatttctaaatattcttcttctgaaaatataataatttggacttttaaaatgtactgatagcttaggtctattggtttaatatttgttcttgttgaccacatagaacatgcacaattcactaacatgtacttttggaacataatctgatagttctgtataaaattttcaatgcaacatgtagatggtttctcttaaaacaagtgctaaataaaagatcagttaaataaacaatttatttctaactaacctataactctcatgtttcaagcactaaattcatcaattttcaattagccataagtcacacagggcattagtgtagccttttggcatttccattattatggaatgacattttaaaaaatgaccactgactgtgctgtgtaacaaatcatagattcaggcaaaatctgcacagagtaattaaaataaaatctgttttgttaaaattttttatatattactttttgagcaattgtcacttgagggctagagtgaacctaatgcacatgaaaggataacacccatattatctttgcttagctgaggaaagataaaagaaaggaaggaaggaagagaggaaggaaggaaagaaaaagagagagaaagaagaaagaagtaaagaaaggaaggaaggaagggagagagagagagaaagaaagagaaagagaaagaaagaggaagaaaaggaagagaagggagggaggaagacagaaggaaggagggagggagcgaggaaggaaggaagggaaggagggagggaggaaggaaggaaggaaggaaggaaagaaataaagaaggaaggaaagaaacagaggaagaaagcaggaaaaagaaattagctccatttcctggctgccaatcctgacctattctgccacctagcctttctgagtcttagtctcatcatttataaatgacatgtttggactaaagtgtgtggttccctcatggctctggaagtcacttggcgaaatatcagagatgtcctaagttttcagcccctatctttacaggtttcctacaatgtgggcctataactttttaggctgccacttacttacccaagcgtggacatctctttgaatgctttcttgtccacaggacagtttggcttttaccaaaaggccgaacagctattattgttaggttctaaatagtttacatgtggaagataaggccatgcaccaagctaactttgaacttgacctctaagtcaagttatatgactccttctaggagccagccaaggccctgtgtgcagttcagagagacaggatgtagggtcccacagctctgtgtcctgttgctactgtgtcctccaggcagctctgatgggctagtagatccctttcatgcaggccatccctggacttatgcccagtactaagacatctcccatgacttttcgcagggctggagactgcaggagtaggaaatgggcaaactgagaagaaaggctgacacagacctcaggccgctccttccagatatgaaacgtcgtagaaagaccacttcaaggccgggtgcagtggctcacgcctgtaatcccagcactttgggaggctgaggtgggtggatcacctgaggtcgggagttcgagaccagcctgaccaacatggagaaaccccatctctactaaaaatacaaaattagccgggcatggtggtgcatgcctgtaatcccagctactcaggaggctgagacaggagaatcgcttcaacccaggaggcagaggttgtggtgggccgagatcgtgccattgcactccagcctgggcaacaagagtgaaactctgtctcaaaaaaaaaaaaaaaaaaagcaaaaaagcacttcaacagcctctggtcactctagaaagaaatcacatctaaattgggcagagatggttaggtccaaaattggggtgatgtaaaaatagagaaaactaaaaggtcggccttgaaaactacttatttgcccatgaagcacttttatttatggctttagatagacaatctgctacagtactttttatgcacccaaaagtttaagaactgctgagctcatctaatagaaggaagtaatggcaagtctacctacagatatcttggtatgaaagtttttctgcctctaaggtgactgtacaatcctagttgaaaacgaagttatggaagggaattagaaagtttttttttgcttgcctgcaaggctgatgccatttgttctaatgctaagcctgtatagcattaataaataaatttaactatatatatgcacctatgtagttgttcattgttgtgagtattaaacgaggaagttgagtcacatggtggggcaaaaattaatgcattactagatgacaagtgtaatgcaacttcactacacccatatttaaagcaaatgcatcttctgaaacatattgtatatcactttaatgatgcctaatatcaaagaaaatgtaggtaggcttatgttttaaagcatgtaatatgagtgtgcatttccaataggtgactttacaacatggcccagtctgttcccataccttttggatggagaaagaatttttagagtatttacaatgatgctgtccgtgatctctagagaagcagaacatttgctgttacaggatgaggcagagatggcagtgatatgaaactcatacatttattaaaatgagctgaaattgacattaaaagaattgctgtcaagatacagtacagctttataacttgctcctaatgggtaagccggcaaattcttccctgggagattttcctttgattttgacaagtgttgacaatatttattaagcacaacctttcaaactggtttcatgctgaaaccgttaagtgtgtttcaatgaggatgtacataaacatgggaaagaaggcacaaaaccaaatttgaagtagtgattttaaaccagacttccataaagcagctttctttatagaacaatttcatatattaataaatgagatgctaagttgccactgtactgctaccactgcagtgactcatgcagtatgaagaagtaggtcacatcaatagtgaaaatagcctagggaatatccagttatttccctagagagagatggatccagttactggaaactgagctgtctatacattgcaatgcaaagtttggtccacggaccagcagcattggtgtcacttgggagcttgttagacacccagaaactcagaattactaaatcagaatctgcatattgacattaaactcaggtaatttatacatccattagagtttgagaaacacttacgtaacatattaaattgaattcaccttccatttgcctgtgggacaccattctgatactgagaaaaatagatcagagtaaaagagatggggcaaacagagataaagaggcttgggtgtaatatcctcatgatattacttcatttaggaatattctacctagtccccaccttcccttcttgataattcctactctgtcctttgggtctcagcttataaattacctctggtacctcccttctctcttccccctgccaaggaggccacttctcctctcccacacacctccagtgccccatgcacacacaaacacacttacgctcctgcctcgttcccacccacatattcccaccccactccaacccaggaagtgagacactcttcttgtgtattccaacagcactctgagccatatcttgttttagcacttgtccaaaaggcatacaattttgtaatatttgtctctttccagtttaggctgtaagttctaaaagggcaggggatcacttaggacacaggacagcgccagtcagtgggagatgcccaacaagcacttattgaagttgtatgttcttatctttctgagcatcctggttaacctcaaaaattaggcacaaacaagtgtttgaatttaatgctaaattttctgcagtgctgacagttggtgagataagccacatctgagaagataatttaaagaatttcccaggatagttctaatgaaaagagattctgctgttatgcttgctaaaatgtcaagtaaacacagtgtaaagttaaaccattttaacagattctaaaagataagattcgctcttgtcttctccctccttaaagaatgctcttggtgaaatgtagtaattataattcatttgattgtctcaaccctattagggatatctactcttgagctttatattaaatcctttaatcccaacactagaaaaaaaaattaaaactcagagctaccagaagagatcttgagcaaggaattgagatgttgtcattaaaatcaatttaacaacatatgacaaccaaaaattgagaggattttaaaatttgccttcacacagttcaaaatgaaagttttctcaagtgaatgttcttattttaccctcttaaattacccaaagtaatttacctgttacatgaagcccagaggtttaagtcaatttttcaaaaactgacttgttttaaacatcacgtgagatgttagtgtctcctatcttcctcttctaaccaatcttgacaaagactcttttcttgaccaaactttagtcaagctcctttgagacatcttctcagctaggcctggaccttggcctgctgagcccagctgtagagaagaatcctgctcagtcagtttagaaagaattctcacatccaaatatctgatcaacttcctcatccgcccacttttgatacttaagtccttggcctgtctagtaagcaccccgttaggacagtttagcaagaatcccctgctgttgacatcccctcttagtaattttctgttcactaaccccttcactctgcctgtggggtataaatttccactcgtccttgctgtattaggagttaacctcagttctgcaccgacagctctcactcctgctgcaataacttgcataaaatctgttttaacaatttaaatatgtatccagtacaaaatttttcatttactgctgtgtacatttttctggtttcatctcctaggtaagaagtttatattttttttctttctttcctaggttggacatgtcatgtcattcatgcaaattaaatatgtcaccaactcattggtagctgaaagacctacaaaatcctcatttattctgtaggattttagaaaatgtgtcataggaaactattaccaaaccttgaaaatatttagaagccatcattttatgttctgtttcaatacttaaaggtggctccatagctgtaaaataaattccagacttcttaatctcctagaccagtaaaataaaaataaccatggcagtaataatgttataaagggcccagcattttattttcccaaataaacttcaagaaaaccccttatagttctgctttaaccatcattcttcaaataaagggctttgtaatggtgtagcaagaaactgtgatgtattatccaagaatgaaggatatttcttttcaagaaaagatgggctttttgtcttcagattggtgaaaatgttgttgcagacctgagtttgggtttcactttttgaggtattggtaagtggcaataaagaaaatataaacaggtcattcattattaatcataaaacaagtgtcccattcttagaagaaagaatggcctcaaatttagctatcctctaattcaatcttgattattaaaagaagatgaaaagcaaagacactacttagtattgttatttcatttgagatgtaatttgtaaatatcaacagcggaaaaattccctattttcagttccgaaatcttttttcaacaatagccaatataatgttttctctaaaacactatgttgaatattgttcaattaatgcttttttatttaggcaactctaaatctatcagatatacacagtaaaatgtgaaatctcttcttaaacagatactatataaaatatctggattatattagaaaagacaatcaaatagtaaacttcctaatgtaagaaaacagctgtacttccaaatagaatgttattggagattatatgacaatataaaataacacttattgaacaatctgtgctttgtaaattgatatattatctctcattaagaagacaataacaagttatttcctatggtttgatcactgctgtacagatttactagttttatatctttaaaagctgtttcacaatctcaggctttcccaagaccccaactataatccttcattccgaaaaagtatcaagcaagtgagcatgataacttagcctttttctcttttctctttcattttttaatgaaggctatgggggaattttttcaaaatgtgtgccctacaaataatgtgtataaaaacattattttaatgtaagatagaaagtacacattcctgctgctaagttaattttgcatgaatatgtgcatatttatacatgaataccactagatggttactatagaaatatttatccctagagttctttatttctttatttattttctttctttctttctttctttctttttcttttcttttttctttttcttttgagatagagtcttgctcttttgcccaggctggagtgcagtggcatgacctcagctcactgcaacctccacctcctgggttcaagtgattctcctgactcagcctcctgagtagctgaaatcataggcacccaccaccatgcccggctaatttttgtattctgtattgaaacatggggtttcaccatgttggccaggctggtctcgatctcctgacctcaggtgatgtgcctgtcttggcctctcgaagtgtggagattacaggtgtgagctactgcacccggcctagagttatttatttctaaaaaaaaaaaaaatgaggtatatatttttcagatagtcaaagcacactatgtatatgaccgcattctgctaaatctagactgtagttcagggacattcagaatgtatgttaccgtaattgcttcatattcccgtgttcttccatcaaaccacttgggcaggtgtctcactctgatactctgatatatgatcttcttcatactacttctaacagaatttaccctcatttaatgcacggcaggtactgagcactctatagtgtgctttacatactaatttcattatacccgttttatagaggagaaactgaggattgatgagggtaacacgtaatccaagtgatatagtttggatatgtgtcccctcccaaatctcatgttgaattataatccccagtattagaagtggggcatggtgggaagtgattggatcatgggggggtggatttctcatgaatggcttagcaccgtctccttggtgctgtcctcacaatagtgactgacttttcgtgagatctggctgtttaaaagtggatgacacccccctctcgctctcttctgcttttgccatgtgacatgcccactccccctttgtctcccatcatgattataagcttccagaggcctccacagaagcagatgccagtgttatgcttcttgtacagcctgcagaactatgagccaattaaacatctcttctgataaatttcccagtctcaggtatttctttatagcaaaaaaacagcctaataagacaagattatattgctgccaaataacagacctaagatttcagttgctgctctagacaccataccatgttattttccgctgtgatctctaacactcctttaagtgctttgcttctgtgaccgtgtcatctaagtgagtctaaataaagccagttcctagtgtgttggcattcaagaatctaagggcaaattccatttctaccagttactagagagatggagttggatctattactcaaccctctctaaaccttagttttctcatctgtaaaatgcagatgataatagaagctttgtcatgagatggttgtggtggtttcatggtgctatttcctgtaaaggagtcacgtagcacctagcacaggtaattactcaatatgaaactgagaaataccacatgaagccctgtaaatctatttactcttaagagtctccttgataggttttcagcacattttcatattcaacattaatatatgcacatttttgaataaattgcataaatatttattatagtggcacttttcttagagctaggatttcaaaatatatacaatgagaaatttctattcttctgctgactattaactattatcattagattataaaatgaagaataacaaaggctttttttaaatccaagagaacacagaatttaatcaattattctaagacaatacaaagatgcagcctgttcatgcgtacaattttatatcaattatcatgggaaaatattgagatcattaaagcaaagctctaaagcttacagaagactaatctgatattagtgaaaaacatgaattgaaagtgtttccagagaaaagtagtggtattgctaaaatgttagttttattggagaaaatttaatggttacattaaaaatatataataactatttgtatttaatgtatatttttctttttctgtttgccttcttaatttgattggcaaatccttccctctagggattccggtagttatggttctgtggaggccctgcttcacttatcacaaacaccaccaaatggaactgaattaaggaaatgttactgaaggttagacatggaatgggactctggcttgagacgctcatgttgatcgtttacagttaaaggcagtcatatgaaatagtataatgaagtgaaggggagtaaaagaggagagagaagaaacgtagttgcatgtgaagagcataagtgtacaccattctgttgtgcccagggactgctgggcagagtgtacattttaagaaatctttgttgttaaataagtgaagggatgaattttgttgctctctgaaattaagaaaacatatagtattctgttaattaaaataaggtgttactggacgggaggctaaggccggagaatggcgtgaacctaggaggcagagcttgcagtgagccgagatggcaccagtgcactccagcctgggtgacagagcgagactccatctcaaaaaaaaaaaaagaaggattatatgttactgggatattatcagccataaaaaagaataagatcatgttttttgtgagaacatggatggtgctggaggctattaaccttagcaaactaacgcaggaagagaaaaccaaatactgcagtttaccacttttaagtgggagctaaatgacaagagcatacggacacctagatgaggacaacacacactggggcgttttggagggtggagggtgggaggagggagaggacaaggaaaaatagctactgagtactgggcttaatatctgagtgatgaaataatctgtacaacaaacccccatgacatgagtttatctatataacaaaccttcacatgtaccccctaacctaaaataaaagttaaaaaatgagtgttgctttgcatgttgcttctgggagtacacattcatatgacatttctgaaaaccacctgcccatactttccacaactcttatccgtgcatgcctattagtcagccatgctttccacgaggaatctattttagatgatagacaccaaacgaaagacttacacactgagatattcaatttgttattcttaattaaaaaaaaccctaaacattagaaatacattcaccaataagtacattgataaggttagtatgcagacatgaagatgatgcccctttgccctcaaaaatgtcatgggaaaatgttcccatgttaactgaacacagttgggtgcaaaatattacactatgtaactattgatatgaatgtattattttaaaatataagactgggccaggtgcggtggctcacgcctgtaatctcagtgctttgggaggccaaggcaggaggatagcttgaggccaggagttcaagaccagtctgggcaacataatgagaccctgtctctatgaaatatatgtatatagagacagggctggatcctgtctctaaaataataataatgacaataaaaacataagtccattcaggtcatttctttcttttaaattttatttttatttttaattttaattttaatttttgagatgggggtctcactctgtcgcccaggctggagtgcagtggtgtgatcttggttcactgcaacctccgcctccctggttcaagcaattctcctgtgacagcctcccaagtagctgggattacaggcgcatgccaagccaaaacacctggctttttttttttttttttttttgtagagatgagggtttcaccatgttggccaggctaatctcgaactcctgacctcagatgatctgcccgccttagcctcccaaagtgccgggattacaagcgtgagccaccatgcccagccattcaggtcatttccgttcttaagatcttgcaggagctctgcattttatttcaagcaaaattgtaagtccttgccacggactaccaagtcctgcatgcatggaccgtctgttacctctgtgaccttgtctttttgccttctgcctctatcgaatcactctggccacactggcctctctgctgttcctaaaacaggccaggcacagttgctgtcttagggccttccctaactgttgcctctgctggaaatgctccgtgcgttgagatctgcacatctcacttcattatttctttcaggactttctcaaatgtcaccttctcaatgagacttcctctgactcccctaactagaattgccacacaggcctctttatctctgtttgcccagtctctcccaccctgatctatttttctcagtatcagtatgatgttccaatgttctatagaatgtatttgtttcctgtgtttattatttattttatgtgcctctccttgtgtgctcccaccccatgctctatagattataaatttcatgaatgcacttatcttttttggttttccacgatgtagttccagtccaagaataatgcctggcatattgtaaatgctcaggaaatgtttgttgaatcaatgagttcattaaaacaaatacatacatagtttcatatatagaaacatgaaaatgttaatagcagctatctttggataatgtagctatttgtgatattttttcttgcccctttctatattttttatatatttaatatatactattttgtgactagacaaagttctttattttaaaatgggtgatataaaggtattttgaaatctagtgcctataaacaaataggcatgtgaaatgaacaaacaggaaatgtgaaattctattacacttaagagttctgaggaaattttctgattattaaataatgctttcctttgaaatcaaatgaaattttcaatcttaatacataggttactgctttgatgatgagttgtcatgggtcccaccaaagataacagataatttagctgccacagtaaaggggactgatgtgattggaaaaagtgacaaaaccaataaagccagcaaatactccttaaagccaaagataacatcccacggcaaaagctttagtcctgactgagaaggatcctttatcacggataattgtttatgagtctatgtgttgcctcccccatatctctgagggatgaggctgtcaaatgatttctagttgtatatgcagataggtggtgaaacgaaatcaaacttggacaatcctatggagcacttcactgattctggataatgagacttaaaccaagagccaaacctcttggagccggctggatagtttctgacacagtttaaaacaacaacatcatcacaccacaaaaaggaatgctcttaaaagcagtatcttctaatctcctaatgtgtaagaatggccaatactactggtttcatttttctttaactactttagtggactccaggatttattgagccctttgttcgatttactgtcctttctatattttctatacatttagtatatattatggggactatttagaaaatatttaaagcctgtagaaaaatttttaaagaagaaccaaacatgcagcatgttgaaattggattaaagaatattccttaagaaagagttgggaggataagcttgcccaggtgattttggctcccattttggcaggcatattaggattcaatgaatggctctccagaatgtacctggagtttctatcattacaattatagattatttccacttaatttaggtaacaattcccatcatgaatgcattttccaacttgttaggtattaaaaaattataaataaaaatatagtaaacttaaaatagaagtagttttatatcaaaaacatttagcaatgagagtataaacagaactgagaaagcgggagccatgttggcctgcacagtattaaatattttaaattagctgccaacaattgaagactgaaagaatgtacctaaaaaagactgagtttctgtcttctctggaaaatgtggtaaatggggctacactgggcagtaattggcaaactcgggacccctctaaagtgtggcttgtgggcctactccttttcattacaattattggcctggaaaatatttaattacatgatcctcggataacaaacatcccagacatatttttcatcttaggttttctcccctcagatttttttgcttttgtttttgcctttcacgttagagaaattgtttggttttcttttttttcaaaactatgtttagagcaattttaggttcacagcaaatttaacaggaaggtccagagagttcccatgtaccccctgctcctccacacacatccttcccattgtcaatatccccagccatagtggtacatttgttacaacggatgaacacccattgacacatcgtaatcacccaacacccacagttcacattagcgctcacttttggccttgtgtattctataggtttggaaaagtgacacatatatccaccattatggtattaaacagagtgagagtattttcactgtcctaaaaatcctctagcaagctacttattactattttttttaacttttattttaggtttggggttgcacgtgaaggtttgttacataggtaaactcgtgtcacggtagtttgtgtacagattatttcatcacccaggtattaagcccagcacccaatagttattttttctgctgcttttcctcctccaccctcaaattaacaccattggctgttgtttccttctttgtgtgcatgtgttctcatcactgataagtgagaacatgcagtatttggttttctgttcctgtattagtttgctaaggataatagtctccagttccacgcgtgttcccgcaaaagacacgaccttgttctttgttaacgactgcataatattccatggtgtatatgtaccacattttctttaaccaatctgtcattgatgagcatataggttcattccatgtcttagctattgtgaatagtgccagtaagctacttatgcatctgacaaagaattggatattttcttcctcttggagacaatatctataaaaataaaattcagtaattatatcttcacccctcaatgttaatatgtaccaatctccatcttaaggcacatttgcattttagattgaaggaagggggattttccaatttaggtggagttgaattaaaattgccatattttatttctaaatttgttatttagttcttgagatgaaaagaatatctgattcactattgaactccacaatatacttagtgcaatgcctgacaattagtcagtgctccataaatgtggtagggtcaataatggcaccacttaaaagatcttgtgatttatctttaagtaagttaataaagatgatcttttaattataactccatgcttttgtctgtgagagtctatagtcctgagataccaatgttagtgaatctatcagataagtagaaatcatacatataaaccgtgagtggaaatctcataatttctgttttttaaaaatcaatacaagatgcatatagtttacaattgcaatatttaaaaccagtagaattaatgaggcaatgtataacagtatctacacattaaatacatatgccacctgagaagactggcagttaatataaatatgtcaaagtctgaacatttcttatgccataaggtgtggtgaagatactactatgcagaagtcagaagactggaacttgggtcccgactgtcacttttacgagttcgaccttgggaaaattccctaatctccctgagcttcaggttcctcatctgtgaaatgggactcatatgattcactttacaagctttgttgttaccgaagggagataacttcagtcaatggtaataaacatactttatagagcacctattttgccccaatcattgtgacaggatttttacatttgccactttaaatccccacagcatcacagtaggggaggtgctatttgactattacatttctaaggagactgagactcaggcttagcatttactcagttgcacttaatcaagtgcaacttgatttactcaggtgcacttaatcaagtgcaatttgatttactcagttgcatttaatcaagaggcttaatttggaatccgaacctagacgaaactgactccggcctgtgctctttcctggatgccctgttgtcctcacagaatacaacgtgcttttgtcccatactaactgtctttagaactgtttttctttggggtgctctcgttttattgagatactggagcccagagaagagcaatgcagacaggagtgagggttagcataagaagctgcctctctggctgcaccaggttgtatggctactcttgctgagagaagaggggtacttgggtcattgaggggtatcccccaaacacactgccagtcctaggtttccatgcaagtagaaaaccatcctccttttgacatttgaggaaagaggaatgctctgcctaactaaaaatgtctgccacctgtctagtcttgtgctgaaagccctaattccttacagtcatctaagatagaagaaggtagcaggatcgggaattggccacagaatgggtaaaatttgatggtaaagaagagggaaggtgtgcagcacagtttgctgtctggctgaagtgccctaaacaaggacgcttgcaaggacagggccaaaacctgagacctgggatcccagaggcctcatgggatgctggaatggaagaggaggccctgatcacgacttggctttataatcccctggaccccacaccccacaaccaacctggattcctgggagtgtctcctggtgggcaaggcagcagagaggcaggtaggtgagtttggttcaactacccacatggctgacggagaggaccacacccacaataagggagttacaaacaccagcagatttggagaggaagcaagagaggagagggtagggggaaaaaaagaaacacaagttttagtattatttaagaggaaagatgcagatctcaccaggctgttttaaaaagaacacaagtagctagatggtgaagatgtaatcattttgttaaaactcaggaaagagttgaaagtttgcaaatatatttccagataacatctgtcttgggtaatacgctggatttgtgtctgattgagcttcatataattgatgcattaaagaggtaatttacatcatgtggataaaactttcaggaccttccaatttgttttatgaatatctagataagaaacacactttgtgtttctcaggcttaatattctaatagagagaattttaagaccacataatttatgaacatttatttcagcttttttgtatgacttgtttactttgactaagtctctacacaatgctcacctgtaaggcatgctctagttcttttttgcaatgcaaatcatgcagatcaataggatattacttcaaatctcaaaagctaaaaagtcattataattatgaaaaaataaaatcaatgatatcaatgtatatagaagcaagaagtgaataagatgtagtcagtgaaattatctttacatctcattgcctgatagtcactggtaaatcattagaattcaatacgattttactgtgtgaatgagaatgctggagaagaactaaggtagtaaaatatcagagacataaaggcaggatacctgccttgtgtggagggattggggaagagagcattagggaagaaggagcaaccatctgtagtcacagaagaggatctccaatctaagccacttataattctctctggaaaggtcttgcatgctttttttagatttattcctagaaatttcacatttattgataacattataaatggtttcctttttaaaattttccctttttttgtgactcatatgaaaaattatttatgtaaattttctgatttatattcagcaaacatcctaaatttatttattcagtctaataatgcataatttatctgcagattatttttttattttctatgtacacaatcaaataaactggaaatgctcagatttggtttcttcctttctaaatgttttactgtttgtttctcatttttgctttactgctttggctaggaccttcaggaaatgttgaatagagtaatgcaaaaatccttaaagttacaccaccatgtattatgcttgctacaggtttctgtagatactgtttattaagttaaggaagttcttgtctgtctgtggttttctagtgctttaattttatttgttaatttgattgattataatagttgattttctaatgttaaaccaggcttgaattcctgagataaactcagttttataacaatattatctttttcacacgttgtggaacccaactttctaatattttggttgggcagctgttcttttgatcatgaatgagacttgctatatttcctttgttcccctgtcaagctaattcaggacatttctatttttctacttgctgggagaatttgtatactattggaattacctatttatcaaatatttggcagaattctcctgcaaagctatctgggagtagaaattttctgttagaaggtttttgatcacagaatcaaattaatgtctgtagactattcgtggtttccatttcttcttgagttactttagtaagttatatttgtactcaaaattgcctgttttatctaaatcttatttttatgtatcaacataacattttaataatgttatattattgataatacttttgtctgtaatatctataatgatgtttactttttttttcatttttatcattgttttatgggcttctacccctcttttaaaattaaggataccaggcatttgtcaatttgatttgtattttcaaagaaccaacttttgattcatttattctccatagtctatgtttctttttttggagacagggtctcattctgtcgcccaggctggagtgcagtggtgccatcatggctcatcacagcctcgatctccttggctcaagcaatcctcatacctcagcctcccagtagttggcactacaggtaagcaccaccatgcatagatagtttatttatttatttattttattattattattatactttaagttttagggtacatgtgcacaatgtgcaggttagtttcatgtgtatacatgtgccatgctggtgtgctgcacccattaacttgtcatttagcattaggtatatctcctaatgctatccctccccgctccccccaccccaccacagtccccagagtgtgatgttccccttcctgtgtccatgtgttctcattgttctattcccatctatgagtgagaacatgcggtgtttggttttttgtccttgcgatagtttactgagaatgatgatttccagtttcatccatgtccctacaaaggacatgaactcatcattttttatggctgcatagtatttcatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatataccagtaatgggatggctgggtcaaatggtatttctagctctagatccctgaggaatcaccgcactgacttccacaatggttgaactagtttacagtcccgttaacattgtaaaagtgttcctatttctccacatcctctccagcacctgttgtttcctgactttttaatgatcgccattctaactggtgtgagatggtatctcattgtggttttgatttgatagtttaaaaaaatttttttgtagtgatgggatctcattctgttgcaaggctggttattttttcttgtattaatttcaggtcttattatcatttcctttctttactttctttggagttattttgttgtttttaaaatctcagaggataggtgcttattatatttagtattatatttagcctttttttaaaaagtacacttttaagactatatgcgtttctcttaaaatggctttatcttcattctacaggttttgaaatgtggaatttttattatccttaaattcaaattactttctacttttcataacagttttgtagctctgcatgctagtgaaagggtattttaaatttgttatccatttagaaattttcaatttgtctgtatttctatttaaattgtattgtactcagataacatgtttcacatgacattaatccttggtatttgttgagaattgctttattctccactatgcatggccaatttctgtaaatgttacatactttctaaaggtttcggttgtagtattctatatagttgcattaagttaagctggttgtgatatacaaatcttcaaagttctttataagtttttgaataatttcttcttgtaattctgtttgattttgctatttttatttttgaggcaattttattaggtgaatagaaacttaaaatagcatatcttgctggcaatgtaggtctttaccattatactttatttctagcaatgtctttccattttaaagttccttttgcccagctgcatgttttctttggttagccattggatgatatatatttttccatacttattagtatttcatgttttaaatatatcttattttgtttaatttttttaaaaatccggttgataatcgttgtattttatttgcagcatttagttcatttactgttaatgtaactgctgatatatttgggtccatttaatgtctgctttcctacaatcccatctcttctttatattctttcttcagttgcattagtcaagttttattattttttggcctagtgtggaagttataccttcttttttttttttagtagttatcctaaaaatataatatgtatacttaccttattatgttctaaaactaattaacatttttatcctcctcctggtaagtacaaggatcttagaacattttaactcccctaatatggtttggctgtgtccccacccaaatctcatcttgaattgtagctcccataattcccatgtctgtggcaggggggacccagtggaagataattgaatcatggagggagtttcccctataactgttctcgtggttttaagtctcacgagagctgatggttttataaggggtttcccctttcacttggctctcattctctcttgtctgctgccatgtaagatgtgcctttcctcttccaccatgattgtgaggcctccctagccacatggaactgtgagtcaattaaacctctttttctttataaattacccagtctcaggtgtgtctttatcagcagtgtgaaaacggactaatgcaccctcctaacttacattattgcctacatttttattatttttgaccccacaggttattattaatattgttttatacaatcattatttgcttagatttgctgaatatttaaaactttcttcattttttatttctttttgtatttcacacatcatatctgagattgtctttctttggcttgaagtaaatcctgtgtaatattcttcagtgagaagtaactttctcagtttttgtctgtataaaaatatctttagttattcttgcaagatctcttcactgatatggaattctaaactgcgattattttctttcagcatgttgaaagtatcactttattatctttggaattccattgttgcttttgtgaagtcaagtatcagtctagttattttttaaaaaggtcatgtatcttttattctggctgatatttaagattttctgtttatctttggtggtctgatgatatttagctggtaattccttattttcttatcaacttttcaatacttttaaaatgttaaatttttttttgcaattttagtcattttcagcaagaggactgatgaataattttgtcatatttctggaacagaaattcacaggcatttaacatttatctgacagtgttgggaaaaacacagagaaggacagcgccagcgggcttaaagaaaaatgtggatagcataagagagacttaataatatttgtgagcagaaaagactaaattagacagaactggcctattgcctgaaaagcttcccagaaagaatcagaagtagttggatagagaaggatggcaaataggatgtcaatctttgatgactcctcactctcgctcagttaaaaaagcaacttaaaaatgatcagattttagaatgagatgcaaaaatgaaaaatagaatcaaccatctactttctcttttctcacataaattcactcaaccaaaagtaaataaataaataattaataaaacgacagacaaaatgcaaatcttcatgtaagtcctaaactgtaatgtttaaagacattgcacttacaaggggaaaatatacctgcattttccatttcatgaaaaaaaagtatgtgagccaaatcaacatttaaaacattcttaacttgtaaagaatattagggagattttatagaattccccttagtttttatatttgaagaaaaaaattagttaaaaatggtagttttaatttggacagcactttagaacttagaatagtcaatattacttattaaattctatttttgtacaatttgtaaataaactctctctctctctctctctctctctctctctatatatatatatatatatattttttttttttttttttttttttttttttttttgagatggagtctcgctctgtcacccaggctggagtgcagtggcacgatctaggctcactgtaagctctacctcccaggttcacgccattctcctacctcagcctcccgagtagctgggagtacaggcgcctgccaccatgcctggctaatttttttttttttttttgtattttcattagagacggggtttcaccatgttagccaggatggtctctatctcctgacctcgtgatctgcccacctcagcctcccaaagtgctgggattacagtcttgagctaccttgcccagccataaataaactatttttaagcccattacccattcaaaagggttattatttaactcacccaagaaaaccatttttaaaaaatggtatagcaacattcctcctttttgtgtaagttatatttctaattacaatgcatttcccaggtaccattaggcattagcaaggtgtttaattatactttttcatccaagttaacctcaattattgtggtttcactgaaagttttcttatttagttcctagctgtacctttgcccaattcattttctttcagaagatgaaatcaatacctgagatgggaccagtacatctgtttaatggttaacaatgattaccctttttattcattcagcagttaccattgttcatttttttttttgggtgagacaaaagttcgtggagtaagaattatttgctttctaaaggtagatcattaataaagtaattgagtaataaaataattgaaatggagataattaaacagccataacctatatgcaactattattaatggcaacctgaagcattatgctccatataaatcataaaaacagaaaaagtttactcactataaagaccataaaccggatatgatataagtatgtgtttcaggttttataactccatatatttccaaatagccaaagttcaagaaactttgacttgctcctggaaaccacatttcatcttttctggaggaagcagagcatgaaattttcccgaggctgagcagatgaggagtttcctcattattaggacaatatagccattggcatagcaggtttatgctgttgcctcattagatgccactgagaaaactgaattaagagcaaaaagtgagcaagtccaactatggtgattatgtaaagagacttccagatgtcttagtactttaaaacaatgcttctcttattcctaaaatgtccaaaagtgctatacatatatctttgagagaaatcctataaatgtaatatttgttgcaaataatagttgcaaacaggcaagagagcttctgtgtgatgcaagcaaagaggacaaagcaaaatctcaaaatttaggagctggtgtttgttgtagctcagggagaaatctcagcaggtcatccagtttattagccagcttctaggcagagtggaactgaatgtgtcctatatagaagagcattgtggttagaaatgtcttcccttgtgaaggatttaaactaaaatgtgcccactaagagaaaaagactcttatttttccctcaagacctactttgtaataagatcttttatgtatacttttagtgtttacatgataattgccccccaaatccgacatatatgtttcacatgtagttacattccagttgtgataaaatagccacaggaactgagaggatactttatttttattagtgttcctaatgtactggctcaattcttctccactgtagatggaatgaagtttattgctttaagcaaaattaccagtgcagcaataaattgtcatggttatatgtcccgggccttcttgtcactgattcaaatttacttctgagctcctcattttctaaggtaaagtcttctataaatacacaggcatttcatttctccttaaacactcaatcaaaatgggatatctttctaatgatttgttaacagttccataaacaacttaaaagtacaacaatcagaaagaacataatcctttctaagcaattgtaaaaccaagtagaaatctgtgtgcatgttcattcttttattctttcaacaaatagctactgatatggtttggctgtgtccccacccaaatctcatcctgaattgtagctcctataattcccttgtgttgtgggagggaccctgtgagaggtaattgaatcatgggagtaggtcttttctgtactgttcttatgatagcgactaagtctcacgaggtctgatggctttataaaggggaggtcccttgcacatgccctctttgcttgtcaccatgtaagacgtggctttgctcctctttgccttctgccatgattgtgaggcctccccagccatatggaactgtgagtcaattaaacctctttcctttataaattacccagtcttaggtatgtctttattagctgcttgagaacagattaatacagctactgggcagcaagcacagtgcaaggagctcaagatactgcagtaaataaagcagacaaacatccctaccttcgtggagtttatgttgtactagagaagagagacagaaaagcaataaaataaataaaagtaaaatatgtaagatatgaaggaaaataacatttgaatattactcttataaagtaaatattttcacataagttgatagttttctttgtacacaaataataagaatcaggtcaggaaacattaataaacacattcagagtagtcaactaattttgccaaagtcacacagtaggtcatagaatatgatcttaaaacccaggtctttcaatttcatgccttgggatttttccattacaaaatactgcctacacagcaccaaaagtaaattacatgtttccagagagctgtatattgaatatcatggaaataaaaattcaaatgatctgaaagattgaatgtatatttgaatattccaaggttttctactcatagcctcaaaaaagaaaaaggcaggacccaattaataagaatggaatggagcagctggataattagcaatagtacacctgttattactcctttttagttgtcgtttttttaatagacttctctttcagagggattctgagtctatttgtctcattgcaggcacttctactaccttggtttatgagtatgggggtaaaggaggtgtcattttgcggggaagcttacggaggaaagctaaggggtagtacataagtctgttttacagttgcaggaaatgccttcattggagagttttagaagtaaaacatggagggcaaaatattttcagactgtttaggtggccacagaggtgtagtagttgttttgttcaagttggataattatgagtcttaaaagaaaaaaaaatgtcaccaaggaaacaaggcaccaagttttagatagttttactttttattaagccatggttattagcctgctgtagaatgcatgagaccaatgtggaaatgccaagggcacaacagcatgtcaagcttaatgaagctcactgtgactgacacacttggaaaaggtcaagaagtgtgcagcagaatggacaacacacagattcatttcttccatgactgtgcactcaagcaaagcagcatggagaattgagccattattcagtgaaattcatcagcattctgttcaatgttgaccatacattcaagcaactctaatttactgcccaaattgtccactatctgcattctttacccactttgctctttttaagaccagagaggctgtgtggaaatacaatacacatatataagataattgtaattgtaatttacttctttctttttttttttttttttagcacagtctatgtgattttaccccttacaatagtgccaagagagcaattgcatcccagctccagtctgaaagtggttaaagtagccaggagtgggaagaaccagagacaagtttaaattgtgtccttgggagtatgaaaggtcaaagtctgagacactgaattctctggccaattctatggagtgaacttagggcccactgggaaaataagaaaaatataaaaagattcaaaattcaagaagaatagaattgggaatgaaaaagggagagctattcttaactagttcacccaagtgatcccatacctctaagattttcagtctagatttatattctcactgcagatctttctcttgagcttcagatttgaatacccaatggcatgttggatgtctacatctacatatttcacatctatttcaaatacaacttatttcagtctgctctgcctttccctaggactttgctgctcagtttttggcattacaattagcccaaattatctaaactaaagaaaaattgaatttacccttgaatctcttttccctcaccccaatcaaataccaaatacttccaattttgctctccgaatatgtcttgcattccgtccccttctttctgttcttaatatcactgaatggattcagtccgtccttatgtggcagagatgaagaaaccaagactgagggatgaagtaatttaccaatgggcggtgatggagtcagggttccagtctggactgtagggtccatcctctcccgactctgagctctcccctgctgtcccaccctgcctttaccaactcagacactgtccagtttcctaaatatggtgtgaaggcaaaaattgtaccaaagttaaatagataagaaagactttatttgaggctattgcaatgaaggagaactccatttcttaaataggaaatggaactcatttctgcttaaacaaagagcaggggagtttttaagagcagggttgggggtgagaatgaaaaccgtaggccatctgtgtttgttaactggccttatctaaaggaaaagtaaactttctcgtatcttcatgagaggaggggcttgcaaaactgcaactggaaacaacgcacccacagaagttaggctcctaccctcccacagaaactggaagatgggatgctatctccctgcatgtttgcatttcaaggaggtggctcccgggtctttaaagaaagacatccctgggttataaaattgaaaagaggcttttaaaaggatttatgtcacaaaaggttaaagaaataacttacaattacacattttctagagaaactgctttaagaaaatggagatctgggcctagagtcaggaagtatatgtgaagtttggccaaactgagggacatattaaggtcatcttctatagactacagggggcttcaatcatcaagcccttcccttcgtctctgctctactttctcaccacagagaactatgtattttgcctctgtgtcatcatcactatgtctgtggaactaatttttatgtaagggcatctttgcagtctccttccagaccaatctgtggtttgttgactgctactaggaatctgttctggggctaggagcctggagccaggagcttcttgttcatttggagaggaagtcaagggaacctgacattccctatcctcagctgccaaacaagatctttaacagaaaaacctccatcactttgaagaagacagaaatcagccaaaatacaaattagagtggaggaagtttagcttaatttggagttttcaatgaacatgagaattgatgctgtcagtggaatctggcatggaagcaggggaggtagaatattgtatcaatcatgtccatcttccccatgattatacaatttaaatgttctttagctagatctatgagtaccttctgaatgaaatactttaatatatttactttgttaccggtaaacttttatataccaattgtattagtctgttctcacactgctataaagaactgcctgagactgggtaatttatacaggaaagaggtttaattgactcacagttccaaatggctgaagaagtcctcaggaaacttacaatcatggcagaaggggaaggaaacatgtccttcttcacatgatggcaggatggagaagcatcgagcaaagagggaaaagccccttataaaaccatcagaccttgtgagaactcactcactatcatgagaacagcagcatggggggtaatcgcccctatgatttaattaactcccaccagatccctcccatgacacttggggattatgagaattacaattcaagataagatttgggtggggacacagctaaatcatatcaccaatcaaagatacttgatgggacaatgactgcttttaggtgaactttttcaacatattttaaacctctgcatatttgtgagttaataaatacttattttcagtgctctgaactcagtgtccctgtccttatactgactttcttggccttccaaataagatattagcatctgagttctctgcgctcacaggtaaacttggcccagataacatttatgtttcatttatttgtctaacgaacatttgtcagatctgacattgtgtcaaatgcgatgaggcactgtagatgcaagagtgacaaaacttagatgaatcttcctttcaacaagctcacagtgagtggataaggtaggtgttaaacaaataatcacataaacaagtacaaatgtgtcactgtcatgaactgtgaggcactgatacttagcagggatttgacttagtaaaggaagtccagggaaagcttcactgggagtctggcttataaaggatgaataggaattagctaggtaaagagacccagtaggtaggaatgactaaaagtaggtcagtctagctactgcgtagacagtgagagaatgtgaaagtcaggaaaagcctggataggaagacagggtgagctcacatgagacctttgaggtgttcagagcagatgtaagtgggaggctactgagttggcccaatctagaaacaatgatattttcatttgctgcatgagtttcagccatcagtgaagaaaaaagttcgtaagatatttgctcagagaacagaaaaccaaacactgcatattctcgcttaaaagtgggagcttaacaatgagaacacgtggacacagggaggggaacaatacacactgtcagaggggtgagggagggagagcatcaggaaaaatacttaatgcatgctgggcttaatacctaggtggtgggttgataggtgcagcaaaccaccatggcacacgtttacctatgtaacaaacctgcatgtcctgcacgtgcaccttggaactaaaaatagaacaaaataaaataaaataaaataaaataaaatacatgtttgcttagaagtacaaatccacattgcatctaatccactcttacaaattgcccttgattgaaatgtttgtttgtttttgccacctcggactccaagcttttatgtcctattaagtatgtggtaatcagttgaaatgccttgtttatagcattgccagtactatattcagaaatattcctaggctttctatctattgcattattaaatcagagcatggttcaagttcatattccttcagaagtacaatttattaacaaaataatcatggcccagaggaaggagtcaatagaaaatagaaggcatttaccaattactaggaatttgctttgtttttatttttgatagatgttggttgtaacctatacatattctttgctaagaaataacccttgagccatgtagagtcaggagttgggccccttcagaggctgaggtttgctgcttctgtgtactttccttccaaacaaatgaggttggagaaacaggttgatctccagaatgagaaactcttcagatgcttcctgcctttttatatctgcatttcagaatcaaaagagctaaattagagaatttattaatagttaaatttcaggtatcaattctgatataagtaatatcttgtggaaatgtctcttatatttgaagtattctaactggccaaatcaagtggatccttccccttaattactgattggtaagctttatcttagtttaaacttgaacaagaccagtggtttggcaattttaaataaattatattcatgcagctattcaaaagttgtcaacatgcaatgaaaagtgttcaatgaaattagttgttaatactgacaacagggattgtatagcacacatacattatatattgctatattaatctgactttgagaggtaacaggatgggagggacacaggttggcagaatacataggagaggaaacaaagcccttctttttatttatttatttatttttttagacggagttttactcttgttgcccaggctggagtgcaatggcgcaatcttggctcacagccacctccgcctcccgggttcaggtgattctcctgcctcagcctcccaagtagctgggattacaggcatgtgccaccacacctggctaatttttgtaattttagtagagatggggtttcaccatgttggtcaggctggtctcaaactcctgacctcagttgatccatccagctcggcctcccaaagtgctgtgattacaggtgtgagtcacgtgcctggccacaaagcccttcttaaagccagtaccatgaggaggtagcaaaactgggaggaacagctttgttacagccacagaaacagaattattaagcactggggctctcagacaaaatcttgctgtcccacttttaaagtgagcagaaagcaattgcatgtcggtgagcaactggatatcagcagcaacaatgacaggctggggattaccaacacaacccaatgtttttctggtaggttttagatttttgcactaccccagtgaatgactgcaattattaagccaactgagtggcatggggatccagggagacagagagatgagagagagaaaacgagagagagagagagatttaattagaataaagaaataatatttattatacatgtatcaaatgttaggggcaaaaattttttgattgaattccaatagcttttatgttcactatgcaagatgcagactaaggtactaagtgacccactaccagctcctcctcctcatcttatctgcatattctctctctcgtttactccttattttatcccactccatcctttcctcagtaatattgaagaggagcaattgtacctatttataacgtacacaggtcaacatgggtgtttgcaggtgtgggcagtatttccacctcccttgctatgtgctgttgagaacatggcaatatagcaacaaatattatgaagaagccctttgggatagtctgggttgccttcttatttgcatgacgtatgaccaacctgttgggtgactgtttccagatgtccttgaaactcaataagatgcttttaaaatgtcatcttaatgacagctgccacttttgaataatcctattctggtgatcctgtaatattagctctccccaggaatgcccctgtgatggttaatattagctgtcaacttgattggattgaaagatgccttgatggctggtagagtattgttcttgggtgtgcctgtgagggtgttgccagaggggattgatatttgggtcagtggactgggagaggaagacccactcccagtgtgggtgggcaccatccaattggcttgccagcacagcaaaaacaaagcaggtagaagaagatgggataacttcccttgctgagtcttctggtttccttctttctcctgggctggatgcttccttctgcccttggacatcagcctgcaggttcttcagcctttggacccttggacttaacaccagtggtttgccagggcctctcaggccttcaaccacaggctgaaggctgcactgttggcttccctggtctggagactttcagactttgactgagccactactggcttctttcttcctcagcttgcagatgtcctattgtgggcctttgccttgtgatcgtgtgagccagttctccctaataaactccctttcatgtatacatatgtcctattaatgctgtccctctggaaagccctgactaatacagcccccaaacattgtggtattgaagttatagtttcaacagtgattattacaatagtaacagtttctgtttatgaagcatttacaatatgccacacactgggctacaacctttatatgaattagggcttccagccacctctacattgaaaaccatcagtgacatcacattgtttttaggaggaatacccaatggtccccaaggcttaacctattctggcccctacctttcaggtctcattgtcactcatctctccctcatttcctgtacttcaggcacacacctagagctctttaaacgctcaattgctctcctgcctctggactctttcaactgctggtctggctgccagagcactcttcctcatgagaatgcactctgctttgctctcgtgcttaagtcttgttcattgtcatatgttcttaaagaccatgttcccttttcttggcgcacacatgtcaatttgctatatgtccactgatgtcattgtctttctctccattggtaccatgagaagggggtggactctacttgtgttcattattgcatttcagctgatattatctgatatacagtaaaggatcaatattagtactgaataaataaaagtatgaatggattctgttttgccaaggcttatatctattttatattagaccttaactctctataaagagacttgtttctgtggcagcattttttttttttttacccatctcacaggcatttggaacccactacaggggtcaatgagtgactcggtaactctgtcagactagacatgtatccatttccccaaagtcctggtcacttcaaacactgttagaagtcccactacacagttctaatccaattgatctatgtgctgtcttttagactttgaataacactgtggtcttatccaaagggaagagaagggtattgatatttatcaagggcctgctttcttcctggaacaccgtttggtgcctttcatacattcagttgaaataactaccagtgcattaaaaatagaataataattttaaggtattttggaaacataaagacctctgtaatattaactactttagaacatttcttagaggactgagtttttgaaatattcaactgcacctgcattgcttagtgagataactcactcctctacagataacctttgtgaaaataaaaatgatttttggcaatgtcattccctggagaaaatctgataaacttaaagtgattgcaaattatcccccaaaagatcaagtgtccttgttattgttaagccagtctctgcaattacaagattgtgtaagaaagcaagagttgtcttaactaatgtactgaacatttaacaattagtttccagtaaagttctcaccccacctaccttgaatgtctctctgtccattgcatcaacatatttggtggttgttgcctgttgattctttaagaggttatgatttttatttaagtaaaatgctaatcaactggaatggcaaactttgaggaagatgaaggatttccaaaaaaagaagaaagtaacattacggaactctttaatcacatgtcaaactaccaccaaatgagtctggcagagtgagaacagttaatgtcagaagaggagaaaatccacgaggactatgacatgataggtgcctcaaagagacagatctgagaatcaaagaattaaagggagtactggcaaaattgatgaggctgtttatgaggtgtttatgatcttgtgacacaagggccatgtttacatacaattttgaagggaaaattatgatctattaatcaacacctaattcattgtttattacataattcatatttacttaaaaactattgacaaaatgaactaatttcccttatattattttgaaagagaaatgcccaaacatattaaccttgttcaacatttagtatgacacctagacctccttgtagtaaatttacttcacatgcctttttccaagttttatgcgcccacacataatgaagactaaattcaagtcactaggttttatctcttcctttcaaataagttaagtaagctgttcccctgattttttgcccactctcaatcattcatgccagtcttatataattaattttcaaggttaaaacttgtatcatatcttctcctttcctgcctcattctttatatatgttcttatttatcctgtggaaaatgtctttgacacaatagaaatactgaggaaaatgttatcattaatattttcacacatttcttctgcatgatgaatgactatgatctataagagctgagtgttattatggttattgtatcattcttgcattgctatgaagaaatacctgagacctagtgatttataaagaaagcaggtttaattggctcacagttctgcgggatgtacaggaagcatagaactggcatgtgcttccagaaagttttctggaagtttacagtcatggcagaaagcaaagtgggagctagcacaacacatggtgagagcaggatccagagagagaggggagggtgccatacactttcacacaaccagattttgggagaactcactatcacgaggacagcaccaagaggatggtgctaaaccattcatgaaaaacccggccccatgatccaatcacttcccaccaggcctcacctccaacactgagggttaaatttcagcaggaggtttgggtggggacatacatccaaactatatcaattgtgataacaacttctctagttaggatgttctctgaatagtgaatctctttcttggatactttttataacgatccatgtgatgaaactgcagctaattttctatattacctgattctcatgaagtcaccacattttttttcacgtttgcaaagacagaaatactaatagtgtaacagaatgccagatcagatcaccgatctactgataattaacacaagtgaagtcaacgtacctttttaatcactatattgaagcactgttgattcatttatttaaaaagttgaagtaaaaattaaaaatattcaggatatattaaatccatgagtcagcaatgaacacattatatggggccaagattttgcttagagaaaaatgacttcaatgggttcttaatttatttttatctgagttttatttttggtttgaattacccagataaattctttaatgcatttttctatgtaaattaagtggaagaattatgtattcaggtgaaaataagtgggtaagtctattcgtatacgcagtctaccaaaagtaatttactgaattctttttatgttcttagttcaaaattataggcttgtaggacaaaaagaaataaggtatgttatgtaacttacattaacactgaagtatatagaaaggaaataatcaattctcttagtatctttggcagcagtactaaatattttaaagtttctactgtatgatttaattcattgtaatatctgagaaaaatacactaaagtataaaatgtaccaactgaaaaagacatgctcatacatgaatacctttagtatacactgatatatatgcacacatatttaaaatgtatatgtaatattacacttaacgaataatttaggaaaatatctaacaaaactttagcattctatcttattatatatttattttaaaacagctgatttactttaatgcactaatcatttcaaagaaactacttacaactttttatatacagtttatcatgaaaggcaaattaaatatgaatagaccataattttatgagctccaacttgccacaagaaaattattttttctgttgttttaaagaaaatgattgctctatagactaattgatttaataatggatatagacagacctcattttactgcactttactatgctctgcagatactgtgttataaatggaaggtttgttgaaattgtgcatccagtaatcctattggcatcatttttccaaacaacatgtgttcccttaatgtctgtgtgttacgttttgaaaattcttgcaatattttaaaatttgtcattattaatattacagctattatggtgatctgtgattagtgatctttgatgttactattgtgattattttggggcaccacacaccatggctatacaagaaggcaaacttaatcgacaaatggttgtctgattgttgttccactgactggaagttaccccttcttttttcctctccttgggtctctctattctccaagacaaaataatattgatgtcagaccagttaatgactctgaaatggcctgtagatcttcaaatgaaaggaaaagtcacacatatctcaccttacatctaaaactgggtatgatgaagtgaggaagggatattgaaagctgagacaggccaaaagctagccctcttgcatcaagcagttagccacattgtgaatgcaaaggaaaaagtgcttgaaggaaattaaaagtgataatccagggaatatacgaatgataagaaaaagaaacagcctaattgctgatatggagaaagtctgagtgttctggacatacaatcaagccaaccacaacattcccttaaggcaaagcctaatccagagcaaggccctcactctcttcaattctatgaagtttggaagaggtgaggaagctgcagaagaaaagtttgaagccagcagaggttggttcatgaggtttaacgaaagaaactgtctccatatatagaagtgcaaagtcaagcagcaagtgctgatggagaagctgcagaaaactatccagaatatttagcaaagattattgatgaaggtggcttcaataaacaacagattttcaatgtaaatgaaaaatccttacattagaacaagatgccatctaggactttcatagctagagaggagaagtcaatgcccggcttcaaagcttcagaagacaagctgactcactttttaagtgctaatgcagctggtgactttaactggaagctaatgctcatttactgttccaaaaatcctagggcccttaagatttatgataaatctactctgcctgtgctctgtaaatggaacaaagcctggatgatagcatgtctgtttacagcacagtttgctgtttattttaagcccactgagacctgttgcttagaaaaatatttcttgcaaaatgttactgctcattgacaatgtaccttgtcacccaagagctctgatgaagttgtagaagaaaattaatgttgtttttatgcctgcttacataacatccattctgtagcccaaggatcaaggagtaatttcgattttcaagtcttatgatttaaaaagtacattttgtgcttgcttacacagcatgtttattaaaattagaatgatacagagaagattagcatgggcccagcacaggaatgacatgaaaattcttgaagaattccatatttttgaaaattaaaaaaaattacaagggtatagttgccatacatagtgattcctctgatggatctgggcaaagtaaattaaaaatcttctggaaataattcagcattctagatgctattatgaacattcatgattcatgaggaggccgaaatatcaacattaatgagagtctggaagatgttgatttcaactttcatggatgacattgaggggttcaaggcttcagtggctaaagtaattgcaaatttgatagaaatagtaagaactagaattaaaaatggagtctgaagatatgacttaattgctgcaatctcatgataaaacttgaacaaatgaggaagtgcttcttatggatgagcaaataaatttttttgtttgtttgtttgcgatggagcctactcctggtgaagatgctgtgaacattgttgaaatgaccacaaagagtttagaaaacttaatttgataaggtattctaaatgcataaacttaactgataaagcagtgacagagattgtgaggattgattctaattttgaaagttctactatgggcaaaatgctatcaaacagcatagtatgctacagaggagtttttcatgaaaagcagagtcaatctgtggagcaagcatttttgttttcttatttaaagaagtttgcacagccaccccaatattcagcaacaatcaccctgattagttggcagccatcaacgtcaaggcaagacccaccactagcaaaagatcataactctctgaaggttcagatgatcat

SEQ ID NO: 38501 - DNA, 1356505 bp, Homo sapiens; identical to SEQ ID NO: 37563

SEQ ID NO: 38502 - DNA, 51703 bp, Homo sapiens
accatgggccggctgctgcgggccgcccggctgccgccgctgctttcgccgctgctgcttctgctggttgggggtgagtgcgctccgggcccgagcgcgggagggcgggcggcggcgtgggcgcggtgctggacagctccccgggccgccaacaaaggggccagagtgcggcgccgccgggagcgcgcgtgtcccggccgggccgcggcgccgccccgacacacgcgcacgaggagtgggtgcgtgggggccgcggcgggcgcctggcgtgccgggcgacccccgacaaaggcgcggcggtgaagctgggacacagcaccgtggcccccacgccgcggctctcaggggcaggtgcgcaggctgctgcctcgcgggccgggggggcgcgcacgtgtgggtgtgcatgtgtgtgcgtgtgcttgtgtgtgtgcgagtgcattgtgtgcctgcgcactcgggggaagaggcgtgtgtgacagccacgcggggaggaggccgcattgtgaaggtcccaggggccgcctgcggagtgtggggcgggtacgctgaggcgcgggtggctgtttacgcgtggcgttgccgggagggagtgtgagtgtgtcacggtgaatgggtattctctcctgttctgggcgactctattaggagctgacaaaaacgggcgtacagccacggaaggcccgtgacagcacacggcgggaggctcccacgcagctcacacacgagggaggtgtgagactcagatgtgtggtttccattcagcagccacgccgggcggcgggctgtgtgggtgcgtggcgggctgggggtgtggcacaggtgtgaaagggatgtgtctgcctgagagagaaagagacgggcctcctgatggcttccagcgcagacggggatttagtggagggggtgtgtagggaggtgggcatggggtgtgacagcccatgaggcaggcggccactatggaaatggcggggagaagggctgtctgcaaaggtgggtcaaataaggtcatagctgagcagctcctgcacacactggcagagcagagggagtgtgttacggtgtatgttaaggtgtgactggtgctgctggaggaatacccggatgaggaagtgtgcatgtgtgcctgtgcacactcatcagccagctgtaacttcacttctgatgcacacgtcaaaatagcgtcctagtatgatgtgtgtatgtgcatgtaggagtgtgtatgtgcatgtaggagtgtgcacaggacatttcccacgcagctggcccatgaagacacaggcactttgtgtccagatgtgtgtgagtgaaagagaaactagtgaagggtctctatgggaagggaggaacagtctttgcctgaggtgggccatgaacctgggactcagagtggcagaatcccagggtaaatggctgggaggggaaagtggtccctcgcacattcctgtgcatgtcatgggaaggctcagttcagggagggtacattttctccacagtcagtctagggatgaagaaaggccctaggtggtgtgcacagaaaaacatgtccatcagtgttggctcagacactcacacaaacccacctgtattctttcacgccgtaaatcctctttggaaaaaggcgacattcaataaataaacatcaattgattggtctgctatttctttgtgtgacagtcataaaccagaactggccagcaacgtcctcatggacccaggcccagctgtaactgcccatgtgcttatgtgaccagctgtgaggactgcaggcagcctgcctcccggctcctctctcccgtgcatgctcttcatgacgcacttcttaccccctgcttggagggcatgtgcgtgtgtctagcagtgtgtctctttcttacacacctttgtgtggaagcccttcagggacctgtcagcattgtttctcaggtgcttacagagtggaggtagcgtgactgtgctcagcagttcctgttgtcgctgacacttaagggtgaggagctgtgtgacagatgctgcagggcccctcccatgttggtgtctgccaagagcttagggagactggacttcaaagaccctgcttaggggagaggtggggtgtagctgatggtggaaatcagaaaggagttttgcaccgggagcagatcacagggactgatttgaaaaggtaagataaaacatgaggatcgctggggtcttgtttttttcacctccccaaatgtcagcctgcttcctttgcctccttctgtgtttgtttgggtcagattttcatttctttgaggctgatcccctaatccttttcatgtgccatctttttctctctcctctgttgggtgtgatgatgtaacagaaaattataggtgctagagggaaaaaggaaatcaatcacacgcagagtgtaattctgaaattttaagtcaggtggggtctcaattaaggcagattaattattaagtgcaaaactaattatacacagaatggctatgtctcagctactattttggtgtcatcttatggtgggcaagtttgaaaataagtaacctcttgtaattacttaaataaatacccattgccaaggcctttgaaaatatcaagttctatgtaaagacaaaacagtcattagagggaaaaataactttaagaaaatgaaactgtttactggaaaaggaatgaaaaaccgggaaaataccagattcctttttcttcagtagggttttcaaaatctttgccaattcctattagaccattgggaagggaagacaaagaaggaaagggagagatgttagaggaaggttatgggttcctggcttgacaggtgggagagctcagagaggtgggggctcactggagccatggaaatgacagggaaggggcctagcaaacacaccagaccacagtactgtgcacagacagctggactgactagaaagtgttttatcccccagagtggggaaggaaacaggctcctctgggcacaatgacctggagagggcagagcagtcttcttgagttccaagccattccgaggagccagagtagggtgtagacggcagcagcctccccgcctgccatgccacagcctctccctgccatgccacagttcagctccgagagagagtgccaaggtttgagagacaacccgtgtttaatccttcagtggttttgtagagagtgaatttcaaaattcttagggagaatcagtttacacttttctaacaaggctgaagtaatatctttcccagcatacctgctggaggttggagcatgcagatacagatctccagttcatggccctctcaaaggcaggctgcccgggtgccccgggaacctatacaatgtgtattatttaattattataaacattttccatcagttgacttttttcttcctggaatgcatgaatgagtttttccagatttgtttcttgtattttggctccctgccagccctggggatactgcttttgcaaagcagtctgctacatcggctcatatcccctaaagaacttagggttccacttcccaagagtttgtaattttcctgagggcaaagcctgtctcttgttcatctgtctcttgttgcacctccaggaagggcctaacacactgtttggcacagaataggagctcaggagtgactgtatttttctttgtaatcgagagtctaatagaaattttacctctaataagagcacagcccacctgaaaccaaagttcaattataattggatcacatctgattggcagtactacatgattctgattcacttttcaaaaattagaaaataactattaaataagtacagtttatagatgaaacatttccaaacacaggggccacatgcaaatgtaaataaagggattcttgcttgtgaaacattgggaatcactttactaatttggtctttttcaagagaagagattccttcaattgattggattggttgtggggaccctgggcagagtgtttggaaaggggtatcttctagtttttagctctggcttctttccctggcccttaaagcacatgaaatatttaagctgttttacatattctcttccttcacgtatcctttggaggaaggaaggtacccagccccacaagtaatagctttccattcttcttcctggagcatccacaagatgtttttgtgggggagaaaccagctaatttcagctcctctattaactagctgtttgaccttaatcccactaggcctcagttatttcatttgtaaaacaagagggttggattacaaattttgtgtgtgtgtgtgtgtgtgtgtgtgtgtgggagaaaccagctaatttcagctcctctattaactagctgtttgaccttaatcccaccaggcctcagttatttcatttgtaaaacaagagggttggattagactactaattatttattcaaacctttattgtgtccccatcatgtgtaaaaggttgtgctaggcactggaattacagggtggaattgaaacaagggactcctcatttacaatggaggctgtatgaaggtctcttacaatttggtgagaaaagtggcgtgacagtagtttgttgagaaggctgtgatagagaggagtggtgtctcatccagacttggagtggccacagaaagcttctcggaagctgagactgcaggcaggagtgagaattagcaggtgggtggtgggacaggacagagatggggagatacggatgttcaagcagaagagcatatgcaaagacccagaaggcaaaagaggcggctgtgttctggaaattgcaggtagtcagtttgtctgaagcgtagagtatgattggggaaggtgggtgcagagaggggaggggaggtaatggtcagtttatgagagccttctcgccttttcaaaggatctgacctgtatgatagaatgatagaaccagatttgcattttaaaaagacctctcggcctgtgcagtggctcacgcctgtaatcccagcactctcggaggccaaggtgggcagatcacctgacgtcaggagtttgagaccagcctggccaacatggcgacaccccgtctctactaaaaatacaaaattagccggtcatggtggcacatgcctgtaatccctgctactcgggaggctgaggcaggagaatcgcttgaactcgggaggcgaaggttgcagtgagctgagatcacgccattgcactccagcctgggcaacaagagagaaactccatctcaaaaaaaaaaaagttgactgggcacagtgactcacacctgtaatcccggcactttgggaggttgaggcaggcagatcacctgaggtcaggaattggagactagcctggccaacatggttaaactctatctctactaaaaataaaaaaaaaattagctgggcgtggtggcaggtgcctgtaatcccagctactcgggaggctgaggcaggagaatcgcttgaacctgagaggcggaggttgcagtgagccaagaacgcgccattgcactccagcctgggcgacaagagtgaaactgtctgaaaaaataaataaaaataaaaaataaataaaaagacctctctgagctttgtcactcaaagtgtggtccacagaccagcagcatcagtcacacctactgtgtcagaagactcgggtgactcacacacatttcagtctgagaagcgctgattagagggcagtgttcgggacagatgagtgcagggggaattgctaggggttcgtaaaagagctctctttttcttccagcggtgaagcactatgaggactgtaattctaatggaggcgtctctcatgtctacacatctatgtttctgtatcgtctctgctgttttgctttatcgtgaagtgtggggcatttcggccatgtgcccccctgagtggcatggttgtctaccctagagaaagggaaactgaacacatgttcctgagatcccggtgttgttatttcctccagcctcctttctccttcacagtgtactgagcacagttagtacagtgccatgagcagttctgttagtagctacctttgagatctctctccctgccctactaaccctgtggctcaaacagagttatatggtcactgttacactattccataatgatttgttttcttgctggtctctgtagtagaaactgacccttttggggcagggaccctatctttcttatttctgtaccaacatagccttggatcatgcctagtccaaataagcatttaataaaggctttttggttgaagaatgaatgaatggatggatgaatgaatggaatttaaccattcaaacactactctgatccaaaaggagaacttgatttataatttgtcttaatgtatcatttggctatttctgtgtaataaatcaccccaaaatttagtggtttcagattctcagttcttaagatctgatccctggacagaagcatcacctgggaacttgctagaaatgcaaattgttgggccccgtcacagaccagctggattcagaactctagggtgggcttaacagtctctgttttaacaagccctcatggtgattccatgctggttcaagtttgaaagcactggattaaaacggtagccatttatttagctcatgattctgtagtttggcaatttaggctgcagtcagctgggtggttctggtctcagctgaactccttcaagtttgtcatcagctgtttatcacctttgctggtcttgtctggctctctcactttgggacttcagctaggacactgagctgatctggctctcttctgcatgggctcctgttttcctgcaggctagccttgagcagaatcctgagagaatggaagcgtgcaaggtatcttgatgcctagccttggaaatggcacatcatcacttctgcattgtcttgtgtagcaactcacaaaggtagctcagattcaaggagtggagaattagatttcatctcttgatgggaggagctacaaagtctcattgcaaagatgtgtgttattaattgggagtcattggataacccctctcaggaagaaccttaagaaggtactgttttggggtaggacagggcactctgtttctttcccatctacctagtaggggatagatactgctttcttctataatattcgggctaggaaaaaatccaagagtagcttagggtccccccgtgatgtgaaggggaattagagtggaagaggtcatgggaaagtcttgagctagagagagtacaagtccttaattcatcctctcccaggaacaaaggggaacttcaaggggagtggaccccaaattgattgtcttggctttctctgccttttaaatacctttggctcaaagaaaccacaaaatatgagatggctgtttctctctttgagtcagggattcagacacaggctctgggaacatgacttcagcttcgtggagccaggccctgcctggaagcagaatctttgtccgtggacatggtgcctaggacagcagaagacattccggatggggtgtgatagcttcctggtttggacttggcagaaggcaatcccctgtgagcagtcctcaggagcactggcaacacagcagtgccattggctcccacctgcccagggtcacagcttgcccaccctttaggtatttttttatttttatttttttgagacagagtctcactctgtcgcccaggctggagtgcaatggcaccatcttggttcactgcaatctctgcctcccgggttcaagcaattctcctgccttagcctaccaagtagctggagactacatgcgtgtgccaccatgcccagctagtttttgtgttttaggagagactagttttgccacattggccaggcctgtctcgacctcttgacctcaagtgatccgcccgcctcggcctcccaaagtgctgggatttacaggtgtgagccaccacacccagccccatcctctagttatgatgatactttctaaagctgagagttgggcctgtgaattatcttattgagagacagagcttcacgggatcttagaggttggcacagacgtttactagccctggtcagatgctaaggctctgatgcctccttagccccggcgttggctttgaggccatgtagaatcactctgatattcttattcacatcaaccttttgttttaatgtatttgaagataccatggtctcttttaaatatttttttccccgggccatgaacttcacaggtctctgttttttatataggataataacacaatatttgtagaatagtttggtttgtaaagctctttgtagagcagctttcacacatggctcaccaattacctcatttggtgcccctcacactggaggcatggtaggaattggtgtccttattacacagaggaggagagcaaggctggtggtggtgaagtcactcagccagagaagccagagtgtaacctatttcctggtaccaggctttctctcctgttatatagaacatcttcctgtctctgacctcagggcgtctctcttaccctggagtctctacttcccatcccccatccacacaacccagaatacacccctgtggctggatgtggcattattggctgtgagttgtctggctgctgcacagtgtgcacagactccctcatacggagactcacaggacagtctgaaatgctcatttttttcagtggccagtcacagtattggcacgtatcaagcttagggcctgctcagcaaagcacatggcaccaataatattagccctatttttattataagcatcactaaaaattgccatgtactgtagtcaagtcaggtcacagtacacatctggtgtagagcaagaggaagactgtgaaattccctcttccctagatccttaagtgttagtcttggaaaagaattcagaggtcatttcatttagcttccttgtctatctggtgaggagactgagacccagaggtcttgagcagctttccaggagcctcacagcaagttagtaatttgtgtggttaggtcattaagttagaggttaagttgtgaaactggcaaatagggctatattcctgtccttaaagaatgagagtgaaagaagaggaaaaaggcctcctttaatttgttttcctgtccatttatttgcttgttttggtaaattaggagagagagagaatccaagattctaaacaaatatgtcaaattaccagcactgggttgagtttgaactgtgacctcacgtggttttttaaaagactacgttcagaggctgggctcagtggcgcacgcctgtaatgccagcactttgggaggcctaggagggcagatcacttgaggtcacgagttcaaaaccagcctgaccaacatggcgaaaccctgtctgtactaaaaatacaaaaattagccaggcgtggtggtgggcacctgtaatgccagctacttggggggctgaggcaggagaatcacttgaacctgggaggcggagattgcagtgagccaagattgcaccactgtactccagcctgggcgacagagcaagactccatctcaaaaaaaataaaaaataaaaaaactaaagactatgttcaggatactgtattgctgaaatacaaatgatattcataatgcagttttggagaaatttcagccaaggatggaagcctggggaacactgtgttcgtccaatcatactgctaggtccttaaaagcatgggccctgtcttcacttcagtttgtagctccaacacccagtacaattgccaacagagagagggtactcaggaggcattttctgagtgaccacatgcgcagtggaacactgactcagtgattcctctctctcccctgcctgtctccatctgtctccccttgcccctgccatagggaagtctaagcaatttggcctttttgaaatgaaaatagtgtctcagaatccccgcaaagcctctgggttttcaggagtgtccactgaagtccccccttccccaggacctttgtcatttgagacatgctctaacctggcaccagtcttgtgtcttctctagcctcccctgactgtctggcttttatgtctgcacaggagcgttcctgggtgcctgtgtggctgggtctgatgagcctggcccagagggcctcacctccacctccctgctagacctcctgctgcccactggcttggagccactggactcagaggagcctagtgagaccatgggcctgggagctgggctgggagcccctggctcaggcttccccagcgaagagaatgaagagtctcggattctgcagccaccacagtacttctgggaagaggaggaagagctgaatgactcaagtctggacctgggacccactgcaggtagctcttcttacctacagagcatgtgttgagtgccagccaagtgtctaggcaaaacaccaggtgaccatttccttgccagaagcatctcttctctctccctacagtttttaccatgctgctgctgtttacctgcacatcagagcaaaggctctgggaccctgaatgtctcacaggcccaggaggccctttctctttaatactaaccactgtttagggagcctttattctgtgctcatttaattcaatctgatgcttataacctgagagataagtaatatgaccccccttgtagacaagaaaacactgagactgagaggttaaaagctggcctgaggtcaaacagcagctcagatgctcagtcatgattcagacctatggctttccaagccctggggctcattgttttgtttttccctactgctctatgctgtctctgttgaagattgccacaaggtcagctgatccatgtttccttgagtctatccgaccagcaattgaggcattctaaccgcccttccctcagtcatgcaccagagctagagctggtgtttggatctacagagcccagctggtgaacatttgggtcccgaagaaagcccgaggcctagggctccaggtttgaatgcccaccgccatgagctgacattgatacagatgcaggcatggcccctccaccaatgtcctgggccagcagggccccatctcttagtagggactgaggaattggtgtgattgtgtgtgcacatggggcaaggtgttacagaacttaacctttaatttttctttttaaaataggtaatatttattggatttaccttttctaattataaaagaacacatgaacattgtagaaaatctgaaacacacaaaaataatacaaagaagaaaataaggctgggtgtggtggctcacgtctgtaatcccagcactttgggaggctgaggcgggtggatcacttggggtcaggagtttgagaacagcctggccaacatggtgaaaccctgtctccactaaaaatacaaaaattagctggacatgattgcgggcatctgtaatcccatctactcaggaggctgaggcaggagaatggcttgaacccgggaggtggaggttgcagtgagctgagatcgcaccactgctctccagcctgggcgacaagaacaaaactctatctcaaaaaaaaataaaataaaataaaaaataaaaactacctataacctgataattgaaagataattactattagtagtttggggatacattgttctagtcactttatgtgcaaaattggaatcatagggacattttgttttcactcaaaatatttcataagtatatttccgcattgttaaatatccatttataacctgatttttaaacatgttattatttatttatttttttgagatggagtcttgctctgtcacctgggctagagtgcagtggcgtgaccttggctcactgtaaccttcatttcctgagttcaagtgattctcctgcctcagcctccgagtagctgggattacaggcatgcgccatcacacccagctaatttttgtatttttagtaaagacagggtttcaccatgttggccaggctggtctctaactcctgacctcaagtgatctgcccgtctcggcctcccaaagtgctgggattacaggtctgagccaccgcacccggacaacatgttattatttatttatttatgtttagagttgaggttttgctccattgttcaggtgtgatcatagttcactgtaacctcgaactcctgggctcaagcgatcctcccacctcagcctcgtaggtagcagggaccaaaaatgtgccaccatgcctgactaattttttcatttttttgtagtgatggggtcttgctatgttgcccaggctggtcttgaactcctgggctcaagcgatcctcctcccttggcctcccaaagtgctaagattatagctgtgaaccactgtgcctggcttataacttgatttttttttcttgagacggagttttgctcttgttgcccaggctggagtgcagtggtgccatcttggctcaccacaacctccgcctcccaggttcaagcggttgtcctgcctcagcctcctgagtagctgggatcataggcatgtgccaccatgcccgaataattttgtattttttttagtagagacagggtttctccatgttggtcaggctagtctcgaactcctgacctcaggtgatgtgcccacctcggcctcccaaagtgctgggattacaggcatgagccaccgtgcccagccctgatttttaacaactacgttatatttcatcatgtgggtcatcaggtgtattaaactggttccctactgttgaatacttaggttgtcttcagttttaattctgctacaaatatccttacacattttcgcaccttcctggtggtttccttaggataaatttctagaataaaattgataggtcaaaagatgtattagggccgggcacgtggctcacgcctgtgattccggcactttgggagttcgaggtgggcagatcatgaggtccggagttcgagaccagcctggccaacatggtgtaactccgtctctactaaaaatacaaaaattagccaggtgtggtggcggacgcctgtgaacctagctactcaggaggctgaggcaggagagttgcttgaacctgggaggtggaggttgcagtgagctgagattgcaccactgcactccagcctgggggacagagcgagactccatctcagaaaaaaaaaaaaaaaaagatgtatcagtcagcatcccacgcggaaacagaagacacaatcaaattaaaacaatctaaggagagtttgtttatgaagcagcagatttatgaaggtatgggctggatacaggtgaactaccaaaggactcacaagtcctttggctaaggatctgtggctagcaacagctgagtgcttaccatctctaggcacagtgagaccagggaagggatgaagatgggagcctgcagggaaagtggtgtagagaggtggccagatatgggaggagacgaagagaatgaacgccgcaccccccaccaagtgttctctctttcccttgtcagtttgataggaaaaattataatggcctttgattactagtatattttaactcatatatgtacaaaacatatgtgtacgttcattatatacagaatatgtgtattctatagaatatacatatacacaaaaatagtgaccacttatcactcttcttttttatttgaagcacagtgtagttaagagaacaggctttggagtcaggaaggctccagtgctgtcatttaacagtgatgcaatttttggcgagtaactaaccctaagcctcagtttcccatctaggaaatggagataattatatacctacctcacagggttgtgaggttcacacaccatcatacatttcgagcactcagctcagtgcttggcacattgttaagtgctctgtgactattagctattattattactttcctgtttttttctattgagtctttaattttttcttatccctgtacaaatctgaaaaaggatactaactttcctctgacatacgtagaaaacatttttccagtttgtcaactgcttgtatttttattataatttttggcataaagaaattaaatattttataagcttaaaattactttttttttcttcgagatggagttttgctctagtcacccaggctggagtgcaatggtgtgatctcagctcactgcaacctctgcctcccaagttcaagcaattctcctacctcagcttcccaagtagctgggattataggcatgtgccaccacgcccagctaattttgtatttttagtagagatgggatttcactatgttggccaggctggtttcaaactcctgatctcaagtgatccacctgcctcagcctctcaaagtgttgggattacaggcatgagccaccacacccagcaaaattacttcttttaaaatgtttttatgtgtttttctttactttatgattagaaaatactttctgcccttgagatacatgcacctttcttccttctattctttttttttaatgtaaattctttttttaaaattatttttattttttggacacagggtctcgctttgtacctcaggctggagtgcagcagcacaatctcagctcactgcagccttgacctcctgggctcaatcgatcctcctgcttcagcctcccaggtagctgggactactggtgtaccccaccacgcctggttaatttttctgttttttgtagagacagggttttgccatgtttcccaggctggtcttgaactcctgggctcaagcaatccacctgcctcagcctcccaaagtgctgggattacaggtgtgagccagcacgcctggccccttctattctttagcttaattttttacatttaagtccaatctagctgtaatttatttttgtgtgtggtgtaagataaggatctaatttcattttctccatatagatcatctattgtcatggcggcatccattgataaatctgtcctcttatcattttaaagaaatgatattttgttgctgttgttgttttgagatggagtctcactctgttgcccaggctggagtgcagtggtgtgatctctgcttactgcaacctctgcctccgaggttcaagtgatcctcctgcctcagactccctggtaactgggattacaggcgtgccaccatgcccagctaatttttgtaattttagtagaggtgggttttaccgtgttgcccaggctgactgaactcctgacctcaagtgatcacccaccttagcctcccaaagtattgtgattacaggtgtgagccgctgtgcctggccaaggaatgatttaaacaaacttttacattgtaccagacaattattgggtctttttctggcctttcccttttgttgagactattgagcgtctagtgtgaggtaagcagtcacgcagagagcattggcctcaggaccacagtggagggccctgaagccttgatgagctcgatttgttgtcctcccccctccccaggggattcgtttccctttctttttctttcagttcatgtctcttcctctcccatttccttccctaggtctcataagaataaaaatagctctcattcattgaataccggctatgcataggcctttgcctcgattgtctctagtcctcaccacagctgcatacagcttggctgtgaggtggagataccaatcaccctacccaggatgggcagaaggctagggaggtgcagggaggaggccaggaggcagaggaggtgcagggaggaggccaggaggccaggcaggtgcagggaggagagttgcttcagtcctgtccctcattgctcctctcttgacctgtcccctcgccttacgtttcctcaggtcaatctcttctctgtactacctgaccatgatcctgtgaaaaaactggagttgcccatcttcttctcaaacaaactagcaaacaaaccccttctcaaaccccaaagcccacaggttaaaggctgaacttattagcatggcagaaaatgctcttgatagtccggccccagccttccccagcctcttctccttccttgctccagcatgcatctgattagctcatcatcagcttgttctcttccttgcttggcagagttgaactgaggcatggggaagtagggtgctttgcccaaggacacattgcttggatgtaatggagctggatctagagtcagtgtcttctcactgacaacagcctggcctattccctaagcctgtgatgcacttgttcctcttgtcccatctgctgggaagctcttctccatcctgatgtgctagtggatatgtattcgtccttgagtacctagctcaagaggactagcttcaagaggcttttgccagctctgaccaatgagcaggaccagtgcacgtggttatgctggtggtgccctgtccggggctcctgaccgagcatgggagttggagctgaagtccagcatacaccctgccaaccaggccatgggctgggtgggaggagcacctttttctaattcatttgcccagaggggacatctccgtgtactggcagtggccctgaaatcaggctagtgacccctgcttctgttttcttgcagcaccttgatggcatatgattaggacatgacagaagagaaagtggctaaggtggcaggctgacagcgaatagtcaggctggtgtaggaggcagcccaggggacagtggcgtgccctacccccctattcttgtctgctcttgtgccccggagccacaggcttctgtctaggggttcttggggagaaggaggtggatcacctcttgggggttggaggagtcaaaagaaccttgagagggcatgcctgggttgggagtcctgcagagtccagattgactgtgccaagtgctatcctaacatggccattagggacattgaactccatgcagcagtagcagggactgctgaaaaccatgctgcagacaggccaatctcagatcaagtacaagtacatcaatcaatgtattcaacacccagtatgtgcccagcactatgttaggggttgtgggttctcatttaacgtccactgaaaaatgtaagtatatattcttacttccatttagctgataagcaaacctgaggcttagggagtttgaatttacagcccagcaagtaaatgtaagaatcaggattcaaacccaagttattagactccaaagcctctctgccctgtcatgtcacctctcagcacagtgattttgctggagactagcactaatgtcatattctatgtggtacttatcaccatttttccatagattttttttttttttttagatgaagtctcactctgttgcccaggctggagtacaatggtgcaacagtcttggctcactgcaacctccgcctcccaggttcaagtgattctcctgcctcagcctcccaagtagctgggattacaggggtgcaccactatgcctagctaatttttgtatttttagtggagacggggtttccccatgttggccaggatggtctcaaactcctgacctcgtgatctgcccgtctcggccgcccaaagtgctgggattgcagacgtgagccaccacgcctggctccatagaattttgagttagctcatttggacttcacaaccattctgtgagctcagccaggtggcagttattctctttgcttgacaaatggtgagctgggccaagggaggttcagacctttgcccaaggccacacagcttgtgtgtggcagagccgaatctggagtcggtatccctgagcactgatgccctgggcctggcttcttgccaagggagcacattgatgacacatgtgagacaggaaaccagtccattctgtcactaggactttgtcatacatcccatttctagtgtgttgggcctcaggtagagctgatgccttccttctccatctgtaatgatggtccccgggcccagtgggaaaaacagctggtggagtttctgcttggtggataatgagcagtgtgaccttgagtgtgctgcttttctaatgttggcttcagtctcttcatctgcaaaatgagacctgggaataatagattgaagtctttgcagcttgaaaatattatgattctgtgacatttcaagtgaaaagagcaacctcaacaaagcagggaaaaaaacatggaatgcgaattgctgctccaccagctagcatcaagtgaagttacagcctgaccagttaattcatgcacaattgttaatgattaggagcagtctctcaggttacctactcattcgagactgtccccactgacccctctagccctttcattttctaagctccttaaggaaattgtcttgcatgcagttttaattttcctagtgagtgagcaaattaaagtgttctgcaagaaacactttaatctttggggttggcaagtcctagatacccaactcagacaggctcacgggcctgtctgataaaaggggactttattggctgaagaacgggggtccaggaacaggcttccagctccagcactcggcgtgccgccctcaacgtgctggagcctgccctgtcccatcagtcatgctcggctttcccttgctggcttcgttctcaggcaggctggtcctgggcaccggcttggagagcccagtagctccacactgtcgtcccatcactcagcaccccgcagaaagggagctctgccttcccagcacttcaggaacagtcactggatggtctccctgagtcccaagcttggggatggaatttgactgtccaggcccatgttgagctgtccctgaagccaggggacattccagaccaaaaagagaggaggaatgtcccccagagtagaattgaggtgctattaacagaaagagagcatgagacaacagtactgtgcttgagtagggaacactcataaagtgcctatacttcatatgtcattttcacttggatttttttttaacctcacagcaacctgatgaaatctgtaaaagcaggcatgattagatcactgttttacagctaaagaagctggctgacagagatttaaaagtggctctaaatgacatagtggcagagctaaatctcaaatctgagagttctacttcaagatctgctgctcccctcaatacaaagtccttcattaggctactttaattatcattgccgtaatcaattttggagaaagcagaccgaccgagcagctgtctgctgggacctggagctggttcctgtacagcgaagccttgttgtgattgtgtctgctgtagaatgatttgaccttctgggtcattgcccacacatcaggtgtatccatgtccttaggatgggccgatagctgtggagcctgtggacagagcaacaaagagagcacttttacttagacaccaaaacaaaagccttgtcattcttgttctgtgctagtaataaatatcaacatataaaaatttaaaacagcaattaaaagaagaaaataaaaatcacctataatccagtgattcagtcagtgaatgttaacgttttggactatctctttctggacttttttttttttttgagacagtctcactctttgcccaggctggagtgcagtggtgtgatcttggctcactgcaacctctgctgcatgggttcaagtgattcttagtctcctgagtagctgagattacaggtgtgtgcccctatgcccagctaatttttgtatttctttttttttttttttttttttttgagacggagtcttgctctgtcgaccaggctggagtgcactggtgcgatctcagctcactgcaatctctgtctcccggattcaagcaattctcctgcctcagcctcctgagaactggggctgcaggcaggtgccaccacccccagctaatttttgtattttcagtagagacggggttttgtcatgttggccaggctggtcttgaactccaaacctcaggagatccacctgccttggtctcccaaagtgctgggattacaggcatgagccattgcacccagctctttccagactttttttttttcctttataggacatatataaaaatatgcttttacaaaaaatggacaatagtggacactgtggtatacacatcttgctgtttcacttagaaacctctttccaagccagcacacacagctctgcagcctgttcaaggctgccatggtctcccagtataaggcgggtctatcatttctttgggcagtcccctgccatgtgggtgctggaccccagtcttctgctacatggactgtgccatgatggggatctataaagccacatgactgtgagcgtccctaatcgtctccttagggtacctttccagaagtgagattgtaggttcagaatatttgtctttaaagcttctcgttcctgtgactcagtagctctccagaaatgtggcctgctttccttcccatccctcacccttccaatactaggcatgaatgactttgaatgtatacatatacttgtcaggttggtagtccaaagattttggcattttgcagtttactttatattcctttgatgactattgaggttgactatcaaaaagtagttttaagccaggcatggtggcttacgcctgtaattccagcactttgggaagccgaggcgggtggatcacctgaggtgaggagttcgagaccagcctggccaacatggtgaaaccccgtctctactaaaaatacaaaaattggctgggtgtggtggtgggtgcctgtaatcccagctactcaggaggctgaagcaggagaattgcttgaacgcaggagacagaggctgcagtgagcccagatcacactgctgcactccagcctggacaccagaacaagactttgtcttaaataaaaaagtagttttaagttatactaaaacgtcttcccttgcacctctgttttagacatatttatttttaattttgagtgtttttatattaacactcagttggataactgacttgagagttgtagtgaggggacaattttcagtgacttgacattaacctaaagggacatttaaagtgatctttcaagggctctggcccttatgcctgttttaattctgtctcttgaatagaagaatcagttcattgatatttcagcctgtgctgaagttcatccctgggattatggctgccctgagagatagaagtaaagtccagagtgacttcgataaactggggaaagaaacctatacagaactgtgatgaaatataggagggaaaaatgatctatttagggaacaaagccagcaccataatgagtttaaaagaaagcggagaaataaggcctaggggacccaggcctggggcttcatcagggtgagctggagctgcatctgagccagcaccaacccatcacagggggcgcgggagagctcagcttaccagctgtgataaatgacagtagtgccactggagtggagaaacccctttacattttgcatcaattagtctcaagttagtgaatcttgttcagttttcaatagttcattcagcaaatatttactgtgtaccccctgtgctgattttgtaacactcttttttgttttttgtttgttttttttgttgttgtcgttgttgtgacggagtcttgctctgtcgcccaggctggagtgcagtggtgcgatctcggctcactgcaagccccgcctcctgggttcacaccattctcctgcctcagcctcctgagtagctgggactacaggcacccaccaccacacccagctaatttttttttgtatttttagtagagacggggtttcaccgttttagccaggatggtctccatctcctgacctcgtgatccacccacctcagcctcccaaagtgctgggattacaggcgtgagccaccgcgcccagctgtaatactcctaaaactgtggtgaggctgggtgcgatggctcacacccgtaatcccaacgcttcgggaggccgagacgggtggatcacctgaggtcaggagttcaagaccagcctgaccaacatggtgaaaccccatctctactaaaatacgaaaattagccagatgtggttgcgggcactttaatcccagctactcgggaggctgaggcaggagaatcgcctgaacccaggaggcggaggttgcagtgagttgagatcgtgccattgcactccagcctgggcgacagactaagactccatctcaaaacaaacaaacaaaaaacaccagggtgaatccagagttttcacaagagaaggatgaaaacagaaaggttgagaataaagaataattacagttgtttagccccaggaaaagaagctaggtttaggggcaactaagagactatgtacattgtttcctctgaaggcggtgctagcaggtgctgctcacttaccagatgaaacagagatggacttgagttgtaaaggaaccatcacagctgggtttaggcaaatgggggtgtaggggtaagtcaataacacagaaatgcctctctaaagagacccagccatattcttgaagataattgccagcccatcttctctagactcaccagtgcctgccagagggctgaggcctcgtcaggtagcctcctgtggtcccttcccgtgttaggaccctgaccctaaccacggatacacctgccgtgagctgggctgtgtggatgctgagaggagcagagaacatggagtgtgacagaaggaaagtgtgccttctgtgggctgggtgttttgcattcctgatgccacttcatctttgtaacaacctgaggtattagcctcacatcatggagaggtgggtgtgtggcacacagaggcaagtggccacccagaattccagcccatgcctccagaaccctgaagcttggcctggggctcttaacgccagccactcttgtgattcaagcccagctttaaggaggttggctgcggccacaaaggtacgggcagactggggagaggtcatgattctgcttgtcagcttgctcctgtccagcatcccaagccaagcccgggtgctggactaaatgaccaggatgtgtcaaaagacactggctttaaccacacaagagtctaagagtcttacaactttacaactgtgacaagtctagcatcacaacttagagcaagaatcctcctctcctgggctccctcatgtggaaaaggcgagagatgggccctttgctcttgcagggcctctgtctacctgtaaaatccctgagtctgggatttggagacccaactgttctgagggctctggggaacatgtggtttctgtttagagccaccagggggggctgtgacttcacagtgccattcccagcagttctgggagggtcgggagcccaggagcctaagtgttatcctgcaatcaatccaggaggtcctccagggctctcctgtgcaacgagggggtctgccccaggtgtcttctgagctgcagcttagacattcgtggcctcccatgctccgaggcccagcccgagcctctccctggagggcttgagccttggatgacctttctcatccttcagtgccccagctcttcctgaggacagggatgaatccatggagccagcccttagacttccacgtgtctccagtgtgtctcccgggcggctcggcttcctcacacctgtgtccaggtgtggggctctagaggtacaccttggtcccagacacgcttttggggtttggctacaaactaaaagggcttcgtggagggacccttctcctgagcctgaagtggatggggtaggaagggattccctggagcgctcagctggtcagaccctccctctggaatcagagctgtccacggcagcagggctgagggtgtgggcatcaaggacttgccctgggtcactgagggcaggctgggagggcaggtagccctgtcatgtgtcccctctctcctccctctcctcttgcctctcccctctctttactctcctcatcttcatctccctccttttcctgctcagcttcacttctttgtttctcttcttccattcccaatttgatcctttttcacctccaaagtgcctgctgaggcttcctctcccctctcaatgcagcgagtccctagaagcctgatctgtattccttggacacctgagtgggaaaagcaccttcctccctgtctctcaaaactgtctcacctgcttcagggcggtgtggctccttcctgccacagggctctgcgctctcagccaggatagcctgccctgtcccttgccatgtttctattcccctcttgacagctcaagcatgttcgctgacctgtagtgaaagtcagtgtctcaggccgggtgcaggggctctctcctgtaagcccagtactttgggaggccaaggcaggcagatcacgaggtcaagagatcaagaccagcctggccaacaaggtgaaaccccgtctctactaaaaatacaaaaaattagctgggcgtggtggcgtgtgcctatagtcccagctactcaggaggctgaggcaggagaattgcttgaacccaggaggcggaggtttcagtcagccaagatcgtgccaatgcactccagcctcggtgacagagtgagactccatctcaaaaaagaaaaaaaaaaaaagagagaaagtgtctctcacatgtgcacgctctctctgttactccttattttaaaaaattttcaatttacagaaaagttgcaagaataattccgtccaccccttgctcggactcccccattattaacactttgccgcagttgctgtatcagtgtgtatgtgtacatgtatggatatggagatgcagatctgtacttcttgctaaaccatttaatggtaagttgcagacatgatgctcctttgctccaaatacttcagtgtgcatttcttaggaacaaagcattctcctaaaaaccacagcaggatgatcaaaatcaggaaattaacactgatacaatatgcttctgtaattacaaactttattcaaactttgccagttttcccagtagtgtcttttatagcaaaagaaaaaaagagcagggtttcatagtccactatccggtccagaatcacgtactgcatttagtccgcatgtctcttttgtctcttttttattctggaaaaccctctaatctttctttgtctttcatgaccttgacattgttggagtgcaggccagttattttgtagattgcccctcaatttcagtttgtctcaaatttccccatggtcagattcaggctctgcatttttggcaggcatattgtggacgtgatgctgtatcttcttagtgaatcgtaccgtggttctgctcttgggtaaagcctggcttcttcactctttattctcaactcccatttggatccagtctcacgggccctctcctgggacccctgctttcacactgctggtgtttgccctgcagctgcccacacagacgcccctcaccccactggttcctagtgtgtgctcccatcaggcctcccggtaattctgtttctgttttaggagacatttgtaatactgaaatcatatttacacttgtcaacagatgagtaatcccctcctgccctgccctttttcctagattttctttgacttaaaactcaagtgcttaggctttagttacattcggtataaaaaatgaaaaataaaaactcaagtgcttatcctgctcctcattctatggagacacttccacttttcctgttattattttaccaggtaataactcctttaataataataatggcaggcggatggccaggtgcggtggcttacgcctataatcccagcactttggagggccaaggtgggcgaatccacctgaagtcaggagtttgagaccagccttgccaacatggcaaaaccccgtctctactaaaaatacaaatttttctttctttcttttttttgtgagacagagtctcactctgtcacccaggctggagtgcagtggtgcaatctcggctcactggaacctctgcctcccgtgttcaagcgactctcatgcctcagcctcccaaacagctgggattacaggcacctaccaccacacctggctgatttttgtatttttagtagagacgggatttcaccatgttggccaggctggtcttgaactcctgacctcaggtgatccaccccccgcttggcctcccaaagtactgggattacaggcatgagtcaccatgcccagccataatacaaaaattagctgggcttggtggcaggtgcctgtaatctcagcttctctagaggctgaggcaggagaattgcttgaacctggaaggtggaggttggagtgagccgagatcacaccactacacttcagcctgggcaacagagtgagactctgtctcaaataataataatgataataacaacaacaataataatagcaggaggaggtggaggaccccccacagttaactgagtgtttactctgcactgcggactgtgcgcagggtcacctcactgaaccctgaccagagccctgtgtggcaggtactatttttattttacacttaaggaaagggagacacatggaggttaagcagcatgtccaagatcatacagctgataagcagtgaaactgagaccacactgtaaaaagaaaaggaataattttagatcttgagagctggtaaggaagtaggaaaggactgctgattccaagtgccagtgagcaagcgttcagtgatttgtcaagtcactggagtgagaggctggaaaaaagcgaggagctctggagaagatgtaaatttgggagcctttagcatagagaaaatagatgcagcctgtggaatgagcactgaccaaggaagaagtgtggaaatgatgagtcagaggctgaccctggaagggactgcattttgggaggcaggagaggaactcatagagacagtaaagaagtctgtgcagtgacgggagggcctcttaccccttggaggcacaggccctggtttttaggaggcagaagaattcaaaaacacacgttgctctcctttctactctgggccaggcactatgttaggtgctgggaatgtagggatgaagacaattgctttgcttggcatcaaaaatttgtaatctagtgaatcctattttattcttacttaagacactagagttgtttgtaatgccattggtgtataagacacatttatcagaactatatccaaagcttaaaatatcagtgatatgaagaaccttagaaatcatatataccatcatcctcattccacataaaaactgaagcccaggccaggtgcagtggctcatgcctgtaatcctggaactttggcaggccaaggcaggaggatcgcttgagcccaggagttcaagaccagcctgggcaacacagggagaccccatctctacaaataataattttaaagaattagccaggtgttgggcgcggtggttcacgcctgtaatcccagcactctgggaggctttggtgggtggatcatgaggtcaggagttcgagaccagcctggccaacatggtgaaaccctgtctctactaaaaatacaaacattagccgggcgtggtggtgcatgcctatagtcccagctactcaggaggctgaggcaggagaattgcttgaacctgggagacagaggttgcagtgagccaagatcgcgccactgcactccagcctgggtgacagagcaagactccatctcaaaaaaaaaaaaaaaaaaaaaaaaaatagctaggtgtggtggtgtgtgccagtaagtcccagctactcaggagactgaggtaggagaattgcttgagctcaggagttcgagaccagcctgggcagtgtagagagaccctgtctctacaaataataaaaaaatttagcggggtgtagtggccctgtggtcccagctgcttgggaggccgaggtgggaggatcacttgagcctcggagtttgaggctgcagtgagccgtgattgcaccactgcactccagcctgggtgacagagtgagaccctgtctcaaaagcagaacaaaacctgaagcccagagaagttggagggacttaccactgcgtgcgcagataagttagtggctgagtcccagatcatgctgccgacagcgtgactgatgatgcatctctgaggaggctgtacacagtttagggagttctgttggtgccctctggagatgttgatgctctctctgacttttggaaagtcagcaccaaattgagtagagagatcgttttagtcagcttgccctcccaggacttccccaccccatgggattctgctgatgggtgtgtcaccatccaccatattcctgccatatcctaggctgcattgaatccatcagctattttaagtgcgtcctgaaggtttccaatactcctttcctctgaacttcaccatctctattaatggcttggctactcccgcagcttctccctgttggccatctagctcacgcatctgattacttctctttcagagtcatctcttgagtctgctcttttctcatcatctccagtgtcatcaccgccatgcatctctcccgaatcactgcagcaactccctgactcttctttgcactttcattcatctactccttcacctaatcttgtaaattgctgtcagattaatcttccaataatgaaatattatgcttgtaagtgatttcatatattgtatttcctaggcacccatctgactcctattctgttacccagtattcctatcaagtaatcatccagcccatttcagttatgttttcatgcattatatcttaattctggatagatctggctattataaagttcttacttacattgaggtaaaatatatttattcttctatatacttgttttgtgggtgtgatttcctcctgaatctttctgaagatattaacaagaaacttttctgaattctcttttgttaactagactaacttttcctagaggtcagttgctttatggtcccacccttatgcttcttcatcaggctggctttcttaaaatgtcttgtgaatcttggttgttctttctttcttatttatctgtagtgacttcactacagagtgtgtgcagtaggtggaagagggggaggatctgctactcaaaaagtctaattaacagaagtggactggatagaatattctaattattgatttaaatactatagtgggctttcagttgtcactaggattgttcagcttctaagtcatactttttattacagggaatcaatttttctttttgaaataatcgttctcagagctctctctgtgtgttctaatttgaaccaattgctttccaggcttactgcacagtttccatcctgagatatattttcattgcattcctctcatgtttcttgatttcccatgtctttttttttttttttttttttggtttcttaaataacttacttaaatctcttggaatctgtggatagtaacacttttaaatctttgcatgtatgagaatgtctttattttgcaatcacacttgagtagtcatttatttggatataacatttcaggttcaaaataaacatccctcagatttttcagtgcatttttaaattcttcctctaggctactgatattaattagaagcttcatgataatttggtaatctgtttcttgttcctttacagataacctgttctttctctgagagctgttaagattttctcttgctccttataattctaaaatcacatgagaatgaggctaggtgtaagtcttttatcattcaccttgatgatacaagctttcattgcaaagattcatgttgccagctctgaaactttttttctttgtttctctccattattctccattttgttggttctatctttccagaaatcatattagctaggtattagatctcctacattggttgtctgtatcttttaactcttatctgttgtcttctcacttttgccctagaggcttttccttgacttttttttttcccagccattaaaaatttgaattttcaatccgttgaatttttaaatatcaactattgactttcaatatccaagaaatttttcttttttaaagattacttgattttctgagtggcgtcttattttagggatgcaatattttgtaatctttctgaggatactaattagacttttaaaaattaccttctgttctctgaattttctgtgttctacatccttgctcccacagttgtgcctcttcctaactctgggtaagaaagcctgcctcctcccctgctattttttcctatgtttattttggctgaggggttatctgttcctataatctcatctgctttccatgttcccagaaatttctctaaaatgtttttatcttcattttgacagttaaaattgtttttgtcatttgataaaagttttggaggaggaggtaaatgaatacctttagttcgctatcttaaagtgttcccaccactctcctttctaaagagtattttaaaactacaatatttattattttgaaacaaaatggcagccaataaaagttgcttcctagatacagcttctgatattttgaatgaatttccaaaaaacttgttgtataactttcatgcatagttatttggaagaggcctagggttcattgaaaagccagaaaacaatctgatctccaggaagtctcctaacttctctgcttcaaaatgtaattcccaagaatggcagggagaataaaaacccctctcccattgccaacagtgaccctgaacattctgggaggccctggaaaactctgggctcagcccctggcctctctctggctctccctacatctttttcatttcctgtcagggcctaaattacagaaaaagagcacagttgaggaacaatggtcataattgaggggtctcacttcctccagtgatgagagggctctcagacctccttcggggactccaccaagaagactcttataacgactcactagaaaaggagtagggggacccttcctagtgggttgttgtgggatcttcttggtgaaatccccagatgaggacaagcaagcacattacaaacacagtggagaatatatacctcaaactactcatggctcttttggaggaatgcaatatacaaaactttctacattcctgtgttcattgagttttggtgataaatttgtattattttatcatcataaaggaaacagtgactagccttgtccctgtgtcctcccacagtctgctcccctggcctctccatcatgacctgatgacccctgccctgtcagtgtattgtggttcttttatgccatctgcccagtaaatactgagtaaagcaatgaatgatgaaacaagtgaatgaacttttcatctctgtccttagattatgtttttcctgacttaactgagaaggcaggttccattgaagacaccagccaggctcaagagctgccaaacctcccctctcccttgcccaagatgaatctggttgagcctccctggcatatgcctcccagagaggaggaagaagaggaagaggaagaggaggagagggagaaggaagaggtagagaaacaagaggaggaggaagaggaggagctgctccctgtgaatggatcccaagaagaagccaagcctcaggtccgtgacttttctctcaccagcagcagccagaccccaggggccaccaaaagcaggcatgaagactccggggaccaggcctcatcaggtgtggaggtggagagcagcatggggcccagcttgctgctgccttcagtcaccccaactacagtgactccgggggaccaggactccaccagccaagaggcagaggccacagtgctgccagctgcagggcttggggtagagttcgaggctcctcaggaagcaagcgaggaagccactgcaggagcagctggtttgtctggccagcacgaggaggtgccggccttgccttcattccctcaaaccacagctcccagtggggccgagcacccagatgaagatccccttggctctagaacctcagcctcttccccactggcccctggagacatggaactgacaccttcctctgctaccttgggacaagaagatctcaaccagcagctcctagaagggcaggcagctgaagctcaatccaggataccctgggattctacgcaggtaaagtgaggggcatgcgggccaccaccctgtaccttcttcacagagcctggccatccccagggctagtgtggcatgggggcaggatctgccaggttgaggagggaggccctttccacagcacgtagaaccccatggaacttgtggggatgcaaacctcagggccaacaatgggtgttctccccacacttctgtgcaaaggcctttggagaaacttggtggcctggcctgggtttcatttgttcatgtgttaccattgccacccttagacatcttttgttttttttttttcccgagatggagtctcactctgtcgcccaggctggagtgaagtgggcatgatctcggttcactgcaacctccaccgcccaggttcaagcaattctcatacctcagccccctgagtagctgggattacaggcatgtgccaccatgcctggctaatttttgtatttttagtggagacagggtttcaccatgttggccaggctggtcgggaactcctgacttcaagtgatccacccgctatggcctcctgaagtgctgggattacaggcattagctaccgcacccagcccacacttagacttctgcactgattctaccagcagctagagctagtggctgacctgtgctttccccatcccatctcaccaccctcctcctccccaccgacacccatgtgcatagcaggcacaagtcagtgttcacacccactgacaccgcaaggaaaagaaaggagccccagaatattaacaataaacttgcccttgaaagccagcatgtggggcaagctctctgcagcctggcccctttgatatagtcccctacttcctgggaataatgcctggcctcctcctctcactcaatacattccctgcttggtccccaaagacattcgagtttgtactccttggcatggtgcctcacagaggctgtcagcagccccctcgctgtaatacgcctccactggcctccaccttccagcttcccaaaaggcctccgaccggggctctctcccctgtccctttcctatgccttcgtaactgtcgcccttctttctgtctcctcgcacaggtgatctgcaaggactggagcaatctggctgggaaaaactacatcattctgaacatgacagagaacatagactgtgtgagtgcccagccaggctccgaaccgcagggaaaggctgcaggcagtggacagggtggggcagagggcaggctggggggacaagcagtgcgtgggagaaggcttagtccttcagttggtggcccagggatataccagcagccatcaacattacacacagagagctttcgtattttaaaatgtccaaaggctctttggttcttgcttccctctctttttaatttaaatgaatactttgttcatgtgtgcaccatcttacctctcccgtgatattgaaacctttctgtcttttttagagttgttttcttcctgtataggttgcttttctccgttttgggtctcagccttttcatatatatacatgctctccacacatgtctggtggagtttgttcatagctctctctatcgaaaaagtggctggaagctttgagcatagtgctagggttgtcagctatggcttctcatgagagtggtctggctgggccgtatcacttagaaatttgcaatggcagcattgttaggtccttcctcctgaggtgattagagtctttgaaaagggaacttctgttctgttcgaagtataacaagttggttgtcagtgttctgggagctggggtggagagagagggctgggtgtttcagtattataaatatgtatccataaatatcaatattcatgtactgtctcttcctgtttgcagagtgaccttctccctccccaaaacacacacttgtgtctgatgctctctaggtcagagaccctctgttttatcttttttaaagaataaacttccagtcttctgccagggagaagggacatttcttggctgtgcagcactgcgggaagaactagggacccagccgtttcttaagcaaactttcgaccagctcatatttttagtagcattttcatcccctcttccaaaggtaaccagggcccctattccggggcatctggggagtgtcaatcagtatgcatctgattgcttctcagctttcctcattttggcttagggtttggctctttagagtttgctaaattaggaaattctaactcaccatctgcttccagtgtctagattttgttgctcttgtctcctcttctgttttgctttgtctctggttttaggccttaaattctttactcttgttagtgggcctgggcaagactgaagggacatgcatgcgttgaatccaaaagtccccagcaaggttggtttcccccaccatcactatactgatggatcttcacctaagtgatgtgtgttttcatccattgcagttattatttttactgatgctcaatacctcatctttggccagggaaagcctctttgagttggcctctgagtccttttgaccaatctattaagtgtctgattgcttccttgctttctggcataataagacattccaggctcaccttcctcccccagacatggagccctcattcccttcattgggaaatggtacatgaagaccacagatgggtacttgggacccttgaacttttggtgtgcatacttgaacaatacagcctaaagttcgtatctttttgccaatcaatacatagatattaagatgcttttattctgttttccctgtttttgtcttctgtgttattctaatatgtgacctccactcaattagtcatcattattttttatggtagattttttttattgtagtaaaaaacataaaattttccatttcaccctttgtaaatataagttcagttgtgttaagtatatgcacattgttgtggaacagagccccagaactttttcattttcaaagctgaaactctgtacccattaaatgactacctgttccccagtcccggcacccaccattctccttgcacccaccattctccttttggtttctatgaatgggactactctggatacctaatagaagtggaattagacaacatttgtcatttttacatctggttcatttcactcagcataatgtcctcagggttcatccatttggtagcatgtggcagaaatttctttttttttttttaaggctgaaaaatattccattgtatgtatataccacatgttatttatccatgcagctgtccatggacacttgcattgcttccatcttttggctattgtgaatagtgctgctgggaatgtgctgtgcaaatatatcttcaagactctgtttttaattattttgggtatatacccagaagtggggttgctggatcatatggtaattctattttaaatttttttgaggaatctccatactgtttttcgctatgagtataccattttacattttcgccagcactagggttccagtgtttccacatcctcataaacacttgttcttttctgtttttttaaacagtggccatcctgagagaagtgaggtatttggttggtgcaaaagtaattgcggtttttgccattgaaagtaatgacaaaacccgcaattacctttgcaccaacctaaatggtctcattgtggttttgatttgcattttccctgatgattggtgatgttgagcattagtcattattattaacagtcaatgcttactatattttatcaacatacttattagtttctttgccagattcaccacttgttagaattttttcaaaccatttgagaaaaagttgaagacattatttccttttgcccctacccccaaatacattagtttgtgtttcctcagaacaagaatattcttttagataaccacaatggaatggtcaaaatcaggaattagcactgctacaaaactattatctgattacctaccttatttcaatttcaccatggttccaataatgtcctttatagccttcttccctcccatgccgggatataatccatggtcatgcatcacattatttgtcttgtctctttagtctcctttaatctggaatagttcctcggcctttctttgcatttaatgaccttgacttatttgaaaaatgaaaggaataaatgtgcataaaaactgatgggctatacagagactacatattcagaaaaagacagggagaaaagtgctggcagtctcttgtggaaagttttacacgatggaactacaggagttccaggagttcagccctcaagatctagagaaagtgatgcaggctcagtggcttctattttacctagatgtcacaggtaacatagaagaaactggaaagaagtctaagaaggaaacatgagaggaggaagaaagataaaacaggaaatccagaggtggtgtttttgagttctagaaggcaaaagaaatccttactgtagagatgcaaggatctgatcctttgtctagcacaacagagagaagtgctagaggataaggacaaggaggagaaatatgtggatcatcctttagtgaaaatcctgaaatagagcttccatgcaaagggctggatcatcaagatctggataaagaagcagcgttgacacagtgatgaggcgccagtcctttgcctgaggctgcagagtttctcagtgcatgccacacacgtgcttacaagatgttccaggctgcatgggactttccttgccccagcccccaatttagccatttctgcaaggagtcctgcttccttttaatgaggaaaggtatttagaaactaagatctgggccccaggtgtgctcatggctactggggtgtcactgcttctaggcccttctagaagaactgagcaatatggatctttatttctgtctctctctagggcatagatatacatatatcatgtataatgcatgtacacatattaaaagtacaaattcagtatttccaattctaatccatcaccactggatgatgtcctcctgtgcttactgctacaaactttagatctgtagtccatctggaattagttttggtaaatgatgtcaggtatgaatcaaggaactttttttgttttccatgggatatccagttgtcccagcacctgtgattgaataagtactttacttattcacagtaaggtagggtgtcaggaccattgcccatgtttttaaatagggaaactgaggctcagagaggtacttctttttttttttttttgctgacatcacagagagctgacaaatggcagaagcaagatttgaaccaatgtatttatttatttttgtcacccaggctggagtacagtggcacaatgtcagcttactgcagcctcaactgcccaggctcacgtgatcctcccacctcagcctcccaaggagctgggaccacagatgtgcaccaccatacttggttaatttttttgcattttttgtagagacggagtttgccgtgttgtctgtgcaggagttggaactcctgggcccaagtgatccacctcccttggcctcccaaatgttgggattacatgaaccagtgcacctggccagaacccagatttatttgattccaaagtcagggcttttcccccttgccacggacattcagttttcctgtctacataataagtggtatgaaatctgcagtcatcagatcctcccacactgacattgtgggtctctgggcttaagccaggcagacatatgtacccaggaaaacatggggtgtgcaaacacagcagagcacagagccacagcacagagggcaggcacttcatgtggcaggagagtgcttgttttgtaaccaggggtctgtgggtcatggtgcatggacccttgctctggcaggggcgggcatgcactccttctccccccatactcaatcagtgaataaagtaagaaccatcacagaactaggggtttccatctgctctatggccatctccaggtacccatcttctcccacatttaaaactcagttggctggctattagaccagtgagtgccaaggcttgagcctgagcctggcatttgccatggtaacaaagaacagaggcccagcatttcaatccctctggtagcctttaggttggcatgacaactacggaacagctcattagcctgggctctagcagaagggagatttggagtggcaggggatcctgcagggctggcctggtgagatgctcgtgcctcccagtggcgctggctctcagctgcatagcagggcactgtgagagagctgagcacctgggagaggggtatctgcagcaggctgtggaggctacgagcagggaatgtgtgactgtgcatgttcaggagggagaaggctgctggggaggagccggagtgaggagtggccacagggccaaaggagggtatcttcctagatggggctgggcagggacaaatggcaggatgtgaaccaggaggcagggttctggcctgtgccccagcctgggctcttgccattcgttgagtttctgtttaaggccaggctcttatttttgttttaaattgtggaattacacgtacacatggtcaagaaaacctcacaatacaagcgagtgcacgatgagaaaaggtctcctcacacccctccctctgttccagcccagctccaggggctgcggttcccatctctgtgtttgctcttctggcctccaccgcctacacaagagcacacagatggcttccccactcaacagcttggggctgcatctctgcgatgacaggcgagaggagagccgcgttctgccacttctggccctccccgatttttggtagttacatggtgcacacctcttttggccatcaccactcccacccgcccatgtgttcatccccagcaccatgcacttgagcactaggcacagggagcagttctcccataggccttaccactctgtgtacccagtttctgggcttgtcactgtacatggctgcgtgtgtgtgtgtgtgtgtgtgtgtgtgtgtgtgtgtgtgtgtccccagcccccgccccgctcaactgcatgtgtctctgggacaggccccttgactttctcatggctagaggccagggcaggaaggagcacctggtgtaagtgaacaaatgggtgtacatcttggggttcccacattccctggcttgcagctctcagagggtctccagagttgaccagagctgcctctcttggaacagccagagggttgagggtgagtacggggctgggcctagaggcagagggctcagtagagcccctttccttcactgaacacggggggctctttctgcccttgtaggaggtgttccggcagcaccgggggccacagctcctggccctggtggaagaggtgctgccccgccatggcagtggccaccatggggcctggcacatctctctgagcaagcccagcgagaaggagcagcaccttctcatgacactggtgggcgagcagggtgagcgagggcaggtgatgggagggcccaggagggcagtgggaggcgggcggcccctgagggtcacgggaaaaaagtgcacgcataagggctttgaaacttggaactccaggacagtagtttgagctacttagcttagtggtcaaggtgtacccaccagcttgggttctggggacaaggaggagggtgtgagaattaaggatggggaacaggaggcaggggaacaggtgtggtccagcacaggtgggagatgaatggacactgtacctggtgtggcaggggagaaggggtgtgttcagaaggcagtgtgtgggcttcgcaagtggctggctggtgttatacaaatcgatgttctaacagatcgatgcagtggaaagcatgtctaagagagggggaggcatgtgccttgaggatctgtgtgcaatttgagccaggaagggagacagaggctcaggccagctgttggagagcggggccagagcccttggaggggcacgcacctcagccatggtcacactgatagtggtgtttcttaccccccaggggtggtgcccactcaagatgtcctttccatgctgggtgacatccgcaggagcctggaggaggtaagagtgcagggacctggacctgttagcttctaatatgctccctcctgtctctgttcctcaaagtcccaggagtctgcccacatcgtgaggttcaaaggagtataagacagagcgtgctctgggcaggttccttgcttcaggcctcccttagacatggttttgtgggaaagacggtgcatgtgcatgctaccaaccaaaggtccaatgcaggcaatggccaggggcagaaaggggccatgggggtgtgggggctgtgctaagaggctgacagtcaggagagggcccagagaggaagggtctggggagcagtgagggttaactgggagttttctgggtagacagtggcagagacaccatgctgcctggtgggaggggcgagcatgatgggttccagaaaccaaaagagcaagcctgggagacctggacatgtgacttggcgtggacgtgtgaatctactggtgcttgcacggccaggccctgcgctcctgctgcggtgagatgcggcgcctgggggccaggaggcagccctgccatcttaggaggtgcccccacccagtgcagtctgctggctgcctggcccatcccgatcaacctctcctacccagctgccgcacaagcttggatgggatggcagggtcccccagtcctgctcctcacaccaccttgcctatggggtccttctgttcctcatctcacttcttgaggacagccaccatctccaccaaaactgcctttgctcactgtagagtccagtgccctgtcatcagccctctccactcccgaaggtgctgccatttttggcaggagagatgagtggtataatgctggccgcctcttcatccttgcatgccaggggagcagaggccctggtggtggtgcttttctggtgagcatgtcgaatgcccactgagcaccacactgtgcaaggctctctccctcagtcctcgccaccaccccatggggttgtgagggttaagtgaggcacctgttgagtaccaatggtgtccccatggaagatgagagctgaagcgggagaggttaggtgacctgtctgagatggcaccagcagtaagcggtagagccaggctttgcaggaagcctgattccggagcccgggcctttcaccacactgctctactgcctggagggccactgaggcccttcccagttctggaatcgtgggtccatgaacagtggggctgctggtggaagtgtgggctaaccttgaccttttatacagtcctccccctgcttttcgctgcccctgagtattctggcgttactggtcacttaattcacactgacttggccaaaagtcatgctgggtctttggaaatatactcaggtgaatctagcaagaaaaactgacccttgataacaaaaaattgagaaaagtactggagatacacgggtggttcacagaaaccggggaagagctgcaacctgaactcagaaagggggcctggtgcaacctaggcctcagcactgggaactgccctgatccctcacctgaggagcccctggtggtgctcgccctcctgcttctctctgctaagatgctgatctgtggagatagcacctgcctggcccctggcgccgatctccttggccagagaaggcaggactgaccatgacaacctgcagcgtggagggatgcaggcagctacatgccagcagtgaacacgccatgggaagggaggaagctgggcagccggggtggccccccatgtggcctgcatgccctcagtatccctccctgcaccggccctggcatcaggaagctgactggtccacccctccccaccgaggtggaagcggttgtatggtggaggatgtgtggggggctcacatctcctgtctctctaactagttaggataggtgtgggcactctctctagttggatggtgtccagcagcatgggtccactctcactggaggcctagggccacagtgagctcagactcagcggctggggcagaagctatggtgggatgtgaaggaggctgggaacatgggcatggggtggagaggcctccaggtgtactgaggcaaacgggatgggcatggggtagaggcaagcccaggcgccagggaacttcaggagccgggagtgccagcaccttctaagcctgctcccccatccccacccgagcccaatgcaaccaccccagaggagccatggcaccccaggacctcagctgaggaaactggcccctcccacccctagattggcatccagaactattccacaaccagcagctgccaggcgcgggccagccaggtgcgcagcgactacggcacgctcttcgtggtgctggtggtcattggggccatctgcatcatcatcattgcgcttggcctgctctacaactgctggcagcgccggctgcccaagctcaagcacgtggtgagtgtggggacaggtggggctgggggccagttgagaggagagtgcccatcgataggtgtcctcatctgcaaggggaggcagtgactctcctgggcgcacagggtcccgtgggtgaagcagctggtcagcctagcactgctgactgctctgcagggcaccagccccaggacaggtgccagaggtgcagggagtgagggggctgctagccccaccagggggcccctccctggcaccaccagcccctttccggcgcaggcactgcagggcctgagcacctgaatacctcaccagaggcaggccctgcgttggtggtgcccaaggatcaaggagaggctccagcagcctagaggcctccccaggaggaagcgagcagagccctagcgatgctccctgcccacctcgcaagtggagtcttcttagggggctgttgggggatcgatgacgtcagggaggccacggggctttgtagtgccaacgactagtaggtttattttgagaaaggagttgagctgcagcaacagaaaagaaggatctggcacctgtggagggtgccgcgggaaccccctgggtggggttgcacagacggccgcgggcctggcgctgtccgggggctggctcgctcgcccatggcctctccccaccccgcctcagtcgcacggcgaggagctgcgcttcgtggagaacggctgccacgacaaccccacgctggacgtggccagcgacagccagtcggagatgcaggagaagcaccccagcctgaacggcggcggggccctcaacggcccggggagctggggggcgctcatggggggcaagcgggaccccgaggactcggacgtgttcgaggaggacacgcacctgtgagcgcagccgaggcgcaggccgagtgggccgccaggaccaagcgaggtggaccccgaaacggacggcccggagcccgcaccagccccgcgcctacccgggccgcccccgcggcctggccctcggcgcgggctccttcccgcttcccccgacttcacacggcggcttcggaccaactccctcactcccgcccgaggggcaggcctcaaagcccgccttggccccgctttcccgcccctgaaccccggccccgcgggcggcgggcggcgcttcctgcgccccgggactcaattaaacccgcccggagaccacgccgggcccagcgcgtctgccttcttgactcattcttatttccggggttggggcggggcggggcgggcggggcaccccggggcaggggcggggccgcggggcggggaggccggggcgggcgggtcctccggacgccgctgcagagcggggcggggcggggctgagcgtgtttacatccgccgggtgcgcggcttcgccgcccgaggtcgttcggctcgggtaccatcctccgcgccatggacaccagcgacctgttcgccagctgcaggaagggggatgtgggccgagtgcggtgaggacctcgcagtcccggggagggtgcgggaggtggccgccctcggaacgcctcgggccctgggacgggcggctgggcggccgcggagaggcgggcgcctctgccgggtcacagccctcggagcgcccccgcggggcagaccacccggacccccgccgcagccccccagcggaagcgcgctggggcggggacactgatggccattgacccccggagggcttcctgtaagaagggactgctcagcggaggcccgaaggcgcagaagtgggcggagagaaggcgggccactgttcgccctggtagggcccggacgtcagaccccccgggcgcagggcgcgggtataggcctgggactccagacgtggcccctttctctcgtgctctctggacctggcgcggggaacacctagagcccataatcggcctccggtccctgaggattcggaaactcctgacgcagctaaagtgaatctggcgctgagatgccccctccatgggccggacgcggagggaaggggtgcccagttgggttctggggcccttcccctccttgggcttccactatcccgtttgacctccttttttcttggcccttcctcccccttgacctggtgctgactgactgcttccacctcccctgggctggcgccgggctgctgtactcccgtagcctccctgggccgctccctgacatcccgtgccactcaagagttagtgcatagtgtcaacgctgagtgggttcacagcacttccaggtgcagcctggaggcctcctttgggctgcccccgcctcagtggggctgcattagcattggcgactcccctcgctcaccttccgcatcccatcagttgctgtatcccgcgactcctgcctcctagaattgtgtgccctccacaccatcaggaggcctgcagcagctttttcccgggctccctgcttctaacagggccagcttcttcctgcagtagagagctctggtgggagtgaaggctccatcacctcctctcccaaacgctgaaaggccaaaggtccagcctcggcactggctctggcttctgtccctgtagcccatcgtcccccagcactgatagcacacagtgtctgcctgttcgaccccacctccacatccttgcctgcactttgccttgagtgcctctcctgctctggtctgcctgtcacctgccctcacctgggggaggcttccccataccaaaagggatgttttctctccgttcctttccacgggccttctttctcagaccatgaacccgtcctgacccaggctctgacctccttcctgcccaggtacctgctggagcagcgagacgtggaggtgaatgtgcgggacaagtgggacagcacccccttgtgagtgctggagagaggggtggggagggtgggggttggtgcaccccttcagcactgaggactgcctcctgtacttccttcctcccttcaggtactatgcctgcttgtgtgggcacgaggagctggtactctaccttctggccaatggtgagagcagggagcccggctcacgggtgtgcgtgggtgcatgcatgtgtgcgtgtgggtgcatgcatgcgtgcgtgcattcaaaggccttgatacacatttgcaaagcaccacgattcctctcttaccacccagtcgaatcagcaagtactattattgctactttaaaaccttttctctgtccaccttgcccatctctacttctacgacctgggcccagtcatcagcatttctccccggacacggtgcctgcctctctcttgccattgcagccaagttgatcttttcacaatgaatctgatcggctaaaaatcctccagcaagttcccattgcctctaggatacagtgagcctgcctggccatgcccaaggctccacagggtctgccctcccactggcctcattccttcggctctccctgcttgcttgctgcttgcttgctgctacactggcctcgctggggctccactgtgctatgcatgcccctgttcctgccccagggcctttgcacctgcagttcctcctgcatggactgccgttctgcaaacgttcacatggcccactcccccttcattcaggtctctgcatgctgccaccattacagagtgacctttcatgacttcccttcattcagtgccattcttcttcctattttggttttttcttttttttttttttttttttggagacagagtcttgctctgtcacccaggctggagtgtagtagtgtgatctcggttcactgcagccttaacctcccaggctcaagtgatcctcctgcctcagccccttcaaatcttcaaatagctgagactacaggcgtgcaccaccacgcccggcaagtttttgtattttttttgcagagatggtgtctcactatgttgcccaggttggtctcaaactcctgagcccaagtgatccacctaccttggtctcgcaaagtgcctggattataggtgtgagctgccacgcccaggcttgtttttcttaatagtccctgccatcgttaggtagtgggttgattgtcctgcctcactagagtataagttcagcaggacagggacctgtgtctcgttcactgctgtgctccagtgtgtgggacaagcccagccaccaagtcagctctccgttctgtgttgtctgtcttccgtgtgagtgagtatgtgcctgtgtgagtgcacacagacgtgcccattcgcctagcccttgactgggagggtgttggggtcagagtgggcccagggtaatttgggaaggcatcgccagagattcggagccccatgtgtgggaaggtggggaggagggacagggagattagaatttcccccaggccccttccctgctaactggtgagccctgcctcccccaggagcccgctgcgaggccaacaccttcgatggtgagcgctgcctctatggggcactgagtgaccccatccgccgggctctacgcgattacaagcaggtcacggcttcctgcaggaggcgggattactatgacgacttcttgcagcggtgagccagggcacacgaggggtgcagcatggggtgcggtggccctggtgggtgtggcgagtctgctctgactgtggcctgcactgggttctgagtgctccgaggaatggggtggggctgtgccaagtatcctccctcctggcttgtccctccccaggcttctagagcagggcatccacagtgacgtggtctttgtagtacacgggaagccattccgggtgcatcgctgcgtcctgggtgcacgtagtgcctactttgccaacatgctggacaccaaatggaagggcaagagtgtcgtggttctcaggcacccactggtatgtcccttcagggtggcagaggggcatgaactgtccaggaacagcaggaggttgtgctgggtggctgcctctgacattactttctggttttctgcccacagatcaaccccgtggcctttggggccctgctgcagtacctgtacacaggtgaccccctgggtccagggtaggaggagagggagtgggccgtccttctggacagcagtacacctaggtgtggctgggctgacctttcacctctagacacttcatggtccccccggggtggttccagctgcctctcgggttgggttgcaagagagaggactagtgtgcctgctcaggaagagcttgtcccacccacatgctgaggccctcccatctgttccctggggcctgtagaacagcttttgatggggaaaccatggtggcaagtgggcccaggagtcctagtcctgcagccaggtggccaggtgggaggggatcaccctttttctgtgggcctgatgacagctgaggtcccgcaggccctcatcctccccactgcccccaggccgcctggacattggcgtagagcatgtgagtgactgtgagcgcctggccaagcaatgccagctgtgggacctgctcagcgacctggaggccaagtgcgagaaggtgtctgagtttggtgcgagcagggtttggggcccggggccatgggtgcggcctggcagggctggcctggctccctgaagttgttcttcccctgtagtggcgtctaagccaggcacgtgtgtgaaggtgctgaccatcgagcccccacctgcagacccccgcctccgggaggacatggcgctgctggccgattgtgccctgccccccgagctccgagtaagtgcggggctggtgggcaggaagggcgttttgggatggcaggccgtgacaggcagcccagatacttgggctcaattccttgtgtggtcctggaccagttacttcccttttctgaacctagtcgttcacttctgtgaacaactgctctgatggggtcacctcttctgtaccccagggtgatctttgggagctgcccttcccttgtcctgacggcttcaacagctgccctgacatctgcttccgagtggctggctgcagcttcctctgccacaaggtgcctgtgccctcctgttgcccctggccccagcccgttgccctgagcccccgtctagctcctcaggagacagaccctggccctcacacttcctgagcccggcctcccccaggcctttttctgtggccgcagtgactacttccgagccctgctggatgaccacttccgagagagcgaggagccagcgacctcagggggccccccagccgtcaccctgcatggcatctcacccgacgtcttcactcacgtgctctactacatgtacagcgaccacactgaggtgggggctcaggcagagctggggatggcacacaacctgtgctgccgtgggctgagagggagcgccagggccctgggggtctgtggaagggcccagctggccccatggttgacgttttgagaaggctggaggggaaggctgtgggactttggatttttctttcaggtagaggaagccttgttgggctccagagagaggatgagtgatgagcctgtgtcacagacactccacacttgtcagccacttgggatcctcagcttctctagcaggagggtggagggtgggtggggacagcctcctctctgtggtgctgcagatccctggggttctgggttcccagtctcctcttcccttgctgcctgcctctgtctccagctgccccaaggtgtccgtaagccaaggctgcagggcagcagcagagtgctgaaggtttgctctgccagggtgtgtgagagagagagagagtgtgtgtgtgcgtgcgcgtgcgcgcgcactataaagcaatccccatatctggtggcttaaagaagaggggagtttgtttctccttcacttctgactgaggtgggtgccccagggcaagtggcttgcggaagatcaggtcatccctccatcttgcccctgtatgcctaagggtgaaggtcaaaaaccttttctctgaaggtgagtgtttcaggttctgtgggccatatggccctgttgtagctactcaactctgtagcgcaaaggtagccagagacagtacagagatgagtgggtgaggctgcattccaataaaactttacttgcacaaacaggctggatttggtccacaggccgtagcttacccatcctgcctggggcatcgcgtttggccatggagattgggtcctaggcaaactcatgctctaggaggaagaggaaggcagggcaagcaatgctgtttttgtagaagccaccggaaattgcaccacttctcatgttcccctggagagaacttcgtgcctacctgccaacaagggaggcttggaaagtcattctgtggccagggccctgttttgtgggggaaggggaggaagcatgctgggagacagagggcagtccctactgctgctctatctccagtggcagctcccttgtccatccctccgcgcggcctgacagcccctcagcctccatctttcccaccccctctactgggcatctcctgcagctcagcccagctctctggcccctgtagcaggggttacctttgcccaccctggagaagctccctcttcaaggagcctcgccacccaaagggcaccttgtctcagagtgtggcttgggctcttaacctgggttgatactggttgagctgtgtgacactgggtgagctttgtgatcttgggccagttacttaactgctctgtgcctctagaacatggggatagctctcgtcgtcacttcctaaggccttgtgcagatgcatgggttacccaggtaaaggaggtggcatggcacatggcacatggcttgtaatgtggtcgcagagctccccttgtctctgtctgcagcttgctccctgtgccacccaggctctggcctgaatctgagggcttcagtcttatccagcacaggatgtatctgtaggtgggctctgtgtccccacagcctcttgagagggagggagctggtagatagtctcccacccctggcagagtccctgcataggtcttgactagctgcctctgtcccaccattctgacagcccccgcaggtaggcatggttatctatacctcatggactgggaactagaggcacagggaggtgcagtgacttgcccagggccccacagctagaagtgtcagacccaggtctgtataactcggagctcagaccctggctcctgcgagggccctgcctcccgcctgccctgccagcctgctcagggcatgggagaaccccccagtcttctgccccctagcggtcctgcagatccctgtgggaatctgggccagccccccgacccccaaccccatacatgcgcagggagctcctactcccactggaagccttcccgccagtgccccccaaccaccacaggccctagccttggctgttgtgccctgggagcccttggtgacctcggggggcaccttcatccctgtcttcactgcagctgtcccccgaggcagcctatgatgtgctgagcgtcgccgacatgtacctgctgccaggcctgaagaggctgtgcggccgcagcctggctcagatgctagacgaggacactgtggtgggtgtgtggcgcgtggccaagctcttccgcctggcgcggcttgaggaccagtgcactgagtacatggccaaggtcattgagaaggtgggccagtggtctgcagtgggtgggaaggaggggtgagagggcaggcacccctccactgagctggcccttcccgctcatagctggtggagcgggaggacttcgtggaggcggtgaaggaggaggcagcggctgtggcagcccggcaggagacggactctatcccgctggtggacgacatccgcttccacgtggccagcacggtgcagacctacagcgccatagaggaggcgcagcagcgtctgcgggcactcgaggacctgctcgtgtccatcggtctggactgttgagcccctggctgggcagccccaggggccaggagctctcttggagacaagcatgtgtatgcgtttgtgtgcagctcttcttcctgctccctgcacattgagggcttcatggggggtgcgaggggctcagtggggcttctcttccctccatgagcctggagaccccaggggaggatccatttgggatgagccccctccccccaatgcacaagccagcccccaagaccctgggggtggacaccactcagggaaacctggggtgggggtgggctttggtcttagcactttccttctccagatcccccctacccaccccagtcccaaatccagtcctctggcccttgcctagccctgaattgcttctctaagctggtgttcccatgcacagggccattcaggaagggctgggggagtgtgtgtggcaataaagcttgaaggcaccgtggg

SEQ ID NO: 38503 - DNA, 19285 bp, Homo sapiens
agacacacccaggcagcccaccctgcccaggacctggggatgcggggcgggagagcgcggccggcgtgggagagctttatggggctgccccctcgatcgtctgcgaagtggggcgcggggcagtccctggaccggctctgctgtgctccgggcagtcgggggcttgcgggcgctccggggaggatgcgggcaccaccggctggacggtcgcagcctgcagggggccctggggacagcctgcctcatccccccggcgggctcgggccaggtggcagcgcctgggctcgccgcgcggaggcggcggcttctcgggctaggggcggcggcaggggcggccccgggatcacatgggcggaggcaggtccgggagccccgggcgggctctccccagagtcgggtagacggcagcgggagcggtggcgtctccccgccttccctccctcccgggcctgggcgcccagccggacaggtgagcggcagccaggtgagcgcgcccacctgcgcctctccgcgcggcccgccctccccggcgccgggctcctctccgcgcccctgtcggcgcggaaccctggcctcgtccgcggcccagctccctggagcctcgcatcagcgggggcgcccccgcgagctgcgctctccccggccggagcgctcctcctccagcccccagcccgcagggtactttgccctcggagcgaaggaggctccagaactggtagagccgggccatcgggctgggcacctccccgcggcgcccgcagcgcggagtccactgaccggctcaaaggtctgggaatctcggggcggccgcgagccggcctcggggactggggtgggggcggtgctgggaacagaggctaggcctgggcccaaggggaaggcagccggggatggagcggacagaccgctggtgctcttgatagattctcgcagcacttgcgtccccagggcagccccaggatgggtgctgggcagggtggtgcccagcctggcaccgcggcttcctgcctggattggctcctggctccagagctagaggctcaggaaatcccacaggggtctgtctgcaagggcacttccttgcccagcggaggggctgtggatgggaggcctgtcaccccggctgtctgtcgggcagcatcaggaatctgggggtgggtgtgtccagcttgacagatgaaccctggcctccttgccctggcagccggcccctgggggaggtggggagcccggtcttgcccgtgtgatccactttgccaagaacgaggtgggcagctaggaggcccatgtgaagactcggcctcaccccaccagtccttcacctggccagtgacttacacagtctgtactggtgccagcctgttccttgacccgtcactcctgcttcctgagccctgctctccctaggccactcaccagccctcccccagagtggagaggaagtaccgtgtgctgtgggttttggggacaggaagcaagcgctagtgggactgagccctgatggtggaggaggggagactgagggggtgctggcatcccctccacttgccagcccctgccccccatgctccagcaagccccctgcctggcagcctgggcagccccctcctgggagtcgctccctgggctgaagactaaggaagggagaacccagaagcatggcttcccagggtggggggaagtgaaaccgggctgagggagggagttagccacttcctctacccaccccaaagcccctgagtagctgctccgggagctgtggtgccctctccttctccctttggctcctctcctgctgccttacagtgcccccagagccggctaggggcatggacttcacctcctggtcctctcttcctcaggtatggcgttgacggtggatgtggccgggccagcgccctggggcttccgtatcacagggggcagggatttccacacgcccatcatggtgactaaggtaaggatggtggctcaaagagatgagaaggtcctgccagaagcgaggtcggccctgttcaccccactctgcacagatggcttgctttttctgttctggagctagggatctgctgctgcctggcgtgctggctgtaagggagccgtggccctttgccacggggatgtggtggccacttcaggaacagaccttgggagtgaaagggagctgggaccaggacagggccggctcttgcctccccagttgctatccccacacttgcaggcagccatttggggtgattactagaacaagagccccggagttcttggcagtctcctcttgacctgggcccaggctgggaacattcacaggagggctgtgcaggcagccacctgcaaggtgcgatttgcacgggcaaggctctctatccaaaagtatttccaagcacagttcctgaaattctgccactgcacattctttgggaggcccattagaatgccagtgtggggtgggggctgccacctgcgctcctggaggggatggctgatcagctgggtgtcatgagcaggcagagggacatgcaggagggtgcaggccggcctgggtcaagccagcctctgtgtttcttgggtagcagagtgggaagtcccttctccagctgggccacggtctgagcatgccagctcctcatccctacaggtggccgagcggggcaaagccaaggacgctgacctccggcctggagacataatcgtggccatcaacggggaaagcgcggagggcatgctgcatgccgaggcccagagcaagatccgccagagcccctcgcccctgcggctgcagctggaccggtagggcctcccgctctgcagagcctgtggcattccccctcctccaccaccccacgtattgagcagcccttgctcctgcccatgggctagagctcagccctaaagcggccttcttgggccctctccacaccttggtgagaaggtcctgggctctgcttcctgcagcagggtgggctgaggggtgttcccatgcctggttgggtaaaggtgggcgccaggctgggcgtgcagtcacaggctgggcagggcgagctggcaccagccaccttgaagcccgggtttgactggttcccaagagtgtgcagggcacagggcgtgggcatgaagtgggttgaagaggggaaccttctgggaaaggtatgcccgaggctgcatccccaggactcctgcttccaacagggcatggcctttgtttagttcccagctggaagtgaggacttggggggctcattcctcatagaggctgtctgttcctccccatcactgaaggcagatgcccgatcctgggttactcctagggttttgagcctataagccaaggtggggccagggtggggcctggaggccaagctatagggggaacaggtggctccctggggtggggcattgcagtgagtcacagatcgggaatgccaggagatccccgagccaggagagccctctgcacgggcctagaacctgagtcagacacctcttgcatcctggccacccccacattgtcctgctctcttcagccctaccaagcccctccttctccaactgccctgccctgtggtgtggcagaagccggctcccttcatgtcattcaggtccctgggtgtttgcaggagcgggaccccaagaaggagggtagagagcacctcatggcatctgggaatggggcagaaagctacaggaggctgagggtctggcagcggaagggcaggagcctcggactgtctcttcctctggggttctctggagggaccagggctcgggggaggtaggcctgggctgtaagtcaggcctctggttctgcaccaggcaagcccagactccagtctcttaattttttttttttttttttttttgagacagagtctcgctctgttgccaggctggagtgcagtagcgtgatctcggctcactgccacctctgcctcccgggttcaagagagtctcctgactcagcctcctgagtacctgggactacaggcgcgtgccaccacgcccagctaatttttgtatttttagtagagatggggtttcaccacgttggccaggatggtctcgatctcctgacctcgtgatccacttgcctcagcctcccaaagtgctgggattacaggtattacaccgcgcccggcccagtctccttacttttgctgacgtgatgcccacccccccccccgcccccatctcccgcctcctaccctcccaggtgacctctctggtattcagaagccctggggcaggaagcagggctccaggctggagccagagactgagctctcctcaccctgatcccatggctctcccaggaagcggagggtcctgttgccctacatctctagaggcagcctcacggccaggaatgtgtggcaagatgggacgaggcaggctgtccctcagcccagacttcagttacctcccattcagggctccagctgggttccactttggaagagggtacccagggagctgggagggcgtgcccctctcgctggtggggagctgggcctacttgtctggaaggaggcaggcgggtctcgccctttgtttaactggggagacccctgagaaagggatcaggagtgacgcgctcaaaggcaccctggcctccagtgggcagggtgcacagctggcccagtcaccgtgggctctagaacttgaggcagctcactttccctctctgggtttcagtttctccatgggttaaaatataaaggattatttctatgaaatcagtaatcaggccgggcgcagtggctcacacctgtaatttcagcattttgggaggccgagtcgggcggatcacctgaggtcaggagttcaagaccagcctggccaatacggcgaaaccccgtctctactgaaaatacaaaaattagccgggcatgctagtgggcacctgtagtcccagctacctggggggctgaggcagggagaattgcttgaacccaggaggtggaggttgcagtgagccgagattgcaccactgcgctccagcctgggtgacagagcgagactccatctcaaaaaacaaaaaaatcagtaatcttcccccaaatcaatctacaaacccgaggctgagtgatatcagtgacaaagtccaggcaaaatagaaaaaaaaaaaaaaaaaaaaaaaaaaaaaagggcaggataatgtgaggactctctaataaaactgaatgtttgaactttctgatgaagttatgtacgttctactttttaaaaccaaactatcctttctttttttggggtgggttttgctgttgttactgtcgtttgagatggagtctcactctgtcgcccagcctggagtgcagtggtacaattttggctcactgtaacctctgcctccctgggtcaagcaattctcctgcctcagcctcccaagtagctggtgttacaggcatgcgtcactatggcttggctaaatttttttttttttttttttaattagagatggggtttcaccttgttgatgaccaggctggtctggaactcctaacttcaagagattcaccctccttggcctcccaaagtgctgggattacaggcgtgagccaccgtgcccggccttggtgtttttttgagacagaatctcgctgtgttgcccaggctggaaggcagtggcacaatcacggctcactacaacctccatctcctgggctcaagcgatcctcccacctcaacctcccaagtagctgggactaccggcatgcaccaccatgtgcagctacttaaaaaaaaattttagtagtcatgaggtcttcctatgttgcccaggctggtcttgaactcttgggctcaagtgatcctcctgccttggcttcccaaagcgttgggatgataggcgtgggtcaatgtgcctggccaactgtcctttcttttaaggaaccatggttgtcattgatgatagttgtttgtcttgagtttgacaaagttaaaagttgacaaccggatgtccaaattttctgtagcttttactggtgttgagaactagatctgggaacagttttggcctcttttgggggttgcagggtgcagggcccctgtgacattccctccctctgttgccttctcaggtctcaggctacgtctccagggcagaccaatggggacagctccttggaagtgctggcgactcgcttccaggtaagctggtgccctcccctgacagcctcagcaccctgatcactggtgcatgaaagtgaggcccgagggcagggcggccttggcggggcagccctgcctttcctgacacagtcactctctccacagggctccgtgaggacatacactgagagtcagtcctccttaaggtcctcctactccagcccaacctccctcagcccgagggccggcagccccttctcaccaccaccctctagcagctccctcactggagaggcagccatcagccgcaggtgagtgtgcctgtgagtgggtaccctggtcgcctgcgctgccagctccaggctggctcctctgagtctcaggagctctgcttgggagcccggggcagcatcctccctgggcaggctgggggtggccctggcacacactgtccctttcccactttcagcttccagagtctggcatgttccccgggcctccccgctgctgaccgcctgtcctactcaggccgccctggaagccgacaggtgaggctccctgggggaggacaggctggaggaacagaagcacctcccgttcctgtgggttgccagtgccccgggactgcaggcggccaggcccacctgggcagccatggcctccttctcctggccacaggcatgctctgctcctgagccagggaggccatgcttctggtcgtgggccacctgtgctgtgcccaagacctgcccagcagtgcccagtagcccgtccatctcctgcacccctcccctcatccccctcccctcccatcctgctgacttcctccctgcccagtatgtttctcttgggctgtggctgaaatagtttcgctgctgttgttgggatgattccctttcgtctctggctgcatctctcgaacacattcctccccattccaagacccgggcctgcctgactcccacccacaccctcccttcctcctctgactcagcccagagatgccccagtgggactgcggttctgccttgagcgctcttggcttattctgtctcctcctccccctacccccgccagctcccctggactctctttcagccaggtcccagtggcccctggtgacagcctaacccccttcctgggtggtatttctcctcttcaacggtgggggatggtgagggagtgaggcagccaacagccctgggccgcagctgctggggacggcgtggggggcacgtccagcctttggggtgatggggatatggcccagctgctgagccctacctttgggttgattctgcattccagaaagcagagcctttgggggtggccagggagggcactagaacccagaggctctggaggaggaaggagcaggatctttctgggggccttccgaacagcggctgcctagtgacccgctgcgtgcccacccagaggccagcctggcactgtggccatagagatatattccatgggtccccttgttaaggaattgaagatgcagttgtagagataaggcaaacttgcaaaacaattttggagcaattaggcactaagcagtgtggtattaattacaaaagcaggaggcgttctgggaggggaggggaaggaaggctgtgtgaggagtattgctggacgttagaggtggtggtgagagggtttagggaaggatgagcaggaggcccgacatgctgggagatggagaaacactggtccgggcgacggctgatgtattggggctgggggattttttagggggaacctttgttctgagatgagccaggaatgagcttgtttcaagagggctggtcagtgtcagtcctggctctgttccgcgacacctctggtgggctgtggtctcagcaggacccacgtgctcaagggcaagccttcccgagcttccccatcgtgttgcccccagtccaggaaaatgaagggtgtgggaggtacagaggcatggctcccaaaccagcggcaacacctgagaacttgttggaaatgcaacttcccaggctccagcctacacccgctgaattgggcatggggcttgtgggtcacgagcccagagctgggtgtggggagactcacttgggtcggtcccacctctgcctgacgacttggaccagccccccttcctctccctgggcctcaggtcagactagacgctctgagttcccttctctgaccttgatgactctgctcattccttcggcaaatatttgtcgagcagctgcttcatgtcagacactcatctgggctctggggatgcaatcgtggaaaaacagagtgacacctctgaccctatggagctgacgttctagtctacaaatgaggctgtggtcccacgggtgcacaagtctcagggtcccacagctgccttttgagaatcactgtgtagctgggtgctgtgacatgtgcctggagccccagctactccggaggctggggcgggaggattgcttgagcccaggagtccagaccagtttgggcaacatagtgaaacccccatctctttaaaaaaaatcgcttatacttgagagtcttaaaggctctaagaggtcccatgagaaagaaacccacttaatttttctttatatcctaaacttgttgaacagcagaatttctcctgaatttctacccctgaccccctgccctgccctgccccacccccaggaacatccttgcgttccccagcacacatttcgagaggtgttggctacagacaagctcatgatgggcaggtgaagggggagcagctttcctggatttggagataaaaggtctcttctgtgaaggcaagggtcgctaacccctaaccgcctgggaggaaaggaaggagagaaagacattgtctctcccagtcggggagctggtctccttttctgggctgggcagtctggtgggagtgtgtgagaggaatgctgtgggctgcagaggcaggggtgctgtgtccttgtggcctcctgacatggccaaggctgcagagagctggaggctcaggatgcccttatagtgcctctggaaattacaggttccccctgctggtaggcacatgccttggtgagcagaggccaagtgaaaaaagcccctctccctctggttgggaatgaggacttgcctcatgaagggatcccgggccggtgccctaggcagggcccatggtggtctgtctggagatgtgatgtggctcgtgaattcctgcggaaactatctctaggtccttcaggtgaccgcacagccccgggcagttgccctggagcccaggtgtggagtcccagccctgcctctgatgctgcaggtggcttggaccagctactttgcccttctgacctgcagtctccttacctatagaacgttttactggagaaccctgagagcagagggatgcgaggccaactgctggtagcagcctggtggggtgagggtctagggttgttttcttaagatccagaagtttttgctttagcttaaggatgtgtgcaattttccatgtggcttcataattcatccatgactttgaattttaaaatggagagaagttggcttcccaggaaatggtgcccctggccctgggcatcggcccacctggctgtctccaaggctctccttcccagtggctggtgcgggctccgggagctcagctgagtcccattggggtggcaacggaaagggagcaggggagtggggagtacggagatgcaggctggaaactggcctccaggaacaactgtgaggttgaaggcgagatttccatgttgggagcaaatttaagagccccagatggacacggcacacctggagacaggcactgctgcctgagtgtggcccagggagggctcggctccccaaagctccacggggcaggcccagacctcccagcagagtagggacaggctggttagcccagactcccgcctctgaggagaggaaccagctctccttgggaagagggcctctgccctggccggccctgactcccaggggacttcgaccccttgcttcatccctttatgtttctatctcctcagtgcaaaagggcagcgtgcttcctctctgctggttccgtgggatcggagccaggccccagtgtgcaatgtctttgcacacagataatagcgtgcgtgacagaggactctgtgcttagctgtcacctgctgccttcctgctgcccggtccccggcagaacccgcatgcctccctccctctctggaccctggcagtctctgcgccctggctccgagggaaggggcagggggcccgctggtcggcgagggctgggagcccccgacaccttggctccaagggaaggggcaggggtccgctggtcggcgagggccgggggccccctggtgtcgggcctgggaacagccgggctaggccctcctgggtgtgttggcccaaggctctggccctgactcctccccggctgcctcctcccaacaggccggcctcggccgcgctggcgactcggcggtgctggtgctgccgccttccccgggccctcgttcctccaggcccaggtaccagcaggccccggagggtcgggttggggtcttggaaggctgggaggggcaggagggagacgggcttccccgagagggatggggtcccccaagcccagttggctcctccacctcccagattcctccccctcccccacgctcttctcctgccccccacccccttgcttgcctaagctccggcacgggaccctcattcctggctgcctcccaccctgcagcatggactcggaagggggaagcctcctcctggacgaggactcggaagtcttcaagatgctgcaggaaaatcgcgagggacgggcggccccccgacagtccagctcctttcggctcttgcaggaagccctggaggctgaggagagaggtgagggtctggggggctggggaggggaaggaggttcccttccgtaccccgggccctgactggatgggtcagtgaaccagtgttcttaagtgcctgtgaggtgctcaccccaggactaggcacggagccgagcagagcgcgaagccccagcccctgcccataaggagctgacggtccgggagggtccgggagggtcaccagcgtgctcccacagagtagtgggcagtagccagctgggatgggaaagtgtcattcgagtgataaaagcggtggcagggcctggggctgggcctccagggagggcttcttggaggaagagggatttgacttggcctcttggccttagaaaaaacatcaagacttaaacagcattaagagggtggcaggaagcactgtggaaggtggaggctggcggccagagggctttggggtgtgggagtgagagaatgggggcctgatagcatgaaagggcgccagtggaggccaagcccctgcagtgagggccctcgggaagggaatcaggctgaggagtgccctaacccaggaaagccattaaatactgatgccaggcgagcaagacatacggaggcttgccagagttccgttattcatgtgacagacactgactgtgcccatctgagggaccagatgtgtgcagagtttggggataggtggccatgaccccactcctgcccttggggagctccgttcattggggcagatgggcctggccagctcccatggaagtgagcgctgctgtgggagttactactcccacagcccctgtccttaaggtgctcagcaccaatgccctctagaacagtggggagaaggggagggagatgacaggacaggtaggagagtggccagagaggcttcataattcatctatgactttgaattttaaaatggagagaagctggtttcccaggaaatggtgcccctggccctgggcactggcccgcctggctgtctccaaggctctccttcccagtggctggtgtgggctcctggacctcagttgagtcccattggggtggcaatggaaagggagcaggggagtggggagtacagagatgcaggctggaaactggcctccaggaacaactgtgaggttgaaggtgagatttccattttgggagcaaatgtaagaggccatatggacagggcacacctggagattggcaggtggctggttctaacgctgatgtttagctccaaggggcatttgcagaggcacagggggtggggtgagaaggtttggagcaaatctggtctgttttgaccctgaggcctcagaaggtcccaggaggcagcacagggagagagcagtgactttgccaaggaggcctcagcgtccttagctgcagacgggcgacagctgccccgtagccctgggcttcatcttcgtgtggcttgagagctcagatgtgacaaggcatggaaaagcactttgaaagccacaccgaggcattgcgctcctgttgccatctccagttattatctaatcacactgttattaccaggtcattagagagggagcacctgcttcacctgacactgagcacagatggccccaggtggccttggatgggcaaactcggccttgtacctgcctccttcatgcccttgcccagcctcagccatggatctggcaagatcaccttcctccttacctggtgccactgtcagcgtgactttagggtttctcttataagggtgctttccaagaccacctcctcagagcatctttgggaggatgctgtggttggtgggctctcaccacatgtctgtctgccctgcccccaggtggcacgccagccttcttgcccagctcactgagcccccagtcctccctgcccgcctccagggccctggccacccctcccaagctccacacttgtgagaagtgcagtaccagcatcgcgtgagtgtggaggggggtgggggacctgagccttcacaggggagtggggagggggacagggcactggatgctttcaggaagggccgggcccatcaggggctagcactgggtacccagtcggggactctaggggaagcagtgttgcacagctttgggggcattagttacaggcttcttaggagcctaggctagctgcttccggctgcatctcctctccctctcctccttttcccatcccttttgatttctctttgatcatttcaaagcctctggagatctgcccggaggtacagcacatcctcttggaaaatcttgctctttccccttcttccccctttggagcaggctgcatttttcccgatgtgggctcatttttcttatttttcttttcttttctttctttcttttcttttttttttttttttttttttgagacggagtctcattctgttgcccaggcaggagtgcagtggtgcaatttcagctcactgcaagctctgcctcccaggttcacgctattctcgtgtctcagcctcccgagttgttggggctacaggctcccgccaccactcccagctaatttttgtatttttagtagagacgcgttttccccatgttggccaggctggtctcaaactcttgaccttaggtgatccgcctgcctcggcctcccaaagtgctgggattacagcgtgagccaccatgcccagccgaggtgggctcatttttctcattaagtggcatttataatgcaaccacattctctggaaggttgctgaaaccccccctcaggtaaatttctgaagtgtgtagtgtgggaggggcaggtgattgactttaggcaaatcccttaacctctctgggctttagtgttttcatctgcagagtgggagaatatccagtccccctgctgtgcagagatagggaatgtgtgttgaaaaagcatgttttccatcctggttctcaaaggtgtgtgtgtcgggtcccttggagggtttgttaaatgccgatggctgggccccaccccagagcctcctctccaggaggccaacaggcctgagaatgtgcatttctcacgaattccccagtgatgcggatgctgctggctgtgggacccaggaccacactgagaatcactgctctgttaaaaatccaggcaatgtgggacggacttacagtctttatgtgagaggaacaacttttaaaaaaaatttttaatatttttaatagagtttcactctgttgctcaggcaggagcgcagtagtgccgtcatggctcactgcagccccaaactcctgggctcaagtgatcctcccatctcagcctcctgagtagctgggactacaggcgtgtgccaccatacctggctaatttttaaattttttgtagagatggggtcttgctatgttgcccagtttggtttcaaactcctggccttaagtgatctgtccacctgggatcctaggcatggattacaggcgtgagctactgtgcctggctgacttatttatttttattatttttaattaggggtcccagcagtggcagcggtggtgggggtttgtgtgtgttagggggtttgtcaaagtgagattcctgtgtgcagcttcaagaatcaagtctcgggccgggtgcagtggctcacgcctgtaatcccagcactctgggaagccaaggagggtggattacctgaggttgggagggcaagaccgtcctggctaacacggtaaaacccgtctctactaaaaatacaaaaacttagccaggtgtggtcgcacatgcttgtaatcccagctactcaggaggctggtgcaggagtatcgcttgaacccggaaggtagagattgctgtgagctgagatcacaccattgtattccagcctgggcaacaagagcaaaactccatctcaaaaaaaaaaaaaaaaaaaaaaaaaagtctagtctctgagaaggctttgggctccacccaggtcctgatgctacagtggggaccaggccccctgggcatggtggcctcctgcttggtgctgtggctctgagctaaagcctctccctccccttcaggaaccaggctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaagtagatgtcccttccttctttttcctaccgccagccctgggtatgacctgctcccaccactgggtggagggtctttatttatgcaacatacgtttcttcttcttttccctccctcaaatcccacccctgccagttgcctgcacctgacatttcccatggaagggccttgcctcttttaggttgggagtcatgtcattccttaacctttttgtaaagatgcccgttttacaggaggacgcttgtgctatggagggaatgagattgtcactggaagctttggaggggatggtggagggcgccaagcggagggacaggaggaagaccaggagacccatccagccaagctggtgagacaacctctgatcctgaggaccggccgcccaccaagggttgggcccccggggccaggttgatctaccgacaccttccacttctttcctgggagagactgctggcttcattggtgattgatttggaggggggaaaaagggcagggtggctcaggctttaggcccaggtactggggaggcctgaggagccctcctggagctcaggaggccgaggctgccttaagctgtgatcatgccactgcattccagcctgggagagagagaggacctgtctgttgaaaaaaacacaaaaacaaatgaatgcatgtggccagtgccaggtgagctgccctgggggttcactggagttgaggcaggggacagtagtctcccctgccagcctaggattttgggcgtcattcacccactacccctagtgctagtcccagaggatgctgcggagggggcagcctcagctctcttttcagagaagatcaaagctgggcttcccagggtgcctggctggtccctgccggcagctttgtgctctccggctctttgtgaaaggaatcttggcgcagatgtttgtgttgcctcctcaggcacctgtagatataatttacaccatgatatcattgtctcaccttttgcctgggtggctgcctgagaaaggtctttctttttatagaaaagatcaaggctgtctggcgcgggactccatgagccccaggcgctggtcagaaacggggtagtctctttggcgccacctagtgtccagtttggcccatggcggggcccattcacggggcaacactgggcttctgggcacagcgggaatacagaaagatacagcactcctcatgccttcctggaggtagaaggccagtggcagcgactgagctggcatgaatgaataagaggatgtggcactgagcgccaagggctaccttggaacgcaccgaggagcgtcccgtgagttcaaagcagtggccgtgatgcaaaaggagggctgggtcttggagacgtggagaagaggaatgctgagtgatggggtggctgctggggggatgcttagctcagagcagtggctgatggggacactgagataagatcggaggggagctgtcaatgccagaagtggtttgaacttccccttgaggctctagggacattttgttttgagacatggtcttgctctattgcccaggctggagtgcagtggtacaatcttagctcactgcagcctccacctcccaggctcaagagatcctcccacagcctcccaggtagctgggactacaggcgtgcaccaccacacccagctaatttttaagtttttttttttttttaagagatggggtctcactatgttgcccaggctggtctcgaacttcgggccccaagccatcctcccaccttggctttccaaagtgttgggattacaagcgtgagctaaccttgcccagcctctgggaacacttggaaggttttaagcagagaagtgacaggttggaaaagatggtttggattattgatatggacagattcccacctgtatgtagcacgccatgctgggccagcagtgtcataggagtggagggggataagtggggactggggacatgtgaaatgatgggcattccagtgaggcatcgaatgccttctgagggctttgtaggttccagctcaaatccccctctggctcttgttctttggtgtggcagccatctctcctcccaggggtcctgagggtttcagcaccagggttctctgcagccacacaatcagcccggctcgggagcaaactcccctggaagaacggagttatgagttggtcagcagaggaggctggggacaggcagtttttggtcttttacctctgatcttgtccccaacctaagccagctagctgcgtgctcccactccctctgccgcacgccgcccgtctatgttcccggactttgtccagtgcagtgccctcttcccttcctgcactgaggagattaactgaagtgacagattagagttagaagtggcccaaaggagcatctggtacaaccccctttggttagagaagggaaagtgacttttccaaagctgcacagctagacagtcataatggctaagctctgggggtgcttttgatgtgctagggatacttccaatgctttaactcacttaatcctcacaacccgagataggtactgttaccatcctctctgcagacgaggaaaccgaggaccaggaggttcagtaaatggtccaagtactcctagctagtaaggaatggatctacagcctgcctcccaggtttctggcttgtggggggcagagtttgtccctctgtcatcagaggcagccttccaggcacagctctggtcacctctggtcacaactggaggtcaccacagccctccccagcgctctgtaggctctcagctttgtgcttcctcccacgggtactagctccagctgagcttgcaggaaacccacttcctgaagccaggacttccccatgggaagtgcaggggccactgggcagcctgagggctgaccctgctcaggacactgtctgtctcaggaactcatggcagtggtttaccttgtcaggagtgcatggacgggctgcccctcccattccttcaagcatcactcagagagccctggcctggctctaggcttgggactgcggctgccacaggaagggggcatccccctactttgggtgttgggtcagatcctgcccccgtgcccgccagggctcaggttcctctgagctggtcctgggccaggacgcatctgcatggcggtggtggggaggaggggtgcgccatggcctggaggggagtgtgtgttggggtgtgtgtgtggaggttcttttgagtcacacacaaagcattgtgctgagacactgcattcctgctggctgggcttcctgtttccagatgcattcctgtcccagagtcaccacagagactgtttggaatcccgccccacattctccaaattcagggcgcgatctggcaaaggctccctcccccaccctcttactttggagggagtctgggctccctcctacccagggagggctggcagggctctggcacggccggggtgtgattccacacatcttcttggtcttgcataaggcagttcctggagacccagcactctggttctctctctgcctgtgagaagcggaatgggtactgtctaggaggactgggcagggtgggggcaacccagaggacccatggctagcagggaagggcctgggcttgaatgtgactctgttgagacatggccagcaattctggcacttggctgtcattcggctggcctgcgcagagattggctgtgggcctcagtttccccattttataaagttttaaaatctg

SEQ ID NO: 38504 - DNA, 14712 bp, Homo sapiens
ggcgcttggggtggccccgcccgccaggctccaccggcccctcctccccgcggggtggcagcccgctggacgcggggccgagggcgcggacgccgacgggtccggggccgcgcgctccagggaagcctgcatcccgctcccctgggccccgacgggcgggcgcactgcgcggggcccaccggccgcagacctgcgtggccgtccagggcgtcgccatgtcctcggtgtttggaaaaccccgcgcgggcagcgggcctcagagcgcgcccctcgaggtcaacctggccatcctggggcgccgcggggctggcaagtctggtgagtggcgccggggagcctgagccgccaagtgcggagctgggcgtgggtggggggacagtgggctgtgctcttgggggcaggttcttccactggcttggggagcttccttcacccaggagggtcgcacaagacaccgtgattttctttgcctcagtttccctgttgccgggctttctcttctctcggctttgtgctcagctccaccatctctgtcttctgttccctgcctgcctcttccctttgtgtcttcccactgtctctgtcctccgtatcagtgacccctgctgtctctcccctctctcttgtgtgtctcggagtcctttactggtcggtctcccctgccaccaaccttccaacccccacccctatgacctaccctggggccagcagtcagtcctggcgactggcttcaaagggacctgttgggcactgatccccctacccaaggcgcctctttgagcttagtcgcagccttgctactccctgattaggcttgggggaagacttcccgtccaacccctccccctccacaccccctccccgtagaagggagctggtgaagtcactagctgttgagatttctcagggaaggtccactcccccactcccacccccattccctgggattctgggacaagttgtgcattcttatcaaatgtgttcgtttcaagccagacccctctcaactttctggaaacacattgggttatggttccaggtgcatgggattgtccttgatgagccaagatcttgggcttccattgagataatttgtgtcaacactgaactatgccactcctggctggctgaaggagggagggcagaaggggtcctccactggctgtttttccagttttagccgttagtgatggccaacccaagctcagctggctgtgggtttcctccccagagtgttctgtaagactcactgggggcctactctctgattttgaagccagccccacccccagagaggggactctgaatctggttttcctacagaagggattaccctcttcctttgaaagatttgccctttgaaaatcagattgttatccgtagctctgtaaccggtaccgtttagccagtgactacataaaagaaagaatttaaattttaaaatatgtattccctgggtattagtttgcaaactgacaccgttaggaatcctaggaaagaattttaaggattttattcacaatgtcacttttttttttttaagacagtgtctctgtcactcaggctggagtacaatggcgcgatcatgactcactatagcctcaaactcctgagctcaagtgatcttccctctcagcctcctgagtagctaggactacaggcataccaccatgcctggttaatttttcaatttttttagagataacagtgtcactgcattgcccaggctggtctcaatcccaaagcactggaattacaggcatcccattacttttctttctttcttttttctttttctttctttctttctatctttctgtctttgtttctttctcttttcttccttcctttttctctttctcttttccctccctccctccttcccttcatccctctcttcttctttcttttttttctttcttctttctctctctttcttctttctttctctttccttctctttcttttattctctctcttctctactcttctcttctcttctcttctctactcttctcttctcttctcttttcttttctttctttccaaacaagcagtagcgaacattactttttgagggtccagtatagtagttggctggtctttgctttatatggctacactctgaaccaaagagagcttaattcttgagttttacattctgctgagatatccatgatgagtgtagaggccccagagaaagccaagacttgcgatgtgggagaccaggaccagagtgtgtttcttcgggacacagacctcacctggaccttacctggaaagcccaggcacttggggatttatacccttcccaaagatcaaccactgcaatcaactctgctcttcctgtgtttttggcttgtagctaaagcctggagtaaatagccccacacttcagaatctctgtgacttgtccggggtgggcgacacctcccttcagttgaggtttcaccaggctgactctagggtaatggttgcatgggtcctgacccctgagttcataccttccaaacaccccttaggcttgccactcattgctttccttgccattaaaaaaaattcccacggtgcaattagaggcacttggctccccgtagttctggtttccttctgagcctttcaaaccaattcctcagttccctagcttcattctctgggagagctgagcttggtgtcagccggggatcacagaggttagataaggcctcccttaaacgaggggccagcagctagacatggccgcggagatggagccaacctctttctgcttcttgcagccctgaccgtgaagtttctgaccaagaggtttatcagtgaatatgaccccaacttgggtaagaaactactccccgtaccttctgctgcctgtgccccatctggagtgctctcctgggacccaccccgtgggtgggcactgaccaggactgcatgtctggggacagaagggagaagccgccaggatgacccagcccatgggggaaaatgttttaagtgtcagaaataccccttccacagcccaccccagacaactggggggttggcctaattcacagaactaagagaggctgatttaccctaaaatatgaggtgtgaaaaaactttaaaaaataaaaataaacatagcaagacatccacatccaaacaggtattattcttgggccgggtgcggtggctaatgcctgtaatctcagcactttgggaggctgaggtgggtggatcacctgaggtcaggagttaatgaccagcctggccaacatggtgaaactccgtctctaaaaatacaaaaattagctgggcatagtggtgtgtgcctgtaatcccagcttctagggaggctgaggcaggagaactgcttgaacccgggaggcggagattgcagtgagccaaggtcgtgccactgcactccagcctgggcgacagagggaaactctgtctaaaaaaaaaaaaaactcaaaaacaaataggtattattcttcaagatggtcactcagtgttctcttccagaaaacctgggcaggacattcgagaaattctctagtggtgctggcttctgaaccagttttttaaccgtatgagaaaacaactgttgttttcatcgctgcatcatggtatattggaaaaaggaacgtttcggtgtcagtcagagctgggtttgaatcctacctggctctgctccttattggcaaccttgagccagtcagctaacctctctgagctactgtttcctcatctgtaaaatgggcattaaaaaatagttagagaattgctgtgaggattaaagaaatagcacatgtaaaagatccagcctagtacttgacccacagtaggcactcaatgcatttttgcttttccttcctcctcaaatggattcccatacacaatagcttagattcccttctaaaacaaatcaaagcaggattttattagtataaatgttgcttaaagctcacatgtataacatttgtctattgtaaactgttcactgagagccataaggtgtctggatgatcttagcctttagaaaatgggtgttgcagtcttggattattttccccattcataaaaatcaattaaagcattcatgggacccctgagagccctccaaagaagcccaaggctttgtgacacagtggaaaccccctgcgctccctgcagcaggcccctgatccagcgctcctgccgcacctggaggggagagctccttaccctagtggtgcccagccccttagttcaggctggagtccagcaccagtgttgcagcaggcagagacatcagggctatttagtccccttgtttaaaaaagcttttccttaggtagcagaatcccttcttccagattttaaacagaaccccagggtgtcaaacagagagagcaaaggggttcccatgggtaagtcagggatgcagggcaggtgacatggtgacagtccctaagagatttgttcctcgaagctctgcttgacccccggtgccttggcacagcccttcagtgctacagtggaggaaacaggcccaaggagctgaagactctgggccaaggtcacccagaggaggccctttgattagcagaggtcagctccagagagaggaggacacaggatgcaatggtgcactggccggcgaggtgttggaagaggccagagcatggaatagagatggggtggagaaactgaggacagaggtgaggtgggaggacaggaaggaaaggcacacaagcagacacagtgtctgggaaaggacaaggggaattcccaagggcagggactcaaaagacatattcggcctaattcaaatattgcatgggtcatgcttataccaaaaattattccttttttttttttgagattcagatttaactgggcatcttgtatttttcctggcatctcacctccagtctgtcttcctccctgccttccaatcgatactgtcacagggtgccaccggatgagcctattagggtggtggtttgagcctcctgattgaataattttggagttctgacctggtagtggaatgcgtgggcagactgtctgggaagtgggcagccccacaatggtcagtccccttggtctgtggtctctcacactacactgacagcccacgagtcagagagccaaccagacattctcccctcagactctctgggaggccagtgccactcctcgaaggttctgctaggaggggcctaaacattccggccactgtcccattgttggttccagcagcagcagagacagatgagaacctttccttctgtggataaaggtctccacattccattggggagctagccatcagcaatgctggtaaaacaactctctaagcccttcctaggtcttctgagagcctgagctcatttggtgagccttgagggtggagattcattcccatttccagcaggtagcacagtactagcttcagtgtagatgagggtttaactgggggggtggtaaattttggttttaggattaccctttaaagaagagctcctatcacgatcctcattttataggtggagaaatggaggaagagagggctcagtgatttgccttaagattatggagaccctcaggcacaaaggaagacgaggcatggctccagttgctctccgctaggagcagcctcatgtcatagagggcctggagtcagaggtctgtgtggcatggggccctctgagctgtggtttccccatctggaagatgggaccaatagcctgtgctctggctgtgtaagagttgcaccgttttctggggtgtggctgttagagctggtagtagctgagagattcagtgtctgtggaagggctttgcctgtgctgagacccgcaggagtgggcaggcgtctccaggagaatattctcctctcccagaagggctgagggtgcctcatctggctcagccagggaagaatgtcagcttctcactcctcttgctctcctcctcctccagcgaggacataggcaccatttctttttttttttttttttggtcacccaggctggagtgcagtggcgcaatctcggctcactgcaagctccacctcccgggttcacaccattctcctgcctcagcctcccgagtagctgggactacaggtgcctgccacccgagtagctggtactacaggtgcctgccaccatgcccggctaatttttttgtatttttagtagagacagggtttcaccgtgttcagcaggatggtctagaactcctgaccttgtgatccgcccaccttggcctcccaaagtgctgggattacaggtgtgagccaccacgcccggcccaacataggcaccatttctgaggcagcaccctgtatacactctgacgtgagcttctgtggtgccatttaaaaattattactataaatgagaggaaaacatcggcaaattcaaaactttgggaaatgactcttctctctacccaaaagtccacaggatattaattacaaccaggtgttaggaaacccatatatttaaggacaccagagtactctgaggcagggacttgatgataggaagtctggacattactgtgactgggaaaggagcccctcactcctgccccagcccctgaggcctgtcacttcttctataaagggaggctggacagtacgagctccaaggcttcttccagctcatgcaggcatgttccacatccccaccagactgggcgattctggtcttcccttgtactctgcccagacagagctggagggtgggctgattcactgagcagtcacggggtgagggggtcccattgtgaacacagcccagcctggaagccctgagttcaagttccttctgctgattaggtgctgtgtggccttgggtgagatcccttctctgggcctcaccttgccatctctctacaatggagctaacagcaaccttgaaaggctgtcatgctgtgggcaggagaccaaggttgagctagcgcctttcactgggctgggcaggacactgcgcccattgaggggaactcctaaaaggggtgcatctgacatctttgactggaaaataaagacagatctgaaagcgatgtaagcatctaggggcagctcttcttggaccaaatatagttaaacatttggaacatagtttccattagattttttttgtctttgcataagagcagctatttatccaagtccccaaagcaggctggggacaagaagctgtctgtgattcatgctggatgctagtggacctggagtgtgtccaggccagcttggctgccagtggccctcagaaagaagtgtttgactataaattcagccagggttgggggcgtgccctctcacagtggatgctgccaggaaggcagagaccaccccagttctgccaaaaggtgacttctttagggtcactaggggcaggggacacctagggaaaggtgataaccaagtgcactcacacatgtgggccaatgacacaggcacagattgggggtgcagagaatgactgccaacatggccgcaaggtcctctgcatgcctggccacttgttgctttctcagatttgagatcatgagaaccatatatataaaaaaagtaacaactcgagaaattcaaataaggtcactagtttggttcatagtatggtatcaatgtaaatttctttttgctcattgggctatggttatgtaaggtgatgacactgggggaagctgggtgaagagtacacaggaactctactattttacaacttctatgtcagtctaaagttatttcaaaagttaaaaaaaaaatcacctgggaatgtgatcctgccctattaactttggaacaccatcattcccactgccctcaccaggcatgtatggtgagccaggccccatgcctggggggcccatccagttcttacagagccctgggagatgggaccgttaaatgagctaatgtcaagcacttagcacagcgcctgggacaaaggaaaggcttggaaactgttagcaatgttatcacagtgttcccattttaaaatgaggaaacagcctcagagagctgaagtgatttggccaagtcacaaagctaaaaagcagctgacattgggtttaataccacattctccaactgaaaacttctgactacactagactcccctgctgtcatgttgacaaggattatttgtaaaaccttctcggaacttctaaaaggggtctgactgccattccttccattgtattgtgtacttctcttttcccttgtctcttctcccactggggacaggaggttggttgagggggaagagagtgggaaagcctggggttctgggatagaggggctagcagtgttgctcctgagccagcctgtgctgctaacagggtctaggggccacacactcgactctatcctgctggttttgtgtgtggatccagaacacagacccacccccgaggtgtggtctgtgagtgaccactgatgctgagccctgcaggtggagcagcatctccttggtgggaggttctgcctgtagcctccatgtgggtgagaaccaaggactttccagtggtcccagccccagagcagctgctaaggtccccccaggccacacaggggtctagcacagagggaagctcaaacttacacccaaggcactgtgtctgacctggctaaccatctgtgttgtagaggacacctacagctccgaggagactgtggaccaccagcctgtccacctgagggtcatggacactgcagacctggtaacattacctccattacctatgcactgctgtgagtcagtatagcctcctgagaagtcctggcccagagtgcgggacctcagataggcatttagatgccttttaagctcaactttgctgtgtaaccctgaatgaggcacttgacctctctgggtctgaatccttcctttgccaaatgagaaggatgggacagggcctggagagacatgatggttgctggcatctgctctgagatcctgtgctgtggggctctgtgcctgtgcacacgaggagacaggtgcacacctgtttacacagatgctcctggtgagagcccctcggcccaggtctctcccacacacaagtctccccccatgtcctcaccaccccctgccaaggctggatgccagttactctcagaagccaaaggggcagcatgaactcaacccaaaaccagtggtgcccagggacagccaggtctctgtagggaccatgccagagtctttggctctgggcccaaggggccaaggtctccaagtctctggctgggtggtgggagggaggttcatgagacaatgtctcctttcacaccaagccaaatccacactcaagtgcccctttgaaagggctctgctgagaaacaatatacaaagaccggggagtggggaggtgggattgggcggctcaggtgaaggcctttaccccaacctcctctgccccccggcggggcttctcaccttcaccccaggacacccccaggaactgcgagcgctacctgaactgggcccatgccttcctggtggtgtacagcgtcgacagccgccagagctttgatagcagcagcagctacctggagctgcttgccttgcacgcgaaggagacacagcgcagcatccctgccctgctgctgggcaacaagctggacatggctcagtacaggtgagcacagcctgcttggccgttatctccagagctcgctttcttcacttgtaaggtcaggtggcatcttgagggattagtgggctgctaagaacagtcatccccttgaattgtggtagaagggattatatgtttgtttgtgtgtgtgtttgttttctgagacagagtctcactgtgtcacccaggctggagtgcaatggcaccatctcggctcactgcaacctccacctcctgggttcaagtgattctcctgcctcagcctccccagtagctgggattacaggttcctgccaccatgccaggctaatttttgtgtttttagtagagatggggtttcgcctttttggccaggctggtcttgaactcctgaactcatgatccgcctgcctcagcctcccaaagtgtgggattacaggcgtgagccaccgtgcccgaccacagggattatgttgtaagggtatggtagatgttggtcttccaggcagccaaggacttgaagggaaacgcttctgggtcacacagcaactgcaccctgaaagtcagaagagtggccactccttccgcgctcttgggtctctgtggattctcttggactcacccttcttgcatgaatctatctgaccttccgatctcactcccagcagctgactggtctagtgcccaattccaattctaaggagagaggctctgatgggctccttggtcaggtgtctgctctggtccaatcggctctcacctcacccagacgcagcctcccactctcactcccacagttggctgggctgagggcaggttctcttagaaagggttggactcgaatcggaggtcagagactgggccagaggatgcattactgaagaatactgcagccatattttgcttggctggcatagtgtcttaaaagacctagaattggaatgctttgaggtggggcacgctctctccagccgaccccaggcctcaccactccccgtggtttacctccaccctttccacacattcaagttgcccgcctggccctgaagcatttgacactgtgatgcctgaacttgatgagtaatgccactggatttctccagcactgacctttgtcctctgtggccagtctacctgcaagggatagccccttccaccagccactcatccctccctgttcacggttggtcagtcctgctgccctaggccccaagggcacattgactggtgttagcaaggaagggaccctttgtttagaacgggtcagatgggccgtgggaaaaagagaggtgtgggaccgtgaaaggggactatggtgagaggccttcaaaggtggccaagccctcagacctaggcaaattgtgtctcagagaatgagggaagtcatgtgacctgaaagctgctgaaggtagtctttgaggaattgcagaccctcttaggggtcagaagactggattgtgagtaggccagttttcagtacagggaaaaaagcacagatcactcttttgaccccaatctttgccaaagggattgtctaaaatggtttgggagcaaataacaaagcatacatgctcaaatgaagctgatcccacccgttccctaaaaacaactcaggacaatgtattcctatttcattcttcgatcaagtcccaagtttagtagattaggattctgggaagcacaggaagtctaacttttagctgagcattggccattgtctcccacgactgtctcactgttaaaagggtaaaatgtcggttaggttgatgcttcccaagccactgataaaattttccctaggatgcaacaaaataagaaaaaggacaatgttctgtgcctctgtcacccactcacacacatgcacgcacacatggggtttgtgtttgtgaaaattcattattcaagcccccacaatgacaaagttgcagattcaagctcatcataaaagcaaataatagcaagtgttctttccaaaagggttcctcaggaagcggtgagcttactggcaccacggcacccagccctgggtggggaatagatccgatgcctctgactcttttttgtcccagttactcactctctctgagaccgcgtgcctcaccatggagtggcactctgggaagctagcccactctcagcccctgctcctgccaggtcagccttgggctcagaaacttttcccaccatggcccactcgagtgcctcctctcatctagtggctgtgccattatcctcgggaatgggcagcgggacagctcagcagtaggtcaggaagatccagccagtggagtcttggccccaagatctcagggacccccccatctcttccctcttgtagacatccgacctatgcaaggccagtcttctttttcttcccgcctcgattcccatggctttcaggtcagaagcctccaggaccttcccaagttccggatattctatcctcccttcacgggaggtggtgtaggaccaaggcagaataggtgttgccccctctctccttttgccctcctcaccatgaaatgttgtcccccctgccctctcctgcctctgccctggttttattatttgcttttatgatgagcttgaatctgcaactttgtcattgtgagggcttgaataatgaattttcacaaacacaaaccccaggagccctgagaactctgccaaccacaggcttctggagtcacctctgtggtctaacccttcagtccaaacgactgcttctctctagagctgatcccacaagccagagctgtgggtggcctgtttcctgccccagggacccacgatggggtagagaagagatggggctgggaatggcctgcttcctccagccacaggcagggtctagcataggggatttggagtagcttcttacccttaccctcatcccaaaattctggcctgggtgacatcagctaccatttattgagcactgactctgtgccaggtactgtgctaagcacttgaaacaaattgtctttcgtaatcctaacaaccctgagaggcagagggcagtaacccactgtactgataagaacgctgagactcagagaggtgaagatgaccccaggccacccagctagtccatggggcgctgggtgtaggagctggtctgcctgacttggcacagcctgctcctaactccctgcctcacactgcttcctcaccaggcaagtcaccaaggcagagggtgtggctttggcaggcaggtttgggtgcctgtttttcgaggtctctgcctgtctggactttgagcacgtgcagcatgtcttccacgaggcagtgcgagaggcacggcgggagctggagaagagccccctgacccggcccctcttcatctccgaggagagggccctgccccaccaggccccgctcaccgcgcggcatgggctggccagctgcaccttcaacacgctctccaccatcaacctgaaggagatgcccactgtggcccaggccaagctggtcaccgtgaagtcatcccgggcccagagcaagcgcaaggcgcctaccctgactctcctgaagggcttcaagatcttctgaggccccctccccaggaagcctaggctcggtggctggacaggactgcagcaggacagggactggcttctcaccaccagcctttccgtctgatggacagcagaccccgcctccagcaccaagcagtgtccctacactcaattcactgtgtgagctggagtggcaggcagggatgctgcttctgttccctccaggccttggtcttcatggtaaccaccgcgtctgtggccgtagagggaaacagccactgtgacaacccagagacctggggtcagccttaagtaggaagaaattgcagtgtctatcctgctgccatcagcccttcctgctccagctacagttgggccagctgtggccttagtggatggtctgggtggatggctctgtcaatgtcaggcccgagaacagcctgcggaatgacagcctggggtccttgtgccacctggtggacgggaaaggcagggcggctgcagtttcagaggccagagcctggccctcctgtcatctgctgacttcacagaaggcccaggctacaaaccccacagtttatccaaggaaaatctagttaaaataatccaatggacagaagccccaggaaggggtatttccaacacttggcgtctcaatgaggataaaagggagggactgtaggttgtccagcataaggagccccagagttctttcaccagcagacagattctccatgtgttttcccactgttaaggactctgtccaaagaacctcagcatcagctccctcaagcttaatgatccaggctgcagaagaaagttgtcactccagtgagttacccagggctccagggagcccacagcagcatcagacccatccaggggctacagggcctgcccccctgcaggtagaaacacagtatacccgtttgtcatctggtttggcaggacccaggaccctcagcaatgagtctgagtgttcaaagcccactttagaacctaaagcattttgggttaataaagcaaaattttgcttatgttatttggtggtgtcaccgcagcttataccaagacaccatggctcagacatgggatcaggacacacctttgagatcccactgttagcaagaaaaggctgtccaaggcaggcagtgtggtagttgtctgattttgtttaccacacgccaggtcccagggaagtcttgcacagactcttagcagacaagcagggaaaagagagggtcctggtgggtggaaggattgggaaggggattctgggcctggaagcctgctccttcccctctcagccgtctcaggactactgttggattgcaaacagcatctctgacccagtcttcggactcattctgtaaatggaggagctgaggtcagaggggggctgtgaactactcaagaccacatgcttgcagtcctacaggcttcccgacccacaggccagctacggattttgcacttttgctccaggccacttgtgtgtgtatgtgtgtgtgtaccactgccatctgaacaaactatgcaataccacctgctcccttccaggagcattttaataaaagattttttttaataacag

SEQ ID NO: 38505 - DNA, 8800 bp, Homo sapiens
agttcccagctgtccgaaaggtaaagacgtgtctctcgctggtttctcgaggttctgccccgcgcgagggcctcacctgtgggtagaggtgctgcatgaactgctcccgagaaacgccctccagccggggtaccgggaggtgctgcccggccatggttgctcacgcctgccctcttccaggtcttcggaacttcggctctaaagcgttcctcagcgccatccgcccggaaacacgagcgacagagaaaaggtccgcgaggccggcagactccagagtggctgggtccgagcgcggggcgggttgccgaagggcctcggcctgggctgcgtgctggagagcggggacggggccgactcaccagaggctgcagcaacaggtccactttgctctccagtctctttctccgacaccgctgaggcggtttcccaccgacttcctttccatacagcaccggcaggcaccggtgtgaagggtcataaaaatggcgctggccgctcgtttgctaccccagttcctgcactctcggtcgctgccctgcggggccgtccgactccggactcctgctgtggccgaggtgaggctgccgtcggccacactttgctacttctgccgctgtcgcctcggcttgggagcggcgttatttccacgaagcgctagggccttggcagcctcggcgctacctgcccagggctcccggtggccagtgctcagcagcccgggactccccgcagccttcgcttctttccctgcctgccctcagcgcagctacagcacggaggagaagccccagcagcaccagaaaaccaagatgatcgtcctgggattctccaaccccatcaactgggttaggactcgaattaaggccttccttatctgggcctatttcgacaaagagttcagcatcacagagttctccgagggagcgaagcaggtttgtttatttccctgattgacctatccgtctctaatgagttcaactattgctcgcagaagtgcttagcagtgagttttcttcactgggatacaagtgatcaaacgtgattagtggcccagacatagagccttccagccattgcttgacttaaagtaagcttctgggccgggaatggtggtacacgcctgtagtctcagctacttgggaggctgaaggggaggatcgcttgaacccaggagttggacgttgtagtgagctgtgatcgtgccattgcactccagcctgggatacagagccaggccctgtctcagaaagaaaaagctatatggctcatcttgtctgaacataattttcaaatttacaaagtgggcaagacaatgcctggcacatagtaggcactccatgaatgtttgctgaatacattaataaatgggtaagattgaagaataattgagataacatttccaaagtgctgtaatgtcaccttgggtagaagagcagaacttcctgccagctattagacagagccgaccaatacaccaccccatactccgtaaagattaaactggagatgagcaattttaccctttcaaaggatttgctgagactgcctggtggctaagtgcacagcaccctgcacacagaaaatatttagcctttagagattcttatccctgactttgttagttacgtacctgtttctgaatggctgattataccttgccttacccttgtgacatatggtcacttgggtcctgagattatttgtagattttgtgggtacatgctttttttttttttttttggactcctttacagattgtatcgttcccaaacattgcagaactgctgataacaatagaagtcggccaggcatggcggctcacgcctgtaatcccagtactttgggaggccgaggcaggtggatcacaaggtcaggagttcgagaccagcctggccaatatggtgaaacagtgtctcttctaaaaatacaaaaattaggcgtggcgagcccctgtagtcccacctactctggaggctgaggcaggagaattgcatgaacccgggaggtggaggttgcagtgaaccaagattgcgccactgcactccagcctgggtgacagagcgagactccgtctcaaaaaacaaaaacaaacaaaaaaaccacaatagaagtcagaaagtttatttcccgcttcatacctccatatgccttaaaaccatgctattggtgtaatcattttacagtattggttgtatactggtattgatattttactccaaatttatttcagattctttccataatcatggccatttgtatttataagaccaatcagttgtaaatcaaatgttttcaactttgtttaataagtgtcagtattaactcctgctgcctgcttctctgagtcaactcttgactactatatatatttatataaaaaaagtcaaagaacaaacttgattaagatgcttaactcagcattataattgataaacctctgctcttgtcagttctcaaagtcttttgtccatgcagtggtaagttgtattgatcctactgttctgtacaatgcccactgatgatatatgagcttgtccacctcataacacatatgatggtaccagttcatttatgtttcagtaaggaatggaaatcatctccccaccatgggcaggcatcaggcctcagtacttgtttcctctgaacacacagaggagcatgcagcatttttggggtcactccagtcctagtggtcctccagctgttagctattttcacctccttccttgctattaagcagtatttccaccccattcatcagccagcctgtaagcattgttgcttatataaagcaaacaacctgaatttcagtatcaaggtgtcggaggggttgttttctcctgaggcctctctcagcttacagatggccgtcttcttgctgtgtccttgcatggtcctccctgtgcatgcgtgctcctggtggctcttactccacatttgctcctcttataaggatgccagtcagattggattttggcccaccctgatggtctcatttaacttaatcatctctttaaggctttatctccaaatatagtcacatttcaaggttctgggggttagagcttcagcataaattttcggggaaggagagcacaattcatcctataacagttaggcagtattctctgacatgccatatctgacatgcctgtgcatcctctggcagcctagatttcagcttagatgtttcttcctttaggaagccctctctgatcctcccagattgggttagaaggctcttctgtatgctcccaagtcatcctgttcttatccctgtcaaaattcttcaacttgtcagtttacttgtccttttcccatgtagactgaaagttccctgaagacaggtaggatcttaactcacagtttgctttctcattgctagcagtgaggagaattgcagttgggtttttccctccttgaaaatggaatttcatacttcaaagttaggatctactgttttagaccacataaactaatgaccttctctcccactttcccaaacctacattatctcccatactgagattcagactacagcccagatttccagactcccaatgcagtctcgactgttctcctttccaactgctatctatgcatgattaagaggtaggtcatataactgccaaatgattgtttacttcatcattttaaaaagaaatataaaggaggatttttattgagacatctagattgtacaccacacactatcatttcccggtcctgagagtggatccagaattaaaggtcaagtcacttactgctatatatgtgggaaggccatatatgaaaagtcaaccaagagtcatgccttgataaattaatatttgatgttgtttatcactattaccataaaatagtctgtattacacttagccatttaaatatgaacatggtatggtattttgaaataataatccccacacttcccttaatatttttttcaaggcttttgctcatgtatccaagttgctgtcacagtgtaaatttgatctgttggaagaacttgtggccaaagaggtaaagtatattttacattttgctttaaaaataaatgctattctcttgcaatagaatgatgcacattttccttatttatgcttaaaaatagtgtgtgtgccagcatccaaagtagagtctgtgtatctgttcttatgggtactttgggtcatataaaagcatggaataactcctgccacttaaggcataatgaagtaatcatgatgtcttccaattgctcttatatggaatgttctgttaggaattacctacttgaataatgagatacatttcagccttgcttttgaggatgagtaaatacggtagtaaatttaaaaataggtttggaaaaatgtattccatgataaagatcactttttgaaagttttcaaaaattgtatcagtgaactaatggcttgcttttttcaaacttaggtgctacatgcattgaaagaaaaggttacttcactacctgacaaccataaaaatgcccttgctgctaacatagatgaaattgtatttacatcaacaggagacatctccatttactatgatgagaaaggtaataccagagcatagtcaacttgaaatgatccataattgtccagataagctaaactagtggataatcacaaaatagtagagttttgtcaggacaagtatttatagaacttcaaagaaaatgttatatccattctttaaagacctacttctgaaagagttgagatatggtcatcatttcttaagcctttctatctagaacttttttctgctactattttattcacagtagagaacatcatcacttacattgatgaaaatagtttgagtggctcccacgtctcaaatagaaaatatttatgtttcagatttcctaacttgaaggaaacaattgagtattttaaagctgcactttatatggaaggaatgaggggtaaaagaaaatcaaattagatattgtcagctaaagacaatttgaaaaggttaactgcagaactcccaaattggatctatttgagaataatgaaaaaagttggtaggaaatttagtggttatctggttcttcttgtctgaggcatacattttccctatagcattcctgataattcactgtttgttcctgatacatacaaagttggccctctgtatctgggggtttcgcatccacagatttaaccaatctagggtaaaaaatattaaaaaaaaatagttgcatctgtacttgaacatgtgcagtttttttcttgtcattattcctcaataatacagtataacaactatttacattagcatttacattgtgttaggtattataaataatctagagatgatttaaagtatactggaggatgtgtgttatgcaaatactacaccattttatataaaggacttgagcatctgtggattttggtatccacaggggggtcctggaaccaatcctccgtggattttgagggatgactctatttgcatatgtattatgtgccagccacacaggaaatggagcctctgcttatacacttcccaagatggaagaaaaagactcttagtgatgataaaatttttcatgcacacattattttgaaatatttgtaaagatatttttagtgataaatattttccgcttccctaatatttcaaattgcatctcagcaccatggtcactaactaatttttgcatcaggagtttgtcagaatcaccaggcacagtaaggtgaattgggtagaataggaagcctttactctttctggcagttgaagttaagatagttactgagcagcaaaaaatattttttttctcctcatttttggtttgacaacaggtatctgtcaggagattattataatcttagaaaatgcctggccagatgtggtggctcacacttgtaatcctagcattttgggaggctgaggcaggtggatcacttgagctcaagagttcaagaccagcctgggcaacatggcaagacccagtctctactgaaaatatgaaaaaatagccgggcatggtggtgcgtgcctgtggtcccatctacttaggaggctgaggtgggaggatcgcttgagcctgggaggcggaagttgcagtgagccgatactgcgccactgcaccccagcccgggtgacagagtgagactctgtgtcaaaaaaagagaaagaaaaagaaaatgccactaattgaaaataatccatgtagtatacttagtaaagtacgtgctcagttaagtagtagttttattactgagatacagagaagagggcaagtatgccataaaccctaagacaattttctaaaaataaaatagtatcaatacaagtattttaagtcacatcagaataagcacaaaatttgacctgtaacaactgtataactgctgccaatttctgatttcattttgtttatatggatgatagattattttgatttgtattcgtatgtgtgtatatgttttttctctaaggaaggaagtttgttaacatcctgatgtgcttttggtatctaaccagtgccaacatccccagtgaaactttaagaggagccagtgtattccaggttaagttggggaatcagaatgtggaaactaaacaacttcttagtgcaagctatgagtaagtttaatcagatttcattgtttcctttcttcagaaaatggaaggtagtgtgaaggtatgaaaactaagagatctttaggaagaaaagaattgaaatttgacaagttatttatgaagagaaaaggtcagaaagacacactggatatgaaacaggagagttaagaaattagaaagaggtaaagttgctgaatttaattaaatgatgttttagctgtctattgctgcttaacaaactacccccaaattcattggcttcaaacagccattgactttgcctgctatttcactgctcagaaattttggataggctcagttagggggttttctctgcttcacctggcatcaacacgagtggcaggagctggaggattcatttccacagtgacttcttaactcgcatgggtggcaccttggtactccttggcttctgcatgactctgtattctccagggccactctttgtggcttggacttgtggtagtttcagactagtcatatctttcatatagtggttgaattctaggaggcagaaaatggaagctgctaaaccagtaaagggctatgcccagaattagaacatcagttctgccatagtctacttgtcaaagcagtcaaaggatctgtatagtttaaagggtgtagaaagactcccccattttttggggcaaaaaccagcaaggccacatagcagaagagcacatgggaggggagatatggttgtggtcatttttggaaaataaaatctgccataattggtacatgaacaatttattcactagacatctgttggtcatctgtgtgcccacatgctctggtagaggttcagatacaaagttgaagggatactgcccttaagcacatactgtatagtaggaagttagcaagttacgtaaaagagacattatattgtatttttatgcgaataaaatctagaacagtgaactgctggagcaagtcagtgaagatataatttaacatttattaaaaaaatatgttgccagagttacacaaatctgcttcaaaataacaaaccccaaaaatgacctaagaaataaaatgtattctgttttactaaggtaaaagagaattatatcctcattttttttttgctcttcttaaaagaaatgtgtttttttaaattttgctttatttgtaattacccaaaatattctatatatttaaatacttaatttaaatctactgaattgcctgttaagaaataatttttaaagagcactgtcgtcaatactaaactttatcttttctgatgtttcttactaagactatgggtacttcataaacattgttattttcaagattgatttaatgtatgtaaactaaattccactatttattcctaaattggtaacagtgctatttgaaaaatagctttttgcctgtatcctaggttatgtatttaaagtgctgtttgcatcaccagagtccagtttatctgtcctcatattaggcatgtgttatagctagtatttaacacatactagctatatgtgttatttatataacacatatatccaagtttctcttaggggctggtagatgttgaatatagattagtccattaaaaatacttacattacttgagaatgtacttcaattttgtgggtatatttattgtgattgaatgggtaggttaaacttttttttgttttgattttgatttaatattaaccattatcttgttgccaaaaattcttctaaatatacacttgcaaattacatagttatctaacacatacttggactgatgtaagatttacattatttgcaatgtctttcctaggtttcagagggagttcacacaaggagtaaagcctgactggaccattgcacggattgaacactcaaaattattagaataattttcttggaaaaatcagcttatggactttagcagttgctgtgaaaaactaaggaagaaaaattttggggtcatttgatcttcacttaatctaagtctgtgaattacttttatattattttgaaatactccttgcagtatattggcatgatacagtaaaagcattttccacagattgttatcaccttctttaaaagaagtcaaaatttaaaaaatacaatagcacgttgttggtgtcatattcaataacatttccaatgctacatataattttatagacataataaagaaggtattgaaaaaact

SEQ ID NO: 38506 - DNA, 10178 bp, Homo sapiens
ccctgctcctccgcctgggcggcccggctgcggtgacggctctcgctgcccgactgggggccatgaagccgagtccggccgggacggcgaaggagctggagcctccggcgccggcccgaggcgagcagcgcacggcggagcccgaggggcgctggcgggagaagggcgaggcagacaccgagcggcagcgcacccgggagcggcaggaggccacgctggccgggctggcggagctggagtacctgcgccagcgccaagagctgctggtcaggggcgccctgcgcggcgccgggggtgcgggagccgctgcgccccgcgctggggagctactgggggaggcggcgcagcgcagtcgcctggaggagaagttcttggaggagaacatcttgctgctaagaaagcaattggtaggtcgtgcccgaaggtggagcacggctgttcctgcccaggggctggaggtcgggcaggtggcctggggcgggcgcgaggttgactctggctggggagatgctcgctgttatgggacgcccccgaccgccccatacctccctgatccccttcctgagtgcccgcggcgtgtgggctgccgacgcccacgcgtttctggcgtgtgcccgctttgtgtctggcgacctcgcgcggattgcgggaagggggtggccgctcttccctcctcctctgccttcgggattcttggagtcgcctagttctaacgttcggtctccttagttagatgagtatatgccctctccccagcggtttgcaaactcccacttaaaataccattttatttggaggttttcttgactttatctcctcccgccgagaggggccaaaagccaaggagggggtttgtggcgtgcttaactgtccagggccgagttttacgattacactggagcgcctgtagggagccgtgcctctccgagagctctccccagcatgccagctttcacccaggctggtgcttaatttcaaatagaagccctttgtataaggcagctcaaactagatggaaatgatggaaatttggctggagactgtgtcccctcctctcatattttatacgttctgccagctgtgattggtggtggaggtgggagaaaagagaacctgctctcggtaagcatttatcttactgggtttctgtcagtgtctcagtctttctatgcagtcttcattaatggggaagaaaaagaactttgtagcttaatgtattgatgaacagcttttgaccccgcctcagaataatggcgacagctttgttttcagtgaccttaaaatgtagttttggaaacagcaaacgtcctcacctgaccaagtgatactatctaaactagacacatgccaggtagtggccctcccacaataaagtggtgatgctgtgcagttgtcatgtgttttcttctattatctcttttcagatcatttcttttctctgtgtgtgtgtgtgtgtttttaagcaccaaagtgcttttacttgataggttcatttttcctgaagaaattaattgtagcaaacaaacatacaatttatgtctccaagctttttaagtcaaaagacaagaggcgtagatattcatatgcatgtgttttgtaaggatgtacactgtggtttgtgtaatatctctgttttggcattttactgtgctgcttcggtcacagaccagattcctatgtaacattcatttgagccagttctcactggttatggctggtgacttttacattttattgttttgtgcaattgcacctttttgtctgcatgaatctcaagattgtaagtggcgcattcctattgtccgcttgaggggagcaaagcagtatgtcaagagaattccagtccagtcagtatttatggtactattttcatttgtagacttggcattcatgatttgaaccagatgctttttgagttctcccgtttttccagcaataggaagcactaggtggcagtgtgagttagcacaatccatctgtcacctttggaaacccagaggcgttcaaatctcgatgggccttcccatgagggttttggattctgccagctcacattatacttggcactggctattagtattagtttctcactttcaaaggctctaagactgattaaaccccacaaagcaactaatagaaaacaaaactctgcaggccaagacatttggccagaaaatctcacctaagattatagtgtattataggaaatctcttactctcatttcaaattaaagagtctactgtgaagtattgttttttaaaagactggttatacaccagatgatttaaagtctcagtccatttttcttgtccctatctatgaaaagtcagtttgtatatattagttgaaactaaaaacaagtcttgtttttatgaagaaactttatatcaccacaaaatgtgagaaagtggaattaaacataggacatattcttgaattctcgaagtttttcgttacttcaggtcatccagtaaaattttggttttctaagtttagtgaactcttcagatgggtaatttgaatccttagagtagactttctggttcttttgtcacccctgtatgttcatgtttcctttgtttcttcctaatcagaactgtttgaggcgaagagatgctggtttgttgaatcagttgcaagagcttgacaagcagataagtgacctgagactggatgtagaaaagacatctgaagagcacctggagacagacagtcggcctagctcaggtgagtgattgagcacaaggacagaattctgcactcttgagttgtatctcagccccttgtggttaacattcccagacctgcaaatggcaatggagtttgtttccagtgcagagaggataaacaaaaaagaagtctgccattcagttttatcggaataagagggaaataaactcagacaacaaaatttttagtaatgagatcaatgtgattggagtcccccaagtttaaaaataaaagctattcaaatttctgcaagaggtgccctcctttgaaacttgagtaagtcagaactgggctagaaaattagtcacacttcaacttcctgagaccacttcaaaagttttttttttttttcttttaaaccatttgggctccttagatttttctcttattattgttctgaaacaatcatgataaagatgaggcttgacagatctaagtttctttccttggacatgttcaaaggcggggtcaaggaataaggtcaatttgagggtgagggtaactctgaaatgtacccctagttatgggctctttgccttttcctaaggattgtttgaaataagaccataagattaggacaccaaagtccaatgaatcaaaattggccaaaaaacaaacaaaaaatctccttttcctaaatgattattcattttcctgttaagcgtgaatatgcattatttcttgacatgatgttaattccaacggtgtttttatttgtagggttttatgagctgagtgatggggcttcaggatccctttccaattcctctaactcggtgttcagtgagtgtttatccagttgtcattccagcacctgcttttgcagccccttggaggcgaccttgagtctctcagatggttgccccaaatctgcaggtaagaatttttagcactgatagaaatttttaattggaaggcatcaagggcccttaaaaggttatttggctccagcacctttcactggtggaaaaatgaaggttcatcactttgcggcatttagtgccatacttacatctagaactcagtttcatctaggtgagtatctagaactattccagtaccctttgggtgctacttggttatatattttgatagcagcaagacactttatctctagaaatcctgtcccaatattgtaggtcttgagctctgtttctgagcctttgctgttaggttgtctgtattttctttcattttggaactgttttcttcttttaattatgtaaagctaaaactcagccaggtgcagtggctcacacctgtaatcccagcactttgggaggcttaggcagctggatcacctgaggtcaggagttcaagaccagcctgggttggcccggtgcagtggctcatgactataatcctagcactttgggaggccaaggtgggtggatcacttgaggtcaggagttcaagaccagcctggccaacatggtgaaaccccatctctactaaaaatacaaaaattagccgggcatggtggcacatgcctatagtcccagctactcgggaggctgagggagaattgcttgaacccaggaggtagaggtcatagtgagccgagattggaccactgtactccagcctgggcggcagagagaaaaaaaaaacaaaaaacaaaagaccagcctgggcaacatgatgaaaccctgtctctactaaaaacacaaaaatcggccgggtgtggcagcatgtgcctgtaatcccagctacttgagaggctgaggcaatagaatcacttgaaccccagaggcggaggttgcagtgagccgagattgtgccactgcactccagcctgggcaacagagtgaggctccatctcaatcaatcaatcagtctaacactcacattaagttaaatatgtccatcagcctggccaagaactggttggcacttcagggagcaatggccctttcatgttctccagaatgttctgcatgatggcagcttgttttttcttttaagtgggtgcccacatgccattattccttattttgggatatctttgcaatgacccccagaaggaatcatgctattgtactagaagagtttctgcatttccagtatgtgtcacacactactggatgctctgtatgtatttatctccaatgaatcctcccaatagtcgtgcacagtacaggtcttgttagctccattttatgtattaaaaaaatgagtcctagtaaggttacatatgttatttaaggctctatagatggtgagtggcagaggcagaagttaagctcaggcctaactgccaggtccacgtttttcatcatcccaagggaattcagaaattgttgttttcaaccttctcatctaacagaagaggaattttggcttataagctaattgtcagaggttctccatctgctgaatggcagggttgctgctggaactcaagactccttccttagtcctgttacattgtgaattcttataagagtagagaaaatatgaagattagaattgctctgggtcctgggcacaagtcatcacactcctggtttgtctgtgttctccacttgggtataagcctgaatttttgagtccaggcaaggcaaacaacactgagcagctgagggagctaattggctggtgtcttcatatctgtgtgttgtcagcagcaatcatttgaggaagcacagaactgtgttatctagagggtctgggcctcaagttcattggtaattgctccccttcattccacagatctggtttcagagggaaactttataaacccattaaaggcactttggtttaggttttccttcaagacagacccgtgctcttccaaatgccacttcctcacataattgagacagttgcaccaggccttgggggctaggatatctgttttgttcaactctaaagagggaaaagggatgaatagtgaagtgtttgtcagtgtggctttaagtaaggcaaagatagggcttacgttgctgggagaggaaggatggggaaggatgttagctagagaggtttccttttagaacaagctctttattggggggggtcatgtgggtggggacatggcacttttgttttattatgttttctttacatatcatctctgggtctagactattttttccctgagaccgctaattatcattgaagtttatggagctttctcaacatagaatcaggcacatataggttctcagtatttgaatgaataaatacaatggaggacaaattattactgataaactcaactttaattttctctgataactgaaggtcattaaatggatttgttatttataatattcaccaacttaagagatcaaaatcctttaagacagcaagcttgattttgctgtactttggcatctacattttcaagatatgggaaatttatccattaatattaccacatgatcttttaaaatattaccaagaattctttatcctattaaaaaaacatttttgacaagtgggaaatttatccattaatactaccactcaatcttttaaaatcttatcaagaattctttatcatattaaaaaagtttttttaaattaaaaattttgttgtagagagatggagtctcactgttgcccaggctggtctcgaactcctgggcctaagcgatcctctggcctcagccttttggtgttaggattgcaggcgtgagccatcatacctggcccctgttttatttttttagcatcactattgaaaacataaggcgattattatttaaatctgatcagtttttactgaagtttgatcagtttccatcacctttcaattgacagttatatttgaatggatgtcattaagaattaggtttaaaaaaacacaaaatgaggagaaagcctactgaacgtacagtttatcctaaagaaagccaggaatagaacagaggggagagcagcctagagaaacagtgattcaaaaaatgtttcccagttgtaaacgcagtacagacagtttaacagaaaataaagaagaaagtaaatatcacttacttctgatcattctgaaatactactactagaatcttggtgtgcttcatctcagatgttttttctttgcatacatgtgatcctaataagattataatcatattctagtattatatcatgattttcactaaactttaaagtgttttccctctattatgcagtagtttgaaaacactcttaatggctgaatttttttccttcagaggatatatcatatgctgtcaaaaatttttgttaaatatttccccctcatccagtagcagtacctacatgtgaaatggtagggcagcactttttaatccttggcaatctctttttacccatggatttttcataaaaattggccaaagagtcaagctggtgctgaccaattcatttcttcagagtgtacctttaactgtttttcagatctcataggattgttggaatataaagaaggccactgtgaagaccaggcctcaggggcagtttgccgttccctctccacaccacaatttaattcccttgatgtcattgcagatgtgaatcccaagtaccagtgtgatctggtgtctaaaaacgggaatgatgtatatcgctatcccagtccacttcatgctgtggctgtgcagagcccaatgtttctcctttgtctgacgggcaaccctctgagggaagaggacaggcttggaaaccatgccagtgacatttgcggtggatctgagctagatgccgtcaaaacagacagttccttaccgtccccaagcagtctgtggtctgcttcccatccttcatccagcaagaaaatggatggctacattctgagcctggtccagaaaaaaacacaccctgtaaggaccaacaaaccaagaaccagcgtgaacgctgaccccacgaaagggcttctgaggaacgggagcgtttgtgtcagagccccgggcggtgtctcacagggcaacagtgtgaaccttaagaattcgaaacaggcgtgtctgccctctggcgggataccttctctgaacaatgggacattctccccaccgaagcagtggtcgaaagaatcaaaggccgaacaagccgaaagcaagagggtgcccctgccagagggctgcccctcaggcgctgcctccgaccttcagagtaagcacctgccaaaaacggccaagccagcctcgcaagaacatgctcggtgttccgccattgggacaggggagtcccctaaggaaagcgctcagctctcaggggcctctccaaaagagagtcctagcagaggccctgccccgccgcaggagaacaaagttgtacagcccctgaaaaagatgtcacagaaaaacagcctgcagggcgtccccccggccactcctcccctgctgtctacagctttccccgtggaagagaggcctgccttggatttcaagagcgagggctcttcccaaagcctggaggaagcgcacctggtcaaggcccagtttatcccggggcagcagcccagtgtcaggctccaccggggccacaggaacatgggcgtcgtgaagaactccagcctgaagcaccgcggcccagccctccaggggctggagaacggcttgcccaccgtcagggagaaaacgcgggccgggagcaagaagtgtcgcttcccagatgacttggatacaaataagaaactcaagaaagcctcctccaaggggaggaagagtgggggcgggcccgaggctggtgttcccggcaggcccgcgggcgggggccacagggcggggagcagggcgcatggccacggacgggaggcggtggtggccaaacctaagcacaagcgaactgactaccggcggtggaagtcctcggccgagatttcctacgaagaggccctgaggagggcccggcgcggtcgccgggagaatgtggggctgtaccccgcgcctgtgcctctgccctacgccagcccctacgcctacgtggctagcgactccgagtactcggccgagtgcgagtccctgttccactccaccgtggtggacaccagtgaggacgagcagagcaattacaccaccaactgcttcggggacagcgagtcgagtgtgagcgagggcgagttcgtgggggagagcacaaccaccagcgactctgaagaaagcgggggcttaatttggtcccagtttgtccagactctgcccattcaaacggtaacggccccagaccttcacaaccaccccgcaaaaacctttgtcaaaattaaggcctcacataacctcaagaagaagatcctccgctttcggtctggctctttgaaactgatgacgacggtttgagtgacatcattggtgtagaaagtttgtgtgtttttttttcttctccctagttgccaaaattaaaaaggtggtgttttcatttttgtataatactttaatggaatgctttttaaaaaaatataaaaccaaggtaaattattgtttcatcttcacgtatggatgctagtgcctttaatggaaggtaaagaatgttttgctagttagaagtacatattgaggttttaatggtggtgatagtgagttttgtggcaccagctgttttttattttaaactttctgagcatccggcaaggtacaggttttgatgttcaagttttattgggataagatcttttgatcccaaggtcaggtggatggaatttttggatttatatttgttccttgagtcttcagggcagtgtctccatgagggttttcctgttgaggggcaccacatacaatagtgtgaagtaggtatgaggggcagtcattgtattctatagtttttttatgtagtctacatttctcagatgtatccccattcggttttattctcagaactgttactagactcatgacttggaggccaaaccttaaatccagagatagcagcctcgatagggaccttaaaaggattcacaaaaacttttgccacacttggtgcctaggccctgttcctaataaccccttctagggccgtttatccaacatttagatgccttcttttccctccctaatttgtagccagtccaacctttcattccttggaggatttagttttgggataaaattttggtccttgggcacagagacattcactattaatgaagtaacccttgggcatgactccaatcccagaattgctcactgagcgctatgccaccgaagcgttgacctgaacatattagtgcaatccagtccagattggacctttgatcctatgtggaagggctgttttttaagaaaaaatttttggtaaacagtattgtgtaaaattgctttttgtataccaatatatgcatgttttgtgcatgagtagtacttgtgttgatactcctgttgatgttaaattactatataatataaacagtatgtgtttttatatatcattgtgtaaatttaatataacatatgcagtaataaaccatttgttttactgctgttaagtttgttatttgggtataaaaccagatgtttacacctgt

SEQ ID NO: 38507 - DNA, 5032 bp, Homo sapiens
cgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcctgcgtgggaggtgaggccgggcgatgggacccttgggaggctgagggcctggacggcagtggggatctctgccgagaagaccacgcgcctgggaggcgagggactgcgggccttgaccttgaccacaccctcgcctcgttcgtgaatcgggcgtcacctctcctgccccctcaggccggctttcctgatgaaaattgggttagagaatcggtgctgtggttggggcctgaaagttattacatgacatcctggctaacacggtgaaaccccgtctctactaaaaatacaaaaaattagctggacgtggtggtgggcgcctgtagtcccagctattcgggaggttgaggcaggagaatcgcttgaacccaggaggcggagcttgcagtgagccgagatgtgccactgctctccagcctgggcgacagagcgagactccgtctcaaaaacaacaacaaaaagttattacgtgggtgacttcattcatccgttcattcccttaaattcattctcttaaataattctttcaacaaattgttcctaagcaatatcacgtgccaggtgaaagagacaagagcctggtcttcatggggcctgtattatactatgtggagaagaatgttgagcaggaacactgcagaggaaggatgcagacatatggaaatgcacatgcagacgactctagggcagcagttgtttgaggtttgaaaaactgaaagaccattgtgactagacagccccgagcaaggagagacgaagtctgcacttgtccttctgtttttcccttaagttgaaggggaggtgcccatgattttattaaactcatattgaccatgaggtcatgagagggcatccatctggacatgtccagccggctcaggaaggacagatgtggcagcagtgtgggatttgccattaggtagctgtgtggccttgggagaagttgcttaacctctctgagcctcagtttatagaaaggagaggctaatagcatctgtctcactggattattgtgaagaatgaatgaggctgtggcatactggcatgtgctcagtaaagcattactgtgaatgtcacagtggccaagagagtgatttgcaaagttgatagctgaagttgagggtggctggtttacatatgagagaatgtagagagaatagagggttaaagatggaatcttgagaaatgttagggaatgacaggaggaagaaatcttagagacggagaagatgatgtcagtaacatagaccctggattgcaagtctccaggcaagtggagagtttgagtggcaagaggggggtgtcctctgcaccggtggtcatccaaaagcatggtcccttccaggatgatcccaatagagtaatgcagaaaacatgccaaagacaccttcatctctgtgtttgcttctaggatttgtcttaggaggtgcatttggggtgtttaccgctggcatcgataccaacgtgggctttgaccctaaggatccttaccgtacaccgactgcaaaagaagtgctgaaagacatggggcagagaggaatgtcctatgccaaaaatttcgccattgtgggagccatgttttcttgtactgagtgtttgatagaatctgtaagtgtctctgccttctaagaaatccttgctggggccaccatttcattacttttaaagagaaattgctctttaaaagtcatttgaaagttgttactagaaagcaaatcagaagcatcagatacattctaggttgaacttccataaaatagtccctgtggcagactttgtgtgtgtttacagtatgggcttgcattattttttactttttgtaggctagaagttagctaatgattttaaacgagacttattggagagccccttgaagaaattttgattacattccaaatgctgggcttggtttcagcactctggtgccacctgcaggaagcatctatgaacgcatactatatatatatatatatatatatatatatatatatacacgctgtatacttaggaactatattttcaagaaagattaggtttcctttgggtagggactgaatgagctaacgagcaaccctgtgtattcctccttaatggtctgccttggcttgtttctttggctctaacgtgtacttccctgcccacagtaccggggaacatcagactggaagaacagtgtcatcagtggctgcatcacgggaggagctattggtttcagaggttagtaaacggctctcgaatgctttttctttgtggccttggacaacgtgctgaggttgtcatttccaaacacacgagtgttccagggacacttgatcttcttccctctgacaaataaatcatgtttgtttctgtggtaactcggttttggaaacttgtaggatctagatgagggtttcccatcgttggcactactgacatttcgaccagacgaatctttgtcgggattgggtctgttttgtgcattctaagacgttgagcagtatccctggcctctacccacgagatgcaagtagcacccccgtccgttgtaacaacttttttttttttaaagagaccgaatctcactctgtcgcccaggctggagtgcagtggcacgatgtcagctcactgcaacctccacctcctgggttcaagcgattcccctgcctcagcttcccaggtagctgggattacaggcacccgccaccatgctcagctaatttttatttttttagtagagatcaatttcacctggtctcgaactcctgacctcgtgatctgcctgcctcagcctcccaaagtgctgggattacaggcatgagccaccacgtgtggccaacatttttctcagtaattctagacaattgtcttttaattttagatataaattataatggtaatatctttctgcccttggggattctgatttctacccattgaatgctaagtacagatattctagaaatattagattatcagctgcaaaaaaaaaaaaaaaaagaaaaccaatttgctgcctcttctccccgttggcatgtccattcagagcgtggtggagggccttggtgacttgactttcctagaagcagcagtgttttatcactgggccactttccatctgtcatgccctaacttacccagagcaaaaagccagttttctcatcttctgagagacaggatgatttgctgtcatgaaacctggttttgctcctcaagcaccatttatgatgacggactgacttctccgccggtcgtcccattgttcagcttcaccagggcctctttgagaagctctgctgtctccagtactgctttgatcaccttcccaggaatgtattccataaacaaatcagggtcaaggccatatgctttcatttgattccgagggctgcttctctcaaccagtttcctgcctgcgaggggctatttccctaagactagaaataccctttgaaggagaaaagctaaacaaatgtagttagataaagcgcactggattagatcatatacactgcttcattgatgtcttccagagctatgatcgtttgaatgacttacagtgcttaagctcatttcatgacactgagggtgtgccaactttccgtgagtgcctcgtgacccagcagctgtcaccacaggtcatgttctttctgtttgtttgacagctggcttaaaggctggggccattggttgtggaggttttgctgctttctctgctgcgattgattattacctccggtgagagtaattgcctgcagggaaggatgatgccagccccggatccgggctgctctctggaggacagtttctgtaccacaccagggccttgcttcagggcctgaagacattcattttccctcatgtcgttggtattctgagggagctgcctggcttctctgcctccagcctttggggtagccacactttgctgctcctggactccagccagccttcacagaggacgtcccgtgccagattctctcacagcagatcgggagacaggatgttgacatataggaattcagctccacaaagcttcaggcctgaccacagctggccctctaggttgtttggtgttgtgggcacagaggtgacagtgtctctgcaggcactcaggaagctgttctaccttggaactccatgcaactatccgtctcgaataccagggcagggcaaggcggactgatgccgtccaaccaattatctcacttgttttgtgttctgtcatccttgttttttttttaaaaatacactcccctcccccaccgccacacaccttacagttcaaaaggttggtttatttgtattttattttcaaattccctattccaaaaatagtgccgggtggcccaaagataacatctgaagggaaagaatgagaaagctcccagggaagcgggggatggggcgctgaggcagggttgttagaggactgtgtcatcctcaccaagctcattacatctgccagggcctgcctcaagaagcccagcccagccttttcctgggatgcagtgaaatcccatccatgaactcgatgggcccctcctgtgccggccgagaggcacacactgccttcacgacgtgactgctggacctggccgagcttgaggccacatgtgaagggtcctgctgtggtcatcttggtgactcggtcacagcagctactggccaagatcagacgtcgctgaggggctgttcaccaccatcctcgttctccagggtcaaggaagtgttttaacatgtcgtgttttcgacttgaccttgtggtatttttcttggcctagttgtgtgccatggatatt

SEQ ID NO: 38508 - DNA, 167503 bp, Homo sapiens
gagagacactcccgagcgccgtaaatagagtccaagtgggcggagagccgtcccgcgccgcccgctcatgtctctacagagccgactgtccggccgcctggcacagctgcgcgcggcggggcagctgctcgtccccccgcgcccccggcccggacacttggcgggtgccacgaggacccgcagcagcacgtgcggtcccccggcgttcctgggcgtgttcggccgccgtgcgcggacctcggcgggagttggggcgtggggggcggcggcggtggggcggacagccggggtgcgcacttgggcccccctggccatggcggcgaaggtggacctgagcacctccaccgactggaaggaggcgaaatgtaagtgtaagcacgagggggcgcgagggagagggcggcctcacgtggagcttcccggctgggcggcccccaacgagcgagcagccccttccacccgagagacctggggaagttgaggccccatctgccctggaacggacccctcctccccattgacagccccccccgcccccgcgcgtgttcccagccccacagaacaattcactccagaccaggtccaagtgtccacgcagggggcagcgtgaggaaggcggccttccttaccccattggaatgggtcacagggcaccccagagattgtgcaggacctaccaacttccttccctgtgcaggagggaaactgaggccgagtgccacagctggcttccccaaggtcactcggagctggtggcaaagtggaggttatgatcccggactctccaaactttgcacagtgtggttcttaagtgttcgggaatggggctgagggaacagctccggggctggcgtcccacctggtggggcacgtaacctcacagagtgaccttcctgggctggcctgtcctgcctccaccccaccccaagcccgcactctgatgccttcctgggcacgtggtctggcgcccttttccccttctcgctggcctctggccacttgtgagcagtttgctcatgccaggaacagaggttagaggagcagggcagaggtggggtcttgtccctgtgacaactgatgacacccttcaagaatcacaccacttcctcttgctcctggagggggcatgagtctggggcctggggagagagagaacccaagctgccgctactgagccccaaatagccctgccgggcacccagctgcccctgcctttcagggcctgcctcctgggatcctgtgactcttcccggctggatcccctttcaaaagtgcagggaagtggctaattggctgggcctccgtggtggagtaggtgtggcctctgggctgggcaggcaggatgggggggtcctgcggtgttaggggtgaagagaagatggctttctcgggaccagaggtggaaatcaaaatgatttactcctgacatgaattgtgtggcctgcgccaggatctaaaagtgacggcagaaagcaccgactttagcccgtgagcagatggagaacttgtcaggcacttggcccttgccccagaacagcaggaggagtttggggctggcagagacccctggagggggagccactgtccccacagagacccctgctcccctgagcactctctcagaggacaacaacccaggagggtgggaaagagctacggagacaaggtgcccaggcacctgctcgagggctgccgctgtttttaggatccagcccccacagccccactccttggtgccaggaaagcaaccggaccttgtgatggggctggggttcctgggctgctgtgttgtcactggggtctcccttttgcttcgaggtgggatttccaatcatgcagcaaacttttattgaacgccccctaggtggtcaggctggggactcagacatgtgtcagataggcaagggccctgccctcatggagcttgtaatctggtgtgaggattacaaagcatctattgtaaagaatgtgttctagcagctgagacaaggcccggtaacctcagtgctgtgaagacaccatagcagatggggccacctgagctggggagatcagaggaggcgtctcaggggtggtggcctgagaagaggcatccagctgggtaatgatattccagacccgttattgagtgacagtgggccaggcccaaggagtggggctggtctggggctctgcctgctactgaagccacagttagagggacgctttcgggggtgagatgtggagatcccccaatagttatctatttctgtgtaacaaaacaccccgaaccttagtggcgtaaaacagcaaacctgcattctctccatctcttgagggtcaggaaactgagagaagcttagctgggtggttctagctcagggtctccctccctctgaggccgggtgggacttggttagggctggaggatgggcttcctaaacagctccctcccataaaatggcatttggtgagaggcctcggttggtcactttggggcctctccatggggctgcttgagtgcctcacatgggatagatgtcctaagcttttcccccagagcatatgctccacgagagggatcgtgaggagaccccgatggagctgcagtgccttctttgtgacctcgtcttcgaagtctctcctgctttattctaggggtcagaatcgagtcagggagtctggccatactccaggagagggaaattaggctctacctcttgaaagaaagaatctcaaagaatttgaaggtgtgtttttattttcttaaaaaaatttttttttgagacagtttcactctttttgtccaggctggagtgcagtggtgtgatgtcactgcaacctctgcttcccgggttcaagtgattctcctgcctcagcctcctgagtagctgggattacaggcacccaccactatacccggctaatttttgtttgtttgtttgtttgtttgtttgttttttagatgaagacttattctgttgcccaggctggagtgcagtggtgtgatctcagctcactgcaacctccgcctccggggttcaagtgattttcctgcctcagcctccccagtagctgggattacagacgcgtgccatcacgcccggctaatttttttgtgtttttggtggagataggatttcatcgtgttagtcaggatggtcttgatctccggacctcgtgatctgcccgtctcggcctcccggagtgctggggttacaggcgtgagtcactgggcctggccaattttcttaaattttttttttttgagatggagtcttgctctgtcacccaggctggagtgcagtggcgcgaccttggttcattgcaagctcctcctcctgggttcatgccattctcctgcctcagcctcccgaatagctgggattacaggtgcccgtcaccatgcccagataattttttgtattctttagtagagacagggtttcactgtgttagccaggatggtctcaatctcctgacctcgtgatctgcccgcctcagcctcccaaagtgctgggattacagtcgtgagccactgtggccggccaaaatttttaaaattaatttaaatttttttcgagacagggtctcgctcagttgctcaggctgaagtgcagtggtgtaatcatagctagctgcacccttaaactgctgggctcagcgatcctcctgcctcagccacctgagtagttggaagtacaggcgcgcatcaccatgtgcaactaatttttttttttcttttgagacaaggtctgttgcccacgctggagtgcagttgtgagatctcagctcactgcttcctcaacctcctgggctcaagcgatcctcccacctcagtctcccaagtagctggaactacaggcatacgccaccacgcctagctaattttttgtatttttttgtagagacagaattttgacatgttgcccaggctgttctcaaactcctaagctcaagcgatctacccacctcggcctcccaaagtgctgaggttacaggtgtgagccatgggctgctaatgttttaaaacctttattgtagagactgggtttcaccatgttgcccaggctggtctcaaactcctaagctcaagcgatctacccacctcggcctcccaaagtgctgaggttacaggtgtgagccatgggctgctaatgttttaaaacctttattgtagagactgggtttcaccatgttgcccaggctggtctcaaactcctaagctcaagcgatctacccacctcggcctcccaaagtgctgaggttacaggtgtgagccatgggctgctaatgttttaaaacctttattgtagagactgggtttcaccatgttacccaggctggtctcaaactcctggcctcaagcaatccgcccaccgcagcctcccaaaatgctggcatgacaggtgtgagccactgtgcctggccaagtgtattttttaagccatcacattatgggagatctggggggctgccccagctggactctgcctttgattagggtctgagccgtggcccttgaagactgctacacttttcatcgttacattcaaatcacactttcagccaagttacatttgacagtcaagtgctgcaagtgtagagatcttcagtgcacagtgtatgcaactgtgcagtcactacttgggtcaaaaggtagagcattgccatcacgccagaagtcgcctcttttcacttggtactgtctggagctaatcactcttgtgatatctgttcattttgtctcttcttgaagtctggccccttttactcaatatccggccagttcgtccttgttattggatgtggcaatggttccctctttttcattgctgtatagtgttccagcatatgaacgtaccacagcttgtttcccactcttttgttgttttgtttggttttgttttttgagatggagtcttgctctgtcgcccaggctggagtgtagtggcacgatcctggctaactgcaacctccgtttcttgggttcaagcgattctcctgcctcagcctccagagttgctgggattacaggcacccgccaccacgcctggctaatttttgtattttagtagagacggagtttcaccatgttggccaggctggtctcaaaatactgacctcaggtggtctacctgtctcggcctcccaaagtgctgggattacaagtgtgagccaccatcccggcccccactcttttgttgataggcatttgggtttcttgtgaataaaactgtgctgaacattttttttttttttttttttagatatggtctcattctgttgcccaggctggagtgcagtggtgcaatcacagctcactgcagcctccaacttctgggctcaaaccatcctcccacctcagcctcctgagtagctgggactataggcatgtgccaccatgcctggctaatgtttttaaaaatgtcttgcagagacagggtctcattatgttgccccaggctggtctcgaactcctgggctcaagtgatcctcccacctccgcctgcaaaagtgctagcgctgagattacagatgtgtgccactgtgcctggcttcctgaacattctctccatgtctctgatggacatgtgctctcatttcagggctgtacctagataggcctccaaatacttgtctgcctgagaggatcctctctcaaagcctggcacacagtaaccaaactcacaagagactgacgtataggtcagaaggcatatgtgcagtttgtggtggggaaatataatggcagtgggtctgaaaactcaggtgtgcctgagcagagcctcctctccctatgggaaagcctcatggaagccaaattgtaatcttaggattgctcagagcatgcgatcttatccagggctggttgagtgattttggaagccttgccctgggcaaggcaggtaagcttccctgtttgagaagggtcagcccacccacaaggatccccttccccgggcgtttgctcggtatttccatctatatgcagtgctgagtgcctgctctggacccatggaaggatgcccagcccatggcccagcttgtcctccaagctgacggccaaattcagcttccccctggacactccttttctttacctccaggctgacgctcatttccatgggcccattctccctctaggtatgtacataccttcaggctggatcttcctggctgggagactttcagtcttttggggacacttcagcagtgtctgattttactagccaggggttactttctctaatttatttttatttatttgtttttttaattttttttgagaccgagtttcgctcttgttgcccaggctggagtgcagtggcgcaatctcggctcaccacaacctctgcctcctgggttcaggcaattatcctgcctcagcctcccgcgtagctgggattacaggcatgcgcccccatgcccggctaattttgtatttttagtagagacggggtttctccatgttggtcaggctggtctcaaactcctgacctcaggtgatccgcccgccttggcctcctgaagtgctgggattacaggagtgagccaccgtgcctggcctgtttgtttatttatttgagacagggtctcactttgttgcccaggctggagtgcagtggtggtatcttggctcactgcagcctccgccacccagactccagcaatcctcccacctcagcctcttgagtagctgggattacaggtgtgtgccactacaccggctaatttttgtatttttttttttttttttttctgagacggagactcgctctgtcacccaggctggagtgcactggtgcaatctcggctcgctgcaacctccgccttctgggttcaagcgattctcttgcctcagcctcctgagtagctgggattacaggcctgtgccaccacaccggctaatttttgtatttttagtagagacagggtttcaccatgttgttcaggctggtctcgaactcctgacctcgtgatccacctgcctcagcctcccaaagtgctggaattacaggtgtgagcccctgcacccggcctcatttttctattttttgcagagacggggttttgcaatgttggccaggctggtcttgaactcatgagctcaagcaatccacccacctcagcctcccaaagtgctgggattacaggcgtgagtcactgtgcccgtcctactttctctaattgaataccctcagttttgaggcacttctttatccccccgggagtgccttttcatcagaagatcatggaaacaccctcactgtaaaggcagttgggcatgagggacttaggttgggcccttgtcggtatctggcgctgtatcatcacaggaggggcctggctttgggtccttgttccaacagcccctggcaggcagagctgtgagccacaaagagcagggacattgttgtcagatgtggagacgtgctgctgcttcctcgctctccaagcctcagtttcctcatccataaaatgggaccaatggcacctgcttggaggttgtgctgggatcacattagaaaccactttgggccaggcgtggtggctcacgcctgtaatcccagcactttaggggccaaggtgggaggattgctagagcccaggagttcgagaccagcctgggcaatatatccagaccttgtctctcctaaaaataaaattaaaaaaagaaaagaaaagaaatgattttatatatcatggcccagaatgggtcccagcagcctccccttccttgtcacccctcaggccctcaggcctgtctcctctctctgctctgtgctggccgtggtgacactgggctcttgtaggcttgtctcacgtgctggggccctgagcatgcacagcctaagccatcctctccttggtgactcaaggtggggctgctacgctccagcctcacaccacactgtgcagaagccagggctaatttcagcccccgtgggatttcatccagagtggatggcttatctgatttgactgcagcactggcaaattttccaggtacccctgggagtcggggggcttctcccacctgtcttttggggacgcagccttgccaatgccctggtgtgggcagagacaagggggcagggtagaggagaggggctccaaggtgctgcgtgctccgtctcccttttgctcgagctgtgggctttgacaagaccctgttcttgcgggccggtgagcgcaggtgattaatgcccctgccaccgagtctaaatgccgctgcattctgggagcccagcctttatcagccctgcccacctggcattctctctgagaggagccctgccttggtgccccagcctgccctcacctctctgaacaccatcttgcaaagtgccataaagacacttcttaaaacacagcattgaattcccattcgcccgctgcactttatggttctggtggagcctgcttcctcctgcttggctttcgtgcctgggagccgctggaagcttcgtctggggtcaggcctctccatcaaaatttactgcggacatctttttacaacacctatctcactgaactgtgaaatactcttgcctcttcaaaaatgaaagaaaatgaaaatgcatgttttacatcttttataacaaataaaactcacttgtgctttaagtctgcatttgtccttcttacaggaggaggtgggaaatgttagaaattcatggggcaaggccgggcgcggtggctcacgcctgtaatcccagcactttcggaggctgaggcaggtggatcatctgaggtcaggagttcacgaccagcttgggcaacatcgtgaaaccccgtctctattaaaaatacaaaaaattagctgggtgtggtggtgcatgcctgtaatcccagctactcaggaggctgaggcatgagaattgcttgaacccaggaggcagaggttgcagtgagccgagatcgtgccactgcactccagcctgggtgacagagtgagactctgtctcaaaaaaataaaaaaaaaacacagaaatgcgtggggcatgttcctggcttaaggcccctgtttctcctccagggggaacaaagaggggcctggcgggcgaggattgccgataagaggacatggaggtgagatgctgaatgggcgcagttggccttttctttccccataaatcagaaaccagtgcagtgtgtagctctttggggatcagccaggccacagccttgttctggtggtgaggacagacatgctgtctggcctgctggccttctgaggcatgcacttgggtccatagactagaagggacgggctgacagatgtcctcaaggtcggcgcccagccagctggtggcagagccagcatgctgtctctgggaagtggagcaatcctgtgggctttgctggagagaaggggctttgtgggctgtggatcactcagaccaggctaccatgcttagggagggcagtgtgggagcaagttcaggttcctctcgcttatgtgtgactgggggcaggtcactctgcctcctctctagaacaaggtggtggcatctgccagatgatatctgctagggcacctgaggtgtctctggtcacgctggtctagttccatgggattcccagggcctgcccagccagagacacttcagcaaggcctctggggtccgtccgggtcccagcccaccagtcccgccagcatcacggtgggtacctgactttctggccacaggtccagccgtctgggagtgcccacacagtggcatgccaaggcctcgcagtggggaggtcacagttgtgcaaggtgacaaatatggggattcaaattatttatttagagacaaggtctcgctctgttgggcagtctggagtgcagtggcacaatcacagctcactgaagccttgacctcccaggctgaagcgatcctcctgcctcagcctcacaggcagttgggactacaggcacatgtccaccacgctcagctgattttttttttttttttttttttgagatggagttttgctcttgttgcccaggctggagtgcaatggtgtgatctcagctcaccgcaacctccgcctcccaggttcaagcgattctcctgcctcagcctcccgagtagctgggattacaggcatgtaccaccacacccggctaattttgtatttttagtagagatggggtttcaccatgttggccaggctgatctcaaactcctgatgtcaggtgatccacctgtctcggcctcccaaaatgctgggattacaggtgtgagccaccatgcccggccgctcagctgattttttgtattttttggtagagatggggttgctccatattgtccaggctggtctcgaactcctgggctcaggtgattggcttgccttggtctccccaagtgctggggacccaaataattagaaaagttcctccggctgctgtgtccccaagttggaaaaaaaagttctccacaattttgtcctgtttgctttgttctctttgggcattatttagccgccaggaaggagtgagtgtgtctggcgtgtagaccgcactttgcagcacacagccaccttctcctttgaccctcccagcaagcctgggtgttagcaagggaaggcctgccttgtccctattccagagatgggaaaacccaaggcttcaaactgagcatggtgttgggaggtcacgaacccaaacctggcgggacctataacagaagaaaaggcgcagcctgggtctaggccggctgccaccagcatctgtccgtcctcagacagggaggcagacctggagagaccgactggcctcactttctccacccaaatgctctctctcttttttttcttttttaattaggggatcatctctggctccctcttacctctgggcttttgcacatactgttccctctgcctagaagactctgtacttagcaaactcgccctcaacctttggtcttggctcatttattcctcagcgtgcccctcaggcaccctcaggtgcccacacaccgtgccaggtggtgggaatctgatggcaaacacagcagatcccctatggaacctacaggtcaagatggccaagatcaagaaagggggccggcgccgtggctcacgcctgtaattccagcacttcgggaggctgacatgggtggattgcttgaggtcaggagttcaagtccagcctggccaacatggtgaaaccccatctctattaaaatacaaaaattagttgggtgtgctggcacacgcgtgtaatcccagctactagggaggctgaggcaggagaattgcttgaatccaggagtgcaggttgcagtgagccaagatcgtgccactgcactccagcctgggcgacagagtgagactccgtctcaaaaaaaaataaaagaataagtgtaaacaaaagcaaactatcccatatcctgcagagcacagcaggtacaaagggcctggggcaggaagcagcctggctgtttggggaactggtgtagtgggggaggcagcattgggagtgaggtgggagagaggccagaggaccggcgtttgaatgcagttttgaacagaggagggatggcacctgatttatgttcccaggatccatggctgccggtcaaggaacagatggggatgagatgcacacggagatcagctgggagttgggagcgtctgtgggatctagggagccatgaggaaggctcagtcctggagggtgagaggaaggcttggtttctagggtgtcacggggatcaatccaaaagaggatggaaagggagggacccctggtgcagggtctcgagtaaaaaagagggaagaatggagcaacaaaaaaatgacgttttgggggaaagagtcaaacgttctgttttgcatgcctgggctttggggaatgagagcaggcaggcactgtgggggtcagaggctcagaagagagtggagggacagccccggaggttgcttgcttaaagagcgttttgaatctgtgcaactgattagaagacctagggaggaaagcagcaaggacacttcctgtccacagggaaggcaggaggggccgctgcatggggtgtggtgaccttgaccttgttggaaggagggaccagactgggtggactgaagggagcatgggagggaagaagtggagacagcagaggagggggcagctgcaggggcgtggaatgcgggcgttgagggaggggacgggattatttgagggcaggcaggacagcctggtggagggggacctgcagcagtgagtcctctgggaggtgggcttggcaggtggcagcgctggtactgaatgcaggacctactcgtgcccaaacatgtttatggaagagggggcagaagtggctgccaggaaaggtggctctggcttgagcagcagtgggggctgaccaggggtgggcctagccttttgtgatgaccccacctttgcatccagcagggactctggactgggccccttgcatgagttctgtcatctaatgctctcagcatccttgggttgttatcacccctgccagcagtggttagatgaggagatggaggcctggatgatgaagtgactctggccgggaaaacaccctgctgtgtgagggtggcctcccaacctccctgaacatttgtggagggacctacctgtccccctcactgccatgtgcatagaagcttccaggctgcagtccttcctttctcaccacctcctctaattgctctcccgcctctacatattttttgatgctttttgagtttctcaattgtagcctttgctgtttgccgtgggggctgccccatcccgggagcctgtggtccagggtgccaggctgggctgagcgcctgggtgtgcaggcggcctcgggccagcagggggagcccgtgagctgctagcctggcctggcgcggtcggggcgggcccttctgagacgggttccaggtttctgtgcctggtgccacccccaagggaaggcggagcccatgggacagtgctcaggcaaggggagccggccagggtggaccccgagtctgtgagcgggtggggggtgcctggctcctcactcaagtccctgctgtgtgagggtggcctcccaacctccctgagccccggtttcctcatctgtaaaacgagaacgattccaaccccattggtcatgctgggagccctcagccgctgccgggggggatgttggggacaggtgccaggtccacttggtcctgcagctcctggaggaggacagctgtcccgctgcctgcatgcagtgacagtgagggcagaactgactggcggtgggactgatggataatgtcgctggctgagtgctgccaaccggcttggccttagtgtgtgggaggaagctcggagctgttctgcaggggacgtcttcacccccgttctaatcagggagaaacgggggacccagagagatgtggacgctgctggaaagtggcagagctgaattcatcacaacccaggtctgcgatgcctgagccagtccctcagcctccccagacctcagtttccctccctgaacaaagagagcaggacaagatattctaggggcctctgaggtttccccagcatgcctgccctgtgtgcccagagaaggagggacaggaagagctggtttgcattcttggatgaggcaagaaaggagatgtgggggtgcaagccccaggcccgttcctctgcccccaccctgatcctccttcctgcctctgcagcctttctgaagggcctgagtgacaagcagcgggaggaacattacttctgcaaggactttgtcaggctgaagaagatcccgacatggaaggagatggcgaaaggtaggccctgctcgggggaggccctggtgggcaggctccagacccgtggcttgggagaattgtgcagacaagaagagctagtccagtggcatgtatcgagtgcttgctgcaggcaggtgctccgcgtgtatcacctcattcaattattttattttattttttgagatggaatttcactctttttgcgcaggctggagtgcaatggctcgatcttggctcactgcaacctccacctcccgggttcaagcgattctcctgcctcagcctcctgagtagctgggattacagacatgcaccaccatgcctggataatttttgtatttttagtagagatggggtttcaccatattggccaggctggtctcgaactactgacctcaagtgatctgcccgccacggcctcccaaagtgctgggattacaggcgtcagcaactgcgcctggccatctcattcaattattaacacaacaagtgcaatttttatccccattgtatggttggaaacagagccctaggttaggtgagccacctgcccgagattacttgcttgtggggagctggggtttgaagctgcgatttggttgcttacagtggggtgtgttggtgagacagcaggcctggtgacccataaccctaggcaagtctctgacccacctaatcctcagtttctacctctgtgaaatgggatagatgatattggcactgtacctgctggtggccttgctgtgaagatgcaaggagtccccgcgtgattttagcacgcagtaggtgctcctcagtgtgggttcctggtactgggtcagcagtcatcgtgctgcaggctgcccctggaggtggagggaggtcgatagggaaggccctggcccctgggccctggctgggtccctctgcagtgggcagcctcgctgtgacctccccggcccctacttgttccaggggtggctgtgaaggtggaggagcccaggtataaaaaggacaagcagctcaatgagaaaatctccctgctccgcagcgacatcaccaagctggaggtggacgccatcgtcaacgccggtgagtggctggcctgaaccagagacctggtggccgccctgttgcctttgctctgctctgctgtgccaggcctgggtggacgccacctggctccagtgaggctcgggttgctggcaaggacagcctgctggcgccatggcagcccaacgtgtcggccactcgggctcctcttcccttgaaaccctgacctgctgtgtcgggggcgccttgctccactgagacccattagtggccggggaagggggagagctgggctgaaactgggctgccctgccaggaaggcagaggccacagcggggaggtctgaccttggggggccacagaagccccaaccagcacctgccttcctctgcctttggcctggcctgcccccgcttcagacctgggcgggtgagggagcttgtcgagggatagtgggggcagagaggtcccctgccatgccctggcagctttccagagcctagaaacaggagctgctcagcttcctgcgctcgcctcttgctggcttggcagtttattgtgatgagtatgggagccggctgcctctttgtgggagggaggaagggggctgctactccacacagctagtggttgtctggcaaggtcaaaggcgccaggaaaggactttggcatggggtgccaagggctggttaagtcgagcaggtggcttgtggaacaggttgagtggcggctgaaccccggccctcgcccgcctgctcgcttgctcctttgcttacctggcatctgcaccaagcattggaggaaggggggcctctttctcagaccctgaatatggggggcaggtcctctcgtcttgggctccagctcacagggaaaaccctgctgtgccagcccctccctaacctgtgcaggcccagggcacccccaggagcttctcgagtctccttcgtccccactttgcgcttgtagcggtcgtgcctggccccagcgctgtcccccagtgactctggggcatggtggtgctgatgctgtgagcatttccgttaatctctgtgagtgacaggctctaggatccggagaggggagttcactcggccgccccgggcctggtccgtggggtctgagttgtgtttcctgaagcaaccttgctctatgcgtcttcccactgttgactgcaaagctggatagtcatatgggggtgccttgcccgcacattccctgtctaggcacacaggtgacaggttacacgtaggcaggagtttctgctcagtgtggctggctgagggcagcagggagagctagggtcaccttgggcttctgcaggtggttctggtgtgtttctctagggccactaggatgagaactgctagtccatctgaggacacacagctaagacaaagccacatctgggttggcagacattacagcggcctaggggagaagggcgttcttgctgcctgtgcccaggaggggctggcctggagcagaagggcagagccttggggctgtggctgagggggcagtcaggcaggccagtgggtactccagccctgccagtcactggcaagcgtgtgagaggtactgcagcggtaccttcttgctgagctgcaaagtggccggagggaaaatgaggcatcttgtgagctctgtcccccttgggttggtggttcgctgcaacatgggccaggagaaagggtgcagggaccaaggtggggtgttgatgggttcagatggaatgggggcgctccggaggctgcacccgggctgtgggcgtgattaacactgcttcctaagtgcccttgggagtcgccaggttttggatgcagcagctccatcagaagcggtttagtgccagctccatttgcaccagggccagggctggggcagtgctggctgagtttctctgtggactccccttctctgtgtccttgcctaggcctctgtttcctcctctgcaaaatgagggtggtgaagaaaccacccgtcaggttactgggggcactcggagctgatgcacgtgacgtgcaaatgacggtcactcagcacctggcgggaatcggggctcagcacctcgcactggtgctgaaactggtgtcatcagcgccgttctgggcatcacccctgtcccagcggtgccgagggacatggtacctcctgcaaatgatcagctttcacctccccctgcttgcctcagtttacccatacacctcttggtgtgttctcctgggatctttttgttctagactctcacagccaggaggacccggtacccgcctggaatcccagggaatgacggaggcagggtctgaacacgggcttcccacacagagcccgagtctcctttcagccgtccagggctttgtggaaccccagcgttcaaagtggctttggcactggtcaggcctccagggtcctgggtggccttggctcccaccccagcccctgtgcccaccagggggcagcagagattgcagttcccaggagcccatatatcagcctgtttattagtggaataaaagtcgttggcaacggcagggcttttcggggctgcataaatctgcgtctgtgcctcgtgaaacccatatgtgcttaattcatatgtaaagtttcaagcaggaagagaatacgtgtccattaaattctatttgacttgattataatcattagccgtgaataattgcttctcagtgcctaccacggagccaccacaataagccagaggagagagcaattatcttggggtggggatttttaaatttatatttttgaagccaggagcagtgctggccccgcgggcgtcagtggcccatggagaacgccgtgggtcacactgggctgggagcttgagatctggccgcccgccggagcttctggattttgttgtggggaacagttctctttgttcctgctgccatatgggaggggctgtcgctgcctgggcttgggtccagctgcagggatgtggaggggaagggtgcagtgggagctaggagagggctgtgagggaaagggggcggggagagctcccaaccccccaccctcctccatcctgaaaagctgtggggttgaaggggtctccagccaggctgtgggcatctctcttgccactcagcagggccctggggatccttggagagggcagttgccaggtgtccccctgcccgcccccctcactctttcccctccctgaagaggcatctgcctgtgacctccgtcaggccattgagaatcggaccctgggcgggacgtagtagctcactcctgtaatcccagcaccgtgggaggccgagacgagaggatcacttgagctcgggagtttgagaccagcctggccaacatagtgagactctatctctacaaaaaaaaaaataatacggcatggtggtgtgtgcctataatcccagctactcaggaggctgaggcaggaggattgcttgaacctgggaggttgaggctgcagtgagccatggttgtgccactgcactccagcctgggtgacagagtgagaccctatctaaaatatatatatatatataatagaacatcagattctgggccaggtacgatggctcacacctgtaatcccagaactttgggaggctgagacaggcggatcacttgaggtcaggagtttcgagactagcctggccaacatggcgaaatcccatctctactaaaaatacaaaaattagccaggcgtgatggcatgcacctgtaatcccagctacttgggaggctgaggtaggagaatcacttgaacccaggaggctgaggcaggaggattgcttgaacctgggaggtcaaggctgcagtgagccatgattgtgttactgccttccagcctgggcaacagagtgagactccatctcaaaaaaaaaaaaagaaagaaagaaaatcagactctgaggctgcaggcggtggctcactcttgtaatcccagcactttgagaggctgaggcaggaagattgcttgagcccaggagtttgagaccaacttgagcaacacagtggcaccctatctctaccaaaaaaaaaattaaaaaagattagtagggtgtggtggtgcatgcctgtagtccagctacttgggaggctgaagtgggaggactgcttgagcctgggaggtcgaggctgcagtgagctgtgactgtgccattgcactgcagcctgggcaacagagtgagatgctgtctcaaaaaacaaataaaaataagaaaatcagattctgtttccctactgatctcctggcatttgaaattcaggactggtttccactcttacattattgggctatgagatgtgattgggatgtgtgtgatggtgtgtgtgtgaggtcaggagtttggcctgtgtgtgtgatgtgtgcggtgcgtgtgtttgtgatgtagcatgtttgtgtctgtgcttgtgtgatgcgtggggtgtgtgtgatagagtgtgtgtgtgaggtcaggagtttggcctatgtgtgtggggtgtgcgtatgcatttgtatgatgtgtgtgatgcgtgtgtgtgcgtgatgtgtgtgtgtctgtgcttgtgtgatgcatggggtgtgggtgatggagggtgtgtgtggtgtgatgtgtgtttgtatgggatgtggtgggagtgaggtgggaggttgggcagaagcatagaagtggggatgcctggctggcgggtggcagggcttgaagttgcagggacggaacaaacccccacaccctcaggcacagtgcaggcctccctgggccctgtccccgtgggctgccagctgaggccacttgcttgggtagcacccgggagagtctcaggttcctgccatctgtgtcggccacggctcctgcccacaggagcatggcgcatccgtcttaatgaaattgggctgccatgtgcaggagataagccagggagcccccgcaggccccctcttctggaggaggaggttctcagagccggtgcctgcctctccagccttgcctatgacctcagtcctgtgtctggggagagcgccggtctcagggtatccactagggggtgctgtggctgccagggtgtttatgtctcctttttaccacgggggtgcagtgaccttgactaggccacctccctgcccttgagtttcctggtgcaccagacctgtgtgtgtggacttcttgttcctgacagatagcagagtcctgggcaggacatgtccgggcacaaagaaagatccccattcttggccaggcacggtggctcacgcctgttatcctagcactttgggaggccgaggcgggcggatcgcttgaggtcaggagtttgagagcagcctggccaacatggtgaaacctggtctctactaaaaatacaaaaattagccggacacagtggcatgcgcctgtagtcccagctagtcaggaggctgcggcagaagaattgcttgaacctgggaggtggaggttgcggtgagccgagattgtgccactgcactccatcctggttgctgggtgacagagcaagattccatctcaaaaaaaaagaaaaatccccattcttggccaacccaggggtccagctgcctggctttggccttcatgtcataagaggacagggcagagatggatgaaaggctttgtgcaaagatggaagggatcttttgtttcaatgccagcccagagcagtgagcatgggctgtgcgcaccgtggccaggagcaggtcagggtcccagcacccctgctggccactccgtggcctctacttcctcatctgagaaatggcatcagcatcagttccaccgaagggcaggggtgaggaggacaggagttcaggcctgtccagccctgggcccagggcctggcacacggagagtccccaggaaatgattactgggaagtcaggagcgagagctactaagcagagtataatgtgacaaagtgctaggagcaaggtctgaacaaagtgccacgcaacgccgcagggaccaattaattctgcaaggaggtggcgggaggcgaggcgggtcagctagcctttgaggggcccaggtgtgcggcggggacgggtgggaagccatgtttcacagcgacaagccgacctcgcagggagatttttaagccgcttatttatttaaaataagtcatgaagtggcgctctatctccttaagtcttggggctttgatttgtgagaatctgctggccgcttatcaccgccctcctcccaagcaccggcagcccctgcctcatcctctcctgccgcctggagggcccagcagagcctggcctggtgagaaggagcaggccagaacctgagtggccacctgagcggccacccgcccctgcgtccggctgtccctgggcactgcttggagtcagtgatttagagaccgccttgatggactaccaagcaggggccccgcagggatgcggactgccttgtgggaagtgatctgacgctgaactgtcgccgtaaatcgctttatctgtcacttcagattttaatgtgtttgctgaggcttgccggccaccacgacagcagaaacctctccgcagtgggcaggggagatggccgggccagcgacgagtccagggctggctgtacagcagactttgcagctggaacctgttagcaacatgggcctggccctgggctccctcctcctcggggaagccaagcgcaggtggggccgggctccctcctcctcggggaagccaagagcaggtggggccgggccactttccggtgccctggccactctggatgtgctcagtgctctcagaggcccgagaggcaggcaggattgttaccccattttcggggatcagataacaagccccacctcggcaggtgactgagccagaattcgaactcaggcactttcatccatgcaacatacatagatgatacggctgctgtgcaccacgccgtggggtgggcctgggctgcaaaggacacagtctctaattccggataaggggtaacacatgtgaatggaaaaggaaccatggtgcatgagaggcaggagtctggcctacaggggagggaagcagtggggaaggctgcctggaggagagggtgcttgggttggacggggtgctaagtcagaagtcggggcaagagcattctgtggggagagagcacagacagggaggggcgaggtggacgggacactgtgggaaggctctgaggggtctggagtgagccacggccggggcctgagttgggggggcttggtcagatcacttgggctgctaggtggaaaaatgggggcagggagcataagataataaggacagggagacccagagcttggggtgggaggtgtctccctctaggtctaggctgcattcataccgtgtgcagttaatctctcttgcactatatcagtctcattgtgctaatggtgaaatggaggctcagagatgtgaaacaacttgctaaaggtcacacagctaaatggtagtagagctgggatgggaggtttgccgagctccagagcccccaggaaattgtgtgtgtgtgtgtgtgtgtgtgtgtgtgtgtgtgtgtgtgtgtgtgtatgtgtgtgtcggggttgggggaagggaatacctcctctctgttctcttttttttggttgatgaatttgagttctgagagtgggtgtgtcctgtctgtcctcacggccaggaaactgagaggtggggcagaagtttgccacagcggggaggggtcgttgtaaaaaagatgggaccaacatctgaatctgggctcctgggtcccctgaggcctcctggtgggctccagctccctcagcctgcccggtatcctgtgtcccaagccccctcaagtccccggcatgccccatggagctccggctctggactgagggcagcctgtcacctgccgcttggtactgagtgttccttctgctcaacacgctgcacacgttgcctcgtgtctgagtcaggcactgacatttcccccattatacagatgaggacactgaggcacccacaggtcacggctctgggtaaaaggcagggctgggaatcaaaccctcatctttcagatttggggtttaagagagagaccatcaggtttttttctttctttttcctttctttcctttcttccttcctttctttccctttttcctttctttccttcctctcttcctttcctccctccctccctcccaccctcccttctttccttttttttgacagggtcacactgttccccaggctggagtacagtggtgcaatcatggctcactgcagcctccacctcctggggtcaagcgttcctcccatctcagcatcctgagtagcagggaccacaggcatgccacccctcccagctaatttttttattttttgtagagacgaggtctcgccatgttgcccaggctgattttgaactcccaggctcaagcaatctacctgcctcagcctcccaaagtgctgggactacagccgtgagccaccatgcccggcccagttttgctttttcaccagctccctctgggtcgtctggaagtgaggggcagagttgatcaggggggccagtcaggatgcctggggtccaagaggccccctccccacattagaaagcccggaacacccagacacagccaggagctaatttccgccagtgcaagaggagggcggctcatccccacaagatcgggcagtggttacataaattcataaatgatggatccctcctgaattattgagatgcccttgtgggctcgcagggtctggtccagtgagtggagcattggctggggggcggcactcagaaaggaccttccagggtccttccaccccaaggtcttccgccccgtcccctgcttcttacctgaagttcttctgtcatttccatggggaatgtgagagtagactgtggacccagtagctctctgtcctgggtttcagtagatttattttgtaaatttttttgtagaggtagggtttccctgtgttgcccaggctgatctcaaactcctgagctcaagtcatcctcttgccttggcttcccagcatggtcggattacaggtgtgagccaccatgtctgacctgatgtttgttgaatgaataagtgactccatgcccttgagagttggtcagatggtgggaggggctgcacgaatcagtgacaccctctaagtcccctcttcctgcctagcccagccccctaccccacccctctaggcctgaaggggctgatccattttacagattaggatggtggtgggcatttctaggtccttatgaggttcctggctccttttgaggtgctggaggtacaaggcccagtgtaacccagtgcctgccctcctggcatttggcgtcctgtagaggaggacaggggaggatctaaagcccagagggggacagtgacctgttcagggtcacacagcaggaaggtggcaaagcagaactacaaacccaagggccttttctccccctcgcggcagactcgtagttagaaaaccccagctaggagtctgctgcccccacatggggtggccaccctgcctcctaccctgtgcccagtgtcccgagcacatcctctgtggctccttcctgtccttgaggcctcagcgcctgcacctgtgcccctgcttgcgtccccggtgtgctgtccacccgagcactgagccgaggaggccggagcttgtgggaatgtgtgtgttttgaaattaatggggaccattaaattggccaagcatgaaaagggctggatctgcagcccttggctcgctctcctggaatgatccgccagttccttggcaaggcacagccgagctggtttcagggctccccaggaggccgtggcttgcctgcccgtttaacggatgggtactctgtgtgcctaggatatgaaggggtctggctgcagcagcacgtggtggccacagtgcccccgctccccggctctgtgcagatggcaatgtctgtgggtgcgttgacttgaatcttttccctagacctctagagtgggctcagacactctccagaccctgaccctggggcttcctggatgagtcctggccgggcctggtgccagcttggcgtggcctccaggacatagcaggattaacagtcaaggacccaggccccgtctcctcacctcccccaccacgaatagccccatctactgtggattctccatgtggacattttcttaaagatagggtcttgctctgccacccaggctggagtacactggtgtgaccacagctcactgcagccttgacctcctgggctcaagcaatcctcccaccttagcctcccgagttgctgggaccacaggctcatgcaaccatgcccagctaatttttgtatttttggtagaagtggatttacaccatattgcccaggctggtctcaaactcctgggctcaagtgatcctcctgcctaggcctcccaaagtgctaggattacaggcatgagccactgtgcctggccatatgggacatcttgtaactgggagttggagtcctgggtacaagtcctggcttcaccgtgtaccagctttgtgaccttgggcaaatcacttaacctctctgagcctgttttcttgtctgtaaaacagggataagagtgcatggggacccagcccccagcactgtgggtttgagaggagactgcttgtgtaggatgctcagtacagtgtctggcacagagtgagcgcccaggagatgccagctctagttcttgttgccatagctgctgctctgggagggctgctgagacccgctgaaccgggcatcccatcagccagcacctgccctgcacccagcccttggtggggctgggaacgggggaatggtccctctatcctgaacaggctgaaggcacctccttcccatattcgtggtagggaatcgagtcacctgctggacctggcatggccgaggggacggccctctcctgactgccagagtctcttggatgggcttcctgaccatgagggcacagggcaggcagcctgggcccctcactccccactgccagcaaggcggtccatgcctgctctgccttccattgggaaagatgtgtggtcacatggaaacggcctgtgcagtggggcgtgaggtgggctaggacaggggatgtccccagagaagccaggtgactgaagtggccctgtcagggcctggctgccatctgctgaggcctaagctgccagagaagacccctgaaggccttcaggggtggggtggagggcgctggcatgcttggttggccagctttggaggtcccagaggccagggcagtggctgcttaccagacagaactggctaagatctggttcctccactatgttgggcaagcccctgcctcttttttttttctttttttgagactgagtctcgctctgtcacccaggctagagtgcagtggcgtgatctcggctcactgcaagcttcgcctcccaggttcatgctattctcctgcctcagcctcccgagtagctgggattacaggcgcccgccaccacgcccggctaattttttgtatttttagtagatacggggtttcaccgtgttagccaggatggtcttgatctcctgacctcgtgatccgcccgcctccacctcctaaagtgctgggattacaggcatgagccaccgcacccggccagcccctgcctctttaggccttggggtttcccatctgttccttatgggggcattaataggaaaaaaatgcattaccacactggaggggctcataaacggtagtgactgttattagcagtgagggatctcacttcaccacccacaggactccgagcccctcgagggcaggggcagctccatggactctgggtctccgtccctggacagggctcctctgcggtgggggcagcccgagcatgcctgcccctggaaggacatacaggaactcatgatggctcatggctaaggagtcttatggggaagcaggctgccctggtgggcacggctgtgtgggagtctcctgctctgtccactcctggcaggggcagggacgcggctgtttatatccgcgccgggtgtcaggagatggaagccagggaggacgggaggatgcaggagcatggagagcatgtgggctgcagatccgggggaggatgggcaccaggacagagcttgtcctgacagtggtgcgggaggcagtgagcagaggtggggctgagaggtcactggcggcttcctccactgaggcatggctggcattcccttcggttcattaaaacccatcagtgggccgggcgcggtggctcacgcctataatcccagcactttgggaggccaaggtgggtggatcacctgaggtcaggagttcaagaccagcctggccaagatagtgaaaccctgtctctacaaaaatacaaaaattagctgggcatgatggcaggtgcctgtaatcccagctactcgggaggctgaggcaggagaattgcttgaacctgggaggcagaagttgcagtgagctgagatggtgccaccgcactccagcctgggcgacagagcaagactctgtcttaaaaaaaaaaaaaatccccatcagtggcacccacctcctggcggcaacaagtggcccttgaacgcccattccccactctcctcctccccgctgctgcctcctccctgtcttcggacattgtaattgcggtaaaaaccagagccgagcggcatcgcagttggggagagaggcccggctgtcagccattcctctgccagcagggcccgcggctgttttattattgccgcctggctgtatttcaggtacggtttaaacatcatcaaacgccacatcccttttgaaaagcaagagctaccttgctgaggacgttgaggagaaacaggaacattaaaatctacgaagcaaatggcccagaattgacatttgtgaggagagctttgcagcttcaattgtcaaaggagctaaatcccctctggcagcctgcggggagctttccccgtgagggtcacaggaaggtggggtatgtttgcgcgggaggagaccaggcagtgccggggagggggttctgtgggtcagctgactgcctctcagggcctccctggcctcggcctccacccagcctcctcttcctcctaacaaggaggcaggagccttccggtgcgcatgggacagggctgggttcaagtcctgctgtggccacttgctagctcttgtgaccttggccgggatacacctctcccctgaacctcagtttcctcacctgtaaacccaggagagcgatgtcccctctgaaggcagaggatggtgcatgcaaacacttgacaagtcattggaattcagtaaatggtgactgctgtcaccaaggaaatgggcatatgagttggcattaattttttaaaaaacatttacttatttccactgaaaaataggaacagtaaaattgagaaccattaaaacaggaacaaaaagaaccaagccacagcaggggatgctgagctgggtatctcctaagaactgtgctcctggtcccacctggaactctgcggcctggatgccctcagcacgtgctttccaggccaccagcctcttgcctggttcctggtcacggcctgctctctgccctggcacctgctactcgatgctggtgtgtggccttccgaggaactacggctcatatctgcccttgtagtttacactctcgatggctacttgggggtatcttggctcctggtatcctctcctgacccggcccagatgacacctcaaaactaggctgagcaaatctgttgcaactgaatatgagatgcagctctgagcttcccagcagccactgcaaaatttgtaacaagattttaggatccataactccaagcttggaagtcaatttaagtttcagctgaatgccttcttttctttctcctcttggccttttttcttcatttttcctctctagtatcctcaccaactattctttatctcccccaaggatggtttatcccttgctccagagcccatcccaaagtgctcgcccctcacatggctgtgccccagctcaggagacccccccgccgctgccctcctatttgtcactgtcgactcccctgtgtcgtgctcacggcagctggcctctgggcctcttgtcttgctcaggcccactgggtctgctgttgctgtttctctcagatgagcctgtgactaataagggttgcccctggggggctggcaaaatctttccctccttaatatcggagtttaaaaatgtgtcaccatcgatttgaagaaaagccttgttcctgctgagaaaagcggcctggagattcgtctcgccttaggaatcacacaggcggctgcatgaattcagcaccagagagagctctccatgcaaatgctgagatgcccactccagccccgcaccagccctccccgctgctcccgggggctggcacccccacttcctcatccccccatccctgcagagacttggggaggcccctgtgcagggaggggctccctggttggaagatccccatctcccgattctctccacctcttttcagaggctgagcccgtggctaattccacgtcacgatgtgttctaatccctgaggaaaaggaggatgagtgacttccgggcctggggctcctggaagccacccgggtccctcacaggtcggtggcggggggtccctctgaccctctccggtgggtctgccctgaaggcaggaatgttacccccacaggccttgtctcctggccttgttgcatccttgcctggaaaggactgttggggtcctttggtgcatcccccagcctccaggcaggcccctcccctctggaccttgccctcatactgggcccagccttgcagctgccaacgcatcccaccctcatccagcagctctcccagcccagaataaccatcacagtcatggcctgagaggcggctatgagtcccacttctcaggttgggaagctatgctatagagaccataagtgacttgtctgggatccaggaagcttgaacccagatcttttccctatgtatcctgggaagtgcccttaactgaatcaatgaatgggtgaatgaatgaatgaggagttgtgggcacatggtgaccactctaggtgttgttctggttagtgaacttggtgacagcccaggatgggtgtgtctggagagcttgagggaaggctgagctttctggtctctgatgggatccactcccactctgccatcgaggtcatggtggccacctttgtggcagtgtcctttctgttccccagagggctcagccgagcgtggcggggagcaggacggtgggtttggctgcctaggacgtccatcgggccgcccacagcatgggccatcccctgcgctggctgcagcaggggtgacttggaccagccgggaagctgctccaggggtccttgcagggagcttagtgggggaaggggagagagggcaggcgcggggtgccaacgaggcttccctggttcttggggaaccacacagccttgggcaggggcaccagagaagagggtaagcaggcagtttgcagtctctctggctgccgtgggccctcggaacatgtgctgggtggccatttaccacctggcgcggggaaggctgcaagctggccctgcgctgctcccctcaagctgcagaaggggcccctcgaggactcctggcagccgttactctgggaaaggaggggctttatttttcctcctccctaaatgttattgcctttataggctttggaaatcagttttatggcctgcgtgtttgtccactgaaatgtggaatgctctggagggaaaataaaatgcagggatggttctggccctgaaaggtcaggtggccgagggcaagcggcaagggctcaggtgtctcctgcaaagctgagggtggggtggagggtggagtgactgtgatggacatggtgacctccagagctgagcggccctggccggggttgctctttagggaccgttgtagttggaaagggggacagggaaggtgtgtgccaggaccgggagggggcctggaattctagtgggagggccggcctgaggcttcaggacctgttccatttgtcatatggtccctgctagactgacctgggatggcgagagtcattctgtcctctgcgatgcccgggtatgccagctggctcccctcaggtgccatctggggcaccttgccagccactggcagtgtagacttctcagtgtaagtgaaaaataagccctctgggttttaccagtcaggatgcaggcctggcaggggccctcacctgcaggagatgcctcatcttctggcagagttggctgatcgggagccaggcagggggcagagattcagcgggagcacccagcaacccacacaaatctctctgccttccctgggaccgaggaccctggagggagactctgagggccctgccctaggagaaggctgcttctctactcctctcttaatatgcgaagagctcctacaaatcaataagaaaaatgggtgaaagatgtggacaggcaattcccggtaggagaaaaacaaatggccagtaaacaagtgaaaagatgcagaacttcgcaagtaatcaagaaaaagctaattgaaatgagagacatcattcttcacccactagagaggcgggtgctggaagtattgctgtgtacaggtgtggcgcagccggggaggcaggtgcttcctcaggtgctgtcccccacccctgcatctcacaccaaacccgcatgtagtaggtgcctggaaatacttgcttcatgccaggtaaacagggctcctctctgctcacagcaagtctcagcggggctgctgccgccactgcctttgtatcctttgctttccctcctccctgtgggttcaacttccagtctcacccctacccccaccagctcccttgcccttggggtcctcacgcttccttggcagaggctggggtttctctgggcctggcctctcactgggggaatgctgcttcctgcttcagggtttcaactctctctgcaacctcatgactggtgccaggggtgtactgcaaagctcagggtggggtggaatgactgtgatggacatggggacctccagagctgggcggccctggctgttatcttggcttctttggaatcccctggaatcctccactgtgggaagctctagtggtgacctcagccttcttgccctgatggccacctctgtcatctagccccagaacttctcctgccttttctcattcattcattccctctcctaccctatccattctagccgggttgggtgactttgggctttatagctgcatgttctgtctctgctcctggcctttgcctgggcacttacctctgtcaggagcaccctctcctccatttccttggctgactccgaccgtcctccaggtcccagctgagaaaccctcccctccaggaacttccccagacctgggtttgctgtcgctcccatgtagtctgtaacagtcattcattcgtttcattaattcctgcagcaggtgctggggctgcaagggggaacaagggagatgtacccgggcagctggggtgccctagggtcctacaagtcacccgtcatgaccggatcccaggggaaaacctgtctgagagtcagggactggggacaggggccctggggcagtctgctctgggaatggctcagcttgctgcactgggaagggaggctggggcgggtggcagggccatgcccatggggtctgggtccagatgtctttctctgcctgctctacctgtgtccagtgcttccggagcacaggggagctgccttttaggaggagatcaagggagagaacgcgagccacacttcacacggccgcagccccgggcatctggctcggcctcctgccctctcacattgcgtgtgcctccctatgcaaggcagccagcaggagagctccagcctgggatccccagcagtctcctctcttggctccctctgtccctgtcccccatcttttgaggcatagcctggcctatcctgtgcccctggcttcctgccagtcttctttccagtttcccaagctgaggtggacgcaaccttcctttctgcattcaaagggcacgaagtgattaagacccagtccttgctccctgtgtagcggggcagcaggggcatagcgtgggggctccgtgcatctgtgcaggaatccaaggcgctgggggctgctcagggacggcttcctgtgggaggtcttcctggggaggtctagttccccacagggcgctctggctggggctcatgggtgtgcatttccctccagctcactgaccctcagcctggtctcttcatgaggcctcatggggccaggactcggggcagtggggggaacccggacagacctggttccagagctaactccgtcaccattgccttgggcaagctgcttagatctgggccttggtttgctggttttaaaatgggagtaagccagcctgccgcacctccctgccgtgaggatgaagctcggtgacagatgcctggcgcctggcaccactggcccccgctgccttgcctctcgcagatgggcgccccttcaggaaatcccccctaattatgaagttacagatctggatggtcacatggggaagagccacattcattaggagacccgggcacacagcctggactgtgccaagcatctctctgtgccagcttcctgaggaccgcgggctcaatagagcacatccctgcatcttcctggtggcagattccatctgccagaccccgaggagccgctgactggggagggcctgctcaggacccgcccgtccctggcaactgccctgaagcccttcaccctgggtttgtaatctctgctttaaagaggacttcaatccctttcccctccccccgccccacccccagtgaccaatccatccgccagggccctgatccaggagaaagctaattaaagaatttctgctcttggctcagcctggacatagaagattccccttggtcttcctggaatatctgaaaacaggtggagaaaggcatcagataagccccgggagcctccataataggcttaatccccccaaagccagcaggcatcaaacagctctcctcccgggaccactgagaaagggctcgagagcttggaggacgtggggctgttcctaaccacatcccagactgtaggtccccttgtccccagctccccatgaataggagactgtgttcctcatgagttcagacggagtatcagccatttctgcatagttctccagagcaggggaaggtgcagagacctggccccagcagctccggcatggggaggccccacttccagggctgccagcagtcactgtgatgactggcatgtagcagatgctcagtcaagtgcgcccctccctcccgccactcacttccctccggttccccctgcccccctcctcagcttcttttctttcaagggcctgtttgcctgtaggagattttcatcaaccaaccacaaatatttactcaacacttaccggcaggcagcacgtgagctccacagggcagggggctctcggtcccatttgctgcatgttccccatctgaacagggcctggcatgcagtaggtgctcaataaaggcttggttggtagtcacagcctgaaacagggtagtctctgctcccagagagcttacattcctgctgccttcagaaaacatcctgaggggctgggcgcggtggctcactcctgtaatcccagcactttgggaggccgatgcgggtggatcattgaagttgggagttcaagaccagcctggccaacatggagaaaccccatctctagtaaaaatacaaaaattagctgggcgtggtagcacacgcctgtacacgcagctacttgggaggctgaggcaggagaatcgcttgaacctgggaggcggaagctgccgagatcacctcactgtacaccagcctgggtgacagagcgagactccatcaaaaaaaagaaaacgtcccgagggtctttgagggatcatggagcccccacacgtgggtggggtgagggtcttaaagcctgccctccccgtcactctgagctatggccaagctgggtgtaaccctggagagagtcagggtgtcctcacccgcttcaggcagctggcccccatttccctctgcagtgcctggggcgggggtgacagggagcatttagacccgcagctccctgcacagggacctcctggggcactcgcctgcatcacaagaataaaaatgataaaaacctgccactgaattctgggtggcagtaaattacttaacacctgaaacaggttgaaatgtggccactgtggttttaataagcccatctccgatgcagtgcttcctcgccgggccggccagttctcttcttgaggcataatttcatctcgtcccaggcttggcagcattgcaaataagatttcacttcccctgtaaatcttagagggagggagtgcaggatttcatttgtgctgtcagttagcactccagagagcctgtttactttgccgcaggaggagaaggtcctctggaggtgctggacagggtggcgggtggggaggtggcagtgtcagcactggaaggtgacgtgggtgcggcggcggggaggcagcggcatgtgtgggggggtcctggaagcatgccttatttggggtgcctgaaagtggatgagccaatgtcagacccacggaggcagaatttcagggccagctgggtgccctcccatgcgtccgggaccctcctaggctgggtgataagactcagccacagaacttgggtgtgggggtgtggcctggggtgttagacccctcccaggttccgacgcctcttcttcaggttgctcggtgaggccagagacccctcctgggaagtaggggcaggagaagggaagcttccagaacccagtggtagccaggtaagggcagtttccaggtacaggaaagcagccatggaggggtaggtatcacccactctctctctctcatttgagcaggagctttttagtcctgagtctgacaaaacagacggagtcagatacacaaagccggagccccgggacttaaggtgcctcttggccgcagggcagccattcgggggtcttacccacacgtgcccctaatctcagtgataatgcaagtcctgagagatttgtggggaaggaaagggcccaaagtggcttggctggagggtggcacggtggggggctgcagcagtggtgtggggtaggtttctcgggggaccaccccatctcctggcatccagctgaagacatggtgtcagggctctttggggccagcaggtcccctgcagtgcctttgaggcactggccagtcctgcttgctttcctgtaagaacgggaggctcacggccccccaaccacccggtcctcttcagaacaggttatgtttggagggttttcctttcattcctgaaatgcaggtcctggcaattccctcctgtgcggcccaaacctggctgagcctccaactcccctggggcgcgtattaaaacctgagatgtcccccacacccacccccaatcctgaagcctaaggctgcagccagcctgtcatcctcttcagcaggccgtggacctgggattgttgtgggggtggtttggggaacaggccccaccctgtacggttgcctctctgtgctggacctgggggcactttgctgcctgggtccaaaggtcctgccaagaacctgggcctccctgcaagaagtgccaaccagctcagcacctggctccatccctgggggccaggaatgcgggagaaaccccccaggaggctgtgctgggggtgggggaggcctacactccccagacaaactgtaggcaacccggcctcccacgccctctcacagaggctccgtcacagccgtagggttggtgcgggtggtttctgagctgggcactcccagtggcattacctgtgtcgtcccacctcaccctcccaacagcagtcggggatggagctgttatcatgtacgcatggaggtggaaactgaggcacagagaggatgagtagcacatgtggtaactggcggagcccatgggtctaacccaatacccagggactccaaggccctgccccaggagagcagtggtgttaatccagtggttcccaaaggcctgtgaccgggaaccctttctgggcaacacctgtgttagctccaggggctgaggaacacagtttgagaacacagcccttcttccctagcttcgagggctccacaggtgtccccagatttgtggcgctgccacacgtggggagggtgaggtaaagccgggagcaggacttcctggggaagggtgggttcactggggttggcaagggctgttgtgcttggagaatcatcctccttgtactcacatggatccatggagtgattggctgattgatttactgtttatcgactcactcttcattcctgtttacggggcctcctggtgccagacaagtgccctctggggatctggaggtgtggagggcaagagctgccagtctgggctcagccaagcgaggcgtgggaaggggtcacctgtgcaggtgagaaaggccagcagaggcgtgggaaaccagtgcagcatagacctgaagtctaagccacactgggcctggggggtgtcaggcgtggagggcagagggtggggctgcactgaggctggagtctgaggggggcaacggggagatggggggacacagggccttcctgagtggggcgcagaagtggacctgccctcctgtctacctcaggcgggcggcgtgccaggccttccccattgcctcctagtcctccttatccgtggaagcgtcctctgtggaaatctggttccccacagagcctccccagccccacccaggctaggccctgactcagccacgtagattcctcactcctccatgaggcaggaatacaccagccccagagcatagcaggccctcagtcaatatctcctggctggctggctggctgactgtgttccagaaagagccctcgacagccccagagaatgggtctcaggtgagggagtgggcacccctcctgggcacccactgtgcgctgggtctcagggagaagttggaagaacagcctgggtcctttcctgggtggtcacactgtgtgccacaccttagagtggtctctcttgggctgctcctgccctggcaggacaggaggtgaggatggaggaggagggtggggcagagagcacctgtggggcccacgtcaccccactcagggccaccggccactgagaattaactttgcttctttggaatataaggaaaaacccgttaactgtatccagacatgaaatcagatctcaggcagaagtaatgagttcttgttttatgttaaatttagcagagactgctattgttctcatggaaattttgttccttcctgtccccctccctttgggatgtgagagaggcagatgaggctccagagctgtgagtgtaatgggtacatctaggggatggggggcgtctggggtggtggcataagctcatgtccccaaacacccggacagtcccacttttaccccggagccacttggttgctggagcctcttccaggataacccatagctcctgctgacacatacttctccatgtagagacccctcggagtctacgttcagctctggttcagctctgggtccccttgtggtgactcaggtgtcagtagacctctggggcctgtgggtggggacagagggcccttcttcctgcagcggaatcattttggttgggatggtgccggagggaacagtctccatcctgccgggtcaccgcctccgagccagggcaccccaagaacagagctgaccctcgggggcaaggcccggggaggggtgggctgagcctcgggggcaaggtccggggagggggtgggctgagcctcgggggcaaggcccggggagggggtgggccgctgagaccacgtgtgccccggacacctggcccctggcccgatggggtgccaagccgagagtcagcagcaagagatgaccgtaaaagttaaatctttctatttatttcaagaaagaacaaggcaagtggacttggacattttctatgaaaatagacaaacagaaaataggaccaagtagttaatcacattcatctcaacattgaagtttcaaggcacctacaagaaggaggccaaagggcggttcgcagtgcactttggtttgtgttgttgtcgtggtggtgggtgtttgcgtgtctcggttttctggaaacccttgcctggtggtgaggttgggagcgaagcaggtgggcacgaggccaggctggtctgggccctgagaagccgggccgggtcagccatctggtcgcatggcagcaggcggtagcggggacggtcaggcccgtcactcaggcccctgagacggcttccaagaaaaagaaaggagatagtgctgcacctgggcggctgattctggaggtgaggaaggctggggggcgtgggaagtgggggtactggcacaggggccccttggacatcaggcaggacctcggtcacaggcttgggagagatcaggcctgctccctctgacccgggcggttagctggcgggcttcctgccttctatagagcagaaggacccaccccttggccgccaggggctggccaaggacccctccctggtctcctcctcctcttcagaccaccgggaaggggatgacgttgtgtgccactccagaatgctttacgacaccacataagatacaaataacctgttaacatccggaaagggaattactgttggtggctcttaagacattcctctgccgtgtttatagggggtacgggctctttcagataactttcatctttggcctccctgttcacacttacctcctggctccagccagcagaatcccacaagcacctctctctctggctagcctatttcgacgccacacaccactccaccctccgtcacctctctccccacttctctcactcttggatgacaagccctgagcgctgggccgtgtggcttcctccccatggctcttggcctctccttatgagctggaaggcaccaggcagggtcctcggaaccccctggcggctcactttgggtacccaggtgggctgctggcggtgtggggtgtggaggtgcgttgtgttggggaaaaacagcctaaggctagttttggggttttgtgggggtgtcttctcacctgcgtactcagaacttttgaaaatgggactagcccgaggacaggtgggctcagaacattgcaagcctgcgttccacacaagaaaggtgagagaggcctggagccgcctggctccagggagatgaactggtggcggccccgcatccgccatggctttgattgtcggtttgtggtgcgtttgttttttcccgtctacagaggaagcccgatgagttcctccaggtgggtggctccagatgcagggattctgcgggggcagcaggcaaggcagcaggtgtcgcctgggatctggatttcttgcagcgcctctgtggggccctcccccagttctctcccccttgtcatccactcaaggcaagtcttggagaagggaaactgagttactgacacaggttggggcagccaccggatctctcagagtggctacatttctccatctggctcacagctggcaacacgtggatccaaggcagggtggagcgaggtgcttccaagaggtaaagctgctgagatgagcccctctctgtgccagctgctggcggggcaggagcaggacgagagaagcctgtttgttgccaacactcgtgcctgggccatcctcaatgagtgggcagatggcaactggggaggaagtgagaggaggaggcggcctcgttccgttggtggcagagaaaggattgagtacccctgtgtgccaggcactgtgctgggccccagtgaccctgggaagggcaaggtgctgactctgactatctaccttgatgagatttagggctgtggcagcaaagaccttcctttgaggactctctggtcttaggctttgggctttcaggtgtggggaggcaggggggccagggcactgtgcccactcagatggccacagtgctttgggggctggctttgttaggacgtgggggcagtcatcccacccacaggttgccctatgccctcagcacaccctcactctctcctggcacaggccgggcatttcagtgacaaggggcgggaggggacagtgacagtggtctcaaagagccaggccctggccagggtctccagcaggtaccagaagcaggagctgtcccaggcaggggtctccgggggagacgtggagaaaagacgaggctttggccgggcacggtggctcatgcctgtaatcccagcactttgggaggccaaggtgggcggatcacctgaggctgggagttcaataccagtctgagcaacatggagaaaccctgtctctacttaaaatgcaaaattagccaggcatggtggcacacgcctgtaatcccagctactcaggaggctgaggcaggagaatcacttgaacccgggaggcaggggttgcggtgagccgagattgcaccattgcactccagcctgggcaacaagagcaaaactctgtctaaaaaaaaaaagaaaaagaccaggctttgctctgtggctttgggggtctccaggcacacccgcaaatctgttatggtgagaaagggggcctgacccccacttttggaatttccaaaaccagggaaaacccacagattaaaaatgccgagggagggggaagagcaaagggaggggatggagagcaaaaagaatctttctgtgagttttttaaaaagaagcaaatatgggtatttcaggcacctacttggaacatttcaaaagaaacagtaaatgcttaaaaccacagagtgaaaagtgccccaggcgccatccaccggcggtgatggatggatggatagatacagtggcagcagcagcagcatgagcgtgttggactgcacgtggggcagccctggcttaagagacaggtccaggacgcagcctgggcttcggagctgcagggcctgggaggcgctctctgtcagcccctctggcgagccataggtgctgagtttagactctggaaagggggtggcatgtatctgtactttcttggtgcctcttggacactgaggatgggtattttgcagcctctctgctggcacaagtggctctttggtggggcaggatggtctggcttcaggactgccctgacttggggttttcaggggacaccagtgactttaaacaacatggtgaacttctcttgatatctgctccctttcagtgtcctgggggatgagaaagcaagggtgggaaccaggatcttctagtcaaagcaccagaccttgggaggaaaatatctgccacgtccccatctagtgcttgaatgctcccagtgacggagagctcactgcctgtttcctttgctgggctagagtttctcttccctgaccttcagttttccctttacccactccccttttactggccacaaggagtggattggagacagacccacccagaacagaaaggaagcagaaaagcccacggctctagagtcctactttctaaggactggatgggccacttgtcccagaggcctgagtccctttccctagggcagtgctggagcctcaagcctgagtgctctggtccatttggtgttgtcttcagagaccctggctccccagggagccaagccagggcaggtgcccccatcttgcacccccaacccccccaccccacccatcgaggcccagaaagtccctgctatgcagatagccacttggggcaggttcataaaccacgaaaaatccccctttccctgcacctccaaggagtttaatctctcctaatcaatttagcagacttgcttggttgtaaacggtaacgatttgcatttttgagcctttttatccctccttaagaaaaaaaaatgcctcctctctgcactcggaaggccaatgcacggctgcgaatcgcctgtgagtgcttgccctggcgcccatccaggggcaggcagcagccaccgtcacctgtgccaatcgagtatgaggaggcacgcggacgcccgtcactgaccctggctgcgtcctggccctgagagcagggtctggcccttgggggcacaggtccctgcgcccggcccctcctgccagcactgcccctgctctccccgttgccctccccgcccctttgctccctctttgctgcatccagttctccttgttgtatttttcataagtgcaaggctcagaagccccagcctcctctctggcacgttcagcaggaagcaggtttctgaagtgggctggctttgggacttgagctgccattttcaagggggagggtctgctctttctcctcctctcctggctccttggctccagggccggaggtgaaggagggaggcacaggttccgaggcagccttgggtcccagcctgtcctctgctcaggccctgaccagcccctccaacccttcagggatccctcacctgacttgggccagctagaacctttcagcaccagcagcggggaagggcccccacttggcctctggagcaccagtttcctgagtgacgctggacccctccctagcacacccccactttacagaaggggaaacagaggctgtattctcaccaaaccctctttccctgcaccgctctggaaacatctccccgaccccctcctcagctctctgcctggctttgttcggacagggctgggctgggctcagagggagggtttcccagatccccaggggaaggaggagacccggtgcctgtgtagagggagggagaagaggcacacggcaggtgtgggctttgggctttgggagagtcaggttgggcccctcctagctgctgccatcttcccaggtgctgtcccctcccctgccagcgtcacccagagccaggaaggtgcaatgcccctgctcttggctccggacctgcatcctggccctgtgtcagggaggcccctggccgccgcatgcaccatgttagcgtggagcaagccccagcctatttagagaagatggaggctgtggcgggaggccgtggggagggggaaggagaaaagggaagaaaaggagcttttgatgcacatcatgtctgtggaattgagtatgactaattaatagattttatttttagtaatctcttaagcattccatacattgggccccacgcctgagctgagcttacaagaggcctcattcgcaaaatgcaaatgattcccggcctgctggtgccttctctctctccttccttgccttttctttcctttccttttttttttttaggggagatttaaaggaaaattgccatgtaatagaaaagagattccaatcactacatctaattaccacgaagggtaaaccacttaaccaaagaagcgtcatgggctttttttatctttaactttaaacctgccttaaatgccacaaaacgtactcatcagtgctggggccgctgaggttattctggctacttagaggctgtgagggtcagcccagccgcggacgttcccttggaaatgtcagctgtgcacgggagcccgggagaatttagacaggctggggttggcatcccaggccttgtgtcctcacgcatgtctgaggtgtaggggaggctgggtgtcctgaaacatctcctatcttgtggtatgagaccagctgggaggagctgggccaagaggggatggggtttcagaacggacctagcttctggcccctccctggctgaggggctgtgacacagcagatatttgggggcttcctctgggaaagcccagaaaggaccctgggaaggtgtcaggatagctaaggggcagaaaagatgagaaagtcagctctagagctgggtcccagggccctgactgggtggagcatctaccttcctccacacttagagcgccagtgggtgggtgatccccacgatgaggcaggcagggtctggtaagaggggccgagccccgccctcgcccagttagtgcaagaaccaggaacaggagactcgcgtggtcctggggcccaaggagctcctctggggcagctgccagggctcctgcctgcctgggcctgctctgtgcaatgggaggggaggaaagctcatcactcaggccttgtctcggagggcgtggctgggcacaggctggctcccagctctgcctgctctctagcactaagtctcccgcactcctgccccagccaagcaggaccttcccaggcagctctcacggtccgggccacctgctgtccccagatgccttcctagccactaagggcatgacctgacctgtctagggtggggagaggagacagggggacctaggtgaggtggggacagtgtgctggcagcaccgtgttgcagatgggcgggacttgggggaaggcagtgatcagagtggtgcccttcagggaggggtggtctcattttagaatcagcagagacctgggacttctgtcccctgtgccaacgtggcacacctcgggcacgctctcctcccagacatcccaggtgggcccttctgctcatctcggggctggggggccatggtccactgggagggcctacttttttttttttgagatggagtctcactctttgcccaggctggaatgcagtggcgcaatctcggttcactgcagcctctgcctccctggttcaagcgattctcctgcctcagcctcccgagtagccaggtaacaggcgcctgccaccatgcctggctaatttttgcatttttagagagacggactttcaccatgttggccaggctggtctcaaactcctgacctcagaaaatctgcctgcctcagtctcccaaagtgctgggattacaggcgtgagccactgcacccggcctggggctgccttttatacagacctgacattaaggcctggggaaatttctctcttgaccttattgtgtgagaaaatgattcaggcaggaaaaggaaaaacacgtctagtttcgagtgaaacgtgaccacgctgctcggctgttccccagggctggggagtggacctatttcgtgggctagcccccccaggccgtgctgggagcctgtgcccatttttccactttccacgtggctgttgtgtccgctcctttcagccccatctcctcactgaaggtggcggtcgggccttttaacgtaacccctgccccgctgctgcttctgcctttgcttttcgcacggtggtggaggccgtttgaaaatagcaccaccaggcgctcccagccctctcatcctcctgccctcggaccagcatctcctctttgacgttccttttccttggcgcagaacaagcggcacagtgacagatggtgacccgggctccctgagtactgggacgcaggcacgtcggaaccccaggctccgctcttcctccctctccaattcgctgtcattatttcatcatcgttttaatctcatggctcaccacactgcactgtcagttgataaatgcatgatagcgacatggattccagagggaggaaataaaatcttaactcttctgagggtcccagtcagggccctttcggaggctggcatttttagaaagagatctggtctctccctctcaagaaacagagtcccaggggtgggcccagctgagttttctacattcagggagggactgccatcacccagggctttttcgagaatttttgtgtctttttctgggctttgtttgagcagccatggaaaccaataggtctaatcagctgatatttaaaaaaaaaatccctgcgctaattacccgtcctaggagggaacattcagcacatggtaaatgctcagaaagtagctgttaaggtgattgcacgtggtgggggagggagacgaggacactggaatcaaataaagcttttatctgtatcagaaaggagagcagcccagtgctggccaagctgagccaggatgggactggcagccccagctgcgacgcctccctaagccacccgtctgagacatacacacctcagcctttaggaacagcagcagcccctggagaccaagtctcctcccccacctcactcccatccccaacacacggtctacttactcaaggatttctaggagaaagcaacactttcacaattctattgttcaggaaatggtaagaactgacccaagaagaacggtaaggaccgtgcatgtggctctatctacccatctgtacttagagacaccgcgacagggatagacaggcagacagatgcacctccaggtggcagggaaagctacggcttccgccggggcttctacggagcgtggtgcatggaactgaagagggcttcagcctaggaaaaaaaagtttgttttttttttttaatcgactacatgattgttcaaagaatgcagtgaaagatgccatgtttctgcaaatctgcaagggaaatggtatggaataagccaggggagagatttcaggaccatatctccagggcaaaagatcttttcttccctctctcctttgtgaggagcctgaaaaccttccatcgggtcgccagcgagtggccagtggcgggagagctgcgtgggagctttgagagccggctgcttctccctggcggttcctttgtgatggccttgaacagagcatgaggtgtccacagatgttgtacaggtagtatccttccagttcaggggggaaaaaaaaaaaacccaacccagccctgcctgcaatattatttttagtccttccctccccaactggcataacttggtataaattatgtcttcaacaatgtcgaattccccctcctgccttctattcttttaaaaaaaattgtcactgttgtgttctacaaaatcgtcagccctccccaaactttgctttctgcggaggaaagtcacccatggaatttctcttccttgctctcttggattgcagcaggctgggcaaagccacatggccacgccagggcagctggggctgaggcggggcagcccgggtgggcgggcatcatgtgtaggagtagtctatgtcggggatgccgccgtcccggtagccccgcgtggtgccgtagccaatggtgtgtgtggccttgcagaggctgctgccgttggaggggaagatagtgtggaccacgtactcttctttggcgcggtacgggttgatgggcagcatctgcagcccagggccgcggatttccaggatggagttatccttcttggtccctgactccatatagtcatcctttttcctgctgccccggttgtaggccctctcccgggtcagcagctcgccagcctggtgcacgtaccagcagatggcccccaggaccaggaagaggaagaccagagccactgccccgccgatgatgcccgccaggggcaggctcgccatggggccagcgttctgctcctggttgagtgtggtggtagggccatagctgtcggctgtctctgccttggcacacacgggtgtctcatcagctacgtaggcattgctggtctccatggtgaccatgcagatgatgtaggtggacttgggctccagggctgtcagcaggtactctgtcttgtccccctgcaccaaggtctccgtgatggagcccacggctgggctgtggcccaggcgcagccaactgagccggaaagaggaggcggggagcgtggccttccacgtgatgcggatggagtctgccgtcagggccttcacgtggatggccagggtcttggcgccatcacccgtggccatggggtagtcaatgttggagtcggggaggcgcagccctggccttttggccttgagggtaaacagggaaccctggggcgtggtggcagaggcgtggttgctggccgtggtcttggcagccgcattggccacgccgccctgcggccccgtctcaaaacactcgtccatctcgctggtaatgtccttgatggccatgccccggaccttctcagggccctggcacatgaggccccgcacgttgaccacggccgcccgtgccttcacccagtcccgcagccacatgaggttgcagccacaaaaccaagggttgttcctgagcagcagctgggccaggttccccaggtcgtcgaacaggccgcggggcagcgtggtcaggttgttgttggacaggtccagccgctccagctcacgcatcttggccagcgtgttgtaggggatgtggctgatggcattgtcctgcaggtagagcttctgcaggtgggcgctgggcaggttgaggggtggcgcggccagcgaattgcgcaccagcgagagctctgtgaggttctgtaggcggctgaaggtgtcgtcggcgatgcgctggttggccagcaggttaccgtccagcaccaggcgccgcaggctgttgaggcccttgaaggcatgcagcgggatggtggagatgcggttgtcatccagccgcagctcctccagcgtgtgcggcagccccgaggggatgctgctcaggtggttccggctcaggaagagcagcttgagctgtttgctgtcggcgaaggcgtcctcctcaatgctgacggtggacacggagttgtcatccaggtgcagcttctccagcagcgggatgcgggccagcgagtccctggcaatggtgcgcacattgttgtcctgcaggtgcagctcccggagggagcggggcaggttgatggggaactcatccaggtcattctcgtataggtagatgacctgcacgttgaccttggtcttgaggtcctgggggatgccggcgttgttgatctggttgttctgcaggtagagggtggtggcatcatcagggatatctgcggggatggatgtgagtccccggtcgttgcagtagatgaagccgttgtcgcagcggcacaccgaggggcaggtggtgctgtcgatgacctccgtcaggaaggcgatgagcccgtagcagaggaacagccagtcccgcaggtccatggtggccgtggtcatcacaacggtggccgtgacagtggcagtgggcgtggtggtggcagtggcggtggggtgtgccaccaccatggtggatggctgggggcgtccggccccacctggcctggagcctgaatacctgcaaggagcacaggacaggggcagtgagagggaggcggcgacagcgaccccaggagtgaatcgtgcattccctcccacctgccagcctgtaccaaggggtgaccgaagtccggtcctgcggggtgaggtcaagctggaggagtggcctttgtgccaggtttatgccgcaggtgattgctcccgccgaggtcggactctaacaacatctggctaatgttaaatcttatcaggagccaagaggctgcgcattaatgagacccgtgctgccgcggccctcctggaatgtgatccggagcctcagggaggttaatttagtgagagccatgcagcaggcttggtttcttctctcaagacttcacacaaagccactttatggccaacgctaaaggtaccagtcaatatggatgggatggatttagggcgtgttttatggattcatagctgctgtttccctggcactgcacgaggagcacgcattgctgtctggctcggacccaggattcgaaaggaaagcttgttgctggaaggcccaggagctcaaaaggggggcgtcgccagaacctgcgggaacgaagctgtcagtgccatcactggcgaggagtggagagcagggagcttcattgtctggtgttaaaacaacatgtcctgttgtcactcgtacattctacagacagaagaatgaggtgtcaacagaatcactttctcatgtatttacagaaatctcttttcatcagaggtgcctccctggccctgggttccgagttgtgtgggaaattgtcccacaccttgcccctttctcaaatcataaactttcagctattcaaaaaaaaaaaaagtggtctgttttcttgcacttaaaggaatgagacaaataaaaggagggaggagtcacgtctgtactctgagggaattggctgcaaggtgtaattttggatttcacaaatggaaaaatagcagcatagatttttcttatattattttactgttcatagtggtaaaaaatcaattaaagagaaattatctttcagtctcagtgaggaaggtgtcttcatgcagccagcaaaagtctgctgtaaaacactgggttcacggaggcttttcaatgatgggacatgatggcctctcggaacctgaagtcccagcctgggagggcagccctggtgtgcagagcagagccggcacctgctcactgagccagcagggaccttattttcatgccccagggactgaacatctctgttactcaaccaggccaaactttctgtcttctctgtccttctctattcctgagctgctttttctttccatcgagcaagctactcttgcaggacccagctcaaatgttacctcctctgctaggttttcctgaggccccagataaagcttccctctgctctgcccatccatctgtccacccacctaccatccatccacctgtacattcatccatccatcaattcatgcatggacctgtccatccatccatccattcatccatccatccatctatgtatcagtccatgcatctacctgtccatccatccatctatccacctgtccattcatccatccatccattcatgcatgcacctgtccatccatccatccatctgtccaccatccttccatcatgcatctacctgtccatccatccatccatccatccatgcatcaatccatacatccacctgtccatccatccatccattcatccatccatccatccattcaaccatccctccatccatccatctatccatccattcatccatccatccatccattcaaccatccctccatccatccatgcatccacctgtccattcacccatccatccattcatacatgcacctgtccatccatccatccatcatgtatctactgtccgtccatccatccgtcatccatgtatcaatccatgcatccacctgtccatccatccatccatccatccatccacctaaccatccattcatccatgcatccatctgtccattcatccatccatccatccatccatctaaccatccatccatccaggcatccatgcatccatccacttgttcattcatccattcaggcatgcaccagtccttgcatccatccatgcatccacctgtccatccatccatccatccatccatccatccatccatccatgcatcaacccatgcatccacctgtccatccatccatccatccatgcatccacctgtccattcatccatccaattatccatccatccaattatccatccatccatccatccatccatccgtgcatcaatccatgcatccacctgtccatccatccatccatccatccatccatccatccatccatgtatcaatccatacatccagctgtccatccatccatccatccatccatgcgtccacctgttcattcatccatcatgcatgcacctgtccatccatccatcatgcatttacctgtccgtccatccatccatccatcatccatgtatcaatccatgcatccacctgtccgtccatccatccacctaaccatccatccatccatccatgcatccacctgtctgcccatccatccatccatccatccatccatccatccatccatccatccacctaaccatccatccatccatgctatccatgcatccacctgtccatccatccatccatccatgcatccacctgtctatccatccatccaattatccatccatccaaccatccatccatccatccatatatgcatcaatccatgcatccacctgtccatccatccatccatccatccatccatccatgcatcaacctgtccattcacacatgcacctgtccatccatccatccatccatccatcatgcatccaacagagctttattgagcatctactatattccaggccctgttgtagccacttgggattccattctgatgggatggatgatagttcacactataataaaggctttgctgagaactttcctaatatttaagtcatttaaccctcccaacaaacatgaggtcagtgcccttaatcccatttaacagatgagaaaattgaagctcagagatgttagcttactcaagactacttgagaaccaggtaggaggaacccaggccatctagggaggaggccagaatcttggcaatcttgaggcttgcagcactctgtgggttgcaggtcacaccatttggtgactggtgttttcatgtcaccaaactgccagggcagggactgtggccaagcatggctttgcatcagtgaccacccgatgacagaatgggccctgccgtggtgaatgtctctgccactcacccctgcacactcaaacgttcccttcacacttacagggtctctgcccaggcagccaccacagtcatcaaggtggctgctaaggccctgtgcaatcctatgtggcacccctgttggcctggtccaccccattcccctctcactgactgcagcagccaggcaccccctagtatccccagggcccttgcaagtgctgtgctctctgcctggacagctcatccccagatccacgcctgcatctccttccagtgaggcctttcctgggcaccctatcgagaattataactcccagatactcctctcagttccttgcttgcctatagtatttaccaccaactaacacactacgtgttttatcttttttgttttgttttgccttgttttgctttttgagatggagtcttgccctgtcaccaggtgggagtgcagtggagcgatcttgggtcactacaacctccgcctcccaggttcaagagatcctcctgcttcagcctcctgagtagctgggactacaggtgtgcaccaccatgcccagctaattttttgtatttttagtagagacgggggtctcaccatgttggccaggatggtcttgatctcttgacctcgtgatccacctccctgggcctctcaaagtactgggattacaggtgagccacagtgcctggcccttttttgtttttattgtctgtctccccactagaaggtacgctctacaagggcagggatttgtgcatcttattcatagtgtttcccacgtggcagatgctcactaaagatttcaaaggagaaactgtgatggactcgttctgtagatgagagaacagaggcacagagacctgtccatggtcccctggcagaaggaggtggggtctggattccaccccagggctgcgtggctgcaggacctcagtgcttgactccacactgctgagggctgtgagtccctggccagcccagacacagtcctgcagcccaggctgagcattctcagaccttcatggagatgcccactctcctgtgagcctcctgcttcctttgcccagggccatcccaggctgctctgacccttatctgaccacctcacctttcattacattggggactgggaaggacactggcccagatcatgggaaaggacgggcttgaagccaggacagcatgcagagctagacacatcagccttcagaggatcaggaaaagcctaggtggtggggtgacctctctggccagacctcacccaccccccttcacaggcaagggtgcagaggttgccgcctacacacaggtccacagccctcatttcacagcccagcagcctgagactcagagacatgaggggcccagccaaggtcacagccagcccagatttcccactgcacgtctgtcccttctgcactgagccaggctcgtgaaggttatggagccggaggtcctgcctcaagccacttatgagcaggtaggtagcacagggcaatgctagagacaggaagacacaggccagctcacaggtcactttgcctcagtctccagggtcaagtctgagtctaggagcacctctgccagggggcccccagcgtctggctggaggattacccccaacctggtctgttggctgctgagttctggcacaagggatacaggtggcctttgtactcagctgttctgagcagtgccctaagtagggggcaaacttgttaaggccaaagccaaggcaagccaccgcattccctggtatggacatctgttcccagcgcccgctcagctcatggccacagtcctcagccttcagaggcctcagcatcataatagagtctaaattgcacctttcagagatgcttgatggataaccaagaagcatttgggaggcagggacccaaggcctttccgctccactgtctgtgggcctcatccatcttggccaaaggctcccctgccgcccccctccccaaggccagcccgaggctgagccctctggctccaggaaagtagggcgggacctgggggtggggaggaagatagcacgcctcaccagaggaatctctaattgcctgggtgcctgcttgcctttttattcccttgttgtgtgtttcatagtttatgtggccatcaaattaaacctggtaaatcgcccatcttttatgggatcgcttgtcgcccttgcgtggatccctcagacttcagcgtggtgtgagttacgacctgccagctccatgactgacagccggatccttagcgggccacgggggtgggcgaagggagcagtgggatggctcaggctgtaggtgtccattactcctccgcttagctgggggccctggggcattattcttggcattattcttggctctatcagtcgttgtcccctgccaacctccaggacagagaggcctgggttcaaatcctgcctctgccactttcaggtggtatgatttctttcttttttttttttttctgagacagtctcgctctgtcacccagtctggaatgcagtggcccgatcacggctcactgcagcctcgacctccccatgctcaggtgatcctcccacctcagcctcctgcagagctgggaccacatgctgcaccaccacacccagctaatttttgtattttttgcagagatggggttttgctatgttgcccaggctggtcttgaactcctaggctcaagcaatctgcccacttcagcatcccaaagtgctgagattatacgcgtgagccaccacgccgggcctcaggctgtgttattttgagcaagctgcttgccctctctgaggtttgatttcctcatctataaatgtggtcataataggggcccttacatgggaacttacaattcaggattcactgacattatatgtgcagagtaccccctcctgagtgtgatctggatgcccccgacgcatccagtttaaaagctgccccaagtctctgcctccccagacacacggcctagcttctgcagtagctgcccgtctctgtcctccgcgctccagtggcccgttctctactcccctgctcctgctgtgccttccggacaggctgaccccttatcagcctctgtgaagctgaggtgttgccccctgcccacctcaaactgtgtgggtgcaaccctgcccctcccccaagccatgctggcagccttgaccctatgtctgggccgcacagagctggtggatggggccatcaaccatcccctcctgtggggccgcaccagcctcccatgggaggccctccaggctgggggcagggtggaggagtccggggaggtaagagggttttaaatgggccttcgtcaccaggtcatccagtggccagaaatagttccctacctcctccacgccacactcactcccacccctgagaagtcctgaggcttctgtccctcccctttccaccccctctgcagccctccccagaagctgtgctcacggtgcattagaccctttgtggagctgctgcccagtgtcacgagtggggagaggccggcagcctcccgggtttcccaggtctgggggagcagtagggaagctgagtgtgggtgtctacacccaactgcaaagcctttataagtcagtgacaccaagcttcttccccacccctcgtggtggcttatggcccactgtctgctgctcagcctttgctggggaccctgctgctggctcctggccctcatggaacctggggatgctattttctattcacaggcatgtcccaggagcttctggaagccagcaaggaaatagccccccatccctgtctggcctcactcccacgtctcctctttcacctgtcccatccctgggatgggggcatctcaggcagggccaggcggggagaggaagtgtcctgcatgtaaactctgtatgtaggaaagacaagtacatgctcacgtgcatggatgctggtcacgtctcccccacccccacttgcccctcagcctccttcctgcccacctgcctgcctctgtccttaggaatctggctgcccatgtggcctggcactggtgtgtggcctggcactggtgtgtggttgctgcagaccctggggtcctttggcttttcccccacttcccagcccccaggtggggtcccttgcaggtgtctttcccctgccagtccctcccttcagcaataattcatgtgtctcccctaaaccttgccatgccttcaattcctcactgagaatgccgtgcaggcagactgcgggcagaagcagtttctcagccccagagcgggaaaggccagtgggaccccagtcccacctcccactagacaggaagccctaccaaggcacaatcatctccagctctgtgatggggcttcagcaaacctttgtttaaattaatgaaagaccccaccttcctgggggctcaactgcaaataagacagagggaagagggccaggaggtagacagggcaggccgctgcttcctggtgctcagggagacccagggagagctcccctccttctcgccaggaagcccctttcctgtgaaggcaagtagccagtggtctgcctggctcaaccaagctgctcagcctactgtggggtggccctgggtctcaagtcttttttttttttttttgagacagagtttcgctcttgttgcccaggctggagtgcaatggtacgatcttggctcaccgcaacctctgcctcctgggttcaggcgattcttctgcctcagcctcccgcgtagctgtgattacaggcatgcaccaccacgccccactaattttgtatttttagtagagacgggatttctccatgttggtcaggctggtcactaactcctgacctcaggtgatctgcccgcctcggcctcccaaagtgctgggattacaggggtctcaagtctatctgaccataaacgatctacttccctgggcttttgtgaagataaaataaggttactttcaatgtttagcagagtcgtattcagaatgagggaactattaccattactagcaatgagccattcttccctgagccccagacatgaactgcaggaagggaggggagccttgagtcgtgtgagtggggcttttccaagccctagttcaggcagatgccccagggactgcaggcccaccagaggcatctccttagggcagggactagatgccatgaccctcaaggaccttctaaccccagctcccgccagggcagggtgccagccagccacacccatcaccctgaacagctttgctcctggatcccatccactggtatcatttagaacttgtgatgcatgggggctggggcgggaattcttttaaaacctaaagttaattatttttctaatttcatgctgcatgcattatgcatcagctgttatcactggcggtaattgcagacaggtatgcaaatccactataaatgcacctaaccacataggccggctgggtggcgctggtgccaggcggcgggatgtcctgaacttcagagaatgtaaatcgcttttaaaaaaacaggactttagaattgtgtcttaggaagttaattatattgataacagtgttcgatattaaaccattcaaggccaggagggggtggggggatgaaaggagacacgtgtaattttgttcctttctctctcggcattatttaataagatgctcctacacctgatatttctgtctgtctgtgtccatttttagtaaagctgcctaaactgagacttaattcctttatggaagggaaaaagaaagcccagtgggctgggcaagttggctcattgtaatcccagcactttgggaggctgaggcaggtggatcacctgaggtcaggagttcaaaaccagcctggtcaacatggcgaaactctgtctctactaaaaatacaaaaattagctgggcatggtggtgcatgcctgtaatcccagctacttgggaggctgaggcaggagattcacttgaacctgggaggcggaggttgcagtgagccgagagatcgtgccactgcactccagcccgagtgacagagtaagaccctatctcaaaaaaaaataaaataaaataaataaaagaaagcccagtggaatttcagagggaaggagaggggctaaaggtctttattttgggggatgaggaaaaggaagagaggcagcaccagcagggctggggacagtcctccagaacaggactgaggctgcgggctctgcactgcttctctcctcagccgcctttaggatcctgggccacagcagagagcctggagaggagcagtgtgaccagtaaaggctggtgatgggcaacactcactgatcctagatcagaggcttggcactgggctctgagggcagggcctctcaggggctgagaacaaccctgacaaggcaggaggcaggcccttctcccagtgggaccctccctatttatttatcatgagtttatggattgtctcctccccttagaatgtaaactcctatagttaggacatggtctgccttgtgcctggcatggagcctggcacagaaagtgctcagtaaacatctgatgaatgaatgaacagggccaccaaaagggaggcccctgaacctagacccagggctgggtggtagagaagagggaggctggccttcctacagcccaccccaggacgtcatggtgacccagggtgccctcaccacagcagcccaaagaggcaaagggaaaggtctggattgtgcagcagatggcagaggggtggccacaaacccaggcctcagactcgatgtctggagctctccccttcccaggtctcctaccgcctatctcagctgcccagcgggacctctctgaccccaaagggagactcttggccatccctcctcacccccactgatatggatgctggcctggcactgcccaactgcctgtctgtctccaactatcagaggtgatcctcactttcctacagagggccttttcccctcccgcccaccccacagatacactcacggatggaacccaccactcaggaccctggaatcatgagataaaggacctcagcgattgtctgctttttgcagatgaggaaaatctgaggccctgcatggaagagacaggctcagggtggagacagagccctcccgcagctgtgggcagcctccccgcccacctcctggggccttggcgcccaactgtaaccctttcccaggggtttggcacagggaggatgctggggaacagtgtctcaactccagcagggcctcatgggagccgctcttctccaccagcatgtctgcagcccctcaagcctgtggggtcactcacgcctgtggggtcactcatgcctgtggggtcacgcctcttagcattaggagtagctggcagggctgggtgcctgagtgttgggcacgtcatagaatgctctctccagctggccacagcctgtgtggaggggacaggctgcatccccagtgcagaaaggggaggcatacagggaggggcagacctgtccaaggtcacatgctcacaaccagagggccaggccccaacccaggtctgtctgcccagagcgtttgtttcttgcctccctttgcacagagccactgagcagacctttcatggcagcaggcctgggggacagcagctgctcccctctagcttggcttcagcctgggaatgacccccgagccctcctagggactagaggggcagtagggaccagggctgggcactgggagagaagcagccagcccagctccggctcaggcacgctcgcggccccgctgtcgggctggcgcacttttataataaataacagcaaatagcccatccgcagggcatctttcacaccggtggctaataacatggctattaatgcccccgcagatggcatgcatgctgcgccgtgctgacgaatgtcccaggccctggtgcaatcataaatcaacccctctcctgaggaagagcgtgggaagtgtcattttccatcttggtaatgaattggggcttccctgtcctgcccagggcacagaggcttgaggttgctgggatttgtgtttttggcggtgcagcctctccctctggcctcctgggatccctggaggagtcagcccctcctcagcggcagggaggactcaccgcctgttgtgtgacccttggggcactctctgcccttctctgggcctcagcttgctccagtaaccaacaaagaggctgaactggaagccagtgcagatggtgcccaagggccaacaggagcaggaccttgggcagtagctttggatcaacccaccctgggtcccctggccagaacaggggcgggccctgatatagacttgtggactccctctcgttcaagggcagcaggcgccagggcaagtagcctaggttaccagagctcctgcccaccaccccgccaaggcctcactgctaccacctttagggagggggctcaaaatgagattcctccaccctgctgcagggccatttactccaggagaggccactccattacatcctgggtccagctgctgggtagagcccagcagcacggggaccaccaggtggcaaatgatgcttatgccggcaagcagaagctgccagctgcatgaactgcgtgagtgggtgtgtgggatggagctgcagacccttggagacctgtggagctctggctgggaaaaggggcctttggagggtgcaacccagctgtctgggtgcgaggaaccctgggcccaccctggagcccttctgaattcgcgtccctcttcccttgtccttgggccttacctccttcgtcgctgccgcccaagaccctctgggtttgactggggtcactggtccggaggcccctgccaaagtcacgaagccgcgactcaggacaccgtgagctcagatggcgctcacattccctgccccgtggtcctaccaggccttgcaccactagggacgcagacctcagccctggggtgactgggcagcactggggctccccagggcacagagaggggatccggtgcctcggtatcctggtctcctggcgttcagatgaggctgtgggccacaatcagcagcctccttggcaccctaggctgcaggcgcagctggcttatccctgcagagtgagggtcctgtgtgcaaggggtacagggacacccctctggaccccaggactcccgagggtggcctgagggggttccgactccctgttcgtcgggcatgccctgtggcctggcacccagccctgagcagggtggcctctgctgcttgctacctccacagcccttttcaactcttgcccttttgtctgcagcccgccacctcttctgaagggcctctgcgtggcttttaccccctttttgtttaccaaggctttttttttttttaattcctttaagtcacttggcagaatgggctgggtgcagagagtgttcttgcatgacggagctgagagggagccactctccaaaggctctgtattcctgccactcaggctgtgtctccgggggaaaggagggggtccattaccccgctgaggagttcagatgttcatggtggggctggagctgctgacacatgcagctgagctgtcaggcccccacatgcccttctttgagaagatgcttggggggcaagggcctcagtcctgcttggctgctcctgtttgtagaggtttccttgctggggaggtagggaggatgagttattcccgcttcactctctggtcttgtctgtccaaaaaggaatccatcttctcgcccactgcctgcttcctcacctgccaaaaacaataccagtgattaagcccagagacatgagggaccgtactgggacaacatccaccagggccactgggctgcagccccctttgctttggatcctgtttttttgtttttttttttgagatggagtctcgctctgtcgccaggctagagtgcagtggcacaatctcggctcactgcgacctctgcctcccaggttcaaccgattcccctgcctcagcctcccaaggagctaggactacaggcgtgagccaccacacccggctaatttttttttttaattttagtagagatggggtttcaccatattggccagatggtctccatctcctgacttcatgatccgcccacctcggcctcccaaagtgatgggattacaggcatgagccactgtacccagcctggatcctgttttttttcttaatgccacttgcctatgagccggggaaggggctggggttattctccctatctcctgcctctttccaaatcctgacaattggccatgcatggtgcccagccttgcagctacctggttttccctccctgggggtggaaggactgggaagagaaaaatgaagtttttcgagctcctggccgtgcagggccaaccgcccagcccagagctggctccaattcccccggcacctgctcttcttgctaaatgtcattcaaaggctccaactgggccgccatggcctgggcttccagaacaagcactgcctttccccaccatgggaagcaggaccatcagggaactggggaagttgggtctccgtgtttctggcctctgtctggtgcccaccccacttcctaggtggggggtcagtcctcaacacccgcagccgccctcctcttccacacagacggagggcagggcaggctgttctggaatccaaaacaaaaccccgagccctccccagcacctctcattagtgcggcatgtggaagggccgcggcgccctggtgtctgtattccccctgcaggaacccctctttggaaaagggcttttattacacatctgagagtgctcactctggtttgaaatcagatccagatgggctcagctgcatctgggcacttttctttgtagggcctaaggtggctgatttgagaaatgcttgttgtcagaggccgttacaaataaaaacagggatattagggttcatgttttaataagcccagcacccagatggggggtggctgcccacggggctcacagcctggcagggaaggcatttgggaagggtgtgtgccagccaggtggtgtgcaggctgagtctgatggggtggacagggtggcagggggagttttcttgggacaagctgccctaggaagaaggaggtttcagagccagcaagccccacgggacatcgattctgaatggccagtgcctggtgaatactacaggtggggcacaggccctggaaggggtacggtggggcttacgcaggagggaagatgaggacagagtccctgcacgcggcgggagggcggccggctctagcacgagcccttattgctattaccacccgcgtgatttcatccaattataaattgtaatttctccatgaaagcgagagatggaaaaagtccagtgaggtcatccgcctccctggccggggcgcagaaattgttttataccgatgggggtggggcaggggcagcgggccttggcattttgagaggatgattgccgtgtcctgggagcccagaggctccagtcagctgtggccgctgcctcccgataaagagagaaaccactgagctctgcttttgaaattaagaacccaaaaaggaggcaggttcatcccactggtgtgttcacctcagacccttcccatagcttctcggctttatcctgagagcgtcccatagctctcaggatagaggcagtgctcctacagtagtctccaagggccctgcccagcccaccagccgtgtctcccactactgcccactaatgccctgagctggctccagcctggcccttcactgtactgttccccttctgtaagaatccatgcagacgtcatccctccctccctgcaatgggccaccctctgcttggcttgtgtggtcctgtgaaccatgacagcaacaacggagcatgaaaagaattgtctccctggcttcaagggaggacctgaggctggatcccccagcacctggctcagtgccttgcatgcagttggtgcttaataaatgcacccaccaaactctccatctgctccctcatttagaaaaccaaggcactaagtgaggctcttggtgcccgtccagctttgtatgtcctcagtccaccttccctgctgcagcccccacccccaccttccctggggcctgcagagcctcctggaaccccagtgctgggatactgggctcctcagcgtctgtgccctggataagtggggcctctcaggcttctggggtgtgtattggttttccaagtgagtctggctggcagtggttgggaggtgtgagctctccagcagcactgtggctcttcccttgtgtgggcgcataatgatgatcattagtagccacctgcattcactgaaccaaaggaggcccaagaataaatatgtaaatgcgtgcgcctggcagacacctcccgccagagccacagcacccccagtggccacccttctggctcgagtgagtggagaccatgccgtgtgaagttagtggttacactcctcgccttggcctcccccgttcccacaggctccaggtctggtctctgtgctcaaaaccaataaaccattttttgagtcaacatcataaaagcttccattttgagtaaaagtactttgagatgcttacacaattttctacttttgttgtcgtcaatcacatcacaactgtattaaaagaaatttgaaaggagggaaagaaagccaagtgcccaatctcacatctctgcaccaccctctgcgttttggccgaatctgcccatacatatatgccaggggacaatgcaccttgtcctttcccagtaatttctgccttgccatcttccctgagcttgggaagacagcatggctagcaggtcagggaggaccactttcattgtgtggactgagaagagggagcaggacttgtgcagggttatacaacctgtagcagtgtcagggcctcaaactccaggccagtttccttcttgctgcactactccaagacagcgcaagagaaacggaccatccaccaaacactgcactgaggggtcctgggcttctcctgaggctctcttgtgcacccctccatccatccatccctccatccttccatctctccctccatttctcgatccctccatctcaccatttctctattcattcatccatccatccatccatctatccattcacctctccatccgtccatccttccttctcatttctccattcacctatccatctctccatctgtcaacccatccattcatctctccatccatccttccatctatctctccatccttccaactcttcatccatccatccctccatcaatctatccactcatctctccatccatcctcctatctctccatccatccatccttccatctctgtattcatccttccatccgtctctccatcagtccatctattcacctctatccatccatccatctctccatcttttcatccatccatccatttctccatctatccgtctgtccattcatccatccgtctctccattcatccatttctctccacctatccatttctccatctttccatctacccatctctccatccagcaaacatattctgagtctaatcatgctccaggcattgtacaagacattggggatccaaagagatgccctcatcctccaggagctcacagtccagtggggagggcattggttttcagagggctacaatgtgagacgcacacagggcagtgtgggagccaagagccccgccttgcccagccttcggggagtggggtggatcatggaggcttcttggagaagatgacgctgtgctgtggttctggggtactctcatgttatgacagtcacatgtgagctcagtggcaatccagagggaggcaggtctggctgtgtttccccttgaccacctgcctatcttctagagccactgcccacccttggcactcagggcttcctcccgaagtagaaacgatcctcaggccctcagctttacagttcatagctgccttaaagatcggagctctctgatattaattcctatattagcaattagccctcctgtttcatttcaacctttggctctttgggatggatttttatgtatgtgtcattaatcagatggctggtatgtgctgctagaaacccaggtgggctttatggctggtgacttagcgaagtggtgttttaaatgaacaacatgcctgccccctccctgggaagagctgccctgtggcaaagagggcagagtttagatcattgtaagcaggtcagagctggtgcgagctaggagacccaggattttctttcattttggacttccaggctgaggtcagcatctgtatctgacctttatagatgaaaaggctctttgtgactcaaactggagtttgttccatggctctgacttccccctaccaggatggccatccacagagcctgttcctttctttcccattgcagagagcagtctgggggctgcttattccctctctcccgagggcactggagacagaaggctgggggcagggagagcattgccgtgtgggggctaggaccgctccagtaatgggctcagcatgttgggagtgggacgggaagaacatttcaggctgagggaacagcctatgtgaagactggaggtgggagggcttggtatagtgagaggtcagtgtcccagagctctgagtgagtggagggccgtgatccgagctgaagcagggcccggagcctggccttaggggcgctctgaatgctgcactgaggggcctggtctttgtacaagggcaggggggaggctgtgagggtgccgaggcatggaggagcgtgaccagacttgcagtttagaaagagtgttctcgctgctgcatggagacctggaaggtgcccaggtgcacaggagaggaccagtgaaaagctgggaccatgtcctcaggaacagggacagggacatggggtagggacctcatacagtgaggggttgaagggaaggggccaacttgggaggcccccaggttttactccctgaagacaggcctgggtgctgagtgggttcccgcctccttctcctcactggagggcagctgagtgctcccaggagcaccaccaagagagccatggacagccggcttgctatgggctccaagcctggtcctgatctgcagcctgcagccccaggcctgagcaggagcaggaaggcctctggaggctgtgccttctgccctgtgagatgggcccaccccattccctgcccactcgctccgggcccccaggcttggcaccgctgcatggcacccgagtagcagggtgagaagaggcggaggcgagagcctgcttgtgtggtgcgaaccctcccagcctccgctctgctaattaaaccatctcctgacaaaacccagactttcagggtatttgcgagagtgtgcgagccaggccgtgggtggcttcaggagtctgtgccgcccggccggcgggcctgggcctttgccagcgcccaccctcaagatggccatcagagaaactcagcaggcagcgcccagagcagggcacttcaggggtgcggggcccactcgcccaggacggagcttctcttgccacgggacatctccccttctttattttcttccttccttcccttcacatgtgggcagctctggccagaggtggcctgggagttcacccatcccttggtgctgagttggcagagaagcccaaattgggcgcagaccgtagccacctgcccctccctacctgccccactggacccagcagtccctccctgtactttctggggggtctggaggcccagttctgccaggctcaggatgctgcagagggggagggttccctagctgaagctgccgtcctcacagtgcagctgagcaacagggacctagaaacagctgccagtgggcaccgccatccccgggcagcagggagacaggagcaggcaggcgcctgaagagttctcatccgcctggagtgctcttgtgcctttgcaatctcctcccagcaagggtaggcaggaactcccgggcccagacgctgagagagtgggtgagcgggggaccagcaagggccactcgcacccagctcacggagggacaggcatcggctctcagctctgccgggggaggccctcgaagggacacagctggcagtgtgcttggagggtatggggacacggcagccccccacaggcctgccctcttcccctcagggaggggcactgcggccagagcctgccccttcacagagcaactctaggcacaaaagggggagagggtagggtgcggtggctcatgcctgtaatcccagcactttgggaggctgaggcaggcggataacttgaggtcaggagttcgagaccagcctggccaacatgttgatacccccgtgtctactaaaaataaaaaaattagctgggcgtgatggcaggcgcctgtaatcccagctactcggtgggctgaggcaagagaattgcttgaacccggaaggcggaggttgcagtgagccgagatcataccactgcacttcatcatcctgggcagcacagcgagactcagtctcaaaaaaaaaaaagaggggacaggaacgaccacttgcctgccagctctacctggcagacctcactgtaatgcgtcgcccgtgcccattagggaccgtgtccagcctagaggaagctcggggtgatgaacctggcgccaccagccaaggccggaacctcttctttcaggaaattggcctgcttttgtcggcagaacagtggctgttcgaccccctgcctgcccgtcacagtgctcttggctggcccttggccaaggcaggtggtggagccggcgggcagccctggtcccctcctggcctccagggtctgggcactctcacagcgtctcctggcagcctggctgtgaagtgggccccacgctgtccccacgctggagctctcaagtggcagtttgaagcagcactgtgctggctgcagcgcgacatatcctgcaggctcatgggcccctggggggtggggggaccactgctggagactccccagggagaaagcgaggagctgtcagagaacccaggctctgcccaaaggcagtcagctccctccctcggctgccccttccccagaccctcccctcagcctcgcgctcctccattcaggtctcaacccctgacttggagcccctcttggcctatttcaggagccccctgctcacttccttcaagggctccgtgctagtgctgggggtccagtgtgcagcacctccctccgcctgctgcatctagaaacccagccctcctcagacctccgctgtgagctggggattccagtccacacatatgccatcatccgagttactcaggtgcagctgggggaagccgcctttccttccagaagcatccactagcaacctcagttctctacttccctcccaccagctctgccagcctccagcccccagggacaggtgccctctcactcagctcccagctctctggtttccctgcaccagcaagagcctgtgccaagggattttttgcctgtgttggaaatctcccaccctttccctccttcccataaacatgctctctctggccgagagcaatgctgtgcgctcggcccaggcggccagactttgttaatatttacagcgagtggctcaggaagctattagcttccttttcttgttgttaattgaaagaggagaaaatggttgtaacacttcaaaagaacttaaagtgcgcctgagagactagctgaattgggaggaatgggggaaaaagagagactattttaaataaataaagcaagcaagccagcccacacctcacacgagagtggaatgtcgttccttccccatctttgcagacgcctggctttcctctgaggtttccttagtgcctctcattgtatattttccttttcatttgggagcctgccttaaggagagaagcaggaagagaaagcattcgcggcacacttttgttaataacgaggctctttgaagccacagctaacgaggcccctagtactttcactcctggagcacacggggctgggaaacctgtggctacctcccctcttgggacacaggcccagatgggacattcggcgaaatccactcctgggccccccaacctggatgtgacctctgggaagtgcttcagcctcagttcccctgtgaaccccaggcacagccaaggatgccgtggtcgtggggtcaggggtgactttctaaatcctggtagataggggtcagcattgagaggcctctggcctctgtggtcagcctccctgaaccacttttcccaaagacaaatggtcccgcccgcagcagccacacactgagcctccggagtctgccccatgacgtacgcgacccaatggctctgccagtcagcctgcggttaggcaggggcagggatggatgactcaggaggccttcactccaggagcctgccattcatttctaactgacaactgtttcttcctccaggaagcttccctgacccttccttgtccccagcctgcttaactttgttttttgggatttttttttttttttaagttggagtctcactctgtcgcccaggctggagtgcagtggcatgatctcagctcactgcaacctccgcctcctgggttcaagcaattatctgcctcagcctcctgagtagctgggatttcaggcgcctgtcaccatgcccggctaactttttttgtatttttagtagagacgtggttttaccgtcttccaggttggtcttgaactcctgaccttgtgctccacccgctttggcctcccaaagttctgggattacaggcgtgagccaccacgcccagcctaagctttgtatttttaatagagtcggggtttcaccatgttgtccaggctggtctcaaactcctgacctcagatgatctgcctggcttggcctcccaaagtgctgggattacaggcataagccactgcgcccggccctggcctgcttagctttggcctctcaggctcccctggcaccgtgctttctatcagccagctatcctctgcttctgcagagcaaggtgattcactgtaccagacacagagggacaccttgcccccagcttctggttgctgcacaggctgtattaatggaggaatcaatggtatattgaaggaggtgatcactgtaccacctcctccctccttccaccctggccaggccagactagaacactgttctgttctgggctcttagagacacacagccacactacagagcgggaggcccagtgggtggggagtgaccttggccatgaccaagagggggtggggcttgttcagccctgtccagggaagagggcagtctcctgtcttcagcagagaaggaagaccgacctgttctgggaggcccaagaactggaaggactgggagggaaggactgggagggatggagttaagaaagaaatctgtaccaggcagagatgcccaaaggtgggccaggctgcccccaccaggggcatccatacctagtctacatggccactggcagagatgccaggcagcggtgagcatgccaggtggaggcctggcttcccggctcactcagcccttgccctctccaccggggagtataattgtcttttcccaatgggccgtgagctcttacgggtaaggactgtgtccgcagcagtgacaacaccagcagctgactcgatcgagttctagatggcccaggcacacagagctgagatgttgatgtggataataataataatactaacaacagtagtggccgccctgtgttgtgtccgaggcagacactattcacacgtcgcctcactgaatgcacaggcactgttattaccattccaattttccacctgagaaaacagatattcaggagcctgcccagggtcccacagggggtctgctccagagcctggatgcaaactcactcctctctccactccgggtcctcaaggccacaccagccactccggtgtggccagggactaaaggttggctggaggctgcaagccgaactccctctgcagggtcacagggcacattagcatattaaaggatctgagaagtcctgcggcaaagatgccaattgaagtttgttcactccagcggttacccattgactttgtctttggtgacacgtgttaacctcccagcgttcatgtcttcttcaaaccatgcttggggagatgctgtgggtgttcatgcacccgtttactcaggcttttggtaaggggctgctgtgtgccatgcaggggcctggtgctggtgacatgcagtggtgaggataggcctgtccctgccctgtgcctccctggtacccagctggtggctggcacacagtggcacacgtgcctgcagcaagtgagggctgaatgagagtgggagtggacggggcagaggagccgggctgggccatgggaaggcacgtgtcatgaccacacgcggtctctgagcggccccatctcctcccatcgtggatgctgtgtcaagacctctggccacacccaacctcaacctctccagcggcacataggcccctgggaggccccaccagccctccataggcagggtcagagccctctgcccccaccccaggacccctgccaggcccagcacctctttccttcccttcaggctctgtgtctctggccttgacattctgatcacatcccctggcctgcctggaatactaattctccccatatgaaaccatccgtgtttaatttttttaagaggcagacagaaagacaagaacaggggagacgttagtgggtaggaattagagccctctttggagcctgagactgtgcagtgactccacccactcgggatgccacggcgaccctaacacgggccaagcttggaggccaggaaggacggtggccttttgaatacaccagagtgtgctatggtcctggcttgggtgggaggattgttttttgggaccctcaggagctgagatcacgtggggatagagggccggcagccccgctgtcctctaccacctgagagcccagagtgacgccactgccctcagtatgcttcctgcagccccagagagaggcctcgggacacagagaagagtggccagatggtgggattggcccagcagccgctctggtgctcctgcctttggctgtgctgggcctcagcagcctcctgggggactggggtagtggcccactgtcaggagggctgttgtgggaagaacagtaagccttgctggaggggacaggacagtgctaatggccagtgtccaggtggggagttggggcccctcgtgcaacttcagcagctgtgccccttgggccgagtgtcttctgaacatcagtctccttatctgtcggatggggggatggtggcggcaacgtcctaggctgtggcaaggactccaggaggtgctgtgcaaacgcccgaaggactggcccagctctccctgggcatgcacctcagctactgttgtaacccaccaaccccaaccccaccccagcctcacccctgtaggctcgtcccccacatccacctccctggcaccagtgcagccctggggcaaaagctgcggtggtgccacccgccccccaacctccctacctggcatcctcatgtccccagaggaatgaatgagattgtaacggcaggaaacttgacagaaaatgaaacgtgatgaaatcagctacgtgagtgatgaaatccaaatcccagcctccttctgaggcaggatgaactctgtcccacactccgtgggctgcagaccctgcagcggaggctgccactgcccacttcccttgccccaggagctggagtcttaggccccctccccatccctcttctatcctcctcccatgccccctccccaccctctcttccctccttctcctctcccttctcccctcctcctcccatgtccctcctcatcttctcttccctcctcctcctctgtcttctttctcccctccctcctcccccttctcctaggcacagtcagcagtcagtaaccaactgacccagaggtcagaggtcagtgctgcagattctgccagtgccccctacagggcagaccaaactgtgaccaccctggctgtccctccccctgccctctcctgctttacttcgtccctcagggctccctgggagtgcagggctggacccgactcgggctctgcttctgcagagccccagagacaaaccccaagtgcctggtggagagacgccgccaccccgccccccttttagtcttgggatgtggtggagagacgctgccacccctgcccccattttagtcttgggacgtccccgcctcagagaagtggtctgttggtggctggggacaaggcctggggctgcgcagtgctccagctgggacccctcctgcggcgatggctggccacagcctccacttcctgcctcatcccggagcctcctggcccagccacctgtgagcaggcagagccggtcgagggagggcccggggaagcaaatgtggttatttggcctcctcctcctcctccacctcaggggctgcctcgtaaattattatcgacccactgctgcccgggctggaggtgagttgaggaaataaagcaccaggctcagtaattgtgccctgctgcctgagtttacttatttgtggctttcctacccactaagaaacgagacgataaataactgctgactattagactcccagacgggaaaagcaacgcacgatgcatttcccgaggatgagcaaaggctggagacccacacgcccgttggcctttcccacaccctgtcaccctgtggactcaggctgttcggggcctgaaacctggggcctgggaagacaggcagagatgagtccctagccccgtggggagagggtgcatatcttcccctcccccagccccattctagaaggttctgggctcaggatgacacagctgttgagtccagtcacaggctttgtgtttcccttttgtttgttacttggatggagggccttgtcataagtgctgaaacaatgaagacgccatcttatccaatcctctcactttacagggcgtggggggcaaactgaggctcagagaggtgaatgccctgcccagggtcacacagggcagagctggtctcgactccagcaccatcatcctcctcattctttccctgggggcaggacacctatgagtgggcacagagactggcattaggagcccttaccctcctctcagccctgcccccacgggactggcagcttccccgatggcactgtctcagggcctctcaccctccctcaagagccccactttgtccaggccctgggccagcttctctcaaggcatcacctccaccccaggagtggggccaggctgggactggggagttccttgctctgagaacagtctccccaagttttcagccgctttctctggtccgtggctgccgacccggcagctgggaaggaaagtgcatggataacaggaggaggctggagaatgccctgggggagtcaggggagggggctggacccacacctgtgttgaatcccacccctgctccgtgaggtgacgactcctccatgttacagatggggaatctgggctcagagatgataagcctcctgccccaggtctaggggacttgcgggccctattttgaccgagtttgggtccgaatccctggcacactgggacacttggctgccctaccccggtctcacagctggtaaacagcagcaccaagccctgctcccccacccagagcccggggccctcacctccgcggtgcaatgccagcccctcagcagagcacttgtcccgtcagatcactccccgacccgccctgtgcctggaaggctgctggtcaccagcgggctcctgggctcctgccttccggctgggttcacagaggagccacagcagcaggccggagggagggaggacagccggcggggcacgagttcctgaggcttccctctcttgtcagtggccctcccagtggcttcggtggctctctctgagtctggtaacctctgcctcctccccagcctccatggtgacagctgcccaccttcccctgttggtttcctaaccccgcccatgactttgtgaaccgcaccttcaatacacccgattccgcctgcgatcctgcctagtgcccctgccaagtaataacagaacagccactcccacccaccaagagcccatcatgtgccaggctctgttcagtctcttactgtctgctgtcgttcatctcgtgctcttagtgacctggggaaacacacgattatccccatttcatagacagggcagccgagacccagaggggtcgagtgacttgccgtgggtcacacaaccaataagggtggcctggtggtgtgtgctgatggaaaaacaaaacccggggaggaggaggagagacctgctccaggccaggagaaacacactgtaaagggtggtgccacctgcaggtgagaggagagtcagcctctgccgtcctggtgaggaaggggaggctaggcagccagctcctgagcgcctgccctgccccaggcccacagccgcacctgcagggctcacagggaggatgcttgtgccggccttccacaggtgaggaccccgaggcccgcagacagtcacgcccaaggccccactgccccctggtctatgctgcccctccctggccccgcctggccaccgagcctagtgacgcaaggtccccccatctcctggctacggctcccctgggtgcttgcctggtccctccccagaggaggcagcgacttttaccaacctccccaccctacacccctggaggagtctggctgctttgggtccctgcggggttcaactttatttttgcagagcactttctgagtaacagaactcctggggccctggggtggagatagaggggccaagtgcctatgggaagagccaggggaggcccagagagccagtgacagggccaccagggcctccaccaccggggtgtttccacaccacagcccctctcgaggccctcccagctctggcccctcgaacagctgaggaggcccggcctcccctcctgacacaatccaggcctctccacctctcccctgtcgcagaaagaaggagctaagccctgtgtacccactgccttcatctcctgaaacagcccccaggagagtggtctgtggaccccacagtgcagagaagccagccctgggcaggcgtccagcctccggtcattcagacgtgcacagcgtgctctgtgtactgggtggacagggtgagggaccacaaggaccaggccaagcatgcagcatcatgagatcatcacaggagagtgaatatgaggacaaggacccgtggctgcatgtcctgcagggtggctggggccgcgggcaaggccagccttgcaggctgcagcgagtgaagctgcaggatgctggtaccagctgcgcccatttcttggggactgcgtgcttgcctccaagcccagagctccagcaaggggtggcaactgtggagaggtgtggccaactggaccctgcccagtctggttcccagagaacctggctttcttgggaggcagacgcaccccggagtctcctcgggctggggacaaccggcctgtggtcagggctacagccgtggcaggggtggcaggggtggcagggttggggtgaggtctgggtggcggaccctgttcccacatccgaagtgacaggagcaggttgatttccctgcacagagggcatggaactggggcaggggcccaggagagcagtgggggcgctgcacaggtgcacttctgccagatccaagaatcggagacctcactgaaccgtgccgtcatttattttaatgcctctgtggcccacatttgggtccaggtgaaatatggccccatatcatttaccagtggggatgttaattgtgctttgctgtgggaggacaaacacatccagggggtgtcggtcactgtggcagctgttcagggtggccacgtggctgctgtgtaggtggaggccggggaggggtcatctccctgcgtcaaaaggcttctcttcataccccgccatcaaggagagaggcagtgacagctcctgccaggacagggaagggctagcgggctgcctgctacctcccctcccagctccatccccagccgccacccctagcaccgcctgtggaagtcacgggctagttggaggagcggatgagggctcacgtccagctccacagctgcttgggtgatctgggtgtgtctacatctctgtactgtgagcacgagaaccttccttcttcatgcccttctccccctctctgtcttccctgaacacatgatgtgagtccctggagcatgaataggagtctcagacagaagtggggctgcaggggccggaaaaagcaccccagtcgcagaaccgctgtgcaaaggcccggaggcaggaggaaggctggctttgtggctgtcctgagacaactcagcctggggcagggcggtcagctaggggacctcagggaagggcctggacttcctcctgagggcatggggagagcagagggacaggtttggactggagagtagaaagctgggggtggggagggaatgttccatcctctgagctcgggggtagtcacaagggcaccatatgcatatgtaagattcacaggtcttagaactgcacaccccaggctgtgcaggtgccggtatgcactttacgcctcctaaaaccacaattcaacaaaggaagcctccctctggccccgaatgcaagacctggggcagggtgggctctgagctaagcccctcctccccactccagccctgggggatcccactgttgagtcccggcttcccctgaatggctgtgtgtgcgcagccacccaccccaccagtgctgagtgctcatggcctggcccagccgactcagctcacagcccccagggctccatagggagggagggcagggacaggctgtggccacctccacccccaccctccctccctgagcctcctttgaggctgcaagcccactaaccatctgctgaggcaggggctgggggcgcaggaagggcacctgagcctccccttctgtgggggtggggtggcccctgagaagggccccctttcctcaccccccaggactttatctgcatcatctcttattcctcctgcatccctgctggggatgctgttattccccgacttgcccagctgaggaaactgaggcctgagaagttaaggttgctgggagaagcaggcccccaatggacaacactgaacttcctcctgggacagcctgcaaggttgcccctgggcctgtctgtgggtgaccgtcccacttcccaaggcaggtaggcccagcctccccacagccatgtggggcagaggaacaaggctgtcgctgtgctggcccacgctgcggcctggggtggacccgggcgggcggcaggggacgtacttagtggaagatttatgagctgggttaaaatttaatttgggtggacaatcccagccagctaagccggccgccccagacacatggcctggtcccggcagccccgtggttgggcctggcctccctgccagtctcccccgccctccgtccccggaaggcaggcagcccgccgcccccagagaaatattagcacgaattcgatttggggtgggagcagcgggcgctgaggcttgtttgcacttcagttcaaaattgaacaggacagaatcagctctggccaggaaccacctccgtggtgcccagggacagcgctgctctccaaggagccccgctaagccttccagctccccacctgtccactcgggcgtgctcctccaagctgccctctgccctcaagccccatcctctgcccagaacccccaatcctccctggtgccccactgcatgggcttgaaacctactgatatgttgggggatctgtgcaatgactgaacctctctgagcctcagtttctttatctgtaaaatggggataataggacccattgttatagtaaggcagagttagaactgtgtctgcatgtggcctccccatagacggaaacccttgttgtgggagggcagcaccaaggctggctggagggagcagggggactgcagagcccccacacacgcagctctccctgtgagtcctgtggtcttgcgcccctcccgggccggggcattacctctttggaccttggggctacggttcttggttgcccagtctgggctggcgggtgagggagaatgctggggtcaccaaggcacgaggtgtggcctagggctgagccgaagcagcacgggcacgtggacagccctgctccctcctgactggccctgcccaacctgcccatcactctttgaccccactgccatgcgctgggtcccttctaggcgctgtcctaagtgggtactgtccacccattttacagagaaggaaagtgaggctcagagaggcaaagaaactgcctcaggcctgcagcagcgatgacccaagcccaggccccgtgaccccaaggctcactgtcctcccaccctcgctgcctctttgctgctgcctccacagcgcctgcccacagtgcagggagggggcttcgcgggaaaggtaggcagctcaggcagcgggggcagagcaggaaatgcacgtgggcagagcacgtggcaggggctcctcgaggctgggggacaggcatcccccactctcacacatgtgttcctgctgcctctggccaggatccaggcatggaaatagccgtgtcacctttggaggctgagtccctgtcactgctttgccccaggcctgggagggggctgagaggagggggaggcagcatcctccaggactgcagaaggcgcgcgtgccatgcactcatgtacaggtatacctacacgcacacgctcatagatgcacacacaggcccgtgtgcaggatggcagggacacactatggaaacctcagtctctgcctcaccaccagctctgcctcctgagggaccagtgaaaggccggaacccagcacgtgttccagttgtgtaaatgacactcttcatgtcagcccacagcagcgccgggctgccgcatatgtgcccctgcccacggggccggccgcacgcccgcctgcacgctgctcacactcgcccagcaccccccaggtcagcgcccctcaccggccctggcagatccgtcggtctgttgatgccaacccctgctgactcaccccttgaccttgggaatttggggctggggcccttcaggagtcaccgaacccccattccacacactagcagaagacctggagccagtctggcgagtcccattcctattttgataaccaggtcctagctctgacccggcgttggcatctcactgcggcctctcattactcacttacatgcttatttatttattcccggctcgttctcgaaaggatttgtggcagcttacagaaatacaacataatacgagaggatcaagaggagggagggagacgggatggaaaaaagccaggcacccgaagcggacaggctggggttcaaatcctgccatttgcttcttttatttttgggggacagagtctcactgtgttgcccaggcagtgttgccaggctggagtgcagtggtgcaatctcagctcatggcaatctccacttcctgggttcaagagattctcctgcctcagcctctggagtagctgggactataggtgcccaccaccatgcccagctgtttttttgtattttagtagagatggggtttcaccatgttgccaaggctggtctcgaactcctgagctcaggcaatctacccacctcggcctcccaaagtgccgggattacaagcatgagccactgcacccggctccatttacatattatactgctgtttactcattcatctttggcctgtggagtcactttgcccccctgagcctcagtttcctcacctgtgaaatggggatgatgatacccactgggtgggttgttaatgggatatgagaaaacgccaggggagactaagccagcacttggcacacaggaggtgccaatggcacacggcagctgctgtgacgaggaaggaaggcagagagaggtcagggcagggacagatgagggcagagaggcagggggccctgggctggagcaggcacagccctgcctacctcggtgtctggtgccctgtgggtcgtggtgatgtctgagctgagggaaacaggggaaatgggagcaggtgactttcaggggtcccaaatgccaaggcccaggaatcccctctgagtcctctcaggaggatgctccacattccttgtgtgagacccaggggcctgcagggtggagcaggacaggggtctggggctccaggctgggggtccccaccctcccacctggtgcctgcactcagaggttccgtcttcagcccagggacccctaagcttcacctgaatctgaaccctacttccgcctggagctctgactcccacggccaccaccgttaggcaccgagccttgtttcaccccctgggaccagctcttggccccagcctggccctcagtccctcagccctgccctcaagcccctcacctgcctgcccctcaccttaggacgcccccacttcaggctccctcccagccatcaatcactccagccatgctcctggcccccgtcctgccttccacggtccccccggatcatcctccacccagcgtctctgctggctgctcagagcaggaggcaagattttctccaccccccaggctcagccatcctctgctaagcaggggcccagtgctgccgagagcaccaatatttaagggatgtttcgcgcctgctcctggctctggcctgctcctggctctggcctccctcccgggaggctccaggcgcagccacaggagggcctggggagatgggcacagccccatctgttctcgccacggcccctctgccccagcccaggacgctgcagctcacacacttttcaacctgtcacgggatccggcgcccgctctgtaaatggctgctttattgacacagctgtggggatggcatgtccatttagaacacagcaggtagaacgcggcactcgagagccgggagtccagagggctgcaggatgctgccaagctccagccccaccaccgagcagccactggaaccacggcctcagtcttcatgtctgtgaattggggagaacggacccggacctctctccggcagctccaggaggcagtggaggagggctgtcaggctcggctctggacctggagttgggatgctgtgtggccaacccccaagcaggaacaggcttcagccacacgccctcacctgcatggttcaagcagaaaagcatgtatggggcgccgactgaataccagagtctacacccagagtggtccccttcctcaccttgctccctgtctttggcctgtgccttcagccgctctgataatacccatgatatgtgtggtttgcgatggggtcgggggggtgttacactgatgttcactgaaccccacgtaccaggcagggcttgtcctgagcccttgctggcactctgccaatccctgtatgagggtcacagctgggacaggtcccaggaccacagtgctgttgtaacgtccctgagcacgcccagcactctagacacctcaggatatgcgagttcatggtcattgattttaaaatatgaagtgtaggctgggcgtggtggctcacgcctgtaatcccagcactttgggaggccgaggtgggcagatcacctgaggtcaggagttcaagaccagcctggccaatatggtgaaaccccatctctactaaaactacaaaaattagctaggcatggtggtggacacctgtaatcccagctactccaaaggctgaggcagaagaattgtctgaacctgggaggtggaggttgcagtgagctgagatcatgccactgcactccagcctaggggacagggcaagacttcatctcaaaataaataaaataagaagtgtaaccttgggggaagatggcagaatgtcccctcattaaacagacttcaacaatgtcacataattccaacagactggagggacttcaggagcagtggggattctctcaaggtctgcctgcagcccgagtcctcagtgccagaaacagccactgatggctgctcagggtgcctcttccctccccatcaccccaagagttctcccatcactgagcccgaggacactgctggtcctctctgagcaccactggctctaaaagccacccctggatccagccgggggcctgtcccctctgcacgtcctccttccccggtcctgggtctgagaggtcctcagtagttgaggtctgtgtagtggatgcagggaggggaggctcataaacgtaactgtatcataaacgtaaccctcccttgctgaacgcctacgtgttgagcactgtactgggtgtcttgtgttcaaccctcgccacctctctttgatttaggtgcttatttttgtccctactttacaaatgataaacctgaggcttctttttaggggatgaaaatgttctggaattacataggaatcatggttgcacaaccttgtaaatacacacaaaaaaacccgctgaattctacacgttgaaggggtgacttttatggtatgtgagttatatctcaatgtttaaagatgaatttgaactaagcttataaagaaaaatattcagccaggcacagtggctcacgtctgtaatcccagcactttgggaggctgaggcaggcagatcacttgaggtcaggagtttgagaccagcctggccaacatgttgataccccgtctctactaaaaatacaaaaattagccaggcatggtggcgcacgcctgtaatccccgctactcgggaggctgagacaggagaatcgcttgaacctgggaggcggaggttgcagtgaacagggatggtgccattgcactccagcctgggcgacagagtgagactccatctcaaaattaaataaaattccaggctcagagagggaaagcaacttgttcaaggtctcaagtgaataacacagctgaggcctgatctcaggtcagtttgtcccttcctgtgatacaaccctgcctccctcatttacgactgaagacaagcttctgtcttggtactccctcactctggagctgttgctggctccctgtggctccttcctggggtccaagtggtccccagacccagctgtacctccagatggaagtgccttcttctccctccttacctccactccacatttctctgagcgtgcgccccactctctccctgaacccaatccccagtccttcctttccccaaccacacctcctccaggggtctctgctcccacaggctttgagtgaggggcctctaggcccaactctgcctccgtctagcccatctcccaccccacgcccaggaccctggactcctctctgtgcccgtggcggctgcggtctctctcacctccaagcctttgcatttgctggtgactgcttaaggcacagttctcatccctgccccattcctgcccctgcgtgcccggctgctcatttcttggatcttggcttcaacacccactgtcttcgcacacccccccatccccaacgacccccttccctcctatcatcccttgctccaaatctgtctcccctttaaccgtaacctcccagagggcagacccctgtctgtctcattcccagaggcatctgcagcgccagctgcacacagcacaggtgggagcccctgtgacccctcaagccacatgccagagcaggaaggggccgtggggctccctacacaccctcttccctcatcccacacacagtcgtcagcaagtcctttccaaatccaatgaatccaaccacctccctccctcccgtccaccgccccccactgcaccatctcttgccaggagacagcagcgcctccccaccgcccccggtctgtccgcacagcggctcagcaagcccctgggaacccagtcccatcaccaccctcccctcagaacaaatccatgttccttgtcggagtctacagacctctgtctccgccattcaccacccttaaccgcactggcataaagatatgtcctggaacctgccaaactcccactctgagttctcgctgtcccctctgccgagacagtctccacggccagctatgtgtcctcaagctggcccctgcccccacaccccctgctcagagaggcctccccccctgcagtcacccgtcttttgggtttccttgtggcctgtctccccagcttggggtgccctccctgagggcaaagcctggctccccctttgctgctggggcacctcaaagctcggtgaagagcacatatttgtaggacaaggatgcaggagccatgatcacctcaggagagggccaggcaatcctgtggccaccccccatgggaccctgtggggcacagggccgcgctcacaccactgcccacccagacagctcccctcccgggtatccctccgatgctgcaaggggaggccggggtggaataaccagattagcctaagtggctcctcttgtttcctggcgtaattggattgaggccatgtttcggtgcagctgcatttaatattgtaattctgcagccgttcagccccctgagagcagctgctgaacgcagacgggccagggactgggaggggaggcaggcctgcaggcaggggtccaggctggagaagaggccagggcaggggtctcatgcctgggacctgtgctgagagcacacctgcccacctcccttctggagggcacgtcctactgggcatgggcatggccagttctttctgcatctctggggcgggcacagagctgggcacaaggagggttgaggttgagaggaaggaaaggagtgctgcctgcagccccaagccggcaggtgcgcagggcagtgtgactgtgaaagggaaggccattcccagagctgctgtacctccctgtgcccgatgcctgggccttgggcacggggagagcgtctgggacccccgctgaggaggaggcaggggaaaggaggccaggctgagcacgggcccatcagggcttagctggctgcaggccacagtccccagagggtctaagggcctaaacatatctgctgttgccaccaatcagggggccctgggctcctgaagcccacccatagccaaaggagactccttgcccaaatgtccgagcggcggccggaggcccagccagggcccagtccagccacgggctggggactcctccctcggcaatgcagtgaggggtagtgaccccctgagacctgtttgaatgctgatgctcccagacaacaagggggcacggcaggtgggggtgtgccagcatgtgcctctgagcgtccatctatgagttctgttcgtgtgtgcccgtcagtctgtgtctaggtggaatgtgtgcacatgtgcactgggagtgagggaccccccctgccccgcccctcaccttcccacatgcggcctgcagcctagtctgtctccacaaatgcccatcagtacctgggtcctgaggcaaggctgatgggtctttaaaaaccaagaagcttggggggaaaatccgaggacggggcacagctggggagggacagagggcagggcagccccgtgacaggggcccccaattcccagacattgcttctggaagcacagcccctgagagatggtgctggcctccctgaccccctggatgcaaacatttccagctggccgcctggggtacctgttgggcaaatgaatcactgggtccctgtggctggtgcctttccaggtagctcctcctggaggctcagacccagttctgaagacctcagctgcagaacagtttctccatcatcagggagaaggggttcaggcctacccgaggctggactgaggtggagggcactgggctgaggcctgtggggtctggggtctgtggacccccctaccctgccctatctccctccctcccatctactccccacagctcaagggcctagcgacagctcccatccgtcactcagccctatttttaggaggtgataacccagctgtgaaaattctctccgtgctgatcccttccacatgaagaagtcttagccccaagccgatgagtaagtgtggcagcttgggaaggcaagggatggaggcaggaagaggcttgcaggaggaccggggggctgctcacgcagtaggagggacgggagcccagagcctgggtcccaccttagctagctctgccaacaacaacatgctcatcgcagtgttgtcctggatcaaacctccggctcctgaaaacatggaggaccaacctctttctgagctgtgtgttcttaggcgatttcgtctctctctgtgcctcagcttcctcctctggaaaatggagataatgatagtatctgtccaataaggctgttgtgaggatgactaagttctctggccgagaacttagagaagcaactatgtctccagaccccagtgccagcacagggcccggcacagatgagacatcatccgtccatccatccattcgtccgtccgtccatccatccgtccatccatccatccagtacagttgaccacctgtgatgtgccaagcactgctgtgggcactggagacaatcacggtctccaggctgctctgggcaccagggagactccagacctgtccctgtccctaaccccaagtcagagcatggcatgtggggtcttttgacccatgcagtggagggtcatgggggcacctggtgagggctggagggtcttgctaaggaagcaggaccctgcatggtgagatggaggggcaggagcacagcaagggaagggtgatgtgttgggagctgggaaggtcgctggggtcagggcaggggcaggtgactggcagggccagcctgtgcttgagggagaggcctctggctgcaggctggatccaccaggaggctgtgggaaggagggattgagagagcgacttggaaccagggcttccttcaccccagcctgaggtagcagcatgccaagaagacagggccaggccgggcacagtggcccacgcctgcaatcccaacactttgggaagccgaggcgggtggatcacttgaggtcaggagtttgagaccagcctgaccaacatggtgaaaccccgtctctactaaaaaagtacaaaattagctgggcatggtggctcaagtctataactccagctacttgggaggctgaggcaggagaatcccttgaacctgggaggtggaggttgcagtgagctgagattgtgccactgcgctccagcctgggcaagaagagcgcaactccatctcaaaaaaaagaagcagcagcagccagggccagattcggggtcccccttcttctcagccagagctgtgtaggttgtcactccatatcaggatggaatgggacaaggatctggctgctgagggaaggagggcagcaggccagatcatccctccacctctgcctgttccctcggtttgagcccagctggggccctgccacctactagctgggcagctttggggaagttatttagcctctctgagcttcggttgcttccatctgtaaaatggaaacaatattggattgcaatgaagaaatgatgggtataaagtgtcaagcttgggatagtgcccagggaacggtttagacccagaaagatgacttctgtctaaacagggtgatgggatgtcacctggagggaggggccaagggccagccaggcaggtcccagcctatctagacatggtccaggagtccctgagaggctggagctggcatgtggatcagaatggtccaggctcatggcctcagaccctcatgcgctgccctgtggggtcagcctcaccaaccgttttctccaagtgagagaaagaggcccagagagaccaaggtgcttcctgaagccacagtggagcccaggccttccccaaagccagaaccccctgtccgcacacaggtggctagggtggggtcttgaattcctggacctcccttttcaaccttaaggagaggggtacagtggtcaggagcccaactgatttaatgggaagtgaccccttttgccccagggtggcatctccctgaccctgcaggaggctcccagatggaaaggggcatgttcaggatcctggagtgaggtcagagctcaccaggcaggccacaggcttccccaccccaagccccaggaactggggagtgactccattcaataacctgcttgtttcatgagaagcctggagcctggtcacccctgggcctctggggcagcagctcagggacccacagggcagtttggtggtatctagctcctgggataaagggggtcccactacttggacatgctgtaagggcacagccccccttggggaaagcccagttcagcaatgggagaagggctgccacggagggcctgcggggacatggaggtgacatcggaattgcttctccacacgttatttgctgcgtgaccttaggccagaaactgaacctctctgagctctgttcctcatctataacatgacaggtcctccctcccacggctgttcctagggtcacgtgggatcctgtgggtggaccacacccctggagctcagcacaggaagctgctattagaaactgcagaggtgagagggcagtggttgggaaatcctcccagagcgggaccttgcagaatgcataggagctcggcagctaggaaaggtggggaaaccttcctcatgagcctcacacctgagaaagaggaaagaaccccacgaactgcattctggggccttgggggaagccctcctttctctctgcctcggtttccccatcataaaaggagaccattgccctgagccagcttcatgtctacttgtgacattctagatgactctttctttgagaggaggcaaggccagaatggggagggggtattccccccacccccatccccagctggccgggctgacagtggccctggagcagacatgctggggactcagggcctggccagacgcctctgccttgtgcctgggcctccaaagcaccctgggggctcagggccccagcctccctccctgaccttcagcccaaccaacccttcaaccccagagcccctaagtggctgggctggatccgggtccccaactgcatctctggccctgcaaggctctgggggctgtgggcccccctccccaacacagggctggatgcggctgctgggtttctcagtgggaagctccagtgtttaccctgccgaggcccagcttttactccccaaggagtgtgtttgggaggcgagaacccacgcgcacgcacactctcgcatgccatctgatgtgccagacctcacaggctcccggcccagacgtacatgtgcacccccagcgctggctctggcctgcacctgccgtacctgggccaggccagtggcctcagcacggcaggcaactggcactaattttgaattagttaagttaattagtaagtgccacagaggacctcagctaatccttccaccaacctccagtttcatgctgtccacctgacaggtgcccaaactaaggctcaagggagttaagagtagaagccagaagttgcaagtggggttcaaagacaggtctctgggacccccaagtctggtctgggctgcctcagagcaaagccaggatgggcatgggggagtgggagtctgctgggggcacaggacactggttaagtgacagccggttgatcacagccagctccatcagcacagagcgggtacccagaagtatctctgaagaaaccgatggccggatgagggggtaaacttaggcagaagcaggcagccctgggagtctgtgcctggtgccccgtggccctcagaaacccacggtgggggtccctggccccctccgcagcctctttgcatgtgtctgggcaccctggagcagggacaagtggctctgtgccgtcaggagctgggcctgctggctctgcctctggctgcctgtgggtgggtcccgacccctctctgggctgcaggacccttcagaagacagggcagttagaacagatcagagggttccactttggggaaggtcaccttgagaacctgactcttttgagaaaaaataaagcccctgctccacacgtaggtttatgtgggattcggggttcacagaccctcagacgctctggttggggaccactgagccacatgcagggtggagctgcaacacaaagcaagacagagatcaaccccagattccaaaagcagttgcttcttaatgtatttctagtgctttaagacattaactcctctaatccccagaacagccctataaccagggcatggggagaacagccctataaccagggcatgggggcgagggggctttgttatccccatctgatgtttgtggagaccaaggccccagcaaacatggccaaggccacacgtcaggatgcagcgcagctgctatgttattagtttctgtggcgggttcacgggtgcctggtttatcatcatgctcgtaacttatggaatgccacatgtacgtttcatatttatccaatgttatgtaattattatttttttttttttaaatgagccggatcagctgaccttctaattttggcttctgggattcctgcattgctggcttccacggcctctgccagaggcaacccccaaaggctcgccctggtgcagccacaggctgctacagttctggggcctggctctccagggccggcatcacccctgtacccatctgtgggttgggtgcagaaccagcccctccatcccacagcagctgaggatgaagcagaccctgctcccgacccccaagtccccccaggcccagccacagctcccactcactcccacccctggctgccagccggggcaggccccagcggttatgagttcagcagtcgattcgattcgggctcacatcatcttgtctgccgggaggatttagtgcgcgcggcggtcaatagtgcgtttgttttgctatcgacctgctggagcggctcaggagccagcccgttcccctcggcagctgaggcctctccagactgcagagccgggacctagaagtgtcactgggcagattaggggttgcttcttgaggcgccctcccagggctctcgccactactgcccacggcccacagcctggcctgggtgagtctcgatgccccttaaagatccatccctaccccttggcctttaggccccacaggccctgaggaggatggggcaggccagtctcctgccatctgtgactctagggcctcctgcttgacaaagggccttggtctcatgaccaccccataaccaccaagctggggggctctgtggttcccacttcacaaatggggaaacaggtctggagaggtgatacgacagaacctgtagtgggaagagcggtcatttggggaaggaaactaaggggcaaggtttcccaccctgcccagagtgggcccctggtctgggatgggccccagggtgactcctgggcgagctggccaaggggacaatgctctccttggcctcagcccagccccagccctggccataccagttaaggggaagggtagacactgggtctccatccgtgagtttcattcattcattcaacaaacattgctagagagctgctctgtgctgggcccagagattgagaccgcaggtctgggatcccagctggaatcagggagcacctgagtaccccacacaggcctgtgctgggtgggaaccctgtgggttccctgagagagagaggtacctgacagggtcttagggaggaaggctgggagggtggtttgcagctgggggaaaccaggggccttagaggaggttattttgagggggctctggggaaggatgagtagaattttgacaacaaaggcaaaaagccaccccaggtggaggtcccaacagagacaaaggcctggtgtccccaacaggtgcacagagaagaataaagagatgagtatggccgctctgtgaactgtggaggtctgaggattgaatagtcaaacccttcagagcctggaataaagacagcccctccttggtctacttaaccaacccctagaagatgtggacccatgggtaccccttccccaagtgtcccagaggggggccccattcattcctccttcctcctctcccctcttccaaaacgagaaagagcaaaaaactattattgttcacgcctcgtctcccaccagttattaaatttcattccacgaacaaataaatccatttttattgcagcgggaggagcaggcagctgttttgctgttttaccttttttatttttcaaagtcctgttaaatctgccccgatcagctgggaggcccctgaggccccagcccgagtgttagttatggtgctttctcctcctctgggaagggggcccctccgggggagaggggagggtgaggctggatcccacctgacttgcttcgagttctcgagctctgctctcgggcagccttcccatggcctgcattcctgcaaggagggtccgaaagcttcccaccagctcctatttgtttggcgttttatcccttgcagtccctcccggaggcctctcctggagaggcgtggccggctctattttataggagagaaagctcaagctcagaagggccaggaggatcattggaattctcagtcacagctccgaggcccccagggaacatgaggaggctccgattccttccccaaggctgggctgaggactggcagcccaggtagggctctgatcagtagactcagacaccccacttggtgcagcagggattcacctcacatctctgtcgcccaaccagctgtgtgaccctgagcacacgacctggtctctccgggcctcagtttccacatctatgtaaggggtataatagtgataacagcatccatctctcatgctgccctgaggattaagaggctgcagggagtgcttagcacagagcctggtctggcggacacctctcaccatccccgcctgtcccccagcttcctggccccctgctctgccccctgcagagggacattgatcccactgggcgcgagtcgggctcagggtgacatgtgccttctcagttgaggtctgggaggggcgcccaagataaatcctcatcgtggctattttttctctctgaaccatttgctaaagacttaatgactgtcgataagaagcctgttgcgtctgctgcgtctgcagtggccggcagcgtgcggaggtttcctggcgaagcatttaggtgacacagctgccggggccgggcccgggggtgtcaccagccccaccaccgcctgctctgcctgtgcccctgcagggaagccatggaggggctgcctccccatgcccaggatggggtcaggccactgcaggaggcatcagcagccctggccccctccacacctggccccacagctaggggcaccacacgggcagggagagcccctccctccccacaaaggcttcctgtggctgtgcttgcccttcccctaccccagagccagaggctaaaggggaccagactggccagcagcttgtccttggggagtgggctccaagacccccagggtccctgagccagatggcagggagaaggtctggctcctggggctttgggccagagagagacccccatcctctggcagcctcctgtgccccccaggctcttcggctgacagccgtgcctcatccaggcctggcagcaccttcccctgcggttcagagctgtctccggtgtcaggtagaactgcggatccaggtgaaggcgcccacctcgggcccccggccgcgcgcagtggccctcctgctctgctccccgcacctctccctcgacccctgcaatcgaaggttgggagaagtgctggacaccgtcaccctcacacccctaactggttctccagggctccttctcctgcccccatcctgccccacccccacctgccactgcccccggaggaatccctcttcttttctgtcccaagctgattagtgagtggcactatcaggataggcagctctagataatgttcccagtgctgtctgttggcacctgggccactctggggtgggggttcacacggatgcccatttcccgccaagtccccacacttctgtgaacctccggggaaggccgaggctcactcaaccaggctgggagggctgctcagtgacacaggcccacaaaggatgggggagcatgcccatgggggtgctcccaggttctgagcccattatctgggctcccaggctagcagctgtcccagctgcagcttctctgccctcagctgggagagacagacacgtgagatcaggacccttggtgcaggctggagggggtagagacaaaagcccctctgcacatggaaccctatctattctgcctgggcttccctggcttcagtttatctgccaatcaaatgggaatgcggggctctgtaagagtaatcggcagtaaatatgtgcaagggagacaaccatcgttatcctaggacctcatgtttgtggagggctccaatctgtgccagcccttaccgtgcccagactcttttattccttgctagcagctggtgaggtcaatgcagtagatacctccattttacagctactagggcatgcgggcagctgggcctgagcctgccagggcctggtaggcatcactgtccccaaaggcggaagagtgggacaggcgggtgctgggtggggttggggtggccttgccaccagctccccaatgcctgggactgaaggggtttctgacaccgcgtggaggtgccacatcacctgaacagaaggcagaaccgttgccaacactcccgaagcgtgagtcctgccaatttgaacgccatatcttaatgccattaatttacattttgattcaactttcttaattttacttcaacttcgcccggctccggtttgagaatcattttaatgtatttatctgtgaggcaatttgttaaataacccccaagaccggcggttttccgttctgagcttttattgcaaggctgttttaaattaaattagttgtcagggtccctgagtgcattgtaacggggatgggttcaccgccagccccctcctaaaagccgagcgaaccgctggctaaatggacagcagcaggaagtgggccgctcagctcctcccccaaccccctcatcacccatttcaggagtgtgggggtggcacagccgcccctcagtcagggaaaacaaacagctctggggccacccccagttcacaagctgggggtggcagcctgcggtgcctcgcgaggggcgtgtccgcaatcactgcaggcagggcagctccaggcaccccagccctccagctgcctgcttggggaccctgtgtgtgcaccggaggccacgggcatgttggtgcgtcacccacctagggacaggagggagacaagcctgggtcctggtccctgctttgggtccctgagccccagggggaggggctggggagttggggaggtgccgtctgtccccgtccccgacctatctcctcccttctgttatctgagctgggcgtctgtgctggctgtcacctgggccgggggcatgatttgtgagctgaaaggctcaggtattgaatctatatttcattttcacgtcagcagctgctattttgcccgataatggattcccccctcaccatcctccgggagaggctgagcagtggggaggaggccatgtcgtgttaatgatgctccttccctccctctcgtgccgcacaggtgggagtgggtgccatgcaaggcctctccccacccctcccatctgccatctccttggagccgcatgtgcctacaggtgggtatggccggcctcccacccccaccagccctgcctacttggccctggcctgtggtgtaatgagaatggcttccattctgccaggccttagtttacccaaatgagccaggacattgggcatggggggtccctgagcccctcatccaatctccccagggactgcctagcgtgagggcagaggcttgggatgccagctgggctctgtgtgaccctccgtagcgcactggggcgggcagcacctgggctggggcgtgggctccggagctatagcctgagcctgaatcctggctcttcagcttccagcagcctgaccttggccatctgcttcacagtctgagcctcaagttgcctctctgtctaatggagttctcgtaggatagttgttaggattaagttgatctaagtactcagaagggcctggaaggtaggaaggaagcctcatgcctgggggctctcatcgtattcccaccttgcaggcagacatctcagaaggagcgtgattatttacattcttttttttttttttttctttttgaagacatggtcttgatttgttgcccaggctggaggctggaatgcagtggctattcacaggtaggatcatactgcactgtagccttgacctcccaggctcaagtgatcctcctgcctcagcctctggagtagctgggactacaggcgcatgccaccacactccgctaattttttaaaattttttgtagagatagcggggttcttgctttgttgcccaggctggtctgaaactcctggcttctagtgatcctaccacctcggcctcctaaagtgctgggactacaggtgtgagccacccatgcttggcctaaattcatctttttttttttttttttttttttttgagacagtctcgctctgtcaccgaggctggggtgcagtggtacaatcttggctcactgcaacctccgcctcccaggttctcgcaattctcctgcctcagcctcctgagtagctgggattacaggtgcccaccaccatgcccagctaattcttgtatttttagtagagacagggtttcaccatgttggccaagctgctcttgagctcctgacctcaggtgatccgcccacctcagcccccacaaagtgttgggattacaggcgtgagccaccacacccggcctaaattcatctttatagccacttggcaagcttctttttgtctatcaagactcatccaaaggtcacctcccctggaaagccttcctgaggcaggattagttgtgctcttctccctgccaaccactctgcactggggtgaatggttgttgcgatctcccacctgcctgcctgtgcatggagagagggggagtctccttgttcatctttttttttttttttttttttgaggcggagtcgtgctctgtcgcccaggctggagtgcagtggcgccatctcagctcactgcaagctccgcctcccgggttcacaccgttctcctgcctcagcctcccaagtagctgggactacaggcggccgccaccatgcctggctaattttttgtattttttagtagagactgggtttcaccgtgttagccaggatggtcttgatctcctgacctcgtgattcgcccaccttggcctcccaaagtgctgggattacaggcatgagccaccgcgcctggccccttgttcatcttttaagtcctctgtagctcaggacaagcacacaccctgccaggctctctggagcctcagtaaatgttctgttttggagcggaggtagtgggtgaactcttcgtacatggcaaatctgtgaggacctggcttaaaaccctccaaggccccagccgccctcagaacaaagcctggcctcctgcatgttgaggcagctgacgcttgcccgccacctgcccgatcctgcccacccaccgcctcactgctccgatcgctcaacactctacccgctcttcatctctgggcctctctgaccccaggcctgcttcctgaaactctgtcctgcacccgttccctgggccacttctacctcacctccaggcccacgtgtagcccgttctcctctgggaagtctctccgaggccgccgagtctggctcaggtgcctgtgctgggccctgctgggcttcttcacccctgctcatgtccctagcaccagcattgcccgcctctggcttgttccaactagcctgtgctctggagtgtagggaaagaccctgagtctgtctcagtcaccatggtggccctcctgcctgccgccttgcctggcacgtcataggtgggctctggaagcactcatcaaatgaatgaatgaatgaatgaatgaatgaatgaggtccttgtgaaactctagcctcttggccaccgggtgcccaggttttagttggcagcctctgttctgtcagcctttgctggatggtgggtccaggcctggctgcctgctggggggctggcagggaggggagaggagaactcagggagggcccccctccttctatctcggtgccgtttaatgtcctgccagaggcccctactctgcatcctgttccaatgctgtcaggatacattctgggttttaacagggccagggaagaaagccagctccgtgtcagccagcaggcaggactcaggcaaggaccatgccaggcacatacgtacatatgcaccctgcctgcgtgcccatccggggcaggcctgaggcctccggttctttggccaagagaaaacagagattgcctgcccagtgcccagaggagctggagtcccggcactggccctgagcctcctccatcctccatccaatgcctgtggccccataggatctacctggacaggcaggcccctcttctgatgagacatcacccccctacccgccgcctgaacagggctgcacgtggagactacggtgtggcttggttgctttttgtccccaaccctaggctgtgcagtttgggatttttttcccctacactgatgttttattcatgtaaacccagcctgcatctgtcctcagaagacaagagagagaagatgctgaaagggagagtgggagagaccgaggggcttggagagatagggggcgcagagagagagacctcgggtttgtgtgggtgtcgctgttcaaagctggctaacctacaaagatccagtgaagatgcgctctctccctgcggctgcctgacaagaggagccgtcactcggatgcgattcattgtcacctcttagtctatcactggttcctttcaaacctctccgcagctcactggggagggcccggctggtccccctccaccaccctctctggggctggggagaaagcgggaggcattgtctgtgctaattgcattgttagagtgaaggtgctcctgttcggctgtctcatttggggcctttattaggcatgattgctggctgacagccgggcgaggaccgcgtggctgcccatggaggggggagtaggtttcagcacccgctgaggtgtgtcccttgacacccccaggcttctgcccatccagcacacactcccacgtcacacaaaccccactcctccagaggtggtttcattcctacgtgagcttcaccaggaagagacgccggggaagaggccgcattgaaggttgctggctgctgggcagtaacggagacttttggggggcacctgggactttgccaggatgcctttccccaccccttgatgaactgttcatccttcaagaaaagcacaattcgccacccctggaagtcctcctcctctccctccatcgctccttgggcttccctgacatctggcatgggtctctgctggattttcagttgacacgtgtgtggcacctccctgcacccagcaatcctctaggtgttttacaactgttaactcatttggccaatattatccctaggaagagggcgctaatattgctctccattgttcagatgaggaaactgaggcacagagagggtaagcgacctctctgtgtaccctaagcagggcgcacagagccttaacacacccagctcctgcatctgtgcctttgatcaccatagggtggcctctctgctgcccgcgttgttctctgaagtttccactcatatggagactaaactagaacgactgtcaccaggcatggtgcttttgctcaagttatatctcactgaatccctcacagctcggaagatgggccgggagccctgtccccttgcagctgtgttgtcccagccccaggccatgctggagcacggaggtggctcaggtgtttgtggggaatgaagggtcacactgagtgcagggctgggaaggactggcctaggaggcggggccggggtggaggtgcccctgctgagttctgcccctgctgtgtgagctgtgtgggcaggcacctgataaagccaggcaccccagacctgcccggcctggttttggggtgggcatctggggcctcagcctgggtcaggctgcgcggggcaggacgggcacactggaagccttcagcactctggcttccctgagaaaccttgctgcagagctggagactgaggcagggccacgtgcctttgctgctccatccccagcgcccaggacagtgcctgtacatggtggtgttcaggaaacagagaccgagcttgtacaagagtctcacagtcacctctgtttgggtgccagagtgcaggaggaggctgcgccagattggctgaaatctgtgatgcttcctgcagccctgtgtgaggcgagccttccgcctatgcccagttggttccagggtgtgggcagagggctaggcagacataagacctccaggtgtgggagggcctctgcatatgtctgagccagccacagacgcaggactccctctgggagacacccagggctcatcactcactcactgatagatgcatttactgagcacctactgtgtgccaagtactatgcaaggcacagggagtactccaagaagcaaaggggaggtggaaccctcatagtgtggcagaaccaggcccctgtgggtgctcagccagaggaatccctgtctggggaaatccaggaaggccttgcggaggagaggggcatttcagcacagctaagcagacatcccccaggcagagaaggggcaaaggcatgccaggcagaggctttggacaggacagaatctcaggacaggatttgtttgggaaagtaactaacagaagcaagtagaagggggcaggggggtgggggtggcatggtggtggcagaggcccaggaatttgagtccagcctgggcaacatagcaagactccgtctctacaaaaaaaaaaaaaaaaaaaaaagccagcgtggtggcacacgcctgtggtcccgctacttgggaggctgaggtgggaggatggcttgaaggatggcttgagcccaggaagttgaggctgcagtgagctgtgatcgtgccattgcactccagcttgggtgacagagtgagaccctatctcaaaaaaaaaaaaaaagtctcatttactcctctaaaaattaaaattggaccttgatagtatcatatcaaaagtgccctagctgcctaacttggagccagagaggcatgcagattcggaccccatccacagataacccaatgcagcaaatggggggtggtgctcagaaccctgaatggtgaacaagaccggtgatcacagtgcagagccggggaggagctgcctggggactgcggggtcagaggcaggggacttggaaagcccacgaagctgttgggcgcaggaggcaccccaaggtcctgggaggccggcctggggtctgggcgggccaagcccattcctcttgcctagcagagggccctcacctccaggctgcgggctgggggcggaggctcagcgtgaaggaagggcagacggctgcaaagtcggcgcgcggagcatccatctgccctgacagccagcaattacaccgcgtgatcgccagattactccaaatgcatttattacaggggttagaagcgggggacttatttactggcaaatccatactcattacaagactcagcctagcctagactgaaaacagctcaactgaaacaaataattaccaaagtccttccagcgcgaggctctcaggtggttgggagtgggggggacgccaagccctttccatcaagacaagggaggaggaggccgcggttgaggatgcctgggtcggggaaggtcgacgccggcccgcccggtcgcctggcggcccgggagccccgccgccgccgccgccgcggtgcgcatgcccgccaaggtcatgaatatgcaaagagcctcgggggcggggctgacacgcccggcctggagggctttggccccgttcacacccgccggctccgggacccgggcgacccgggggctgcaggactcaaagactgggcattcgagaggtagaaatgaaagtctcgcattttccggtgaaaatacagtgggctcggcacagagctcagcctcgaagttgatgaatgaatgaatgaatgaatgaacgaatgaactaaagagaagcgcagacagaccttgccccaggtcacggcgtccggaggagaacccagtttcaccagttctaatcctcaggctgtgcgcgcatgggaggccactgcccagcgtatctccaggctggggcctgctctgggtacccctcacagcacacacagctccgacctcggagccgccaggcatctgtgagggcctggagtcgcgggcagccccgacaggggccccaggtcccacatgcctcccgcacctgcctgggactctagggatccggaaacacaaccaatccgaggccttctgggtctggcagaaaggctggtgttctgctggactcctgcccccgattttacagatgaggaaactgaggcccagatcggcctgcaggcggaggaagacctcccgccgctcccggagctctggggcctcctgggcgcccgcgtggggagctgtcaggccgcttgaaatgtgggcctggcctctctgcccgctgggcagatgctggcaccgccgtccgcgccttaaatattcattcacttgacagaacactaattaaacaaagtaaggtgcattattacttgattaaattttttattggcagcttaattggtctgttagttgccccttagggagttgttcgccattcccccctgccgtgtgggaggggggcccctggacgtcccgcaccgcccttcccggccctcagtaccacagggtgccccggccccccaacatcccccaagcgccccagctgctcaggaggtcgcggttgccagcctcgcctcgcctcctcggccttcaagggctggaccctattggatcagtagcaaccaatcagcgcctaggggcgggcctctcggggtcaggacccttggaagacccaaaatgattaactgagaaactcaggagagggaatagacccggactcagaggggaaggcctgcgtttgcctcagctgggagtagctgagtgacctgcccctctctgtgcctaggcctcagtttccccatctgcaccactgcagggctggacttttctggcccaccatccatccaagagtccaggtaccccgagacccctgcggaggcacacacaccttccagcctctgagatgcctgttccccagatgagggtggaagtaccctgcaggcagggatggcctggggggcctgggtacccagggtcagcctgtggaagggcatgggatgccctctcagaacaggtgggcccacgcttccctgtccagcctccaaccctggggggacatctcttcccacccccactacagggagcagggcagcctgctgggctgcgagcctcttgggataagcccgcaacgcctcccatgtcggtggctacacgcatccaccttcagtggagccaggacccgcaagaccctcttcacagggcggcacctctcacctgcttctcccctttccccgctcggcaagaggaatctggagccagcctttgccccctttagacaggctgcccctcctactgctccccaagtctgtcctctgggggaaacacagaagaggaagagaaggaccaggggctgttccgtcctttcagcactggtcaaatttccatgtgagcctcagtttcccccagtgcaaattgggtgcccatcctcactccatccaaagagcatcaggcactcctcagcccatccagtagacagtgagcccctgttttgaaggtaggggcagagggggaaatggagccctcccacggtagcctgggtccatgtgtcactcacccccacctccagctgtgcctgggtgtggcccaggccagagtgaagatggaagctcccctatcactggtcctacccccccttgccggctgccctcttcacgccctcccacccgtcagagaggatccaggccctggccgatgacagaggaatcgtctggccaccctagaagctgccgctggcaagcaggaggcgaggtaattggcatcgctggccagggagcaggaaatgagcggttgcagccggcgtggagcgggaagctgttcagtgtcatgggccttatctgggaacaggctgcccaattacagggccgtgcccgctgcacccggcagctgccggctcctccaccaccccctcttcagtgtcctcgtggcatctcccaggcctgggcatctgctgccccttccaaaaggcatgaggcagctgcctgggaaaaggcctgacctgctcttcgcccacccaggtggcagctacaggtgccccctcgtcaggcctggcatacaggggaggacccccccccaagccctcctcacctgcaggtgactgtccagactaagccctgcctgggctgcctcctctaagcgtcagccttcggatgggggctgagatgggcaccaaggagcacagcagagccgacagtagtccccaactgctcatccgagagcaccctcggggcaggagcaggttaccctgctcagatgcccacctctctaccagccccagaaagagaggattagtcatttcgtgggtggacagcattccaccgtctatcccagaaacacagtcgctgggggctgcagtaaggtgtcatggattaggaaaataggcctgtaatgggttcgcaattgttcctagcgcagcccagtgtcgcagattacattgcgcattactcagtggctcacagatggtggcaggccagctgtcccaggaggctgagcacaaggtggggtggcagtggcagcgttgtcttgggagcccaggggtggcacagtggaaagaaaactggctttggggttgcacccacatgagttcaaatcctgtgacctcacgaattcgtgcctcggtttccacaactgtaaagtggaaaggggtgctgctgcctgctggacccgcgaacatgcccagcaccaagtacagagtaagcgctcaacaagtggctgtccccttcctcctcctgggccatgtcaggcacccctttgtgggaaggtctccctcaggtctgggtacagatagagtgggggagcagacaccctggggaccctgtagccccctctcctgaccttgatcttcaaggggtccaggcccttgggtgtaggtcctgctcgggcagtgaccagccagatggcctcaggatgccagcccctctctcatctgtaaaatgggcgtggcagctgtttggcctggagagctgggcttgcctccacgccagccttcctggctggctggggcttcctgaggggagggactgggtctggcctctctctgtcctcagaactggcatgagctggcaccatgtgggtcactccccatgaggttttaaatctgccttggtaggtgaaactgttcaccgagcaagagctgtgcacatacagggtggatgaggggtccctgcggcctgagcagagggaccccacctgctctcagtctgcagggaggaaccaccaatgggctgtcccgtcccctacgttcagcccccagccaagctggtcccagaggctgccctttctcccagccttataaacacggggctggctgtggcctaaagtggcacaggggcacccgggtccagcaagcacttagggagccgatgaacacacaggaagccctgtttcgtgagagctggtgcgacgcaggctggcctgcagggaggcctggagcctgggagcccagggcaggcttgcttaggggggtgacacgggcgcagaagctgaaaggaagggccaaggctgtacccgggctgggtggggaagctgggagcaaaggaggggctgtcctgtggcagtgtcagcccgatgggtgcagaccagctccgaccctggtaccttgggtctagggagtgtagatgagtttagaaggcagagtggaggtcatcccagggggtgggacaggccttgcaccagccagaacccttccttcagcccagggttcgcactaccccatcccacaccaaggggtccccaggatgggcctcacacccctgccgggttctctgctgtcccctatgagtgctgctggtgggcacagccccgggtggtgcctgtcccctgtgacctgtcggccatgtttctccatcacaaccagccctggctgctgccatccggactcagggctggccaccctggccgcagcctttggggcatgaggtttgggccaggcccccggctgttgcctacagatggagacccaggctccgtctctccgtccgtctgtcttctctctagtacagcctcctgttcccgcagctgctcccccttcctccccaccctcctcccctcaggcagcctggttgggctgtgggtgtaaatttccactaggagagggggcctgttcattctggcactgaagcagagcctgggcggggagtggcggggtagcgggaggagcaggaagcaaaacgtgtaggggctgcagcagggaccctggagacaggctgaggcctagctccctcagcctctcccatgggcccacctgctgcagctcctccagggaagccaaatgggcaaagacacccaggcatttttgcctgcacagcccaaaagatgggagcaaagtgggcgggggtcccaactgccggggctgcttattgccgggggtggagcagactccaagctcccttcctcctcctgtctgaatacagcctcctgccaaccctggcccacagggaggacaaactgtgctcccattctgtggacaggaggcctgaggcccagaggaccgacagcgcgtccctcccaggagctccccgggtgctgatacggctgtcggctgcaggcagcatggcatctgtccctcacctgctgtgccctgcctgccaaaagccctggaaggacaatagcagacccaagagtcaccggcctggcctggtgctaagaatggtacccagaaagaggctgaatcccacaaaccagcatcctctgtatgaaaggggaaactgaggcagtgcagaggagcagggaatccccctgccactccctcccatggcccatcatccatccatccatccatctgtccacccatccatccatccaggctatttattcctggtctaacatgcaggccccggggaatagaagcaaaagatgatgtccctgcctctgctgggctggctgcctcgtggagggacagagaaagtccccttgtgctccgtgctggaaaggacaccagtgaaaggttcccccgctcctctttagccccctaatggggcaggggagccacttaggatggggacaagcagaccctgggccccaggagctacctgccctgccactagctcccgtcctggcctgtgcaaagcacccatcccccatcgtttcttgtgaatgaagggcaactccacccacccagaaaccgggctgcttccagctggtatttaaagaggtgtctctgagtgtgatgatggcatttgttcctgtctcccgcccactgcatggtgtcccgctcaaggcaaattcgaggcaaagctactggctgcccctcaccctgctcccggcccagaggagcacctcctgcaggctgggctccatgccaggccctgtgctgggcatggtggatctggggacaactaaagcccagggctgctctcaggacacacaggttggcggtgatgagggtcaccttctggaccaggctggggggatctaggaaggcttcctggaggaagggctgtcagcatgggaaagaaaggagaagactggcagagtctggatggtagtggcggtaggaaagggctggtaggagatcctgagccatcctgagaaattcagcggtgaagagcaggggagaaagagggcggtcaccaagacagaaagagtagtgggggtatttgtcacgggagatgctagaattcccttaaaagctggctggaaagtaccacccaaggaaggggtggccacttgaggagacaagatgagtgacacaggaggacccatcaaggcaggaaggggctggccaggtgggggttcaggcaggaaacaaggaagtttgttgatttgggagcaagatagaggggaatgtcttcttcaaaaagcaggaggtgaggttgtctctctcctcaccaagtactccacccattttaaagatgaggaaacggaggcccaggaaccgtggcttgccctggtagatggaccagcctggggcctgctggctggctgccactctgcaccccatcaggcacctctgagcagagagaagatgcaaggggtgagggctgccgagggtactgcacagcgaacccagcacccactttgttgatatttactggaaacaccctggatttatagtgcggtgtttgcagaagagctcaaagcctatcaggctggctgccgaaagcactcagtctcctggagaagtggccgcttctttcctttgcaaacttgttaataatccccgttgtcaggcagttcttcctctgtctaacctaaatctctcctgtcatgacttgagccaactgtctcctgaagcaggctatggtctgtcctctcaaacctggaagacctaaagacgtccccagggaggttggggcctcctttccgcttccctgccctgaccctggctagccgtggggctccaggctcctgcctggtagaactcaggggctgtggagctgggatcctcatccccattcgcaggtggaggtgacagctgcttgctgccaccagggccagggcctcgctttctgaaccacgtgggagcaaggagtcaactagatcacagtgcagagcgcccagcacggtgctggaacgcaggaacagctccgtgccatgcaaggatgactccgggccagcagaggtggtgggggggatgacggaagcaaccgggtatgcggccttgcatcttagccctgcccctaactcccatgtgaccttgagcactcccctccccatctgcgggcaggcaaggggctcgggatgccgctatagggctcaaccccactgggctagaaacaaccaaggcccagcagtcccagagagcggaaggcaagggaaggagaaagtaggggctccaggccccttaagccccttcccccaggcagtcacacctgctgaggaccccgctgagccagctgccccctgtagatccccagggtaggggccccacatccctcccacttcctgctcccactctggcccttgtgtgctgtggtgtctgagtccagggttgtccctacagcctcagaccagccttgcctccccaacccaggcctgggttcctggccacactcccatcggggccacagacatccccagcccagcctaaccctgcacctcagtgcccctggagggagggccggcctctaagtacagatctgcaggaaaccatgggctgtgacagccccagttaacagagcccagcctgcttaatctgcttcattaaaggcactaattaattggcttaattaaaagggtaacctcaaagccaggaaaactacctcctaacgaggcccaaggtgtactgaggcaccagcctagcagctaaagaggggagcctcaccccaccctgctccccagcacgcccaccccagggccccaagcccagccccagctctccgtctggggcccgcatgagcctggtgactgcaccttcttggtccctgcacacccctcaggcaggcccagcgtgctggagggaatcagaagccccacattcggaggctgcagcgcactgtttggctgcagttgagagcccggggtgtaagcaaccgaatgtaattatacccaagcacaggcaggttgcagccaggggtggggaaagagagatggccctgaccgtgaggccaagcctggccatactgtgcctatctggagggtagctgggtggagtagtggtgggctctggcaggggcataattaaagctgctggcaccacggcagaaccccacctgggcaaagggcccctggaccaccagcttccatgatcacaaagttctggagtcaggagaatcaggtttacatcacaactccacccctagaagctgggaggttgtggcaggctacttggcttctctaagcgccatttcctcatttgcaaaacactatcagggatgcccaggtcagttgccctcccaggtgggccctccctggactcagcaggagacagggctgggattgattagccatgtctgccaagagcagcgggtgaggagtggaagctcagatactgtcctgctcctgaccatcctgccaacctcagaagggctaacttcatgtcaacatttaaaccttcccacaagcttggcccaggcctgcccctgtagtcccagcaactggggagagagactaagatggaagatcgcttgaggccaggaatttgagtccagcctgggcagcctagtgagactcccatctctttaaaaatttttaaaaactctttccagggtcacagggaaataattctcacaacttctcacattgtttcaaggcctcacagcaaaaaaagttgttttttttcccccaccccgacaatgcttatttgggcttcctaccacccttctagatttagaactgagcatccctggtttggcaccggggctctgggtgccttgttgggagccatcttctggccccaaggccactctttctcactacagggaggagggccagggcttcctccaagggatttgctccaatgcagggactctgccttcctccttcccaaaatgcccccctagataccagccaagttcattagcaagcccccagctctcgcctggaccccctctcatccaagcaggaatggcacaaacacataacactgtccgggcaccagtggccttggagtatccagtctctacctctcttgcagcccccgagagaggaaaggcaggaccccacgatgggacggccatggcccccaatatccagaggatcccagctaggccttgaggtccctgggggtggacaggcaatgaagccatgggcaatgggcaccctcagaagttgtcctgagagggactgggccgcagggctatctggccaaaccactgttcagggaggagctcaccaacctcggcccctgcccctataagctccgggccgtgagctcggagagggctgatgtacacactgccaccagcccactgcccgctccacgcaggaatggcggtggtggcacaaggccgtctgtcagacccggacagatttagtctctgcacaaacagctgttagcctgcccggccgacagctctgccgcccaggagccaggagcgaggcttccgagagggtgcccccgccccacaacaatgagactcaatcagtgccaccctggggagggtgggtccgccatcactgtcaccactgagtgtcaggccaagccgccagagtccctgctgcctctctagctcgtgaccacacgcacccaccccaccacatcagcacccagagggccgtcaaggcaggtgtctgcccagagctacttcaaaagagggaccagcccctcccctcccctgattgggcacctacgtggggtaaggctgctgcccacatcatcctgtcttggcacccctggccccatgtcacagatgacaaaactgaggcctagtaaggtggctaggtgagtggtcagggggcctcaaacctggggctttgggggctgcacccacaggcagcatccatggagtgaatctctcctccagatcggtggggcacaatacttgagcctcaatccttggaatttaccaggctgtccccctgggcaaggctggtccagaggattcaggagtggggctcaggggacaggcctggctgcctgcaacaagaaagtcttggagggtcaagaaaagcaaggctgtggccgggcgcggtggctcaggcctgtaatcccagcactttggaaagccaaggcaggcggatcacctgaggtcaggagttcgagaccagcctggccaacatgacagaaccccatctcaactagaaatacaaaaattagcggggtattatggcatgcgcctgtaatcccagctactcaggaggctgaggcaggagaatcgcttgaacccgggaagcagaggttgcagtgagccatgatcgcgccactgcactccagcctgggcgacaagagtgaaagtcagctgggccatggtcactgctgggtcatggtcaccgctggacagccctcactgtgtgccaggcctgtccttagcgctgtgagggagggctgtcctcaccaggtgacccttgggaacagaagcaatagagggtatgggggctgaagcatccatggccacacagccaggaaggggcagagtggaagcagtgcccgggcatctgggtccccaccactgtcacactgagggctggccaagggcctggccccaggacccctacgtgtccagctgcccctaggtggcctgcacatttcagaagggtcagtgggaagagcactaaactcagtcaagctctgggcctcgtggtagctgtgagtcctggggagccactcatctctcggggtctcaggtccctcctcttgtggggatgggtcatcggccctccctgcatccccaggctggggtctagggagggagggatgggtggagggagaggtgggagtggcagggtgaagacggagcctgcacccggcttccctgtggggcataaggaccgagggcctggtttcccagcctccggagagatctcgagggaagagtaggccatcaccctcatcatcactttaccaggccatttcttattaatattaatagcattatttataatatggcatccaggcctgggctggctctgtgcgatcgctaggccaagagggctctgagagaggtttggcctcccccccggggccacagcgtcttggtctgggacacagcctttctagaacagagctgggggatggtggggtggatcacagctcagccaggccccagccctagcaagcagggagtctgcagagacgacttcacttgtgggtcccccacaggctggcgcccatttcacagatggagaaaccgatccccctcaggatgagaaggcaagacactgggctctggggtgtgcagcctgccccgcagatcactgagctgtctgtctgcacccccagcgtccacccccttcagcaggcacctccaaccctgaaccatcaggatgtctgtgcgggagtcagcaggtcctgcaggacaggaagccaatagaaccagctgagctcggagaccaagaccgcttggggaggctgaccttggaggtgtggcctggggaaggggcctcagtttcctcatacctcccccataaggttgtgaggatgaagcgagtcatgcgggtaatgctcagaactgggcccagcgcacaggaagtgctcagggggcctgctgacctccctgcccaggactggccgtgggcaccgctgtgaacagcacagcctttgggcatcggtaggaccctgttcaatccccaaggctttggggatcctgggccagtccctttttcgcttctctgtgcctcagtttcctactacacaatggggtgttaacaaacacagtggtctctgggggtccttccaagagtgggactatgaatggggtggctcagccctgaagtcccccagacctctcaggggctctgtcacttttcctccactgttccccactccagtgaatgtaatacctcacccacaaagtgcaggcaaaggccccaccccctgaaggacaaatatgtgatctgcctatcacccacactcagggcaggaggcagccggcaccccagtctgtctctctgagcatcagtttccttggctctaaaatgggatgacaggctctccctcacaccagactgctttgagggtctggcgagctggctgggagctctgtggggacagggcaagggcggctttgggtttgcaccatgggatggccctggtgcctggcccacctcgggtgcttggtggggatagcagcccctggggctcagaatgggttctggagtgggatccagctccgcccttagagttatgggatctgggttgaatttcctaaccctgcagagccttggttttctcatctctaaaatggagcaaaaactgcaggcactttgtagggctgctttaaggaatcggtgatgacgcataaagtgcttagcggcaggaacagtaagaattccgctggggctgcagcccctgctgccatgactgttattaaccatcctgcttgacttctgcacctctccaagcctgagtcaggccaaggactagcctcctccatggctggatctgggagctggaagggctcctgggtccctggcaaccacagcctggcaacacaggccacacccgtcccaggccaacggagggtccagggcagaccctccccgggaggcccccagcctccacagacaagggcctctgtcctgctgaccccgggtcagggcagggacagtgcactggcacaaaggctgggctctgtctgcacctcccatgggggcagctgcccatggcagactctcctgccacaatgaggcctttgagtagctgccggcgggagctgagctctcctcgaaggcccccggctctcacaagccctgtctgtctgagaggccagtgggccagagaggcagctgtcgtgggggcagggcccctgcccggccctgcttctgggcccactgcctcccgccggccagggcaggctgcaggcctgagagccaggctgggcctcaggcgggcagggcctgccagcatccccactctgaagtggtggctcaggcccagcacacagggcactgggaaagctcctatccaccatcagggtcccaggaagttgctgcagggctggggctctgctttcctgcttccttccttttttttttttttttttgagacggagtttcactcttgtcacccaggctggagtgcaatggcacgatctcagctcactgcaacctctacctcccaggttcaagcgattctcctgcctcagcctcccgagttgctgggattacaggcacctgccaccatgcccagctaatttttgtatttttggtagagaaggggtttcaccacgttggccaggctggtctcgagctcctgacctgaggtgatccatctgcctcaggctcccaaagtgctgggattacaagcataagccaccgcgcccggccttccttccctctattaacctcagtttcctcatctgtaaaatggagcctctaagtacatctgggccactgtaaagattaaatgtgatcctctgtgaatgccaggcaggtgaggagggctcagggaatgccaagctggtcactcctccacctgctttacggctgctgggggtgaaacggaacaggacagggaccccatggcatggacctggctttatctcctccgattgctgggtgaccttggcccagtgactgaacctccctgagcctcaggtttcgccttcttaaaatgggctcacgctacccactcccagggctgttgtacaaagaaagccatttatctcgggccaggaaggcttgctgggaggagttgaggaatctgactggttccacagttcagcagcacctctctggggcaggggaggggaggggggcaccacaggtgggtggaggcaggcagtgccacctgcaccgcctttcatgaggcagccaatgtcggggagtgagggtggccttccagacacagggaacagcacgtcgaaggctcagaggtgtgagcatgctagccggggggggcactggggcgaggctggtgcatcagccagggccatgctgggaaggtctgaaatgccaggctgagggcgctggacttctcaggaactagagagccactgatggtctcagagctagtgcgtgacttgactgaattcaagtgttttaaaatgtccggcagtatctggctagaggatggggagaggcagggatggggaagacttcacatcacaccatgaattcctccacagcttaaagaacgggccaggccaggcgcagcggctcacgcctgtaatcccagcactttgggacgttgaggcaggcggattactcaaggtcaggagttcaaggccagcctgaccaacatggtgaaaccctgcttctattaaaaatacaaaattagctgggcatagaggcacacgcctgtagccccagctacttgggagggtacatgatcttgtcctctagcctgagcgacgagaacaaaactccgtctcaaaaagaaaaaaagaacgggccaatcaggagtgtgcatgaagctgacctgggctggagcacagcgcagggtcccagacaaaggccagcactgtctggggtccagggcaagggtaggacccagctccctcctgtccccttgggcagcctcgcaccccagcacaggggacactttgggaacccagggccagcctggctccaccctgcctttgtcacctctgtaagcctctgtttcctcatctgtgccccaccaggctctagtagcaactaagtttgctactagaaggttctgcaggaggtggcccctgtccctcttctggggcttcctcactttggatgagagggactggggacccagtgggagtcggctgctctggagaacagaggctcaggaggccagaggcagcacccatgctaagagaagccgggttcccatcctacccctgccgctcagaacctgtgtgacctgtgtgaccttggctgcctgtaactcagtttcctcatgtgtaaaaagggaataataacagtatcactgcccacttatggggattaaatgagatacagtactgtacgtgacatgtttagcacactgcaggtccacagtgagtgctcagtcatgttacccagtgtcactgctgttattgttttaagagatggggtctcgctatgttgcccaggctggtctcaaactcctggcctcaagccatcctcctgcctcagcctcccaagatgctgggattacaggtttgagccagcatgcccacctgttattactattattgttagttctgaattccttctcatcccccagaaaagtgaggtctatttctggtttttggcatccaggggtacagtggcttatgcaaccacatggctggccagcagcagggatgtgcgcctgcctttgagaccccaggagcagtctctccaatctgtaccctcaggacgcagcaaggtggctaccccagctgaacgccgctgctccctcggcagaccctcaccccctacctaccaaattgggtcccataagtgacccagaggctgggataggggtggtagagccccctctccagctgccccacggcagggcccacgctgcagaaaccaagctgagtaaataatgacatttcctcctctctcctgcgctcttcacccctttcccttccacaaataaattatcaacatgcccaggtcccggcggagcagagcataactcggggaacaatgaaaaagcttttaataggattccaggagctgctgccactcgctcaggggccctaatggagattgctctgtgacggcaggccgccagcaccctcccgggccccttcgcccaccacccgccccactcctcccgagggcaccagcgggcagcgaggcccagctgggccacctgctgacgtcacaggccagcatctgggctgcagaaaagcactcggccgaggcagaagcacatgccacccaccacatgcacccggactgctccccctcagcccgcacaggcctgactgctcacaatgcctctgccaaggctgttcccctccaggaataatgccctcccacctggctccaaagtgcaaatgacacctaccctatgaggccttccctgattcctccctgacacatgtgttaaatgacatcacctactgtcagtaccagccccaggcccagcacacagtggggcctcaggaaacgaaggcagaatccaggcagggaagaggaagtatgaggctcttagaccacaggagacagctcagaggtcctgggcaggtccccagcttggggaggggtctggtgaggggggagcatgacagataccaaagctcaggtgctggtgacctcaggcagttacctgccatctccatgcctcagtttcccatcctcctttgtaaaggacccaagttcaccctaatgaacgtggttccccttcctctgtgtgaccttgggcaagtgactttgccactcagtgcctcagtttacccctggggtaaaatcaggataataatagtgcctacttcagaagttgctgggagagcaggcgcagtgtctcacacctgtaatcaggaggccaaggcgggaggatcgcttgaggccaggagttcaaggccagcctgggcaacataaggaaaccctgtctctgccaaattaaaaaattagccagtgtgttggtgcgtgcctgtagtccgagctattcggcaggctgaggtgggaggatcacttgagcccaaaagttagaggctgcagtgagctatgattgcaccactgcactccagcctgggcgacagagcaacactccatctcaaaaaaaaaaaaaaaaaagttgttgggggaactgccaaccaccaggtacatagtaagtgtgatataaatgtcagctactattgctgtgttgattactctcatgtgttgtaggctgagggggttacgagcatatgctttaagatgccatgtcctgggccgggcacagtggctcacacctgtaaccgcagcactttgggaggccgaagtgggtggatcacctgagggtcaggagttcgagaccatcctgcctaacatggtgaatccccgtctctactaaaaatatgaaaaattagcccggcgtggtggcgggcacctgtagtcccagctacttgggaggctgaggcaggagaatagcttgaacctgttgcagacagaggttgctgtgagcccagattgcaccatcgcactccagtctgggcaacaagagcgaaactccgtcataaaaaaaaaaaaaagatgccatgtcctggctacgtgaccttggtccaatcactttacctgcctgagcctcagttttctcttctgtgcaatggggctgttgtgaagcctcagtgggattctgcaaggtagagtccttagcatggtgctctatgaaatatgcattgtatgcagtaaacactcaataatgacctctctgccacccttaatgagcagaaggtgacatttgagccccatgctttccctttccacgatttgacctcttgcccttcccacacctgctgcctcctaacccttgctgctctccagagccctccagagctcagctctccccagctcccccaggagtcacccacacctcaacttgcccttttgtcacaaccaggcgtttagagtccactgctccctgatgcattccacctgctactgcatgggccccagacctcggggctcagcagtgccccacaagccttcctgccagagagggtggggtcctgagggcggaaagctagcctgtacagcccctctccagcccctgagctcctcagagccccgagcagggtgattatcccagcacgtgtctggcggggcctgtccaatgatccaaagtaactactggttcccacaaagcccttctgtggacacagtcacatggagtcttcatgctaaccctgggatgtcagcacgtatgccatcatcctgtttcacaggtgtggagacagaggcacagagaggggacgtgaggcgtccagggtactcagatgataagtaacaaaggtgggcttcgagcccaagttcatcgactccagagctttcatttcatagcccttctgccccagaatgtgtcctgactaccacatggcactggacagggcgtgtctccactctgtgcctcagtctccctgctctcacagtgggaagaagataaaccaggcagagcttgtcaagccagaagcccctggaaactggggtgtggcactacccagcccctctggctagcccaagcctggtgggggtctcagggctcagagccatggtgctgctctgagtggcagctactagggacctagtggtccaaccccttgtccagaagtagtgggaaactgaggcatgaagcaccccactgtgactgggggatcaggggagtgttgtctatctccctgggaccggtagacagcctaggaggcatgcagccccagtgaggcagggaagggcttccaagacccccacaggcctggccaccaggccagccccccattggctagccaagggggtggccctacccagagcctacctgactgctggctccctggggtcaaaggttacgctgcagggctggccatcacagggcctcctctattggagcagggcttaggggaggggctgtcactcccacttctcattccttcacacccccccattccccagagaggggtccaggcctgggcaacagatggccactgtctgggggcaggaagggcaggggactgcacgggaagggtggggcagccactccagccccttcctcgtggcagcttccagaggtgggggtgagatgtgggcttcattcacctcagagcctggctcaggctggctcagggaagacaggagaggaaggtgggttaggtgtgagcatgtgtgtgcaagagtgtgtgcatgaaggtgcatgtgtgcccaccagaggtgtgagcgtggtgcacatctgtctccccctcccgcctggtcccactggactgggccaccgccaccttccctgtggccagctccaggcctggcccaccatggccgctgcccgagagagtgagtgagcgaagaaggaagggtgggcccctaactgccccccactgaacccaagtccccactcagggtggggcagcccagcccaggctaggagcccaggggctctcagcccaccgaatctcactcctgtgctttaactgggcggggcaccctcagccttgaggtgaaactcccgtgaccctctgcgacttgccatgtccctagggccagacacccaccccctaacagccagattccctgaaccaaagccaggccccctctggtctgaccagagagaagtggaattggatccaagacccaagatgctatgtcgcttgagagagctcagtccctcggattttgtccctaggaatcctgatgggcaggctggaccctccactgccaccacaccagctcccgaggcggtcattcggtcctggctgcacccctttttccattcattcatctgttcactcgctctgccctacacgaagccccacctctgcgaccactcagaaccagccaggtgtcccccaacacaccctccagagcagccccgggcaccctcctcactcccctgagctctcctctcctcctcagcccctggctgacctcccccaggaaaagcccctcctggttccagcacccggcagcatttttgaggacattttcccgagcagcatttcccaggcgtcacggggggtggaggggtggggggcagcaggaatggttcaagaagagcaatttgcttctggagataaatgccggctcctcacggaaggcattccctcctttcttttctctcttcctctctcgctcatgcttttttttttttttttttttttttttttttacagtttgctaaatctgttgtaatctggtgccaacgattaattcaggcagaaggagggaaaggggcgtgaaaaaaatactgccacagagctgcctctggagagtgacgcgggcaggaatggccaggactagcgccccgtgaccccagttttaatcccagttttaattaagtataagccatccccaaccagcccggccactgcctccctgccagccagacaatagaccccgtctgcccatgaggatgccctttgaccccttgaagcagagcctgccacacctggggcctggccggacgtcggatgcctgggtcctgcggtctgcctgggaggcagtgtcccctagtggctagctgagccccatacagccgggtccggggccctccaggacacagccccttcactcccttctccctctgcctgcaccccagcccacttccctgcaccgggaacattcagggctggggagggtttctgcggactctccttcatcactaatagctctcggtccacccagggctaccgcccccgtcataaacaagcccacatttgtctcacagcccatcagatgctggggcaacctgtctacgcaggtgaacacacagctctcgggaaaaggggacctggcatcccgggcctaggaagcccactcttccagaggcccatctgcaaggacaggcagagggtccctgaggcagacccaggaatcctgagagagctggggatggatgggccacagagacccagggagacagcccaccagccccagccctggccgggtgccttgagcccctctgccctcctgccgggggtctccatgcagccctctccatccatcctgtcctccaggcccttgtttctgtccctgcccttccctggctccagctcactcttcatgtcttaagcacccccttccctgggaagtccccctcaatcccacccctcagcaggcccctctgttacttgacctcaccactttgcgccttcagagccaaggcttcacggggaagaggtagatctgactaatgtctgacaccacatctgactggaagcgccctgagggcaagacacccactgcttttgttccccacttttgtcccagagcccagcactgtgcctggcaataactaatgctcaatgattatctcaagaatgaatgaatgaatgaatgaatgagcaggaaaggagggaaggagtgagggaagggaaaacagaagagccagggagccaggcgtgccagaggagcactggtgggccagcccatttatcctccatggcttcagccccaaactcccacccatcctcctccctgtcctctcccccaccctcactagccaccagctctgcaggttgtcattttaaaacccagggctgcaggaatccagcaaacaacctccacaaagcaaggagaggcccccaaaccctgacatcatctgcagagccgctggccccggggagcggcagtgctctgggggcctcgagcgatggtaaacaggcaaacacaggcctgcacaaacacagcctgctccatggaaccctcttggtgtctccagctgctgccagagaactccaggcaggctgtccggggggaggagggcaaaacaggggtgctgtccttttcccgtctcctcccggccatccagtctgccccacaccacagccctggccctctcagggtgagtgtcccatggcagaggacagaatgcagctgcctcgtgggccagccagagcctgaactttgtctccggcagaacaacacaggttctgaggagggaccccccgctaccacccgacctcaaacacacttggaaggcagtacaccgggggcagcagccagggcctggggcctgggcctcccagaggctggcgctctcctctgccagtgagcagggaaagctacccccggggcagtccccacccaccccactataggcagttagcaccctcgccacacccacgccccttcttgtccacccacgctcgctcacccacatgcctcacgcaccccatcctataaggggcctcagcaaaagccctccagctcccccttgctctggggcatttcccactgccccttgggccaggtaccagagtggatggcccctgcctgcaggggatgagggccacctcagtcctccctgccaccccaaggcctgaagaagctgaaagcccttggcccacagtgaacgaggggtgtagactaggcaagggccccacattgctaggcatgaactctgctagaaacctcatacgcatcctctcaacgtgggtgcctccccaaggtaggtactgctgttaccccaccctacagatgaggaagacgggtcacttgccgaaggttagcaggccaggtagagaaaccctccccaggaaccgaaagtccttaggaccctgtgatggcattctagtgtcccaggaacacaatcaacagggatgactaggtggttgatatcatttccagactctagagcagaagggccagcacagccagacccacacagtcccatacaggccccatctctgagatcaggccatgtccagccctgattctggggatgtctggctggctggggagggggctgctagccccatgactgggcagaggtggctgtgcccagctagatcctggaggcctcatcctccccctgcaccagagcagccacttgacagctgcccccgtgctggcctctgggctctacacccacctctccgtccctcaacacccgcagggtcaaggccacctggagccctagtcctctcagctaacttcgaagcaagcacagatgccacctgctcatgtgtgcactgcccttccctgcacccacacgcagaacacccagacatcctctctgtgggacaactgctgtaaacccctgcgcaggcaaggaagccggtcccagaggggaggctgcaggcccagggtcacccagtgaatgcgacacaggctcagccaccaggcatgaatctctacagagctaagtctgtacacctctggcagtgggtgaccagtgggatggcagcaccccctccccatcacctccttagaaacagctgggcggacctcccaggggctttcatgggaggcctcggagatggggaggaggggacacagggcgctgccactgagggccagcgtgaggatgaagtccagtgacagcacactggctggtggtgggaaaatccgaccccccgaccctctgaagtccctgcagataccctcagcccttgagaatcctccagtccaggagcaggaccactaacaacatgcgtcaaatgcacttacaaagcagcaccctggctcaggctcaggaggtggcactatcaatcccattttaccaacaagggaaactgaggcacagggaggtggagggaccaataaatggtagagtgcggatgcacagacccaggtctaggtgaagtccagcaggccacagctgccttgggggtgtgggctacggagcctccatgctggggtcagggtgctttttactgaagagtatccagtctctgtgtctgggaaagaacatgggactgggtgcgcacacacacacacaccctgtgcccatggccgacccttcagccagatatgtgacagccctcagctcttcctgcccctcacacctaccagggccccctcactgctggcccagctaggcagcgtcccctcccaggcacgggccctgtcagctcaggccatttccattttaaaccttctgaggaagccctgaacagtcgcccacggagtcagcaccagctgacaggtgatgtctgcgcctctcctcccggggctggcggaagagatgcagtagctttcaactccagaaactggaatctggagcccctgagcgcggcggctgcctcccccgcggccgccgggcagagacagggtgcctcagccacctccctccacagtggcatcgtgggtcccccccacagacagcctccttcctaactcctgagccacctggggagggggatgtggaggggctggtttccatccaacccgagggcgtaggggccgcggtgaggcagggctgttctcagtcacccctcacctccgtccccagccttggctgtatttattcacatcagagctctggcttgggcctcgggggcctggcacaccccagctgggctgtattctctcaaaactgcccaccctggagggcctcgaagacctcccggggccaccgggaaggctgtggcagctccctggtgtccctgttccacaactttctcctcctcggggagctctgatcaaccacggttccctgcagctgggcgacaacactccccagccttcctccccggggtctccagtgcccgcgaggaggggcgtgcgccgccgggtcgggccgcctccttgtcttgagagctgggggatggggggtgcccgccgccccccgcccaggcaccatggtctcaccgttccagccgccaggtgtacggccccagcccccgcccggctcagggctgacggtccacagcgcgcacagggagggaagttggaggctgctcatgccccccttgaagtcgttttaaaaataaaacctcgctccaaccgtgactcacgcggctggtggggacgggagcgcggcgcccaggccggccggctgtccctggccgcgcgccctcctccggttcccgagtgcgggagctgggacccacatgaccggcctgacgccccccacgggccaggccccctccctggggggtgcagcgagggcttggactagagctccagctgagcccccgccctttccagcctcggctcgggagagctgagccgccggccgcgcaccccgcgcctccccgcggcggggccagcgccaccgctactggtgcttggctcttgactcagggacccccaccccaaatcccaaaggctgggcgtcccatctcccgccgctctggggcaaagccaggctgcctgaccccgtggcgcttcggtgcccccgggcccccggcccccgccccgtcggctctggcgccctgtcccagacgcgcggaccccgacccccgcccggtgcagccagccctacctgcgcagcggccggggaggcgggtctcctcgggaaactttgcggtgacggctggagcctcaggggttattccaaggagcgggcgggaaccagagccggagggcgcccaggggggcccgggagaggagcccccggcgcgcggcagagcacggtggcgggcccggagcggggggcgcgcggcggcgcatctgcccggctcgggcgcccggcggagccgcgggaggagtgcggggggtgcgtccagcggcggggtgcgtgtgcccgggcgggtgcgctcggcggcggggcggggaccagcggcggtgcccgcgcgagcggcggcggcgagcagggcgcggggaaccaggctgtgcggccgcctctcccctcgcggcggcggcggcgggggccgtgcgtgcaggcgcggagcggggagggagaggaggaggaggggagggggaggaggacgggggcgccgcgctgcgcactggccggcgggacccggcgcgggaggctgcgccgccgcgcggggattctggcccagccggggagaagcggcctccgcgcccccctcccccgccctcggctaaactggctgggggaagggcgggtgggggagccgacccctctggggagttgggggagggaggctcccaaagccaacctccaccgtggaggcgggggagaaaggggttctagctcacgcgccgcctccccagcaccctcctctccgcacccactcattcaaccatccctccagccatccattcattcattcattcattcatccgtccacccgtgcattcattcacaaacaggtacccaccgcctactctgcatgccaaagtaaccccttccttcctgcctggcgccccttccctgggcagaccctctcatccgccgcgtgctgtaaacacccgggcgctccccagcaatacccctcccacctattaagggggcagtgccagggtcccatgccagcgccccctcccatccccagctgactgtgaccttggccaagttgctgaacctctcccagcctcagtgtcctggattgtgaaatgggaccgttactacctagctccaaaggttactgtgagagatgaagaagaccttgaatgggagggtggctggcccagtgcctggcacctattagagactgggaagatgttcatgcctgtgggtggcatccgggtggggtgagggagtgtttagaccagacagcctcctcttagcctgaaagtccccgtgctcttggcattcgctgggacactaagtaagggactctcccatatacccagcctggcctgccctggtcagacctcatcaccttgtcagtggctgctctgagtcccaagcctgcccagagcccccaccagggccccagtgctcctgatccaccctcagaccgcccacagtctggctgggaccccctctgccggccctgctctttgctgtccatcgaggcctgggggccacctcccctctgggatgccctcccagatccccttggggagggtcccccctacagagactccagcacctctccccctcctttccctgtgcaaacccagccctcttgcgcccagtccgggaacagactggggcctagcctgaggccgccgcctctggcctctgtgcgctctgcatgcgcctgtctttgcccttcctgcctctccctcctcacttcacccttctaatttccctccccttaactccctttcttctttctcccaatttctactcaattcaccaaacagctattttttcctcccaatttttatttattgcccaaacagcattataccaacaataaaagaaagaaaaatcacccacaatgccaccgccctgtggcgtcaacagcttccgttcctctgctcccttccaggcttgtccatgcagagacggctgtaatttttacagagctgtggtttccgtcccgccttcccagacccccagatggacgtgtggccctggggctctgtcattcctccatcccagcacttggcgtgtggctcaggaattatgttcaagccttcctcctcttctgaactaaatgtcttgaaggagagacccctttctatccctgccacccccacaccaagccacagagctggcacagagcgcgggcactcaatgcctcgcagtggaatggattgtatgattgtagctctgtttgacatgtcacacttagatatcaaaatgttatcttcgagccagccatggtggctcacacctgtaatcccagagctttggggggctgtggtgggatgattgcttgagaccaggagtttgagataaaaaaaatacaaaaaaataaaaataataatttttttgggggggcggcgtttcactcttgtcgcccaggctggagtgcaatggcacgatctcagctcatggcaacctctgcctcccaggttcaagcaattctcctgcctcagcctcccgagtagctggaactacaggaatgcaccactacgcctggctaatttttgtatttttagcagagacggggtttcactatgttggccaggctggtctcaagctcctgacctcaggtgatccacccaactcggcctcccaaagtgctgggattacagacgtgagccaccacacccggcaaaaaataatttaaaaaaaaaattaggcacctgtagtcccagctactcaggaggctgaggcgagaggatcacttgagcccaggaggttgaggctgcagtgagctatgatcgtgccactacactccagcctgggcaaccttgtccctaaaaaacaaacaaaaatcatcttcataattgtggttttaacagctgcacgatattccacaaagctgatggaataacccgctcagccatgcctggtggctgtgcacagttcgggggatatggctgggagtccactgtgtgccaggtgctgtttagggcaccagggaccagaagtgaatcgggccctgctggatctcgccctggcaaagctgaaattccagcatgggggctgggcacctagacagttatggcttagcaagatcttgctgaagcaggcattacctcgtgaccccaagacagagggccaagtcgattttgacatcagcttcctcagggaggtgcctcttgacctgggtcttggaggggcaggagggatgttcttgcagacagcagaagctcacagttgctgtgacgtgaaacagccttggctttgaggctcaggaattcttggttagagtgggggacagaagctggggggcggatagtggaagatgaggtggctggtgtcagccaggatgggtgtgcagggtcttagacaaacctggagtgcctcttctttatcttggaaggagtagggcaccacgagggagtgtcattccaggaaggggacagtgggctctgagagtcagaaagatcactgttcagtcaacaaacccttgccgagcccctgggagctgtgggctccaggaggacacaggtgactggtaaaggcagtgtggccttgggctggaggactgagctagtccctgctgggcactcatgggggatgcactcagccgcaagggcagctcaagtcacctggcgatgatttgtaggttcaaccttgagctcaccaagccccagcttcccggctcccagaggggcagtaacccacacagcctggtggggtgggccttaccaccgggcagccaaggtcaccctggccctgcccgaagcatccttacctctccagctgccatctaccctctctggagcccctaaatctgggtcctgctcgccatcctgcaactcaccagccatcggccctgggcaccatcccagccttgctgtgcctccatttccttatcttaacaaggccatctcagacctcccagggctagcgagagtccagtgaggtcccaggaggaaagtgcttcgtatacagtgaagtatacaaagtatacaatatgactcaccattattagactgtggtcaactaaagctgggccacccctggcttcacttgggcctgttctcagctgggggcaggggaaggaggtgacttgactcaagggaggaacagggtcttcctcactggggggtggggtctgtggtcatcatcagggacccttagccccaggctctgtgctgggcatccaggcatgaagccatcccagggcagtggtcaggggttggcaccaaggcaaggacaaattgcagatgttcagagggcacaaccctggcctcagccttccccacaggccccagcctgggtatcacctccaaggaggggtggactcctagctcggggccccagtgatgccccagtatactacgggatgttcacgcgaatgcatggatatgtaacctctggataggcgggctgtgcatgccacttcagggacaccaggccagcacacatcagaaagctccagcagtggccgggtgcagtagctcacgcctgtaatcccagcactttgggaggccgaggcaggtggatcacttgaggtcagccattcgtgaccagcctggccaacatggcaaaaccccgtctctactaaaaatacaaaaattagctggcatggtggcggatgcctgtaatcccagctactgggaaggctgaggcaggagaatcacttgaacctgggaggcggaggttgccagtgaacagagattgtgccactgcactccagcctgggcgacagagtgagactacgtcacaaaaaaaaaaaaaaaaaaaggaaggcaggcaggcaggcaggcaggctccagcagcttctctgatccaagttctaactccactgtgctcccctcccaccattatgcacaacacagagggctggggcttctcccctctaagcacaaggtctaggaccaggagggtgggccctggcgcagagcttcagggagagccagagagcaagacctccagcccaggaggaaagtcccagagagggtgccccaaggagcaggcacagaagggacaaagccaggtagggtgaagtcagcaacccccaggactggtgctgggagcagggaggggcccaaggcaggtcagaccaggccactggcaccggggaggctgccagccaggacaagagcacccctccagccctgctccagtgcctgcctcctcctcatcctcatccctcccttcagcatgctcctgcccccaggccttgaaacaagggtcttacttctctgcacccttccgcctctccagtcctaaccaactcctcctcatcagcccagagcctggccaacctatcatcagaaaggcctccctaacccccacatccccaccacccacccaccttccttttttttttttaagagacaggatctactatgttgcccaggctggattcgaactcctgagctcaagcgatgctcccacctcagcctcccgagtagctggaattgcaggtgccgccaccatgcccagcttctaaccccaccttcccgattaggtcaccttcttctgtctccctcctccacttctgttttgtagcactcagctcgttggtgattgcttatgatttctatgactgcgtttttcatctaccggccaacatgtccacatctctaagatccgggtgtggctgattttttctctggcgttgtgtttgcttcctggggagtacgtacaatagtatcgtgacttagaatcacaggcacctgtgtccagtgatgtgtgttttgttagtattcatctctgcaccagactgtcggcaccttgagggcacagccgggcctatttgggttcctgcatgtccccaacccctgctacagtgtccagcatgtggggacagcatggtcaggcattggtgaatgtggtgaatgaatggacagaacattaaacaggagcgagcatcaggctgacagagcccttcaaggcaacaatgacggagctgtcccaaggccaaccatgattcataaaactgggaattgcccggagatgatggctcctggggttctggggggccagatgcacatccagctactggggagtgggtagagtctgggtgtgagtttggggggtgatggagacatgacgggggagatcaggtctaaccagctgcccctgggtgggtggggagacagacgccagagagggtgggaacgcaggcctgggcaaaggcaagactgtgtcacccggggggtggttgttccacctgtcagctggtcagcccccagccccagcaggactgaggcggttggtggccaggcttctctcatgggcccctccttcccttgggagcttcctctgctccccaccagtgacatcacctcccctgcccccatcccttccagacactcagggctgcctctcccggctccctcccttctcagcgatcattcccagcagagaatatgctttttgcggtgatttagaccttcctttactccagctgtcattcacctgttacacacatcccaagttcaggaaggagatgtgaactgtgtcctgaaagacagccctgtggagacaccagcctcagccagggtagggagggctgtgtgacgagcagctcatgggcatgggtccgagaggggggtgggggcgaggccagctgcgcagggtgggctgggaagggcctccaggagagagactgggccttctggatggtgcagagtctgtggcaggtggaagcaaatgggggctggacccccgggacagtgaggaaggggatgccattgggagcgagaggtagggcctgatccaaagagagggtggcagccccaagacatcagggagccaggggacggggtccctgtgactgcccgaggtaggggatgcaggaggctctgagattggtgtctcagagacctctactggggatccccccaccccgtcactgtgcctcttctgccggccgccagatgcctgtttcaggggccccaagctctgcagccccctcatctcccctcccgttcctctgcccgtgtgagctgctttatggcctcagcctcccccacagcgcaaaggctcttgaggcccagcgcccacatcccagcacccggctcaaccaaccccagcaggtggccactccccacctcactgggaactcaagcagctcctcgcccttccccttgggttgtctctgtcccccaacagatgccaataaagctaaggccacagatggtgccctggggcggggaggtggggatgggagagtctgaggtggggtgccctgagtccagggtccctctcccagagtcctggggctgcagagctggggttgcggaaacagatggcatcttctgggacccctcacctgccctcgcctgctggcctaggtgctccaggggcagggaagtaaggagaaagagtgtcctaagcccagggtctccctccctgagtcctgggaggcagagctgtactccagagctggggctggatgtagtcactcaaagccacttacctgccgggcacaggtgcccccagcagccaggcctggcaggttctgagctaggagcaccagcgccgctgaggctgggggcactgggaggagctgcgggaggagggggaggggaagagggccagcgccagcggcagggggcggggcgcgatggggttgcccagcaaccagcacgctgccgctgccgaggagggattcttaaagagctgagcagaaaggctgggccgcggagggagcagaggggctgaggccgggcctcgcataccaatggctgccacactgacctcctcctgcctcctgctccttccttccgcctcctgcctcccacctccctccaccgttttccctcctccctctccctcctccctctgcagcgtggagcccaagctgggagggcaggggaacagagaagaggaggcgcccaggccaggggggccctaaggcaggcaggcagggaccaggctagggtcctgtcgtgtccccacaggacaaggcctgggaggggtaataacacagggcaaggggccccctcggctccagaccctcagcacaggccctggcgctggggacagcagggaactagaaggcctggtccccaccccacccggcccttcccatgcgcctccccagcactccccactggggaagcactagttttagagtcagacacaactgcttcttccgcctgcccagccccgcatcctgagagtcctgggcagcctcagagggtgagcagccactggctgcagagaggtggcgggtgcccggcaggcagaggacggtgcttcctggtgtctgacttagattccctgcgcagcaagtggctgctgcctttcctctgtctttactgagaagggaacgtttttggccttggtgcaacacttcctattctaaaaagcaaagtgacaattcagctgtgccaccttcttccagttcctttccttctagggcctcggtttcaaatccgtggtgggggaggggaacctaggtcaagggctccttgctgggggccccgggaggatcctcccacggaaattgtaggccgagtgtagtgcttacaggcagcgtctggggaagtgttcaaagcggtcactgggggccagggggaggctataacctataaccccagaggttaagacctgagcctctgggtgggctagacatgaatgagccccttcccagcttcctgcagagggtggtggaagcccccatgggcaggagggtggcggggctacagctaccactgtgtcttcatagaccatgtgctcttccattgactggattgagccagttctgagccaatcgcatccttgatccagtcccatctccacggtcttctctttggtcccatgggctcaatcatgccgcctctcccagccctccctcaacccatcctcagccaccaccatccctgcagcccctgcctccaggaccacctcttcaatctgctcccttccccagctctaaagggggtctttctaaagggcaagaccaaccctgctgctcccagctccagcacccgccatgacaccccatgactgtgggagaaggatcagggagggccccgtgggcctggtcacctctctgccctcctctcagccacactcccctctgcaaagccccttccccactgctaaccctctgtgacatcggtggcctcatcaatgtctgttgaatgaatgagtagtcataagaggagctcttaggtgccaggccatgccggcctttgggatccaggaatgtacaaagcaaatgaggtcgtctccccacaggctgccatgctgttaataaaccagcaaacacatcagaggatgaggtcattatgggcacagggtgtgggctccagaggaaataaagaggctgataaggggaatggggcagaaggccttttaactgggtggtcaggggcagccccttagaggaggtgacattttcattgagtcctgaaggataagaaggagctcagcttgggaagagctggaagagtgtgccaggcagagggaaacgtatgtgcaaaggccctggggcatgaaagagccagacctattgaaggaagagaaaagaggccaggaaattgtgggggaggggtgtggggtacagccatgcctccatggagggaagcatggattttattctaagtataatcggaagctattggagaattttaagcagggaagtgacacgatctaatttatattttaacacgatcatctgaacaaccactttgcagagcaatttggcaataactagtaaagttaagatatgcgcactccacaacccagcagcccactcctaagtgtggacccaagagaaattctggtgcatgtgtgcatggggcgtgtaaagatgctactgccactgtgtttgcatgagacaaaaccaagcatgcttgactgtgggtcagtgggagaatgggtggctgggcgtggggtagttccaccatggaacattaaacaccagtgaacacgaggccgagcgcagtggctcacacctgtaatcccagcccttagggaggctgaggcaggaggctcacttgagcccaggagttcaagaccagcctgggcaacatggggagatcctgtctctgtgaaatttttgtttgtttgttttcccgagataagtcttgctctcttgcccagagctggagtgcaatggcacaatctcggctcactgcaacctccgcctcccagattcaagcaattctcctgccttagcctcccgagtagctgggattaccggcgcgcaccaccacgcccagctgatttttatatttttagtagagacggggtttcaccatgttggccaggctgatctcgaactcttgaccttgtgatatacccgcctcggcctcccaaagtgctgggattacaggtgtgagttacggcgcccggcccgaaaattttaaaattagccggatgtggtgatgtgtgcctgtagtcctagctacttgggaggctgaggcagaaggatctcttgagcccgggaggtcatggctgcagtgagctatgatcccaccattgcactcactccagtctgggcaacagagcgagaccgtctgaaaaaaaaaaaaaaggagcggggggggcccatgagagcagtgtgggcctgcccagataaatcttacaagcattgcaatgaataataacagcaaaccgggagctcccgtttatacaaaactcaaagacacagaacctatcttaccttgttgaggggcacgcatagtaaaactctaaagaaaataacatgccaaatccagaatagtggacacctctgcagggagggggcttctgctgttttgtgaggttgattcatccatgcaggaaatgcatggaaaaggctcatcagttgctgggagaggaaggcatgaggggtgaggggcagctgaggagccgcctatgtaggaggccacagcagccacgcctcctgggatggggatctgggagtcagggggagcccaggctggcctggctgttcagagctggtgctcactctttcctcgtgcaaactcctgctttgttttctactaaaatagccccagctgggtatggtggctcctacctgtaatctgagtactttgacttgaggtcaggagttcaagactagcctggccaacatggtgaaaccccgtctctactaaaaatacaaaaatcagatgggtgtggtgtcgtgtgcctgtagtcccagctactcaggaggctgaggcctggcagaatctcttgaacctgggaggtggagggtgcagtgagcccaggtagcaccactgcactccagcctgggcgacagagtgagactctgtctcaaaaaaaatttaaaaattaaagaacaataaaatagcttctggttttctccttttagaagaaagctgaatcacagagaggcaaggggctttctggggtcacccagcaagctgggtgcagaggaacccgtgacttttcctacggggcagtcgggcctgcccagctggggctgggccttgacctttcctaggggtcaaggctgccttcaagacccacagactgaggggtccatggccgtcctaaggccccccaactcctccctcatcttctctgatgccctccaccctcccacccgccaaggctccctggatcaccagcccctcattcttgcaaggatggagactgcccggctggctggggcccaagccatctcctggtaattgagtttcagggatgcttatggttatgctaatgtgggatgctgagtgcctgccccatggcgcccaggagaggggaggcccaggcagcagctgggggtcctgcagtgcagcagctcagtcctcccatggaagtcagacagcccaattcagacccagctccccactccccagctgcatgaccttgggcaagtcactcagcctctgcgaacctctattttctcatctgtaaagtgggaaaaatcataggaccccctcaacgggctcttgtggggagggcgaaatgaaagaagccactggaaatacttggcccaatgcaaagcacggagaacttatttgataaatgtgtcatcagctattttttgtttcgttttaaagtctggaaggtccttcagggccatgggaatggggcgagccgagtctgcgccatgagcgagcagctgacttgcgtttctcttgtttttgtgttgcatgctcatggtattccatttggtggaatgaacatgaattttttacttaggaaaatagcaataagtggaaggtgcctggggacagggcttggagagggggtgttgagggggacctccatgttgccaggggtttaggggacagcttggggtgagactggccaggagcttgggtctccaggggcccaggcagccaggcagacagagcccaagaaacccaggcaggaagcagacaagagaggcccaggccagctggaaccgcagccacgccatttcaaacagtgaactgtgaggcttttatggggagaggcgtgggggtgggatgcctcgattagaccaggaagaggggctatagagtggagtggacgtgggcaaacaggcagggggcacctggaggtgtgtgggagtgaaggaggccgctctgaggtacaggggagtcggggaaaggagggcctggaatgggcccagtgggaaggaggagacccaggggaatctagtggggatgcccagctgggtaccaccccagcagctttgagcagctcccaggctcgtcagagaagacgtggtgaggggcttagccctggagcagcggggttcaaatccttctccctgacttaccaggagtgctgggaccttctgcccccaggaaccgcccccacccagcttcggggcccactgccacagtgaagccctgtgaggctgtaggttttacgggcatttttaactttatcatctatgcctcacaagggcctcagttaaatgatcaccccccctacagatgaggaaactgaggccccaggaggtggggcagctgacccgagatcacagctgggggtttcaggaccagggctggcaaagcataagactgttggctcctcccactgaagtctgtggccttaggcaagtcatttctcttctctgggcctcagtttccccatctgtaagtgggacaggagggtgtgtgcaaagatgatggtcaaagatccatgtggaggccaggcgtggtggctcacctgtaatcccagcactttgggaggctaaggcagatggatcacttgatatcaggaatttgagaccagcctggccaacatggtgaaaccccaattgtactaaaaatagcaaaattagcccggcgtggtggcacatgcctgtagtcccagctactcgggaggctgaggcaggagaatctcttgaacccaggaggcagaggttgcagtgagctgagatcgcactactgtgctccagcctgggctccatctcaaaaaaaaaaaaaaaaaaaaaaaaatccatgtggaagcttgctggggatgcacttggtgcccataaatgggagccctcaccctccagtgaggcccctgctcccctggctccccagcctggaaaatgtccaggaagtctcccaccttccacctgggccgccctaccacggaggacagtgaccttggcctggggggacagagcttgtcaaacaagcaactgctctcacagcttgaggggcctttgaagtctcttattttatcttcaaaatccagcacatttcacatgttattccatctgcggggtgtttctaatctaaaacatgttttaaacgactcgccctcaagtcacacggatacccaccgctggcctgcaggaagtggggcatcgatttccaagaacaaactccgctcccctaagccccctgtggggccaggcctgccagctggtcagatgctgggacagttggcagtcatggagccccttggaggtgccaggctctgtgctgatggcggggatctgagctcggggagggtgaggaggatgctggggacacactttgtgggagcaccaaggaggcttgctatccccaggggaagtctgagaggcatcccggaggcaggggtcacccggacactgcagtagccaggaggcccctcctgccactgcctgtgcccccagtcccttccctgtgcggttcatccctcctctgtctaaaccccccagcagctcccatttctcactaaggctctcaaggccccccaggggctgctcttgcctgagccccctcacttctgtcctccttccctgctcctcagcccctgaggtctcaaggcctttgctcctcgtcccccacccctgcctggctgtgctgctcacaccagctccagggttcagcaggccccacccacccctccagatccactgcccgccgccacctcacaccccccccccccccccccggccccctgccactcccttgcatttccttctcggcctctggcactcacagggattcttgtgcaagttgattctcgtgctgtctttcctgatggtctcccagccagatgatgcacgtgccagcagggctgccccatccgtgtcccagcgcctggcacacggtggggctggctgcacacttgtcagagaacagaaggctgagatccggctcacaaggggaagaggagaatgaaggccaggccaggacgctgggtgacttaggggagcagcccccacccccccaactcctggctggggcccctccaggcagctgaggccagggtgaggcccagagcagcaagcagggggagtggaggcggcctccagggacatgcaggtgggctgtgcccgcctcaaagtcacctctgtgcctgctcgcccagcctctccctggcccaggaacctgctcagcgctttccttgggtcactgcgtctcctctgatgtcccggcccccacacagcacccctcaccgccctcggcagcccccctccctgggctggaggatttcgtccctgtcaggggaacagcagaggcagttcctgcacctgagcaccttcgtggctctggcctcctgccactgcccttggagcagcccctgtcgcctacacagctcccggcccaggtcctgcctcccaagggccccagggtgggctcccctgcatggcccatggtagagagctggagcttgggagtcaggcaggcagacccagcttaaatccagctgagtgactctgggcaccatctgtaatgtccacgggctccttcaggaactcattagtgggcacctgctgtgagccaggcgctgtgctgagagccggggaagaaccatgagggagacacccgagggcaggagtgggggtatcaagataagcacctgggggccgggcgccgtgactcacacctgtaatcctagcgctttgggagaccgaggtgggtggatcacctgagctcaggagttcgagaccagcctggccaacatggtgaaaccccgtctctaaaaataaaaaaaattagccaggcatggtggctcgcacctagactttcagctactcaggaggctgaagtgggagaatcacttgaaccctggaggcagtggttgcagtgaaccgagatcgaaccacagcactccagcctgagcgacagtgagacttcatttccaaaaaaaagataggcacctgggaggggattctggaggcagtgatagtgattcatggcccccccaggagagcatcaccgggggccaggagacctgaggaggtggcagatgatgagggtctcctccaggcagaggggccatggcagagtctatgaaaagggtctggggctggagagcatggggcaagtttgaggaccatatgtacggcagagggagaggagaaggggaggagatggtcgatggggcctgggggtctgcaaggagccagtctttatcctaagagcaaagggatttctcatttctcactaaggctcccaagtcccccagggttccctactgggagggttttcatagggcagctggggcaaaataggagattttacctcctctccaaatgtacattgtgagaggatcactttccgtgtctcagcgtcctcatctgtaaaacaggtctgtaaacacgtcttccagacagggaaaggattaaatgagctgtgcatgcaccaagcttacccagcctgggcccaggcattccaccttgttggtccctttcctccataaaacatatcttaaattatattttatgacttggttagcatcaagacaaatgtattaatattatatctgataacattgtctttgacctaaaagttcattgttttcttctgattttaaaagaactgcaacatctttgtgggcccctaaaagtgtcatgggccctaagcacgtgtctactgtgcccagcagggaggctggccctgcctgggccctaggaggctggcgctgccctctcagtgaggtgttggctggtagggtgccctcatcatgcacgtccccgtgcccctccctccatgcctttccttcttatccttcaagcctcagctcaaatgccacctcctccgagaagccttcccagtctgcagacttcagtagatcccacacgcccccattcccctcgccacagcatttagcacgcccggggcagctctcaagcctgctcccagctacccctccggtcaggactggaagcttccaaggcccagggactccatactgttcttttctctgtgcctgctgcccagcacaaccctggcacccaactggcactgaattcaaatgttttgtgtggagcatggaggaggggccgggtgccacctgtgcctcgggcctcctgtgacctgtcgtttctgagcactcaggtctggccctctccctttcgctggacagcggccacctgctagcctctaactaggctgggagcaggggcacaaactggggagctactgcacctgccctcagggacagcaagtgctggggcagaggagggccgggaggaggggtgtgtgggagtcggagactgaggtttccaggcccccagtccccagggaccgccagcagcggacagaggacttggcagtgactggcattgaggggtgccaccccaaggtcacaggcgcagcaccgggctcagagccagttaatcaagtcccagggagcatggcgcaggcatgtcctcgggcggggggaacccgatggggccgggccacctcggcctgcagtgggggcctacaggtgactccaagagcagaccacagactagggcactccacagcctccagggtgtgcttgctgccgggaggccccgcccccacccagagccaaagcgaactgtgccgctccaagctcccaggtccaggctcgggtcccccactcagccccacatggcgttcaaaggcccctgtttgctgggagcaggtctgggtcccttgggtggggctggatcatgagccccagcttggactcgcagtccagtgcccatcccccacctcacacagccactgcccgcctgaagccaccacgccttcagcaagaagagccctttgaggtgggcatgttgggggtcaagaaaaggagctgtgacaaccagtgctcctgggcccacctgcatctcccccagtccccgggtactctgtgagcctcagtttcctcctctggaaactgggttgatgacttgttgtgtaaggaccagagcctcccagcaaactgaggggggtggtgcagtagagaggggacttagaggctcaagccggtggccaggaactagctgaggtgaaaagggccggccacaggccaagatgttggggtgcacggaggcctgaggagcagggagacctgagaggccctgccctgggctgggcgggctgggtggccacacccagaagcctgtctgttggcattggctggcacagcctccctaggctcttctctgcaagcctccgggccattcccctgcacagcctggcccagctctccggccttggaggcagctttatgggggaaccatgtggcttggtgtcgaggcccaggggccagaacgggggcccagggaaaggaggagctgaggaactgggtcccagccaccaggttggccacctgacccccagagcccccccacccgtgggacgtcaggcacagggggctagagaagggggcacagtagactggcctcccggggcacccactgtgcgtgggtggcctgggaccaggtcctccgtgcatccaagtctgagcccccagcactgggccgcagccactctcctgcctgtggcaaatcccatctcctggcctggcctcccccagctccacccagcaaagtcttccctctgcccccagctcaccccctcctcaggctctggccgggttggcgtcaggtcagttcaccccactcaccttgccgggtgcagtgcaggccacacacagtggagtttgggggcgccaggtgggcaggggaatggcatcaccttcccacaggggactgcagaacagcaggtcagcaaccctcccctaccaccccttcgaggctcgctgccaacctatttggcacagtgccctctttgagcaggagccagctcatttgtggccggtgttaattaagagagagaggtgatggggggaggtgggggggtcccgaggagggcagctgccgaccgctgccaggactgcccaggccaaggggcctggagctggaccgagacctgagatgccccctcctccctcgctggctctggggtggcactgcccagatgcccagccctcgcctctgcagctggacctgctggggtggggagtgggtggaggctgcatctggggcttgcggggtactctgcctggtttcgagaaggcaagccccacccctggccagggaaaggcagtccctctgaccgaccctcagacagtgtccctggggtcagctggcttcgtggcttggctttggagtcagacagactcttccaattctgctgctgccaccccatgactgaagctccctaagcctcagtctccttctctgtaaaatgggaaccatcgcacctcccttgtggctttgttatgataataaatgggcccatctgtgcccagcaccccgtctacacccagcaaatagtcttggtcagcagaaatgtacattcatgcccaggcgcggtggctcacacctgtaatcccagcactttgggaggccgtggcgggtggatcacttgaggtcaggagtacgataccagcttgaccaacatggtgaaaaccagtctctaccaaaaatacaaaaaattagccgggtgtggtggcgcatgcctgtagtcccagctactcaggaggctgaggcaggagaatcacttgaacctgggaggtggaggttgcagcgagccgagatggtgccactgcactccagcctgggccacagagccagactccatctcaaaaagaaagaaagaaagaaagaaagaaatgtgcatttgtgggcacaggccccacccagagtcactggggggcccgcccctctgcagcctgtcctgggccagcctgggcaccccattgtggtccgtgtcctgctctccctccagctccagctccggcttcggctcatgctcccactgcctcgctggcaccactcagctcacctccccctcacttcccgcggcccccacccctgctttgggagcgcccagccgctcctcgcctctccatcttaattagctgcttgtattaatctcgcaagtaacatggcaacttgcagccctgggtttttgggcggtggaattaattattccccaagcgaagagctgtcagctctgggagaccagccactcggagccgcccgacaccacttagcagcgtccatgccgtcctcacggcatcttgggcctgcagcctggccacccagctcagctctgtgtcccctcatcctttctacagaaagggctgcaatggtctgggcagatggggtgggtagcaaagctgtgtgcagagctgaaggccctgtctgggagccaggactcctcggcagaggggcgggcgcagctggcctcccacctgggcagcatctgggcctgggcggcacctgcctggcctcacccgctgctttccctgatgagctctggcagttaccacggacgcaggctgcggatcggggctggagcccaggctgggggcagtgctggcatgcacagctctggcattcctacagagaggggctgccagcctcactttgcccccgtgtcagctgcatggtggcgaggggcagccgatcggacagactgagacagacagggctgtgcgcaggaaggtggcagccacaaagccgtcagtccagctctgcctggcagcactacccctagtccaaggagggggcggggacccaggtcttcctgcagcggggctcagagttgaggacccctctccattgaccttcacaccagctggtgaggtggggctattctcccacatggggaaaatgaggcacgaagccacatggccccagtcaccccgctgttgatctggttttggctccagtggcagcgctccaggccccttacccggctcgccttgtccctctcgcagttggacgcccccgcccctgcccccttctgcgccccctcagcactgctccgcgttctcagtcctccagctctggccctgggcagcgcttagcccggttgcaaaggtgcagtttgcttcctagtggcttcaaggctatgccctgccggaagctgtgagccctggggaaggggacctgtcctttcctccccacatctctgcaccaggcctggcgccgaccagcctcaggagatactgtgggcgaaacagtgaaggaatgaaagggccgtggcgggggccatctgcctctctggacccccccatgcgtctgcgtccgggtgagcaggcaggccctgatagctctcctgtgtccccagccctaccaccctacaaaccccaggaccatgaagaacctcctccctcttcaccatcgtctactaccgccccggaggactgggaagaccctgtgcccaagtctgaagacctagctggcagcccactcccatcttgacatcaccctcccctcaaggctgatactcccgccgcagccccttccccactgatctgcctttgtctctctctcttgcagccaacagctccctgctcggaggcggtggcggtgagtggaccttctgtcttggtgggggtggggtgtggcatctcccctgctgggtctgctcctcccctgcccctcgccctcggtgcccatctcactgcaatccaccttccccactgtcctcacagggtgcctcccttccccagagctggagacctggatggcaggcctggcaccctcaccaccaggcaacctgggccagctccccacccctctgaatgcaggcctcctgctctgtaactgggcaggggccacaagtgtggtggaaaaaacccagccctgaccttgatctccctgtgaccttgggcagctctgtcccttttggcctcagtttccccacctgtgagggcaaaattatcatctctaccctgcccttggacctcgggctccgcagccaggacaggtctcacaaagtcagggagagagctgccagctctcagccctgggatgtctctgtgtctgccattgttaacgaccaccacggagcaggggttctggaagggccaggcaggcaggaggtcagaggtcagggtgggcctggccgcaagggatacaggccaggtcacagataccaagcgggcgtgtccctgtacccccagcacctgcctccatggccagcccacctagggcagaccacaccagcccctcagcccagtcctgcagccccccagctggccaggctgcccgctgtctgcacaggcagcaggatgattggtgagctaggggccaggggttaatgtgccgtcggataaatcccgggggccgtgtttacggcagcggtggcagggcccaggccaggttttaaaagggggaaaaataaaaggggcataaaggtcaggaataaataagagcagcattaagagctgtcggtgaccagccaggatgcagaatgggggtctgtttgtggctgagatgttttccctcctccccattctcctctagctgtccccatggaggtcacagctccccagaggcctcacagaatgaggggctttgccggggactgtggtcctgaaaacagaccacctaggaccctcttccgaagcctgtccttttggaggacactttgcagacctgacacctgcatgtcccacccacagcaccctgcccttcctccgttcattgatcacccctgtgtgccgggccccgagctgggtgccaggacaggtactgccgggcacagatgggcctggtccctgtcccctgagctcccagtgcagatgagagcaccaccaagacacagggtgatctgtggtgtgggggtgggggtgggagtggcaccataggagcttgatgaggagtgcctgtccctgcttgggcatcaggaaggcttctagaaggaggtggtgcctcctctgcaatctgagggatgcgtaggcatgagcccagcgaagagtgctgggaagggtgtcccgggcagagggaacagcgcaggcaaaggcctggaagtggaggagagggaggctctgacacaggaatgactggagcccagccaagaggtggggagatgggagatggcccaggatcccagacagcctgtgaggagcgagatctttagccattcagttcaggaagataaaggatcacaaagggggtgggcctttctgtcccacatcagctcatcgagtctcttctgcccaccaccctgccagggttcttgtctcactcagggcctaggccaagttccttagcatggcccgttaggtccccagtcacctctcacagtcacctccgcactgccaccctctccactttgctccggccaccctggcctccctggacaggccccgcccactcctgcctccgggcctttgccctggcagttccttctgcctgcaatgcccttgctccagttgtccacgcggctgctccgttcactccgacaggccttgacttgaataccatctctcaggggggtccaccctggcccctagctgaaattgcagctgcctcccctgccccatgctggcactcccccggcccccaccctgctgtggttttaacttttctgagcacctgtctccttctaatgtgctgtataatttacttacatattgtgttccttgtcttctaccccctgaaaatgaaagactgtatctggggctggcacttataataagtgctcagtaaatgtttgtaatcccagcctataatcctagcactttgggaggccgaggcaggaggattgcttgagcccaggaatttgagaccagcctggggaacatagtaagaccccatctctacaaaaaaaaatcaactaaccatgctagcatgtgtgcctgtagtcatagcttgggaggctgaggtaggaggatcacttgagcccgggcggttaaggctgcagtgagccatgattgcgccactgccctccagccagggtgacagagttagaccctgtctcaaaaaacaaggaacaaggggccgggcatggtggctcatgcctgtaatcccagcactttgggaggccaaggcaggtggatcacctcaggtcaagagttcgagaccagcctggccaacatggtgaaaccctgtctctactaaaaatataaaaattaaggccaggagcggtggctcacacctgtaattccagttctttgggaggctgaagtgggcagatcacgaggtcaggagttcaagacaagcctagccaacatggtgaagccccgtctctactaaaaatacaaaaattagctgggcatggtggtacacacctgtaatcccagctactcagaaggctgaggcaggagaattgcttgaaccccataggcaggggctgcagtgagccaagatcacaccactgcactccagcttgggtaacacagcgagaccctgtctcaaaaaaaaaaaaagtttattgaatgaatgaactacaggtaaaggtggagatgaccctacacattaagcaacggacttacccaagggcagctggtggaaaccaaagatgttttggcaaatccaggagtggctcacagatggcctgtgacctcactctaggaagtggaggggccctgccctggccactcagaggcatggcagaggtctctctggttctccttccagcatttaggggtgcggagcggctggcacaggcctctcacacaacctgactgatggagagatggacggggcgggtgcccctggaggaagtgggcccggagtccaaccttttaacatgggctgagatttatggagccgccgccagcacttgctgggactgtcactctgctaatgtgattggaacacagtggaggtggtggggagggggctgtggtagggacgatgctggggctggaatggagcccagcctggtccccggaggtgctctgccctcccctatacccctgctcctcccaccatcctttgagttcatccagtcctaatcgcctacctgcccaagttagaccccatctgactctgcccagacacacccatcttcccgtggggtccctggacatccctcctacaggagttcaggcctctacccgcgcccctcccatgaccagccacccattgttcgaacacgcacaagggccatcctgcctgccctggccactctgcccagaaccctgatgcactgccctgctccatgtcttcgtcccgcagccctgattccctgcttgcgttttgtgtttgttcttcattgcctgcctccccaccggaatggactcccccgagggcagggttatgggagattctgagctcctagaagagcttcctgctttgaagtaaataattaacatctgtggtgcagtgagtggcaccctctgtgtgccctgggagccagggacacagctctcagtctggcacccacatcccatcccctcaccctggggactgccagtctgccagtccctcaatggagaggggcagcaggcaacaccctggccaacaccccaatcagcatcctagccaacagcccaaccaacatgccagccaacaccccaacaacatgccagccaacaccccaaccagcatgccagccaacaccccaaacaatacaccagcaaacaccccaaccaacaccccaaccaacaccccagccaacacgccagccaacaccccaacaaataccccaaccaacatgccaaccagcatcctaacaccccaaccaactcgtgccaaccaatatgccagccaacaccccaaccaacatgccaaccaacaccccagccaacacttcaacaccccaaccaacatgccagccaacacgccagccaacatcccaaccaacacctcaaccaacacaccagccaacatcccaaccaacaccccaaccaacacatgccaaccaacatgccagccaacaccccaaccaacatgccagccaacaccctggccaacaccccaaccaacatgccagccaacaccccaaacaatacaccagcaaacaccccaaccaacactccagccaacatgcaagccaacaccccaaccaataccccaaccaacatgccagccaacatcccaaacaccccaaccaactcgtgccaaccaatatgccagccaacaccccaaccaacatgccaaccaacaccccaaccaacatgccagccaacatgccagccaacaccccaaccaacacaccagccagcaccccaactaacaccccaaacaacactccaaccaacaccccagccaacacctcaagcaacatggcagccaacaccccaatcaacatgccagccaacatcccaaccaacacatgccaaccaacatgccagccaacgccccaaccaacacaccaaccaacaccccaaccaacaccccagccaacaccccaaccaacatgccagccagcaccccaaccaacaccccaacatgtcagccaacatctcaaccaacactccagccaacaccccggtcaacaccccagccaacatcccagccaacactccaaccaacactccaaccaacaccccaaccaacaccccaaacaacataccagccaacactccaacaccccaacatgccagccaacaccccaaccaacatgccagccagcaccccaaccaacaccccagctaacactctgggcaacaccccaaccaatatgccaaccaacaccccagccaacacaccaaccaacaccccaggcaacacttcaaccaacaccccaaccaaccccccaaccaacaccccagccaaccccccaaccaacaccccaaccaacaccctgggcaacaccccagccaacaccccagccaacaccccaaccaacaacccagccaacaccccaaccaacaccccaaccaataccccaggcaacaacccaaccaacatcccagccaacaccccggccaacaccctggtgtgggtagtggcgtggagttcctgccaggaggggccggcgcaactggggctcagaagatggggctgggactggcctgcagggctttggggcccgagcccactgtttttacggcaaatgtgcggtgatttagagcagaagagggctgcagtctcaggggagcagagaagggagtctcccgggcacccccaatgcagtgagagcccccaggggctgctggggctaaagggacttaacctggagggcacaggactcctgtgcctgcctcactctgggcctggacccccacccaccacaccctggggccgaactagatggtgctggcaatgcagtgagtcctggggaagtccccctactcccttactacccattcttccctggagctctctctgagttgagggagctatgccaaatgctgggactcagggcttggctctgccttcagggagacccagtttggtaggaggcttcccagcagagggagcatttgacttgggtcccgaaggctaaataggagttctgcaggtagagcaggatggacgggccccccagggggaaggcctgtgtctgcttcaggaaggcttgatgggcttggggcagctgccagccttcccgacagaccctttggcctggtgtctgccaggccccctcctctctcccacctccctcctggaaagcttttactggctcaataaaaacattttttaaaacactctcctattgtatggtaagaagggaggcaggtcctaaatcaggatgggaatcgacagagccctgacgcccgtgtctctcctgtttattaggactgaaatgtttactcggagataaggagccggctttctcggggagatttgtgcgctctttttcaattacccctcgtctttctctgccacttttgcactaaagggataataaatgtatccgagcgtttcaattattcatctaaatcatgactgcgcctgccacggccaagctttagtgacagattaattcagggccgccttcctctggctgcgtggccgccatctctactccggcctggccagcgccccaaagggtcagctcctggcatgggtgggagggagtcaggcaggtccctggcaggcgggcaggagaggatggaaccccatccccaacctccccacattctgtctggggccttcctgaggttagcgaccccgctcaaactgcaggagccgagcctgcctgtgtgggtgcagctgcccctgcccccatgccgtcggccctgagcacctctgcaccctgtgctggcagggcaagcccgtgtgtgtgtctcctacaccgcccaagagaagctagggtggctgggcttccctcactgtcttcccctagcaccgggcctttgcacatgctgctcccgggcccgagcgctcctctgccctcctgtcgcaaccctcccgcctagtttcaccttcccatgtcagggcagcccctccgacaccccctccactgctgcatttagtgaaggtctgccaggtggacaacactccctgtcccgcgcccgcaccctaaccctgggcgcctctccccaggccccaccgcagactccctcacctgctcagaagccgccacccagggccggtccctcctcacacacatgctgggaccctgggggccagccgagcgctctcccccacaaccctgcctctctccctcacctctttctcttgccacctccctctctccctcgttttctccatttctccctccacgctttgcctctccctggctccctctcccttctcctgtcgttctttctctctggctctggctggttctctgttcgtagacccgcaggcccgggaggattcgcccaggcctctaagtattcagcgctcgactcctgcccggctcacaagcgctccgcgccctgctctggcgctatctcccatcgcccggccgctgctaatccgtgattgcttcccgcggccgctaggaaaaggctcagctccggccgctccgattagccgtggccttgctctgcgagcagataaacgtgacctccgtggcctgtggccagcctcggccctctggaggcggggctgtgtgcggccctcccctccccagcagggctgagctcagaagcagcaggcagccggaagggctgggcagtccccgcacctgtccctgtgccagtctggtgggtgttgtgtgtgcagggtgggcgtgccgggaccctctggcgtggggctgtctggcaaagggcgaggggggagggggctgtgcttcagcatagaagggaagggcgtgtccagaagagggaacagaagagggtccagaggccgaaccagaacacgtcccttcactgatggaaacttcccaccgcgctcgaatcaattcccaattgctcgactcctcgcacctcccgggaggtcctgtagaggcagcgctccctcccagcctcacccgccggcctgttcctgccacagggctctgcccttcctgagctctccgcccggactctcatcccggactctcctccccatctccttccaaagccagttctttctcattactcagggctctgctccaatgccacctcctcggaggggccacctcatcctctgaacggcgcccatccctccctccttcctcggggccagctccattttccccttctcctttttcaccacgcccacaacttagagccgcgtgtcccgtccctagaactgctgcggccacaggactcctggcccttgcatagggctggcacgtggcacgtcgcccccgagccctcgtacgcattttttgaatggtagagtttggaaccagtaggaggggcgcgggaggcagtgaattcatctgagagggaggctgcagggagccccagagagtccaggaaagctttgttggagttgaggattttattccatgtactcttgggagccatgggaggttttatgacaggggatgcgtgcccttccccaaggaaaggcccccaggccttcctgccacccctgcctgaccccagttgatgatggtgccaacggcagccaggcattctcagtacttacgacatggccaccagcaccctttgaacctctccctgaagaatctcatacaccctcaccccgccctatgggaggcatcattagcgtctccattttgcaggtggagaaactgaggcactaagtccctggagctgaacctcacttcccgccccaccccgcagctggcccctgtgtaagagggaggctgggacttggggcccctgtcccgtggccacaactttgaccaggcagggctgtggagctcctgctctgtccccagcaggcacgatgccaccaagccccggcatgcagctgccacagggatttttaataacgggagtgatttttgcatgatgaatgaggcactgccgttgtgtacataatgaagccctaatgttttcaaatccccatttaaggagctgatctcaccccgtaatgaatttcagatctcatcacagaactgtcgtccatccatcttctcccccgggcacccacccgccttggcaccgagagggtggggcctggtgaggatgggctctgcaccctgctgggctgagctcaagcctagcacagagccggggctggctagagtttgttgattgaatggccgaccaggagggtgtgagcagaagcaaagatggttccggcaatgggatatcgctcaggtcttggcctagttgaatagaagccagaggtggagaatgaggagtgggctgggagagaagagagcgcaagacccttgggtaggtcacttatccggtctttgtggctaaaccttccctctgcagggttagaagcctggggcagcaagtcagatgtctgcccttgacgcagttggtaccctctcagagactcagtttcccccatttccccgggagccttgtccctttctgccttggcatctggtatttctgtagccctcctccagagagggaaaccagcatgggctgcaccgaggcttggctgccaatgccctccaggctgtgcccagcccgtccaggcgggagtggtccctggagcccagacccctggtccttcctgggctggaggggagacacacccctccctcaaaccccagctcacacctctgcctccccaaggccctctgtctccagccctcctgcctgccttctcaggggcatctccaccctggcagtgcagccagtccctggggtacaaggcccccaaaagcatgacagggcaaaggaatcccctgcctgtgaagtccatggctgagcctcagcctcccatctgtaaaaaggggatcctcccatacagcccccaaaagctcatttcagaggcgtgaggttgagccagagaggtatgagactcggcacctgagaggcagggccagacgctgcagtcacagggcagcaggctggacacccagccagcccaggccccactcacccccacaaccttgcccaggccccccttcctgttcacctccctgctcttggggcccacaggagtctaggaaggtgggggccaggggcaagagctgcccaggcaaggccttacactttgctgtgtggctctgggaaagtggctttgcctctctgagcctatcactacttctgtacgatgagggttaataatgtgggtcttggccgggcgcggtggctcacgcctataatcccagcactttgggaggccgaggcgggcggatcacaaggtcaggagttcaagaccagcctggccaacatggcaaaaccccacctctactaaaaatacaaaaactagccaggcatcatggcacacgcctgtaatcccagctactcaggaggctgaggcaggagaattgcttgaacccgggaggcggaggttgcagtgagctgagatcatgccattgcactccagcctgggcaacgagcaaaaaactgtctcaataaataaataaataaataaataaagtggatcttagtttctgctcctcctctcactgtggggccttggacaggttgcttaacccccctggccctcagtctcccatcccccttgacaccttccagcatatctcagtgctccccaccactcttttttcttttctttgagatggggtcttactatgttgtccaggctggtctcgaactcctgagctcaagtgaccctcccacctcagcctcccaaagtgctgagattacaggcatgagtcacccctcccagcccccaccagtctctggaggccagagctctgagactcagagaggttaagtgacttgccccaaaccaccagcaatctcgtggccaggaattctgggaagagaaatcccaaagagggcacagcgtgggccagccccacgggatggtagggggaatgggggagcagagagagaccaggagcaggtccaggcctgcgggttggggtgccctgccctcggtaggggcacagctgccctcctggtcctgtgggccacaggcctccttatgttcctgtaaataattaattagcccctgcctgcttgtttgtttagcatgaggaatgctcccccactgagatgcatttattgctgaataaatttaaatatctaatcttcccttcatgcatattacagcaccctaaatagcggccaactcatcctaagcgccttggcggatggccccaccggagcctgcctgccttccgcctctgctggctctgaggactgcccactcctggtgccctccactgccccaggaatgcccagggccatgggcaatcactcagcccagccctccttccttccacaacatccttccatgggaggcgcacagatgctgggctgaatgctggccgtggaggctggaaggcagggctttaccacagcaaagcagggagatgcctaagatggggcggagggtcaagggccgctcagaggccagggcttggggcagaaagaggttcctccgggctcaggcgagggcaggcagagccccagtggcatttgaggagcggcctgaggaacgagagcccacgaaggagacgggaagtcccgctggatggagggagccgtcagcgctgggggcagccaaaccgtccagaaagacagtggcctcagaacactgtgcaacaagaggccaccagggcagcccccctgctggaaggggacgtgctgatgtggggagacactgcctccccaagagcgtggacagggggccattcaaaccagtcagccagagtggttcagggcgaggccctttagtggtcccagaggaagcagagccactgaggttgggagcccaaccttccagccgtgtgggcaagttttgctctctgtgcctcagtttcttcttctataaacaggaaaaataataagacagcggctgtaaatcaccacgcaggtgcttacccaacaagaaggctgacaaaggccatggggggtgagtcataccagctacttaggaggcttaggcagggcaacatagcaagaccctgtctcaaaaaaacacaggctcacatctgtaatcccagcactttgggaggctgagacgggtggatcacttgaggtcaggagttcaagaccagcctgggcaacatggtgaaaccccatctctactaaaaatacaaaaaatcagctgggcatagtggtgcgcccctgtaagctcagctactcgggaggctgaggcataagaatcacttgaacccaggaggcagaggttgcagtgagccaagattgcaccactgcactccagcctggatgatatagtgagacagagggctgatatgaaggagccatatcagggggagtttaacggtagaggagggtggagggaagaaggggctgcagggaggaggcagaggggccttaggggccatcttctggccacaggtggaggaaggcttcatctttgacctgatggagaaacatctcaggggggtcccgccacccaagtgggctctgcctccccaggaaagaccccaggttttctgctgacttggggtgagggttgagctggagcctggaggtttgttttggtggctgagggccctggagaggagactaagggttggtcagctcctgtgaactgggaataccccacctccaccaggtagccccagggatcagggctgctggtcttttccagctgccttggggtggggtgggaagagggaagagggaaggaagggcatctcccctgaatgggaccccaggaagcttgagtctctaggacctagcttagccccaggtaagagccaggacagggcctggagggcagagctaaggggactctgggagtgtgtgtgggaggggtcctttgggcctatggctaaggagagcagggtgggggggttcccctctgcactctcaggggagagagcgagaaggctggtgtgtggacagggagggacacgcaggcaagaggggccaggctgcactctagcttgttggggtagcagtgggctgacagtgacctgtccctcatctctgctttaggggagcccctccctggggcccctgcagagccatcacctggcccaggccctgttctggaactgctgggggtgaggagggggcatctggcctgagccctctgccagcattgattccagctccctccacctcccttgcgcccccaggtcagccccaaaggcctggctgcaggccagtccacttccgcaggaaacattaaattcctgaaacactgagctccacttccccgcacgggcccccacagctggccgaggtcgcctgcagggcggtgagcccccagagacttcgagcagccggtgccaggtgctcgacccgggaggctcctaggagagccagctcagacagatccctgggctcacccccacacactgtgaacaccctgtgtgcacccacctcccatcacactgatgtacacatacccgaacatgcccacactgtcacactgttgttaataacaggatacactcatgacctccattcttgccaagcactgccttaagcacattacaaagttagtttaactcaatccttccaacagcccaatgagctctgaggtgggtgctattatcccattttccagatggagcaactgagacccagagaggttaaatgatatgtgaggggtcacacatctgtggctggcagagccaggatgtgaactcacgttgcccagctccacagcccagccacggcaccccattcggaacactcacttcccagcactgggagctccagcctggacgcccgctctgggccctgccttcttgctccatctcagcctcgccctgggctacagctgcctttctccctgcagaggagaggagcaggtggaagggatccaggcctgagccgttctcagcgttcccctaacctctctgcccacccatccctgggacgctctgggaaattgcctggtgccagctctgagtaaagttgcagaatgaggtttaattgtgcccccagggcacgagatcaaacagcaaaagaaaggggtgtgagctacctggcatccctggaactgtgccgagactgaggtgatgaaggagaaggtggccttggtttgtccatctgtaaaatggggaatgatggtcctctcttgatgcccgcctgtgagcaccaggcagctggtgcctgaggagctcctggcgtgggcgatcagagctgccaaagatgggccctgtcctcccggccagcacgcggcgttttcctctgtgggagggtcgctgtcccggtattccagataagagggtggacgccagagaggggaaggggcaggatctcacagccgatgaggggtgagcccgggctggacccaggcctgcctgaggccgcgcctctcctgcgcggtgccctggcgaggttgggctgctggagcgtttcctccatgcctcccgctgcgccccggttgtttatctgcgcccgggtccccagggtcgctcgcgaggccctgcagccgccctcggataaacaagcccatgcggggccgtaattaagctggatgcgctaacgaggcggttcattaaccagctggggtttgcgcgccaggagactcgggcccgggcgtcgggctcacctccccgcgcggctggaagacccagactccagctacagatctgatcaccctgtaacaaggtggcctcggtttcctcatccgcaaaatgggtcctagggtttgccgccgccccgtgatggggcgccgcctggggaggtgggccttgggatcgcaccgacgctgaggcccgggcggaggcagcgactggtcgcgggccctgcagcgcgcccgggacagggctagggaggggcgtcggggaggaagcttccccgtcaccccggctcgggcggcggttcctgtcccggcggcccccgcctcccggagccgccctgcctgggccctggcggcgcggcctggaagggacagggtgggccgggtgcgccccctgccggcctccttgcgcgacttcccgccaggcccagggccgtcccgctctgcgcctcggtttccccagatgtgaaacattccgggcgggggtgggggcagcggccgcggccggaggccacggggttggggcgcggctccgcatgggtcctcgcatcgccgaggggcttctcgggactgagggtgctcaccccggggccgcagccttgccaggccagctcagtcgcgcccgcccttcccgcagtggacggctgcattcatcgggccgccggccccctgcttaccgacgagtgccggaccctgcagagctgtaagactggcaaggccaagatcaccggcggctatcggctcccggccaagtgtgagtccccgacgcgcccccagctgtggggcgcagacagggcgcccgtgtgtcactgggacatcaggggtgcggcccccacaggagtgctggggaactcctcagggggcccttcttaaccttaagggccaagacccggcccccaccccgcacaccccaggaagcacatgggggagaccgtgcgtggaggctgaggatggagctggggggcaacgccttcgcgcccacactcgcgctcgggtctcagccgggcccatacagatgtggggagggggcgcggggctctgtgcgcgtgcggattcgggctcgagggggcccacaggggtgggggccttcgcggaggaggctcagcgcttggggggaaaggtgtttcctgcccccttctgcccaggccggcagggggaagcgagggagctgaggaccgcgtagacccccgccggtctgaccccgtcgccccccgtagacgtcatccacacagtggggcccatcgcctacggggagcccagcgccagtcaggctgccgagctccgcagctgctacctgagcagtctggacctgctgctggagcaccggctccgctcggtggtgagggacggcccgcgggggagggcgggaggcggggcgcagtgacaatgttccaaccccctctcacccctccccgcccaggcgttcccctgcatctccaccggcgtgtttggtgagtctggaagaaaggcaaggaccaggagtgggcggtggacccagacgccgggaggggccggggcggacaggggagtgggcggggccagagcctaggactcactcccgccccacccgcctcaggctacccctgtgaggcggccgccgagatcgtgctggccacgctgcgagagtggctggagcagcacaaggacaaggtgagtcctgggcccgggcgagggtggggtccgcatcccggccagagtgaccagcccccatcatcgcccagggagtcagggtgcagagcgcagggccaggcccgccccttccttccctgtttctcctgcgcaagggcgcctggcggtggcgagatgggggtgatggcacacagccgtgagcctccgtgaagggcgcagggccaggcaggtgaaagcctgcaccagggcaggcagtcacaggatcctggggccaggcgtggcagctcggcccaggctgagcagcccctggcgcaggtggaccggctgatcatctgcgtgttcctcgagaaggacgaggacatctaccggagccggctcccccactacttccccgtgggtacgtgccccgcgccgccccacggcccgcccctgccccggtccaccctgggggcgggctctcactgtcctctgccttccagcctgaggctcccgcagcccaccctgaccgggactggtaagcagggcctcgccccgtgcggcggccccggccctagactaacccgcccactaacccccgctcacccccaagcagggcgggaaaccacggggcagcctgggaggtcggggacgcccatagacacctctgactctgctctgccctcagacccgccttcgggaccccgctcccagctctgagaggtcgccaaagcctgcagcctggcctgggcctggccaccccttctttccctccgcgccccgcccccgaggagcctaataaagatctcgttgtggc

SEQ ID NO: 38509 - DNA, 67567 bp, Homo sapiens
cgcgccccgggctcggccgacccggcggggatctaggggtgggcgacttcgcgggaccgtggcgcatggtgagtgggagcggctggggggttgtgcagcctcttggcctcttggttgggaaggggccgggcgccgagctcggccctctagaggcccggggccgcggcgagcttcgcgggggccgggagaagcctgggcccggctgcgcggaggacaaagtgggggtgctgggcgcgggcgcacaggccggacgccgggagccagcagcatctctgcgccgctttggtccagaccatctctgggccggcccgcgtcctccgcagcccgcgtcggccgagccggggtgggggtggttccgggtgcccggtcccccacaccgctaccggcctctgcctcgcggggcgtccggcgccttcggggccctggcaccgctctacagaggctcggctctgccctggtcgctgtcagtgccatctcccttaacgagaaacttgggcgtgatgtatgcgaaacaattttgatgcatgatggtttctaactccttaggaaaagataagtcctttaattctattacctgatttcgacatggtcgtagttacttgaatactttttccagtgaaatttggggagtaagatgaatttgtggaacatttcataagacaaccgtaaaagatgggaaaggggggaaatcccagttttcatggttgtaggatgaaaactagttccacgacagttagtctccaaataaccttatttggcctccgcaaatatgtactggttgctccagaaatcatcctacttggtatgcggcgttagatacattagaaaattagttactaacggtctttagggaatgctttgtgagcctcagtaacgatcaccagggttttctctttcaaaattgactcataccaggtccaaagccctttattcttttcacccttttattatttttcctttaatgtactttgtaacacttagaataaaagtttagagtaatcataaatgcccccataaactcactatttatccctcttacgtcagtagtcatttattttaatttattatgtttgatagggaggtgttttaacctgaagaaatgatatcttcccgtatttaaagtttaataactgtatactgtttggcccctgtcagactgtgtttgtgctagtcttttttccttcttctttttgaactgtagtatcttcttaataactttgaagaatgtgtggtactaatagaattaaaagaatatcttggccgggcgcggtagctcacccctgtaatcccacactttgggaggccgaggcgggtggatcacctgaggtcaggagatcgagaccagcctggccaatatggtgaaaccccgtctctactaaaaatacaaaaattagcggggcgtggtgataggctcctgtgatcccagctactcgggaggctgagacaggagaatcgcatgaacccgggaggcggaggttgcagtgagccgagattgcgccactgcactccagcctgggcgacagagcgagacaacgtctaaaagaaaaaaaaaaaaaagaatatcgtcacattctaataattacctagagtttttaatgcaattagtaattaaacagccttttgttatttgctcaattatttaagaagtgactctgtggactctacttcttgctttgagctgctttattctgtctaaataagcctgaataatttccatttaaaattttgttttgattctaagaattaaaattaaatatcttaaaattataatacaatattaatagttttatatgggcttacagttgaataatggacctaaaattaaagttgaatagtagcagtgcagtattgaagctagttatttgcctgatatactctcaagttactgagggtttagatatactcactctactttcacagtcaccatttctggatagtctgaggaactgtagagttctaggtccttgaagatggctatgaagccattattatacaaaattattgtttatttttgaatgtttatataatctttcattgagaatgatctttaaatgatcactcaaaagttttttgaaggccaggcatggtggtattgtctgtagtcccagataactgggaggctgaggtgggaggatcacttgaacccaggaattgaaggctgcagtgagctatgatcacaccactgtacttcagcctgggcaacagagcaagactctaaaaaagaaagaaaaagtatattgacacaaacaatgagtcttagtttatgttttgtttctcatttttatatttgtttttaccctagcacttgcctttgaattaaagttgtgtttgtttgtttagtttcctgggagttactgatcatcttctttgaagaaacatgaagttacactatgttgctgtgcttactctagccatcctgatgttcctgacatggcttccagaatcactgagctgtaacaaagcactctgtgctagtgatgtgagcaaatgcctcattcaggtaggactaagagtacttttattaatatcaaaatatattgtagagcagaaacattatgtttatatacagatatagagtgcatatatcatatagagtaagacctgagtattgggtcagggcctgaggtactgaatcatgacacacaggtctggatttttaccctcatagcaatcaatatatataggcaaggttagattcaagaagttcaatactgagtataatatcctgttgtataaacatgtcattacaaggtgatgagcactctattcagatgatttaatctgtgtaatctaattaacatagcaaagaggttcaatgaatgtatttagaaaaaaaattagctggtcaaataatagataaattgttaccctaagtatgatgtattagttgtccattgctatgtaacaaattaccccaaaacatagcaacttagtgcaataaacatgtattatttcatgcagtttctgagggcctggaatctgggagcagtttagccaggtggctgtggcttagggtctcccacaatgttgcaggcaagttgttggctgggattggacaatctgctttcaagatacttcgaagttatatctcttccaatcatcaaggcaggcctcttaatgtagccaccactctcatttttctggggagaaaagtaagaggaagtaatgtggctaagttaacaggctcgtattgaactcctgattagcttcctttctagttgcaggctgtgcactcagaaattcagtagccacacacattagcattctatgtaaagtatgagtcagctaacatgactgtaaccctcacttgagagtaattgtgtatatgtgctagagtgacaattgtttttatacatcagaagcattttgtgcttatttctgacattttggtccttctcgctaatagttggaattctacttgcccccatttcgtactctgataaccctaactttgcatttcaaaccaaaacatttaactagagaagtgtgtttgctgttcagtttttaactttttcgctgtggacattttcaggtataaaaggagaagaatataatgaaccatccatgagtagttactgcagtcactacctcatggctactcttattttatctataccctcctacattattcactcccagctgttttaatttcaagcaaatcccttgatactgttttgttgataattctaatatgtatctctaaaagagaactctttaccaacatagctattagaccaattttacagtttaaaaattaacactaattctttaatcacctaattttgtatgtggaaatcttaataaggcacgcctgcttaggcttgtgttggctggaaactttgtgtctgcaaatgaagcccagttttgtgctatggtcagatgaggagtctgtggtacctcccagattgtttcaatgtagcttcattattcattattcacaataaagtctcataacatttgctgtattcatgtttagatggaaattctcttaaattccaaattatattcttgactcttcaactctataacttgcattagttcaagtaattaaaaattgtactttggccatgcacagtggctcatgcctcgtaatcccagcactttgagagattgaggcaggaggatcacttgagcccaggagtttcagaccagcctgggaatcacagtgagaccctgtctctacaacaaatagtttttttaaaattagctgggcatgatcatgtacacctgtagtctcagctacttgggaggctgaggcaggaggatcatttgagcccaggaggttgaggctgcagtgagctatgattgtgccactgcactgaagcctgggtgacagagcaagaccctgtctcaaaaaaaaaaaaaattgtactttatttaaaataccttgcttttaaagggagtatttaaaagagaaagcttttgattaatatgggtagatacttgtaaaggtttttttgtttgtttgactctttaaaaattttttggctctattacagcttactacagccttgacttcccaggctccagcgatcctcccatctcagcctctggtgtagctgggactacaggcacgtggcaccatgcctggctaatttactttgtatttttggtagagacagggttttgccatgttgccaaggctggtctcaaacttctgagctcaagcgatctgccaaggctggtctcaaccttctgagctcaagcaatctgccacctcggcctcccaagtgctgggattacaggtgtgagtcaccgtgcctggccattaaaaaaatttaaaaaattacaattacaaaaattagctgagcatggcggtgcatgcttgtaatcccagctacttgggaggctgaggcaggagaatcacttgaacccaggaggcggaggttgcagtgagctgagatcgtgcgactgcactcccacctgggcgacagagcaagactctgtctcaaaaaaaaaaattgtaaaaaaacaaaatacttcaaaatgtaaagagtactatatcagtgtaaaaaaactggaaaagcaaatggagcttcacctaactcaaatggtgattctagtaaacaaaatcagctaggacgtattttcagtcacaaattcatggatgctgacatttctgatattccgttgtagcttcagagccaggaaacatcaaacttttttctggagtagtggacacaactatcctggtggatggtagactacttggatttagaaaagatctagggctgggccgggcgcggtggctcaagcctgtaatcccagcacttcagaaggccgaggcgggcggatcacaaggtcaggagatcaagaccatcctggctaacatggtgaaaccccgtctctactaaaaatacgaaaaattagccaggcgtggtgatgggcgcctgtagtcccagctactcgggaggctgaggcaggagaatggcgtgaacccaggaggcggagcttgcagtgagccaagatcatgccactgcactccagcctgggcgacagagcaagactccatttcaaaaaaaaaaaaaaaaaaaaaaagaaaagatctagggctcaaatattgaggattttcttgtttgtttattcacaaacatttattgagtgttgaaatgaaatgtgattagttccactcttcacctagttttgtggactcccaaactctagcagattatttcacattctgatctttagtttccatgtgttcctcttactatggctgtgtggcaaaccaccccaaaaaccagtggctggaaacagcatttattttgctcacgaatttgcattctgagcagggctctgcggaagagttcatctctgttccacgtggcattagcaaggcggcttgaaggtggtgggggtggaattatctgaaacagcactatagatagagctttctgcgatgatggaaaagatctacatctaccctgtgcaatacagtagaatctagccatacgtggctaccaagtacttgaaatgtgactagtatggctgaaaatctgattttaaatttaattcaatttcaatttcattagctgcatagctgcatatgactagtggccacgtattggacattgaaaatctgaaggctcactgataaagtctaatacctgggctgggaagattcttcaggtatacgtctcttcctgacttctcctccccttcctcccttctctatccccatctccctccctctctccctttcactctctctgtgtatatatgtgtgtgtctctgtgatcctgctatatgatctctcctgcaggtccacctggatttaagtggagggaacataggccccacctctgttggaggagtgacagtgtcatgttgtaagctgaacatgtggatgggatataatggtgtggccatctgtggaaaatacactctgccacatataaactgtaaagtgaattggctggctaggtgagctcaaaattttcttctagttctaggcagttttaaagaaagaaaccaactagtatgtgtcaaatgttctctttttttcatcagagtaataaattattaaattattagaaggctacatagtgaaaaattgaatctcttgatctaattctccctactcattctattaccctgggaaaaccgcttttaatctaactcttatatttttacttctgttagtaatttttagccatatgcctaaataatatgcttgtactactatttcttgattcatcagttttagatgttatatatctaaaattgcctttctgctataacagataaggtcatagctcatcatgtcatccttcccactcctgccctgccacacttgtatcacagttttgagtttatctcttggttattttttcaatttcttcaatatatttaaggttttctattctgttctatcaactggagacactatctctttattcctgatgtaagtggagaatattaatagtcctttccttttaaagtttattttattttattattttttttttttagcaatgagacagactataagtgagttttaagaacagtgcatttcttgagggaattgaagagagggtttgtttgggttccagtcttgggagatcatgtgaagctaccatgtttaacatcatagaaagcaaagaaatcagttttttcccttgcatttatgagtactgcccttgaaattttctacttttggcattctgatgggctacttttggaattctgatgggctgcatcaaaatctgtggggaacggagtgttacctgtacttttacttttatattgtcaaggttgataacatctacattctgagaggctgcatagtataatggttaagcgtatgaactctggaaccaggctatctgaatttggatccagttctgccacttactggttgtatgaccttgggcaagttagttaatctctcaatgcctcaatttcctcatctgtaaagcagggataataaccatactgtgcgagtattgtgaggattaggtgtaaagtatttagagcaatgcctggcacgtgagtgcactataggtaattactaaccttatttctctgttttgtaactctatttgaatcttctaatgctttatttacaggtatattctaaaactggcaataaaccatgtttatattgtaatgattatataaatattgttgactgttgactgtagtcacataggtactatgattacatttcccttcttgaatgattttgtttttcttgagtttctaattatctttctttaccttgtatcatcaatcattagcaccttatattgttttaagtacttaatgtatttttcctcccaaatggagccttcagtcttgatgtttccagacttaactgattgcaatctaggtctgatgcaagctgtcttatggtgactttccatcattactttcccaagttggttccagtgtttcttggatttcgtatcttgttgtttttaacagtaacccttattttgtcccaacatgccctcaagtaacttcctaagaaagcctgtgtggaaagtaagctttctgggtcctgcatgtcttgaagatgtatttattctcacctttcacctgactgatggtttgcctgaatacagaattctatgttaaattcttttccctcagaactttggagacatttctctattatctaatagcattccatattgccaataagaagtctgatgccagtctgtttcttattctctataggtaactttgttattctctctagaaacttttagtatcatctcattagccttcatattatggaatttaaactgttgagtctagtgttggtcttttcattcattctgtttggtatcttgtgagtcttttggggatcagttttgagccaaagactaggaaatgccctgttttgttttttgttatatatatatatatatatatatatatatatatatatatatatatatatatcttgtcctaacatacatacatatataatatatacgttttatataactatatttttgtataatatataattatgtatagtgtcctcttttctttctggaactcttattagtataaatctaagatggattctctgttagattttttttaaaaaacagttttattgagatatatgattcatatattataaaatttacccatttaagggtacaattgagtggttttggcatatcgacagacttgtgcaaccatcaccacaatctaatttcagaacattttcattactttagaagggaactccataccctttagaagtcatttcctattctctctccccacaaaccctaggcagtttactttctctctacatgcttgttctggacatttaatatgaatggaatcataccttgtcttttgtgtctgacttctttcattgagcataatgttttcatggttcctgtgtgttgtaacatattcagtatttcattccttggtcaaataatattctgctgaatgggcataccacattttatttatccatttattggttggaggatatttgagttacttatatttttggctatggtagataatactgctatgaatattcaagtttcagtgtgtggatgtatctttgtttgttttttaagagataaactgtgttacacaggtttgtttactgcctgtgcacacaggcagtggtgcaatcattgttcactgtaaccttgaactcctgggctcaaacgatcctctcaccttggcctcccaagtagctagcactacaggtgtgtgccaccatacctggctaattaaaaaaattttttgtgtgtggagacaggatcttattatgttgcccaggttggtcttgaactcttgtcctcaaacgatcctcctgccttggccccacaaagttctggggttacaggtgtgagctgctacagacaaccctggatgtatctcttaatttttcttttgtatatacctaggagtagaattgctgggccatatggcaactctgtgtttaacattttgaggaactgctgaagtgtttattctaaagtggctgcactattttacattcctaccagttgtgtatgagagttctagtttccctatagcctcaccaacacttatctttcctttttattgtagcacctttgtggagtggttatgatttgcatttccctaatagctaatgatgttgagcatctttttatgtgcttagtgaatgcatgtgtgtgtgtgtgtgtgtgtgtgtgtgtgtatgtatgtatttttttttttttttgagagaggatcttgctctgtcacccaggctggagtgcagtggtgcaatcacggctaacagcaacctcaacctcctggactcaagcaatcctcccacctcagtctcccaagtagctgggactataggcatgcaccaccatgtctggttagcttattgtatatctttggggaaatacctattgaaaaccagtgctcttttttgtgtgtgtgtgtttgttttagacgagagtctcattctgttgcccagactggagtgcagttgctctatcatagctcactgcagccttgaactcctgggccaacacgatcctcctgcctcagcctcctgagtagctaggactacaggtatgtgccaccacactcagctaatttttaaaatttttaaattctttatagggatggggggtctcactgtattgcccaggctggtcttgaactcctggtctcaagtgatcgtcctgtcttggcctctcaaagcgctggaattacaggtgtgagccaccatgcccaacccagaacctatgctcattttaaaattggcttgtctttttattgttgagttgtaagaattctttatatattctgggctcaagacccttgtcagatacattatttgcaaatattgtctctcattctgtgggttgtcttttcaactactatgtatcatttgtatcacaaaagttttacattttaatgacatccaatgtttctgtttttttcttttgttacttgtgcttttggtgttgtatctaagaaaccattacctaagccaaagtcataaagatttacttgtatgttttcctctaagaattttagagttttaggccaggtgtggtggcatgtacctgtaatcccagcactttgggagatggaggtgggaagatcgctttagcccaggagttcaagcctgcagtgaagtagggatccaactttattattttgtatatggatatccacttgtcccagcaacatttctcccccactgagttatattgccacccttgttcaaaaccatttcaccataaacggtttatttatggactgtcagttctattctattggtttatatctctatttttatgctagtaccacattgtcttgattatgtagttttgtagtatgttttgaaatcaggaagtctgagttctccaactttgtactttttcaagattgcttaggctgttctgggtcccttgcattttcatatgaattttagaatcaacttgtcaatttctgtaataaagccagctgggatcttaaaaaaatatataatagactttattttttggaaaagttttaggtttacagaaaaattgagcagagagtataaagggttcccatatacccattccccccacatatccccagtttcttctattattaacatcttgcatctgtgtggtatacttgttactattgatgaaccaatattgatatgctattattaactaaaatctatgctttgcattagcattaactctttgtgttttacatttttatgggttttgacaaatgcataatgtcttgtatctaccattacagtatcattcagaatagtttcattgctctaaaaatccccatagccaacctcttcatccctccctacctccccccagtcccctagtaaccactgatgttttttactgtctctgtagttttgccttttccacaatgtcatatagttggaatcatacagaatgtagccttttaaaaggggcttctttgacttagcagtatacatttaagtttcctttatgtcttttcatggcttgataatgcatttatttttatcacttattattacctaataatatcccattgtatgaatgtacttactgattaatattgcactcactgattagtatggatgtactagagtttgtttatccattcacttattgaaggacatcttgattgcttctaagatttagtagctatgaataaagcttagccaggcatggtggctcaggcctataatctcagtgctttaggaggccatggcaggagggtcccttgaggctgagaattcaagattgtagtgagacccccatctctaccaaaagaaaaaaaaagtcttgagtgctggtgtgcacctgtagtcctagctaactgggaggccacagtaggaggatggctgagcccatgagttcaaggctacagtaggttataatcacacaactgcactccagcctggataaccaagcgagaccctgtccctataaaataacataaagctgctataaccatccatgtgcaggttttgtgtgggcataagttttcacttcatttggctaaatactaaggagtgtaattgctgcgttgtagggtaggactatgtttagttttgtaagaaattgccaaactgtctttcaaagtggctgtaccattttgcattcctaccagcaatgaatgagagttgctattgctccacatcctcaccagcatttggtgttttaagtgttttggattttcaccatctaaataggtatatagtggtatcatattgttttaatttgcaattctctaatgacatatgatggagagcgtcttatacttatttgccatttgtatacctttttgggtgaggtgtctgttaagaatctctggcccattttttaattgggttgtttactttttttattgttgaggtctctgtatgtatgttttgtatagcagtcctttatcagaaaagtcttttgcagatattttctcctagtctatggcttgtcatctgattctttggagagtattttttgcagagcagaagtttaaaatttcaataaagtccagcttatcatttatttctttcatgaattgtggctttggtattgccagctaagatttaatagggattgcattgaatctgtagatcaatttggggagtactgtgttgccatcttagcagtattatgtctttgtttcatgaacatgtgtgcctttccttttatttggattttctttcatttctttcaacaatattttgtagttttctgtgtattacatttcttttgttaaatttatttatcagtattttattctttttgatgctattgttagtggaattattctcttaatttcatttttggattgttcattgcttctgtatagcatattagctcttttctatcccatcataccttcttactctatattctgggaaatttcctgaccttacctttggactctttctattgaattttttaattttagcaataacttttacatttcaagagctcttatttattgcttgttaatttttcctattaatattatttacttgttttttttggatgcattattttcctcagtgtcttcaaggatacttattggaattttttttgctggtggaggaggtgtgtgtccccttcccccaactctgttacctggattatctctttcgagatctttttttcttttatgtcttttttatgtgtcaggatttcttcaaatgtatacatttctttggttgtcaatatataattaagaatgaggcaataaaacctggttgggagatccatgtatttagataggacttacagactggacttacagcagagaacacttggggataaggaaggccttgatgctggaatgtgttctctgctctgaggctaatcatcttcctgaagagaattgttggttatttgtttattttgattggctgattttcttgttgtgattggacatgagtagatggtcagtagatgcctagttcttgtctttttggtctattgtgggagtagcctaactgatctgatagaaacctgaacttgaacatcctctttttatccctgttctctttagttgaagaatggtttggctcttggtatttcatgtgccagtgattgttaactggggccctggacctcttaaggggtatcccccggattatattcaggagatccccaaggttatattcaaaattgcctgtgcacagttttctggggaaaaggtccacagctgtcaggaagttctcacagcagttggtgaacctgaaaaggttaaacattgttgtggctttgctttccattccaacatactgagttattaaaattccactttcatgttctgcgaagtacagggcacattgacattttagataacgagagctgcttttctccttaaacttgcagaagatgtacagaaatgaatacaataaggtggaagataagtactttaagaaagacaaagatgcaatgctataaaagtttataaaaagatattagttcccttgtagagagaatttaggtttctttttgttaaattggtttagtttgaacatttgtaatgttgaactgatgtactatgaggataaattagaacatttgtttatattgcatcctctacacttataactaagtatgaaaaattttccctggaagctcttatgtaaatattttttaccagcatggttgcaaagcagtacagtcattcctgccactcctacaagttgctgtgcctaaaggtggtccctatataaatatttattttgtgcttctaacaggaaagaaatctaactttaaacatcaagaaagtaaaattcatcttgggtgtacttccttgctcatataatgaggggtttagttatcctgtttcaggaaaaaaaaaatttggtaatatgggattttcctttaagaagatctttactactttcccctgctgcttttgtgaaaataatttttaaaatttggatcaatattatgctataccccagaaatctcaagtcccattttgtattaagagtggaaaaactcctatattaacttgtgagtactttggctaatatttatgatagtttttaggatgacataaacattgtatttcatgaaaatattcaaaattgggttcagagataatgcatcattttagtactttgttgtctgaacatttatttagctcttttatgtgctaaattgacagtctgcttttttattctaaaaattgatttagttattaaataaatcttaagttttctgaaataagttggaattttaaaatagtttacttctcattaataattctagcttttaaaagtatattttgtcttaagttaaaaataaatagttcaggtaagtttagggcttccttaattacagtaaactaaagaattaactttttcttctttttttcttaatcagtgcaaattagattcaactttagtctcttgctatagttatcttgatttgttagtacactagtaatattttggtttacaatgtaaaatgttttctcttttctctcgtgaacattattttcctaaattgtttctttcctcttcatcccattttcctgctcttaaaagttgtggtgccatggctgggtgcagtggctcacgcctgtaatcccagcactttgggaggctgaggcgggcaggtcacaaggtcaggagtttgagaacagcctgaccaacatggtgaaaccccgtctctattaaaaatacaaaaattagccgagcatggtggcgtgcacctgtaatcccagctactcaggaggctgaggcaggagaatcgcttgaacccaggaggtggaggttgcagtgagccgagatcgtgccactgcactccagcctgggcaacagagcgagactccatctcaaaaaaaaaaaaagttgtggcgctaacctatttttgtcctgttttgcttcagttaacaccccatgaaaatctctgaaattaatgttcaaatgtaatgagttaggcctgatataatttaaagaaagaatacatcgtttccctccaaatgtttaatgcagttatagtagctgctaatatataaatggagattaaaatttattttcactagttgtttcacctgttgcattgttaaaacaaaatgaggatttcactgggacacacggacattttcaaacatacataaagtaggaaaaattgtaaaataacccccccatttacccattactcagcctcaacagtgatcaacatgtggtcagtctcatctgtacctactcccaactcactccagctggattcttttaaagaaattcactgggggacttgtacagtaagtaggattagcatctaaatgtttgttactaggtttatgtgagaaagaggcactgtttgatatattttggtaattcatatatatacatgaacttgtatgctgacttatttagccaaaaataagtactcttttcaatactgattcattcaagtgtatgttattttcaggacaaaagtttaccaatcagttagaatttgtaaagaacaacatgctaatgaggttgggttgatatttctctcctgggtttgaagattcatgtgatgccctccttaaagagtattatggcaaaacagatttgttataacccaatctaattataattgtttattcttttgaataggggctaattgaatattttatttatttatttatttattttaaaatactcatttgacctaagtaaaagtagtgtcagcataggtataatataatgcttcattgattacttatgcttacacaatatgcaagtaaatacttaattagatttattcctacatttctgttttttagctcaagacattataaatacttagtttccttaatttaagaacctcagtttgtgtttttaaatatcttttgtaattgttcaaacattaattaaactggatcttaagaagtcataatatccaaataaattaaatgtttatttgctattataaaaatatattttctacccccaaattcagaaaatacagagaagtagaaaaaaagagtaaaacgttcttagtcctattatccaaacacatactactcttactattttgatatagctccttctggtttttattctctgtttagattatttttaacaattttatggtatatacaacttttgtgttttacattttcactagcattattttatgtttctttgaaaaaaattatgtttggttagaaaatttcagttttaggttaaaagtaaattaaagcaatatattttcagagttagaactgtcttctgcattgctttaataccaacttaatgctttatatttttcagtttaggtttatttctttaaaatttatgaagaaaccccagtgtaccatgctgggtttttttttttttttttgtctttttgtttttttgttttttgagacagagtctcgctttgtcacccaggctggagtacagtggctccatctcagctcactgcaacctctgcttcctgggttcaagtgattctcctgcctcagcctcctgagtagctgggattacaggcacgcatcaccacccccagctaattttgtatttttttagtagagatggggtttcgctgtattggccaggctggtctcaaactcctgagcccaagcaatgcatccaccttggcctcccagaatcctgggattacaggcatgagccactgctcccagcctgttcactgtttttagatgtacagttttatgatttttgacaaacatgtactcatgtaactactactacaatcaagatagagaatatttttcatcaccctaaagcattcccttgtgccccctttgtagctggacctagctttttccctagcctcagcccctggcaaccactgatttgattttttttctctatagttttgccttttccagaatgttatataaaaggaatcatacagtatatagccttttgttctgtctagcttctttcattcagtataatgctttgagattcatccatattattgtgtgtgttgggtagttctttcctttttattgatgagtaggattcctttgtgtggatgtactacaatttgtttatccattcactgattgttggaccttgcgtggtttccagttttcagtaattatgaatgatgttgatactttcccatatgggtctttttatggacctatgttttaatttttcttgagtaaatacctaggaatgggattgctgggtcaccggagcattttgatattcgttatctcattgggatgcccaagtttgtaagggaaaatccaggaacaccattccttttttatgactgggaaaccgagactcagggttgcaaacagcttatgggcttaaaaccagatcttgtaagtccaagtcatttgctatctttactagaatataatgttgttttcaatgacgtttccttgttttattatagcaacagggttaacaaatctctcagatctttgcaacaagaatggaaatatttatcagtaactgagagtcaatattaataagattcttcctcaagttgttagtttccatttctggcctagaaatttgggagttcatacaataaatgttaactcttaaagtctaatcttaatcttggataaatatactccccctcaatttattttgcataaataattaatatctgaccagagcatcagttgtatagtcatggcactgtgtaacaacattttggtcaatggcagacaacatatatgatggtggtcacataagattataatactgtatttttattgtaccttttctatgtttagatatgtgtagacatgcaaatatttaccattgtgttataattgcttacagtattcagaacagtaacatgctgtacaggtttgtagcctaggaacaataggccataccatatagcctagggttatagcaggctctaccatgtaggtttgtataagtatatactgatattcatataacaacagaattgcctaaggatgcatttttcagaatgtatccctatccttaagcgataaagcgtgactgtatatggaataagattcttctctaaagatgatcgaatctgtcttctggcatctaaaaatttgaaattctctgtcatattgaaggttttccttaatataaatgtagtaaaatacattttgaatgattagatttttccctcaaacttttcatcctgccagactttcatttcatataagctttgaaaacagtttgccaaattctctctaaatactcatactggtcaatagagagtagctcaaatgtataaatttcagtttaccatttagtgtaaagttttaatttttttccatcataaaattattgaacaacgtgtctaccaaactttaagaacatctagcatagttatttacacatagaagatgtcttattccatattaccttgcctctaacatgcaagagcagtggtggtagaaaaagccttgagtcagaagaccttgtttcaaagccgcagttgtgtgaactcacagaaatcatgaaaccactcattctcagccttctcttctccacatgaggaacaaccacactttctctgtgacttgcagactagggaagcagaagatatagtcattaaccagctgaagcgacaacaaaaaaaattaagtattgcattccaagtcactggttttgcaactcttagccaatgagtccaattttacctttacaaacaatgattaaacttgggcaatagcatttctagttgtattcaggtactgagagtgaaagatataataatgcctttgattaaacaatctaaagaattatctaagtttaattataggcttattctttctaagagagtaataactgtaattattaaaatgttaatttaatgaaaaataacttttatatttctcattttaatgtttacaaaacaggaatacctaaccataactggggtcaaattctagccactaattgaatgaagttgtataaatttcatgacttcacttaaaaaataaggataataacgacatgaatctttatgagattcaagacaatgcatataaaatacttagcacagtgcctataagggttaaatagaacccatttaaggactttgggggaggtggtagcagtaaataattggaagcattgagtcagtctttattttggacttcagggaacttggtgtttagttttgatcacatgttccattcaactgagcagaacccaaatttagtcatagtgaggttagtaaaatatataaataacccagtccaaagagaagattctaaatttcaactctaccgtattttctgtttaaggagtggagactttgaaataatagtaaaatagaaactgatgaagtttatgaaggtgataaaaaatgagaaagtggacaaggtgtggaaaggattaagaatttaatcactgtttctgaattttggcacattgatgtactattatgcgctgattaaattatgttgacagattttttatgatagagaaatgctatttttttagatcaaggtagtatataatcattattttgttagacatgcataggaatttaccaaagggggaggaatttagggttctttctttctactctagtagatattttccaaagtcttatataattaaagaaatacttttaaaattttggtaaaacctttctttttatcttgactttagcctttctggttatagaagacatgtgttcttataagtgaaacagctaggggtaaagttttctttttttttttgagacagagtctcgctctgttgtccaggctggagtgcagtggccccatctcggctcactgcatactccgcctcccaggttaacgccattctcctgcctcagcctcctgagtagctgggactacaggcacccgccaccatgcccagctaattttttgtattttttggtagagacggggtttcaccatgttagccgggatggtctcgatctcctgaccttgtgatccgcctgccttggcctcccaaagtgctgggattacaggcgtgagccaccacacccggcctaaagttttctttttaagtgttctgaagaacagattctgcttgatttaaatggggcagtttttatgtttttctgtaatccttgtttcatcacagagagttgttctgagttgttttttcttttctattttcaatacttgagttcaaagcactttacaaatgttattatatttagaaacattcatcctaaccgcagcttgcttgctgttaaaaatattatacatttctaaatatgttcacaaccaaacattattcaataatgtgatttttaagggcatgtagaatgaatagaaaagaatgaattacttgatgagcttcataaaactgctatttataattatttgcatgtggaaattcattgtttcagtttgtttcttgacttaaaaacagtagtcatagagtagacatatttttgctctcctgatttgcagtaagattttaaatgccatctattaaatttgcctattatatttctcctgaaaagtaagaggtgtgtttttgaaaatggaaaaggcacagatgctgttttcaggcacaaactctgttttcaaaaggtcggtttgaagagcttgtttttcttatttgcccatctcctaaaaagaatgctgacgtgagttatgaagaatagagagtatttgatgtatgtggaggctcatttacccaaattatgaacatttcttaatttatggtgattaaatttctgctttattaagacaatggttttttagtcttttctgtagtaatgtagaaagaaagaaaaatattagccaggatattgttgtttggtgtccaacaagttttaatagtagtttttaccattaaagtcttaaactggatttttgtctctttaattgtacagtaatgaaagcttatctctgtcgtttccctcttgtttctccttaccatagcttttaacgttgtattctatcactaaattataaagcagtaagcatatgactacagcatattactctcttacaccagtatgtaaaagtgcaggacaggcatctattaagagggtgtgaaatacatttaatcttcagagctagataacctgggcaagttcaagcgacttttaaataggccgttagttttaactttctgtttgttcgcagtaatctcattctcacccaccttttcattctagtttaaaacacttcacaaatacctgacagtaaaaggcataatgaatgcttcacagactcagatttctctaatgggaactattaaattgacattcatttaaaaaaattatttggcataatatacagtaattcatttagcaagctaccatttggaagctgcagaaaaaggagagactatattctttgaatagatttgttacttttctaatttgtttctccttagtttagttaataatataaatacaggttgaacatttcaaatccaaaaatctgaaatccagaatgctccaaaatcggaaactttctgagcattgacatgacatcaaaggaaatgctcattgaaagagtttagatttttggatacaggatgctcaactggtataatgcaaatattacaaaatccaaataaactcaaaaatccaaaacacttttggtacccagcatttcagataaggaatactcaacctgtataagcaactaagatagtgaaaggatattttctacatataaagtaaattaaaattttttaaaaagctttatttcttgtgactaagtgctaacctttataaatctaaaaaaaaaaaaaaaaaaaagactgttagtattcttatctgatggtgtttctaaaaagtgcgtactcagaaaatgttcttttactccaaagacaaagtatagctttggcaactctgtttttctacatttccaactaagtttgagcctgtctgaatcacgcatcaccagttttgtgatgaaacagctatacttctcattaagtctctgccctttcagtccctctgtttctgataggcccagcaaagttacctaatgtctatgtcacatgaatgcagcctgagtgtacaaaattctgcagtaccaaaatattacaatgtgcatatattaggtcacacatatacacttatatcaaactaatgaattagttagaaaatagcacaagtgttgattcttgaaagtgctgtataattagcaaggggacttttggagacaaaaaacaataacaaaacccaaggaattaaaatcggtgctgcaaaaaatgtcgtattagaataatgggctgactctaatagtgtagaaatataataagatgaatttagtagggataaatattgtggtctgtgtttacattttgaaagcacggtattgaggtacagaaatgagaaataatagttacattgcactagttaatttttaaaaacatacatatcaatagcattccattaggtctcagatttttaaaatcttactgaaatgatttgttggaatgatttgaaagtagcacagttgctgacagcatattgctaccccaaacaaacaaattttaggcttctttaattttaaaaactagtgttcacaatcaaggaggtaagtgggattctctccttcttggctagttacattatgccataaggaggaggagcagggaaggggggggatggggatgatgatgatttaagattaccacactttcacctaatgacaaagctaatggcagggttaacatcatgtcatggggaacaagtgaagaaaccatgggagtatttgatctaaaatgaggacatgggggaataaaaatagaaatcattttgttttaaacagggcgtttttggttggaaataaataaagcctactccaattgatatgaatatatcaatgaagaatatctccaactgataatagtatctctaagaacaggaagtgcagctggttgcaaaggactagagccaagaactagagcattattaggaatcagaatggcgtcttccctcccttctcttctccttgtgaccatgaatgtcatggtgcttatctttggaaagtaggaatgggggggccacaggataattttttacctcttattttgaaacggcctccccagtaccagctctgtatgatcccctagttcaaattcctaacagagattgacaattatctgtgtcttacttccagaatcttggaagacaatctgattgaccagctacagtctgtttttcacctgtgttccaattatttgtagccagagagaagaaaggtcatatagttcaaaacagagctgcagacagacagggtgggaatcaaaggcaggtagcagccaatcagggcagacattccaaactgtccagtgcaggtgccatgaaaaattagaacggctttgttgaagagaaattatatttggaggaggggggtcttaaggagcaggcttctgggaatcaggcttcagttccacaaaagaaaacacttaaaactttataagattaggaccggctactttggattgttaagttccttgtcagctgtgggctgcaatggccatatgttgatggaacactatagaagcgattcaggtgttacatggaaggatggttttgttgacctgtgaagttccttctaagcctgagagtaaaatcagttttgtcataagttatttccaccaaaataataaaatattaatgtttttcgtataaatatatatggtatcttaaaccagggaaagcaagtaatcagtggtggctatggaatttccatttcagttgggtttgttcaggactggcagtctggtggcaaggggagggcaggggcaagtgctaaaggaattgctttagaacttcatgtacagagcaagctatcttagctcttgtggaataacaaaccaccctaaagtttagtgggttaaaacaatagccatttatttaactcttgtttctgtgggttgacagtttgagcctggatcagctgggtggttttctggccttattcctgtgtctgttggcagctgctggttggttggaagctggctgatctaggatggccccaggtggactgacttgtccacatggccatatcctggcttcacatggcagctgggcaaagttctaagagaaagagtagatgcactcaaggcttcttgaggtctaaactcagaagtgacataatctcatatccaccaaactctcttgaccaaagtgaatctcaggatcacctaaattcaagaggtctagaaattgaccctgtcctttgatcagaggagctgcaaagctacattgcaaagaggggagacctagagaggggaataattgccaccttctttgtaaataatctaccataccaagcacacttttttctgtatcatggaacaataaaaatagaatttccaaagttcttttactcacattttacatattgaggaaccctacaagttggctatttgtttaaatttggacaacgaatataatagctgagaagcaggttttgttcttgtactgaattattcgttgaggtggtgtgggtagtcaagttatggattataaaataaaatattttccttatttcaaaataaggtaaaagcattcaaagtatgttcactgaatatatccaaaaaaaatctacgtgacattgtagatatttatgttctgatgaatagttaataatgttgaataaaaaattatgtgaagaatacattactgtaaatgcaaatatggcagggttttttgcttaaaaagtagcagttttatatatgattatttggaatttgaagtttaacatctgtcttgtttctaggagctctgccagtgccggccgggagaaggcaattgctcctgctgtaaggagtgcatgctgtgtcttggggccctttgggacgagtgctgtgactgtgttggtaagttgataccaagggagacttcttaatatttcttatcacagaatccttggctttaagagactttaaggaatataaatgtagtttatgtgcataaacaagtatgtgtgtgaaatatagtaaacatacagaacattgtatttttacattcaattgtattcagtagtatttacctatacatgtatttaaaagtgcttatccttgggaagtaggagtggggggccaaggcagaatgtttaactttttattttgaaagtttttgtactgttgaattttttataagcagcagcattttttttttgtttttaataagaagtaggttttataagaagaaacattctccaagatgtgttaagtaaaaaaagtcaggttcaaaattatgtttatagaatgctatcatttgtgtgttagaaagaaaacttacgtgtgtaggaagaaacacctgtcagcccttctctgaccagttaactcatttttaacttttaaaaccccagttcaagtatcccctttccttggaaaccttccttatttgactgagataaaggatcctctatgcttctgagagatcatttattgcatgctcctataattgttgttttgcatgttttttcgacagagtatcacctccttaagaacaggaatatcatcatattgatcttttttacattatcctttatcgaaataggctatatgcatatactttttaagtcacatagtactaaaacaatcccatctcagttctttccaagcctttgatcctatgcccagagactaccactttcaacttttcagcgttgcactgcttccataattctgaataataaccctatactactctcttgattctttgattttagaaactatcagttgacttcctcttatggtagacaagcatttagttctcttatctcttaatcttcccagtgtgattttatcactccttctagtgaaatcagtatttaccttaataatcactctaatgaattaataatatatactcatttgatgcataataatgtaagcactaattaattaaatgagttatcccattatctgtctttctgtattttgggtgtatggtgtacttcttgagagatttcctaatcttttcacccttgtattaattttttaaatttttacttccttttttaatttccaagagcccttctctgattgtccttttttaaggaacatactgttcttgttttatatgtaacatatttttcttatctttatgggattcttaattgtactgttttgtggttgctgttgagttttttccttctactccttgcatgatttccattttctcaggtgtctggtgacccttggctgtctattcctttgtagaatttaggtactccaaaacggactgggagtacttaatccatggacagggcatggaatgtagtttgcctcacgaaaaggtggttggaggatgaactgcctttttcactgacgagccctctatttcatgtctatagatctttccctttagggttgcacattttttctagagaaagatctcctggtttcctgctggtgttgaggctggggtatggggcagtatgccaggctgcaaatgttctgggaacctgaggggtgaggtcacagtaaacagtaagcatacttttatttacgttccttgtttttttcccatactcatctctaccctttgccatttttggcattcccagtccagggcctctttggtttaatttctctaaagactaactctctcatctcctacagttgtggaagaagagacagggacctgaaggtataactaccccacagaataggcttgcctctgccactctggcacctccagctcctgagtctcctcagggttctgtggggtgcatggcctgtgtgaagactgctcagtcaggtacctttagctcttaggttctccacagatagagttagtgtttccatttcttgtttttctttagtgttttgtagtgaattctgagagaatgggggcagaagtatcttttcctctgtcctcttatattcatcttggtatctctaacagctagctttgaattattttaggtcattaactgtatattaatttaatatgtacagtgaaactaaaaaagaggaaatagtcatcttaatctctgatatacacacataagatttttttttgagacagggtcttgctatgttgcctaggctggagtggagtggtgtgatcatggctcactgcaggctcaacatcctgggctcaagcagtcctcctgcctcagcctcccaagtaggtgggactgcaggcatgagccacaacacccagctgatttttatagttttgatggagacagggtttcgccatgttgcccaggctggtctcgaactcctgggctcaagtgatccacccgcctcagcctcccaaagtgctgggattacaggcgtgagccaatgtgcccagcctcacacataagaatttaatttaaacatggatgccaaaatacacaaatgaacttttattaatagcattgcctaaaataatgtgtatgtatgtgtgtgagagtgtttgtgcgagtgtatgaatgtgagtgtatgtgtgttatatatgtgtgtgtcttaaccatcacaccatgatgacagtgctgttcagcgtcttcttttaggaagagagttctgcatttttttccactgagaaagaataattatacatgcttatatctctacaattttagaagcaactggtatgcttccaggctagttctcatttttttaaaaaaagcttatttacctttaagggttggatgtccagttttaaactttgagtaagttcataatgtaacttcatctttcattttaagttaagttaatctttctactttctaggataaaactgagatattccagttctatttatacagcaatcctcctccttgtaggcagctctcttccaaattaggctctcttaacatcctttgcaaacctgccgctgctcctccttcctaagttgaaatagtccccatacttttcatgggtggggcacagacctctgagagaacacaaattagagtgcagccttcctttcctctctcattctgtggacttcagcacatactttctctaggaaactttcccctgtggctcccttgtataagagcttctcttttctgattttttcttaaggtaagagtaaccaccatagttgattttaatctttgctgtccaacatattcctgaaatcctgtgggttttggatcctagatctccacccacaagctcttttttctttttttttactgtttttacttttccaaatgtgcacaaaaatagagagtacagtgatacgtactacctgttccaatagtcattaatacattgccagacttgtttcatccattcatctgtttgttggtatatgtctctatcttcccccacaacctttttgttttgcttaggtattacaaagtaaatcatttcactattatccgtgaagtcctttagttatacatctcaaaaaaagagtatttttacataacacaatgtcattactatgcctaatgtaattaacagcacatctttattttatttttatttttatttttgaggcagagttttgctctctcgcccaggctggagtgcactggtgcagtcttggctcactgcaacctccacctcctgagttcaagtgattctcctgcctcagcctcccaggtagctgggactacagacacacgccaccatatctagatacttttttgtatttttttgtacagatggggtttcaccatgttggccaggctggtctcgaactcctgtcctcaagtgatctgccctcctcagcctcccaaagtgctgggattacacatgtgagccaccgcacccggccatttaacagtacttctttaatatcgtctaataccactcagatcatacttagatttcactgattgactaaatgttttttacagttgttttactcaaatcaagatccaacaaagattactcactgtatttggttgttagatttcttaagtttcttttattctaaaacagtttcttctccccctctctcccatcctttaatattccattggctttttgaataaactagtcagtcatgattggtttcttcaaaataaaccacattctggatttggttgattgcttcttttggttatttaacttgttagttggtcttttctatttcctataggctggaagttagatatgaaggcttgattagattgaggctcagtttttgggaggagggaacagtggtacagtgtacacaaaggcaaacaatatccagacgtcctgcttttagtaatgctaaaattgatcccatgagttccgacggtgaaagtctgatccctttgtgataaaggtccccatcagcctttcacctggtgatttcaccccttcttgatgaccattgcctgagtcagctacttcattagaagctgtaaaacagccaggtgtggtggctcacgcgtataatcccagcactttgggaggccaagagggggcgaatcaccttaagtcaggaattcaagaccagcctagccaacatgacgaaatcccgtcactactaaaaatacaaaaattagccaggtgtggtggtaggcacctgtaatcccagcgacaagggaggctgaggcaggagagtcacttgaacccagaaggcagaagttgcagtgagccgagatagtgccactgcactccagtctgggtgacagagggagactctgtctcagaaaaaaaaaaagaagaagaagaaaagttgtagaacaatgattttctatttttatcattacttctgcagttattagctggaatttttctgtataatgtaaatggaatcctacactactacatagtagcttaaaatacatttagaacaacatgaaatgatgaatgatttaataatagactctttaatggcattaagacattgtaacttttgattcatgtttaatgtgcattaaaagttggattctgcctaagcatgatggctcattcctgtaattccagcacgttgggaggccacagaaggaggatcacttgagcccaggagttcaagaccagcctaggcaacataaggagaccccatctttaccaaaaataaaaattaattagttgggtgtgatggcatgcacatatggtcccagctacttgggaggttaaggcaggaggattactaaactcaggaggtcaaggctgcagtgagctctgattgcactacagcactccagcctgggcaacagagtaagaccctgtctctaaaaaaatttttttaaataaataaataaatgttgaattctatgggaaatgttaaattagaagaaaaaattgcctgagcgcagttgctcgtgcctataatcccagcactctgggaggccaaggcaggcggatcacttaagtttgagaccaacctgggcaacatggcaaaaccccgtctctacaaaaaataaaaaatttagctgtgcatgggtggcatgtgcctgtagtcccagctacttgggtgggagcgggggctgtggcaggagaatcgcttgagcccaggaggttcaggctgtactgagccatgtctgagtcactgcagtccagcctaggcggcagagtgagactttaactcaaaaaaaaagaaaaagaaaaagaaaggaaaagaaaaaaactaggccaggcccagaggctcacacctgtaatcccagcactttgggaggcctaagtgggaggatcgcatgagcacaggagttcaagatcagcctgggcgacacagggagactctgtctctacaaaataaaaaaacaaaaaattgactgggcataatgatgcatgcctgtagtcctagctacttggagggctgagacaggaggatcacttgagcccaggagcttgcggctgtagtgagctataattgcacccctgcactccagcctgggtgacagatcaagaccctgtttcaaaaaaataaaagaaaaaattaataacttgtgccaataaataaaacatggcaagcatgaactttttcatcttgagccacctgtttagcatgtcgtggaacactataattcagtggtgcactgtttgtataatgttgatatagaaatagcagattctttatagtaccaagatcatttgctatacttaataaattggaagcatcataagctccaagaccaggctgtgaagcctgctgaaaacctgcttagcaaccacagcttggctcattttgccataccaactcatagatcctagatgtcgctgtggtgaatggaagaaaggggcacagggaaagagccggaaaaggtgggtggtgtcaggcaacaggcacagtgcctgcaaaacccaggaaaacaggatcagacagctctgtgctgggaacacaaccctgggacaggctctaccacctagtggatcaaatgtttcttccttaatcctgctctttgttaggcaaattccttgaactctgactttgaactcagggctacagtccagtactaaccttgacgggtcttggcatcttccttttggaacatccaggtttttcgttatgactctctcttgtatctcaggtcagatctagatagatccgttggttcctgcatagaatggatttctgtcttgcttcgctctaacatgttacttttctaatattaaggaataaataggtgctaggagttcaaattttctgttttctgttttaagaaaaactatgcaaattatttagatacattatttattattattaattttaattgacaaataatagtatatatttacccagtgcaacaggttattttgaaatatgtatacattgtggaatggctacatagagctaattaacatacattacctcaccttttctgtgtatggtgagaacacttaaaatctactctcttagcaattttcttttttattttttcttgagatagggtctctgtcacccaggctggagtgcagtgatgctatcacacctcactgcagccgcaacctcaagtgattttcccacctcagcctcccgagtagctggcactatgctaccacacctcgctaatttttaaattttttgtagagatggggtctcaatgtgttatccagactggtcttgaattcctggacacaagtgatactcccgccttggcttcccaaagtgctgggattacaagtgtgagccactgtgcccagccagcaattttcaagaatataatacattgttattagctatagtcaccatgttgtacaatagagctcttgaatttattatttctatctaactgaaattttgcattatttgatggacacctcccctttcctcagctcctggtaaccattctgctcaccgcttctgtgagttcaacttttttagattccacatataagtgaaatcatgcggtatttgcctttctgtgactggcttattttacttaacatgatgtcctccaggttcatccatgttgtaaatcagggtccccaacccctgagccatggaccagtagcagtccgccgcctcttaggaaccgggccacatagaaggaggtgaacaccaggcaagcgagcgtcaccgcctgagctccgtctcctgtcaggtcagcggcagtattggattcttacaggagctcgaaccctattgtgaactgcacatacgaggggtctcagttgcatgctccttatgagaatctaatgcctgatgatctgaggtggaacagtttcatcccaaaaccagtcctggtgccaaaaaggctgggggctactgataggatttccttctttttttaaggctgaatagtattccattgtatataaagtggaattgtattttatattgtataaatataccacattgtacatatccacattttctttatccatttttggacaattaggttgattctctgtcttgactattgtgaataatgctgcagggaacatgagagtgcaaacatctctttgacatactgagctagttctatttttaatttttttaggaacctccatactgttctccataatggttgtactaatttacattcccaccaacagcatgcaaggattcccttttctccatgccctccctctccaacacttgttgcctttcatcttttttataatggcccttctaaaaggtatgaggtaatatcttattgtggtgttttttttgttttgttttgtttttttgagatggaacctcactctgtcacccaggctggagtgcagtggcatgatcttggctcactgcaacctccgcctcctggattcaagcaattctctgcctcagcctcccaagtagctgagattacaggtgcctgccaccatgcctggctaatttttttgtatttttaggagagatagggtttcgccatcttggccaggttggtcttgaactcttgacctcaggatccactcgcctcagcctcccagagtgctgggattacaggcatgagccatcacacctggccattattgtggttttaatttgtattgctttgggctgggtgcagtggctcacgtctgtaattccagcactttgggaggctgaggcaggtagatcatttgaggtcaggagttcaagatcaggctggccaacatagtaaaacaccatctctattaaaaatacaaaaattggctgggcacggcggctcatgcctgtaatcccagcactttgggaggccaaggagggcagatcacctgaggtcaggagtttgagaccagcctggtgaacatggtgaaactccgtctctactaaaaatacaaaaattagctgggcatggtggcacacacctgtaatcccagctattcgggaggctgaggcaggagaatcgcttgagcctgggaggtgaagtttgcagtgagccgagatcatgcaactgcactccagcctgggcaacagagcgagactctgtctcaaaaaaaaaaaattagctgagtgtggtggcacacacttgtaatcccagctactcaggaggctgaggcacgagaattgcctgaacccaggcagcagagtttgcagtgagccaagatagtgccattgcactccagcctgggcaacagagtagactctgtctcaaaacaaacaaacaaacaaacaaataaataaataaaataaaataaaataaaataaataatttgtattactttgatgattagtgattttgagaatttttacatatacagcatatatctgttagccatttgtatgtcttcttttgattaatgtctattctgatcctttgcccgtttcttttgagtcagagtcttgctctgtcacccaggctagagtacaatggcacgatcttggctcactgcagcctccacctcccaggttcaagcaattctcatgcctcagcctcccaagtagttgggattacaggtgcccgccaccacgcctggctaatttttgtatttttagtagagatggggtttcaccatgttggccaagctggtctcaaactcctgacctcatgatacacccacctcgccttcccaaatgctgggattacaggcatgagccaccgcacctgggccctttgcccattttttaatattggattatttgttttctcactgttaggttgtttgagttccttttttttgctttgagacaaggtcttcttccgttgctcaggctggagtgtgcacaccaccatacccagcttactttttaatttttgtagcaatgggatctctctatgctgcccaggctcatctcaagctcctgacctcaagtgatcttcccacctcagcctcccaaagcattgggattacaggcgtgagccaccatgcccagccccctgagttcgttacatattttttatattaaccgcttatcaaatgtatggtttgcaaatattttttcccattctgtagattgtctcttcactatattgattgtttccttgactgtgcagaagctttttactttgagttaattccatttgtctgtttttgcttttgttccctgtgcttttggattcatgtcccaaagaatcattgtccagccaggcgcagtggttcacacctgtaataccagcattttgggaggctgaggtgggcggatcatgaggtcaagagatcaagaccatcctggccaacatggtgaaaccccgtccctactaaaaatacaaaaattagctgggtgtggtggtgtgtacctgtagtcccagctacttgggaggctgaggcagcagaattgcttgaacccaggaggtggaggttgcagtgagccaagatcatgccactgcactccagcctggtgacagagtgagactccatctaaaaaaaaaaaaaaattattgtccagaccaatgtcgtggcactttctgtattttcctctacctagttttagatacataatgatcactttccaatctcttcccaaattcaaccatcgtcagtgttgaatttcactgaacacatataccagaattggtatgccaaaggataatgccttatgtacttttttgttgggttttattttgccagagatgtttgtttggtctagatgtttgcaactgttacccaataagtacttaaagacaccgaagactagagtcatttaggcctattcagagtttacttttaaagctgatgcattgattcagaaaaccgactaaaaaagaaaactgaatgtaatttatccattgggtcaaatagcacaggacctaattccaaaattaactccagccatagatgttttctactagtaatagtagcttcttccttagagtgaattttcttcaagaacattcatttaagtatccttttctgctttgagcccatcaaaacttgtgagttgtataaaatatgagccatagcataatattcaggaacaatttcaataaactttttcttccaaaaaaagctatgttaggtaactgttcattttttaagttaaggagatttttctctaagtagccaaaatggaataatgatcacttaactctaaggtgtttctctgagaaactgaatagcagtacctttattccagattaaacttaaaaaaaaaaaacccttttgtgtgatacctattgggcctattagatttatgtaacttccctcacttttagaaatgacagattgaccctatactttaaaattgcttataaaagtcccttaagttgccacaaaaggaggtctgagattgcattatgaatatttagaagttactttttgtttttagtatttatatatgaccttaaatgtgagtctcagccaaagcaaagaaactgcactgatttaaaggattttagaaatcactttttttttttttttttgagatggagtcttgccctgtcgcccaggctggagtgcaatggtgtgatcttggctcactgcaacctctgcctcctgggttcaaactattctcctgcctcatcctcccgagtagctaggactacaggcacgtgccaccatgcctggctaatttttgtatttttagtagagacagggtttcaccatgttggccaagctggtctcaaactcctgacctcgtgatccgcctgccttggcctcccaaagtactgggattacaggcgtgagccactgtgcccagcctataaatcacttatatacatagtttgccttccttatcctaaaaagaactttgaagttgcttgtagtatatttcctatatattctctgcctttttagaagacattttaaaaagaagttcttctccagtagcaatgaacacacaaagaataagtgaagataaagtgaaacatttttattctttttttttttttttttgagacagagtctcgcactgtcgcctgggctggagtgcagtggctcagtctcggctcactgcaacctccgcctccccggtgattctcctgcctcagcctcctgagtagctgggactacaggcgcacatcaccactctcggctaatgttttgtatttttagtagagacagggattcactgtgttggccagactggtctcgaactcctgacctcatgatccgccctccttggcctcccaaagtgctgggattacagccgtgagccatcgcgcctggccaacgtttttattcttaattgatctaacagatgacagctctttcaaaataatagcaacaatgtatttaattatgtgtgctatgtatgtatatatattatatatttgtatatacagtagttcccccttatcggtgggagatacattccagggcccacagtgaattcctgaaaccacagatagtaccaaaccttataaatactatactttttcctatacatacattcctatgatacagtttaatttataaattaggcatagtaagagattaacaataacaatttatagcaataatatggtaataaaataaaaataaaataaaataatacggtaataaaagttatgtgaatgtgatctctgtctctttctctcaaaatatcttaataatttcagatgatagtcaaccacagataattgaaactggaaagcaaaactgcagataagggacaactactgtatgtatatatatttatatatattatatataatatatacattataatatatgcttatgtttgcttatatataagtgaaatgaatgaaaacaatgatacatggacaggagggaggaattaggattattttgtcattataaggtactcacattacccatgaagtgatatggtttattcaaatgtgaacttgattcattgtaaatgtatactgcacactccaggacaaccactaaaaaaagtagaagcttaaaaaagaagagaaaatggaatcaaataaaatgctcaattaaaaccaaaaaggcagaaaaagagtagaagacaaaaataggaacaaaagacaagaacaacaaatagaagatagtaacaaatatgatagatattaatccagttatattagtaatcattttgaacatcagtggtctaaatgcaccaattaaaagagattgttagagtggatcaaaaaacaagaccctactgtatgttacctacaagaaacccactttaaatatacagacatatagattaaaagtgaatggatggagaatgatatacaatggtaacactaatcgaatgtaagtgagaacagctatattaatttctgacagagaagacttcacagcaaggaaagttatcagagataaagagggacattacatagtgataaaggggtcaattctccaaaaagaaataacaatctttaatgtgtatgcacctaacaacagcattaaactatgtaaggcagggccaggtgcagtggctcatgccactttgggaggctgaggcaggtggatcacttgagggcaggagttcaagaccagcctggtcaacatggcgaaaccctgtctctaccaaaaaaaaaatacaaaaattagctgggcatagtggtgcatgcctataatcccagctacttgggatgctgagtcatgagaattacttgagcctgagaggcagaggttgcagtgagctgagattgtgcagctgcactgtccaacctgagtgacagaatgagactctgtctcaaaatgaaacaaaacaaaaacaaaactctgtgaggcaaaaactaacagaactgcagtagaaatccactcttatagttgaagacttcaacccccctcaacccaggaggcagagaatcaatagggacatgtttgaactcaaaaacaccattaatcagctgaatataatggatatctattgactatttcattccacaacagcagaatatccaagcatgtaagctttatctcaagcttatgtgaaacattcaccaagatagatcacattctgaaccataaaacacaccttagcaaatttaaaagaatagaaatcctacaatgtctgctctcagactacaatggaattaaataaaaaatcaataacagaaagataattggaaaatcccaaaatatgtgaagattaagcaacacacttctaaacacatggatgaaagaagaaatctcaagaggaatttaaaccttttgtactaaataaaaaatgaaaacatcaaaatttgagggatgccatgaaagcagtgtttaaggggaatttataacattggaatatatatattcaaaaagacaaaagatctaaaaatcagtaatccaaactttagaaaactagaaaaagaagagcaaactcaatccaaagtaagcagaagaaaagaagtaatacaaattagagtagaaatcaatgaaattgaaaataagaaatcaataatcaacgaaatcaaaagctgtttttttcaaacagttcaataaaatggatgatcttctaactaggttaagaaaaagagaggacacaaattactaacagcagaaatgaaaaagagaacatcactatagatcctatggatagtaaaaggacaataaaagaatgctatgaaaactctttgcccatggatttgataacctaggtgaaatggaccaattccttgaaggacacaatctgccaaaactcacacaagaagaaattcacacgagacttcaaacctatattttttaaataaattgaatcaattgctcataaccttctaaaagagaaagtaccagacccaatgggtttactggtaaattctaccaaacatttaaggaaaaaatactaagactctacagtctctttcagaagacagaagcagagagaattcttcccaactcattctgtgaggttagcattgtcctaatacccaaattagacaaagatattacaagaaaactacagaccaatacctctcatgaatatagaggcaaattatcaacaaaatattaacaaatcaaatccaacaatgtataaaaattacactttgaccaagtgggatatatcccaagtatgccatactggttcaacattcaaaaatcaagcaatgtgggctgggtgtggtgcggtggctcacgcctgtaatcccagcactttgggaggccaaggcggccagatcacgaggtcaggagattgagaacatcctggctaacacagtgaaaccccatctctgctaaaaatacaaaaaattagctgggcgtggtggcggacgcctgtagtctcagttactcaggaggctgaggcaggagaatggtgtgaacccgggaggcagagcttgcggtgagccaagattgtgccactgcactccagcctgggtgacagagcgatactccgtctcaaaaaaaaaaaaaaaaaaaaatcaagcaatgtaatcttatcacatcaacaagttaaaaaagaaaaaaaaatcacatgattatatcaatagatgcagaaaaagcatttaataaaatccaacacccattcatgataaaaactctcagcaaactaggactagagggaaactttctaaacttggtaaagaatatcttcaagaaacttagagctaacatcaaacttaatggtaagaaactggaagctttcccactatagtcaggaacaaggcaaggatgtcccctcttatcactgcttttcaacatcatactggaagttctagctaacacaataatacaaggaaaggaaataaaaggtgtacagagtaggaaggaagaaataaaactatctttgtttgaagatgacatgattgtctatgtagaaaacctgaaagaattgaccaaaaatactcctgaaatgaataagcaattacagtaaagttgcaggatataaggttaatatataaaaagcaattgctgttctacataccagcaatgaacagtagaatttgaaattggaaacacaatactatttatattagcacccccaaatacttaggtataaatctaacaaaatatgcgcaaggtctgtatgaggaaaactacagtaatctcatgaatgaaatcaaagaattaaataaatgggggatattctatgttcatggataggaagattccatactgtcaagatgtcagttcttcccaccttcatctatagactttttttttttcttagatggagtctcgctctttcacccaagctggagtacagtggccaatcttggttcactgcaacctctgcctcccgggttcaagcaattctgctgccacagcctcccaagtatctgggattacaggtgcctgccaccatgcccagctaatttttttgtatttttattagagaaagggtttcaccatgtttgctatgctggcttcaaactcctgacctcaagtgatccccctgcctcagcctcccaaagtgctgggattacaggcgtaagccaccacacccggccttcatctatagatttaatgcaattgcaataaaaatcctagcaatttatcttatggatattgacaaactgattctaaagtttatatggaaaggcaaaagacacagaatagccaacacaatattgaaggagagaagaaagttggaggactgatactactggacttcaagacttactataaagctacagtaatcaagacagtgtggtaatggcaaaaaaacagacaaatagatgaaaggaaaataatagcccagaaactgacccacataaatatacggctggccctttgtatctttgggttttgtattattggatttagccaactgcagatcaaaaatgtagttagggctggacatggtggctcacgcctgtaatctcacccctttgagaggctgaggagggtggattgcttgagcccaggagtttgtgaccagcctaggtaatgtgatctcttcaaaaaataaaaaaattagccaggcatggtggcacacatctgtagtcccagctacttgggaggctaaggtgggaggattgcttgagcctaagaggtggaggttgcagtgagctgagattgtgccactgcattccagtctgggtgacagagcaaaaccctgtctccaaaaaaaaaaaaaaaaaagtattaggcctatgatggttatgtctgtactgaacatgtacagaatttttttcttgtcatcattcctttaacaataaagtataacaactgtttacatgttacttaacagtatgtttacactgtattatgtatcataagtaatctagagattatttcaagtattcacgaggctgtgtgtaggtaggttatacgcaaaaactataccactttatataagagacttgagcatctgtggattttggtgtttcctggggggtcctggaaccaatcccccacagatctatcaagggatgactgtagtcaaatgatcttgacaaaggagcaaaggtaatacagtggagcaaagatagtctgttttgtttttctttttcttttttttttttggggggacagagtcttgctctgttgcccaggctggcgtgcagtggtgcgacctcggctcactgcaacctccgcctcccgggttcaagcgattctcctgtctcagcctccggagtagctgggattacaggcatgagccaccacgcccagctaatttttgtatttttagtagagacggggtttcaccatgttggccaggttggtctcgaactcctgacctcaagtgatctgcccgccttggcctcccaaagtgctgggattacgggcatgagccaccgcgcctggcctaaagatagtctttttaacaaacggtgctggaacaactggccatccatctgcaaaatatgaatctatacacaaacctgtttcacaaaaattaactcaaagtagatcacagacctaaataaatgtaaacacaatactgtgaaactcctagaagataacataagagaaaatctaaatgaccttggatttggcagagactttaatttttggggttttgtttgagacagggtctctactctgttgcccaggctggagtgcagtggcatgatgtcagctcactgtagccttgacctcccaggctcaagccatcttccacctcagcctcccaagtagctaggactacaggcatgtgccaccacgcctggctaattcttgtattttttgtagagatggggttttgccatgttgcccaggctggtcttgaactcttaagctcaagtgatccacccgcctcggcctcccaaagtgctgggattacaggcgtgagcctggcagtgactttttagatacaacaccaaaggcacaatacatgaaagaaagaactgataagccgaatttcattaaaattaaaaatttctactctgcaaaagacactgtaaagaaaatgaaaagatcagccacagactaggagaaaatatttacaaaagttgtatctaataaaggactgttacccagaatatacaaaaacaaaacaaggatgccctctctcaccactcctattcaatatagtattggaagtcctggccagagcaatgaggcaagagaaaggaataaaaggcatccaaataggaagagaggaagtcaaactatccctgtttgcagacaacacaattctatatctagaaaaccccatagtctctgcccaaaagctccttgaactgataaacaacttcagcaaagttttggggtacaaaatcaatgtacaaaaaatcagtagcgcttttatacactaaccagcacccatgctgagagccaaattaggaactcaatcccattcacagttgtcacaaaaagaataaaatacctaggaatatacctaaccagtgagataaaagatctctacagtgagaattacaaaacacttttcaaagaaatcagagatgaccaaaacaaatggaagaacattctatgctcttggataggaagaatcaatatcacttaaatggtcatactagccaggtgtggtggctcatgcctgtaatcccagcaccttgggaggccaagatgggtggatcactgagtttaggagtttgagaccagcctgggcaacttaacgaaataccatctctacaaaaaataccaaaaaaaaaaaaaattagctgggcattgtggctcacacctgtagtcctacctactacagaggctgaggctggaggatcactagagcctgggaaatgagaaaatgctcaatatcactaatcattacgtaaatgcaaatcaaaaccacaatgagatactatctcacaccagtcagagtggctatgatattaaaaagtcaaaaaataacagatgctggcgaagttgtggagaaaagggaacacttacatactgctggtgggagtgtaaattagttcaaccattgtggaaagcagtgtaacgattcctcaaagaactaaaaatagaactaccatttgacccagcagtcccactactcagtatatacccaaaggaatataaatcattctaccttaaagacacatatgttcatttcagcactgttcacaatagcaaagacatggaatcaacctaaatgcccatcgatggtagactggatgaagaaagagtggtacatacacaccatggaatactctgcagccagaaaaaagaatgcgatcatgtcctttgcgggaacatggatggaactggaagccattatcattacccttagcaaactatcgcagaaacagaaaaccaaagaccgttatgttctcattgagctaaataatgagaacacgtggacagaaggaggggaacaacagacactgaggcctacttgagggtggaggacgggaggagggagaggttcagaaaaaaaactactgggtactatgcttggtattcaggtgatgaaataacctgtacaccaaacccctgaatcacaagtttatctatataacaaacctgcacaagtacccctgaacttaaaataaaagttaaagtgtttttaaaaaatagatcccagaggaaaaaactataatggacaatacaattccatataaaagaaatatgtctatccatgtatccttttgtagaataaagagacttgtttgaaaaaaacttcttagtatttttattagaagtgcgttgaatctatagatcaatttgtagagaattgaagttttaatattgattcttcctacccataaacatggtatcactttgtttttaatgagaaactcagatgagactgtactatggagtgaattagttgtagacttttaaaacttgatgcttctttgattaaagatatcttgaagagaaaaaaagatcctgatttcttaacatcaggcattccctatatactgtgtggctcattagagaattttgtctaggaaaacagtttttaattctttaaaatgtcagggtagcagtgtctaaattggatttgatctagtcagtcatggaatattttgtgaaacttaataatagctaatgcttttatagcatcttgtatgtggcaagcactctccatgtattacttcattcagtcctaacaacaaacctaaagagtgtgagagtgttattttccctcatctgttccacacatgaggaaactgtggccagaactcagtgacctcctaaggtcaaataactagtatggaggaaagccagggttccagccacgcagtcttgcttcaagggtccatgctccgtgatccattatgttacatggcttctagatgttatacattattcagcttcttgtgaagatgaaggtgaaggtggttatcattctaaaatcacatcatatacacagtagctttcatctgtagccatgataactgttactcttgagctagtaatgatgttggctttaataagtaattgtttacaactactgatttttcatgatctccaaaaagataactgggactgaggacaaagctgtagtctatgaacttagattttctctttggattcagccagattgcctgagaactgcatacttagactgcatttttgtggctctttatgaaattgcctcagctgaactacacttggctttacacattgagtcttcatttagaggcatcgtataaatatgacaatttgagagaggacagatggtagtgagatttttatgtttatcaaaacagagcccaggttttaaaagattaaggaaagctgccctagacaatgccatgccctcatttttcagtttcagtcattatttttctcagcagtgtccttttggcttcactgtgtcttctaacatcatcagccaaattgtttctttcttttgtaatctgtagtttcaaaataataggagttgttttgctttcagaaaaagacaattataatgttgatttggttcttttaaaaaactaaacacaccctctggagattctaatttactccgtattcatgctgaggaaactaagtgccagcaatgaaaacttgtgtctactctcaaacccctctcacaatgaggtctatttgatcagatgctgtgaatcccatcagcttttctgggtaactgccagcacattttgccgtagcgatatagctactatggctagtctcctgccatctgttcttctaatgcaactgttctcaaacattttttttgaatctcaggacccctctatactctgaaaaattcagtcttttgtgctgtgttgtagtggttgaagtatataaagaaaatacagcctcacacagctatgtaattggaaaaaagcatttttaatagccttgtccaataattatgtatctggagtattgtattaatatattcagcattttaaaactcatgaagtaataattttgcatatctaggtagattacttaaggttcaagtattatgttaagttttgcaaaaatatagaaaagaaagccatctagcatctactgctattaacatatatgtatttctcttcaaaatataatttaaaaactaaaattactacttgaacatatccttgaacatagtaaattcaagcaatgccaaaaaggtgcttataatgaaatgcctcccttctttatacccctagtcgctctccctcaagttgtttatcatacaactagtaaagaggtatatatttttcaacctatttttgaaatatacatctagaaagtataccccaaaagtgtacagcaaaataaatttacctgagctttacacacccctgttactagcatccatacggaaaaccagaacattgctagcaccaccaaaagcttcactgtgcttatccgcacgttttaagtacatagttgtacttaaaactctatgatacctttagaataactctaagatatctttatcttttaaaaactctaagatacctttagaataactatacttatttacatcaaaaggtatctttcaataatatttttagtcttttttttttttttccatttacagaaagcacttacatgaaccatacatctcagctttggtttcttcttgtcctcatcactggaaagttctaacttttgggaaagttaaccatatttagaaaaaacaagaggaggctgggcgaggaggctgggcatggtggctgggagtggtggctcacgcctgtaatcctagcactttgggaggccaaggcaggcagatacttgaagccaggagttcaagaccagcttggccaacatggtgaaaccctgtctctattaaaaatacaaaaattagctaggtgtggtggcgcatgcctgtagtcccagctactcgagaggctgagacaggagaatcacttgatcccaggaagcggaggttgcagtgaaccgatatcgggccactgcactccagcctaggtgacagagtgagactctgtctcaaaaaaaaaggctgggtgcggtggctcacacctataatcccagcactttgggaggctgaggcgggcagatcacctgaggtcaggagttcgcctggccaacatggtgaaaacctgtctctactaaaaataaaaaaattagctgggcgtggtggtgggtgcctgtaatcccagttactcaggagtctaaggcaggagaattgcttgaacccaggaggcagagattgcagtgagctgagatcatgtgaccgcactccagcctgggtgacagagtaagactccgtctcaaaaaaaaaaaaacaaaaacaaaaagaagtctgttggaaaaagaataaattaagagaggctgggaaaagaaaaagaaataacaagaggctctccccaacaaactctcagcaactttagataaccaataacaaaaaggttgaggtgaaccacttaatatcaaaatatgtcttacatgcaatgactaaatatacaagtttgaagaacagaaagaccagtatggctagatgtttgtaaataaggagaagggtagagaatgatgagtgagagaggtaggtcaggaccaggtgttggagaccatggaaaggagtttggattatatcctaagtataatggaaactcattggagagtgtatggtggtgatatccgaattacacgttttttttttgttttttttttttttttttgagatggagtcttgctctgtcacccaggctgaggtgcagaggtgtgatcttggccactgcagactccgcctcccaggttcaaacgattctcctgcctcagcctcctgagtggctgaaattacaggtgtgcaccaccacacccagctaatttttgtatttttagtagagacaggttttcaccatgttggccaggctggtctcgaactcctgaccttgtgatccacccacctcggcctcccaaagtgctgggattacaggcatgagccactgcacccggccttgaattacacttttaaatgatcattctgacttttatatggaggtagatttaaggatgtaaagagaagaaacaaattaggagactgttgcagtagttcaagtaaaagattatggtggatttgattaggattactgatagcagtggaaatggtggcactcagattctgaaaatattttggagggaaactgtcagagtttggtttgaattggatataagatctgagaaaagggaggaattaaagttgacctatgaggtaggtaaagtagggtggatttacaaatcagtatcattaaggaattgaaattttggccagagtgttgagtgaatctttgatgtgaatattgaaattgtcaagaatgacagtgggtccagtggtggaaatgagatagtgatccaggtattgaagttactagtaagtaggggagaaatggctgagtatacaaagataatagccaaaaggagggaaaaggaatggtaacattaaataatgtgtgttttaaaggagctggagttttctaaagagaatagaagacagtttaaaatcccttaaacaattatgtttccaaattcagtcaaaatgtaatgggggcttggtctaggatgatagcagaggagatgaagagaggtggcctcattagaaaaataattacaggttaaactcgactagatttggtgacagtttggaaatgggaactgaggggtgatgggagccaggaataacctttaggcttctgtttatgtgactggataaattgtgacagggaaccaagataagcttatctaagacccaggtatgttagggaagatgactgagacagttgaatttgaggggcctataaggttcccaagtggcgatgttctgtaggaagttggatacaaatatctggaagaaatggatcaatggatgagtagattgatatgcaggtaatggttgatcacattttccaactccttcaagttaatgtgacttctggttcaatatgatggtctaaattcacatattttcttcccttccacttaggatgccagtaaaatgaaataaagggataagattggaaataactctaaaaacaaagataaataaaaggaacaattgtaatttgagtctgcatcagatatctaaaaggaaagacaaatgtgcttatgtgctttccctttttttttttttttggagacaaagtcttgctctgtcgcccgggctggagtgcagtggctcaaccttggctcactgcaacctccgtctcctgggtttaagctattctcttgcctcagcctcccgagtagctgggactacaggcacatgccaccatgcctggctaatttttgtatttttagtagagatgggatttcaccctgttggccaggctggtcttgaactcctgatctcaggtgatccacctgcctcagcctcccaaagtgctgggatttacaggcatgagccaccacacccggcccagatgtgcttgctctttagtaaacagattggaaggaacaccaaaacaaattgcataaaagggggttatggtgagagtatgagtgacctttccggctaaaccccaaagaggctccagttgcagctttatggagtgtgggtgtgagaaatgaatttgaaaatagcgagattatttgaagatctgtctgtagaacagctgtatgatttgataaccaattccctcctccattcgtcagaaaaagttccaagtaattaagaagtttctctaggaaaaagaaattggagaatttctttctagagaaattgaagggaactagctgaaaagaagtagggccactgatgtgttattggtacccaggcaaggcctcctcattcaggcattgtagggagggaaggtgtctccagcctaatgactagatgcgaaagaaaaatagaataagtgtagcttaaaagaaagaacgggccgggcgcggtggctcacgcctgtaatcccagcactttgggaggccgaggcgggtggatcatgaggtcaggagatcgagaccatcctggctaacaaggtgaaaccccgtctctactaaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaagaaagaacgaagtaaaaagcagaccaaggaggaaatatttaggacataaaagaaatcttttaaaaactgattgttatcttttagaaaaagttaacaaagtatcatgtctgtattatgaaaaacaatcagaataagaaagcttttgcaaatttaaaattcaaatggggccgggcatggtggctcacacctgtaatcccagcactttgggaggccaaggcggatggatcacctgaggtcaggagttcgagaccagcctggccaatatggcgaaaccccaactctactaaaaatacaaaaattagctaggcgtggtggcgcatgcctgtagtcccagatactcaggagactaagacaggagaatcgcttgatcccgggaggcggaggttgcagtgagccgagatcgtgccactgatgcctgagcaacacagcgagaatctgtctcaaaaaaaaaaaagaagccgagtgtggtggctcacacctgtaatcccaacgttttgggagatcgaggtgggcagatcacctgaggtcaggagttcaagaccagcctggctaacatggtgaaaccgcgtctgtactaaaaatacaaaaattagccgggcgtggtagtgggcatctgtaatcccagctattcaggaggcaggagaattgcttgaacccaggaggcggagcttgcagtgagccaagatcacaccactgcactccagcccgggtgacagagcgagactccatctcaaaaaaaaaaaaaaagcaattggaaaaataataagagagtctgaaaatattattggagtgtcatagaatatagtgaaaacaggcagataatataacagggaaagaataggcactccagaagaattaaaaaaaaaagaaaaaaggaaggagggaagaaattatcgaatagtagaagaaaaattaccaaagctgagaaaaaaaacagtgagtccttaggttgaaagagccttcagaatgctgagtgagatgagtgaaaaaagacctacatgtggcacatcttcacaaaattttacaacttctaggttaaaaaatattctaaaatatttcagaaagaataatagagtttgtatacaagaagttaaaaatcacactgccatcagacttctcatcagtatcactgggccaatgacttaagtggttggtgggaaaactattttgacctgtcaaattatcaggaatgtgaatgtaaaatagaaacatttttagacaaataagaactcaaagtttacttctcacctaccgtttctaaaagaattagtagaggatcaatcaaacaaaacaggatagaaaaccaagaaagataacaacatgggttgaaggaagcaatagctttaaccaggagttcagttaaggatagctgcagaatgataagcacacaggaggcatgggatgaagcattctgactgaagcagtaagtgaagagaagaaagaaactgggttcaagcatatcattgagaagcagaataagttttcaagatatgctgaaacatttttgtgtgctacagagaaagaaaattccaagcatagaaatgccaagaaaaaacaaaactgaacaagaaaataattctccataaaggaattaaatttggcgttaattttttattataaaaatattgaaatatacacagaagtggagagaatagcataatgaactgtatatccctcacgcaggttcagcagtggtccagaatatgccacattcactttatccttttttatttctttgctaaagtatttaaaagcaaattgcaggccgggcgcgatggctcatgcgtaatcccagcactttgggagtccgaggtgggcagatcacctgaggccaggagtttgagaccagcctagttaaaatggcaaaacttcatctctactaaaaatacaaaaaaaaaattagctggatgtggtggcaggtgcctgtagtcccagctacttgggaggctgaagcaggagaatcacttgaacccaggaggcagaggctgcagtgagccgagatcgtgccattgtactctagtctgggcaacaagagtgaaactctgtctcaaaaaaaaaaaaaaaaagcaaattgcagacagcaaatacgttttacccctactttctttcagtgtcaatctgtaaaaaaaggtggacattgacttttctaatcataatgctgttgtaacacctaacaaaattaacaataatttcttggtgaaatctaaaattcagttcatgatcaggtttctccagatgtctcagtgtttttatagttcacttgttcaaattaattcaaaattcttgtattgaatctgcttgttgtgtttttcatccagattgaccctcctttcatttctgtcatgccacttgacaatgaaggaactgtatcagttgacctatagaatagcccacattccggatttgactgcttcctgtggtatcctttaacttgttcctctgcccctctgtatttctagttatttgaagttaactataagaaaatgattagatttaggtttaatatttgttggcaagaacatctctcaggtcatgccatgtgaaatgtagcatggttttcactgttttatgaagttcaaagaaaagttcactttatctcaaaatcagaagtattgtcctttgacaatatgacattgaacaaggaagtcctaccatactgactgttctgtcataaacaattttcataggattatgttaaggtaactacttttactggttttcaacttttagaatcaatgtatgagacaaggctgcattgtgaatttgctacagaatatggttatcaagtttgtcatatagaatttggagaagttggctagggaaagtggaaaagaccttagtatctttaacagcaaatcagggacatcaggtttactagttttagtgcagtatattgagatttaatttatgaatgtttttgtcctaaatttgttaaatgcacaaaactgcccccaaattgttttgatataatgaaatatctgataatgagctttcatttatttatttgtttgttttttagagacagggtctcacgagttacccaggctggcctggaacttttgggctctgtcagtcttcctgcctcagcctcccaagtgactgggactacagatgtgtgtcaccatgcctggctgaaatttctttaaagtcttcagtagatgttaaatttagcttttataacgtttgaactcagttgtttaccttcaactctatttactaatttttttgtgtgtttgttttttggctttttgtttgtttgtttgtttgtttttgagatggaatttcgctcttgttgcccaggctggagtgcagtggtgcaatcttggctcaccgcaacctccacctcccgggttcaagcgattctcctgcctcagcctcccgagtagctgggattacaggtatgcaccaccatgccaggctaattttgtatttttagtagagacagggtttctccatgttggtcaggctggtctcgaactcctgacctcaggtgatgtgcccgcctcagcctcccaaagtgctgagattacaggtgtgaaccactgcacccggccactaatttttatttataaatttggcagaagactatattatgtatagttgtataatatgagcattctaagtattatttgctttttgataccacttaaagattacgtatagatatagttattagaaagagtagtagacatgaaatcaggaggctacatcatgatcttggctctgatcctagatgacataatattggacaagtcatttgacttatctgcacctatttcttctttttatgaataaagggatcagatttgatcatttaatccatgatcctgtcatacaacctaagttattcaagttcagctgtattgaaaaatgtgatgaagagcacacacaactttgttctcctcagctcttgccatgatccttaaactaacaaaatgaggaaatagatggtttttttctcctccctgaatttataaaaacaggaatttataaatttggtttaactttttaaacttttaatctgaggaagaagtgaaactccatcttacacctaatagatgcgaaacaaaaatgaaacataatttagctttcaaaagtatagccataccccacggaaatattgctgatttggttccagatcactgcagtaaagcgaaggtcccaataaagtgagtcacgcaaatactttggtttcccagtgcatataaaagttattttacactatagtgtagtttattaagtgtgcaattttattatgtcttaaaaaatacgtaccttaaatacaaaatactttattgttaaaaaatgcaaaaaatcatctaagccttcaggcagttgtaatctttttgctggtggaggctcttgcctagatcttgatggctgctaattgatcaggctggtggttgctgaaggctggagtatctgtgacagtttctttcttcttcttctttttttttgagatggagtctcgctctgtcgcccaggctagagtgcagtggcgcgatctcggttcactgcaacctccgcccctccaggttcacgccattctcctgcctcagcctcccgagtagctgggactacagatgcccaccatcatgcccggctaattttttgtatttttagtagagacggggtttcaccacgttagccaggatggtctcgatctcctgatctcatgatccgcccccctcggcctcccaaagtgctgggattacaggcgtgagccactgcgcccagccttctttcttctttttttaaatagagatggagtctcactatgttgcctagactggtctcaatttcctggcctcaagcaaccctccagccttagtcccccaaagtgctgagattacaggcatgagccatcacactggctggcagtttcttaaaatatggtaacactgaagtttgctgcatcagttgactctttctttcatgaaatagctctctgttacatgtcatgctatttgatactattttacccacagtagaacttctttcaaaattaggccaggtgcagtggttcatgtctataaacccagagctttggaaatctgagacagaaggatagcttcaggccaggagtttgagacaagcctggacatcatagtgagaccccatctctacaaaaaatggaaaaaattagctgggcgtggtggtgcacacctctagacctagctacttgggaggctcaggtgggaggatccacttgaatccaagagttcaatgctgcagtgagttatgattgtgccactacactccagcttgggtgatagagtaagactctctctcaataaataaaaataaaaaattggagtcaatcctgaaaccctgcactgctttaacaactaggtttacgtaacattctaaatcctttgtggtcatttcaacaatgtttatagcattttcagtaggagtagattccatctcaagaaacacttcctttgttcatccataagaagcaactcctcatttgttcaagttttataatgagattgcaataattcagtcacatcctcaggctccgcttctaattctagttgttttgctatttccactacattttcagtaattttctccactgaagtcttgaacccctcaaagtcatccatgaatgttgtactcaacgtctcttctaaactcctgataatgttgatagtttaacatcctcccatgaatcatgaatgctcctaatggcatctagaatagtgaatcctttccagaaggctttcaatttagtttgcccagatccgtcagaggaatcatatctatggcagctataaccttacaagatatatttcttgtcagaatacaaccacaacagttatcaattgagcttgcatatggaggcacttcctgctgccgcaagacaattacaatagtaacatcaaagattagtaatcacagatcaccataacagttataataataatgaaatgtttgaaatattgcaagaattaccaaaatgtgacacagagacacaaagtgagcacatgctattgggaaaatggcactgatagatatatttctgagataataagacttgcaagttgaaatgactctctcaaccttgggtttcagaacagctgctgtgttagcaggaatgaaagcaacattaatccccttgtacgtcttcatcagagctcttgagtaaccaggtacattgtcagtgagcagtaatatttgaaaggaatcattttttctgaaaagtaggtctcaacagtagacttaaaatatttagtaaaccatgctataaacaaatgtgctgtcatccaggctttgttgttccatttctagggtacaggcagggtaggtttagcataaatcttatggatgccctagggtttttggaatagtaaattagcattggcttcaacccaaagttactagctgcattagaccccaacaacgtagcctgttctttgaagcttttgaaaccaggcattgacttctttctagctaggaaagtcctagatagcatcatcttacaatagaaggttgtttcatctacattgaaaatctgttgtttggtgtagccaccttcaccaatgacttagctggatcttctgaataacctgctgcagtttatacatcagcacttgctgcttctcgttgcacttttatgttatagagatggcttctttccttaaacctcatgaaccaatctctgccagcttcagacttttcttctgtagcttccttacctctctcagccttcacataattgaagagagggccttgctctggattgaactttaagggaatattttggctggtttgatctatccagaccactcaaactttctccatatcagcaataaggctgtttcactttcttagcatccatgtgttcagagtaacacttttcatttccttcaagaacttttcccttgcattcccaactaggctgtttggcacaagtggcctagcttttggcctgttttagctttcaacatgccatcttcactaagctttcttcttctttttcttttttttggcttaaaaaatactgggttatttgtttgtttactgtgaaagagagcagacagacatttctaacttttttaatttaaagtgagagacgtgaacacttggagaccatagtacggttactaattggtcttatttcaatattgctgtgtctcagggaaaaggaggccaaaagagagggagagatacaggagaatgaccagttggtggagcagtcagaatacaaccacaacagttatcagttgagcttgcatatggaggcacttcctgctgctgcaagacaattacaatagtaacatcaaagattagtaatcacagatcgccataactgttataataataatgaaatgtttgaaatattgcaagaattaccaaaatgtgacacagagccacaaagtgagcccatgctattgggaaaatggcactgatagactagctcagagcagggttgccacaaaccttcaatttataaaacacacagcatctatgaagtccagtaaaatacagcgcaataaaataaggtatgcttatataatgctcacaaaaagaaacacagagggttctgttccagtaactattgctactaaacaagctacaacaaaacatagtggcttaaaagaacaagaatcatttccttagctcccaagtctgcctttggggctgagttttgtggggatacctcctctctgatccacttggtgtcagctgggacagcttgaaggctggggctgattaaacactgtgtcaccttgcccctttatagcaaaactcactgaaaaagttttctatactctgtctctgattctctcctgccatttttctccttttaaaattatttttatttccatctgtttattttttttagagactgggtcttactctgtcacccaggctggagtgcagtggcacagtcatagttcactgcaaccttgaattccagggctcaagtgatcctcccacttcagcctcctgagtagctgggactacaagcacgcatcatcatgctcagctaatttttttgtttgttttgataaagacagagtctcactatattgtcctggctggtcttgaactcctagcctgaagcagtcctctcacctctgcgtctcaaagtgctgggattaaaggcatgagctatgatgtctgacctaaaattattttttaataattcattttgaaataatctcaaatatagagaaatttgccagaaggataaaaagatttatattttccctcacccagattccccagttattaatacagccactatggaaaacagtatggagcatcctcaaaaaaccacaaatagaactaccatatccagcaatcccattactatacatttatgctaaggaaaggaaatcagtatatcgaagagacatctgcacctctgtgtttattgcagcagtattcacaattgccaaaatgtggagtcaacctagatgtccaacaacagatgaatgcataaagaaaatgtggtatttatactcaatggaatgctattcatccacaaaaaagcatgaaattctgtcatttatgccaacatagatggaactggaggacattatgttaagtgaaataagccaggaacagaaagttaaacaccacatgctctcgttctcactcatatgtggaagttagaaaaaagttcattccatgcaagtaaaaagtagaacggaggatggtagaggctgagaaggataggagggtagagggaacaggaggatagagagatatttgttaaaggatataagattacagctagataggaggaatgagttctctagtgttctctagttctataggatgactatagttaacaataatgtattatacatttcaaatagctagaagaaggatattgaatgttccaacacaaaaatgtttgagatgatggatgtgttaattacccagatctgatcattattcatgattgtattgaatcatcactgtaactcataagtataattattatgtcaatttacaaaaacattttatcattgcatttgcttcattgctcaatacccttcctctccctacagacacacacacatgcatgcatgcacacacacgcacgcacacacatgatcattcatgtttttttgaatctttgcaaagcaagctttacaaacaatgtcccattaccactaaacactccagtctatattttcaaacaacaaagatattctcctaaaaattggcatacagccctccaaatcaggaagccaatatcaatataacattgctacccaatccacaaaccccattcagtgtcaccagctgtcccagtggtacctcttctttctttctggcccagtgtcctatccacgaacatgtgatgcgtttagtagttatgtttcttcagactcattcaatctgaagcagtcctttagtctttctcttgacagtgttaaagagtacagaccttgattatacaggatttccctcagccttgatgtgcctgatgtttacttgtgaccagacttatgtcacacattcttggcaacatcaccacctcccatcactggtgatgttaactttgatcttctgatcatattggtgcccgccagacttctccacattaaagtcattattaatgaccttttgtaagtgattagtattttgtggagaactttccaagaatacatcagtatattcttatctaacagtcactcatcagacttaatatccattgaccattcccatccgaatcaaacccctgtgatagtgccaaatggtgattttctgtttcctttcttctacatttatcagttggtaaggaatatcattcccttctcttgtatttatttatatataagaacttattgattcttgttttgtttacaagatggtaatccatgtttattgattgattgattgattgacatggggttgcccaggctagagtccaatggtacagtgatagcttactgctgccttatctcctgggctcaagaaatcctcccgcctcagcctcccaagtagctggggctacaggcatgcaccaccacacccagctaatattttttattttttgtagagatgatgttttgctatgttgcctaagctggtatcaaactcctgggctgaagtgatcctcccaccttggcctcccaaagtgctgggattataggcgtgagccactgcgctcagcttattattattttaatgctcaaattgtctattagccagtaggagccccttcagttgtcctcctgtgtctcttcagcatgtcccatcattcatggtgcacttccttactttctggcacaaatgtgttcctggctcactttgtactttcctgacccagccttcaaatcagtctttcctccaaggagctctggttcctattatgtatttaaaaaacaagatctgagcgttcagtatgcttgaagctactggggtagaagaatatcatcatttaggctcacccagcaaaaaaaaaaaaaaaaaaaaaaggtaggaaaatatccatgtgtaatcctagaagttacataattttaatgtgttatagctctgattgcaaggcagtaactaacaaaatcttatgatattacccccaacccaggtatgtgtaatcctcgaaattatagtgacacacctccaacttcaaagagcacagtggaggagctgcatgaaccgatcccttctctcttccgggcactcacagaaggagatactcagttgaattggaacatcgtttctttccctgttgcagaagaactttcacatcatgagaatctggtttcatttttagaaactgtgaaccagccacaccaccagaatgtgtctgtccccagcaataatgttcacgcgccttattccagtgacaaaggtaactgccaacagttgactttttccattccgccccctcatgtggtctgtccatgtaatctataaaacctatataagaccatcttttggagcagccttttggttttgaatttgtatcatctcacataaattctagactcaataaccctgatcccatcatatctagaggcacatgccagaaggataagagaaaaaaaatatctccaatccttgagtagataaaaaggcatgtcggctgggcgtggtggctcatgcctgtaatcccagcactttgggaggccgaggcaggtggatcacgaggtcaagagttcgagaccagcctgaccaacatggtgaaaccccatctctactaagaatacaaaaattagccgggtgtggtggcgggcgcctgtagtccagctacgagggaggctgaggcaggagaattgcttgaacctgagagtcggaggttgctgtgaaccgagatcacaccactgcactccagcctgggtggcagagcaagactccgtctcaccaaaaaaaaaaaagataaagaggcatgtcagcatattgtcagaattcctccatactcctggcagcagaggctgtactgtattggaaaatagataattgttcctaattctggtatttatttgtgctaggctttattctgttcataagatagcaacaatgctgcttctctaataaaatattgctcattgtcaggtgacattcagagtatcccatgaagtcagatttttataatagcacccgtaccaaaatgatgccaaagtcattagctaaatttctttataagcaagttggtattccagacatctcatttccaggcataaactaaccccagccagttctctgcaaatgggtgctgttggtcagaaaaggaattaagtgagaaaataacttatacaaattacagaagcatatttaagagcatttattagtgaagataggtcatatcataattttggaatgtaaagagcatgtgacttttataaaatctttgatattttttgacaaaaggcaccatataattttactgtggaagcataaagcacttatgaaaattgcaattatttcttaaaacatgaggtgaattatgtataaatagtataatttgtactcttacttgactattagttgtgccctccattacattcctacctatataaaacagtgcgggctgggtgcggtggctcacgcctgtaatcccagcactttgagaggctgaggcgggcacatcacctgaggtcgggagtttgagaccagcctgaccaacatgagagacctcgtctctactagaaatacaaaattagctgggcgtggtagcacatgcctgtaatcccagctacttgggaggctgaagcaggagaactgcttgagcctgggaggtggaggttgcggtgagccgagatcgcgccattgcactccagcctgggcaactagagcaaaactccatctcaaaaaaaaaaaaaaaaaaaaaaaccaagaaaacaaaaaacagtgtgagcttcgaacattaatagtaaaaggcaaaacagcttctgttaaatgacagtgtaagatttcttattcccttttaggttaaagtactttgtaaaacaaatgctagattttggaaaacattagaaacatatggaatgcaataataatatgttttgttatcattttctccattattaaaatgtaagtaatcaacataacagatattaaataataattcataaattttgctcaaagattatttaaatttatgaagcaattagcaagaagctaattcctggaaactccagctgtcttcaagacacaactaaagttttttctctgtgacatctttcctgggcacctattcccccagatagagtcagtctctttctactgctcctcctgcatttgcaggtttttgtttgtttgtttgtttgtttgttttttgaaatggagtttcactcttgttgcccaggctggagtgcaatggcgcaatctcggctcactgcaacctctgcctcccaggttcaagtgattctcctgcctcagcctcccgagtagctggggttacaggtacccaccaccatgcccggttaatttttttaatttttagtagagacagggtttcgccatgttagccaggctggttgcaaactcctggcctcaggtgatccacctgcctcggcctcccaaagtgttgggattacaggcttgagctaccatgcctggcctgcatttgcagttctgtttgttgtctgtttttaacttatggatctatcattttctacttagttctgtggattctctgattcctctactaaaaatataaaaattagccagctgtggtggtgcatgcttgtaatcccagctactcgggagactgaggcagagaatcacttgaacctgggaggcggaggctgcagtgagccaagatcacaccactgcactccagcctgggtggcagagtgagactccatctcaaaaaaaaaaaggaaatgcccagtttaaaagcacagctgtataacatagcaaatgtttttaagcccaataatccaacttttcgatcaaagcctgaaatctaataaaagaagctaaggaagccctttgccttcttcagatggagtgggagaatctgacttccttctcaacataattaataaatgaagatcttttttcctgtacctcatctttgtcatgtacagaccagtaataagagaaccaagataaataactgttaatattcaactaggtaataaagcattttatttttttgtttttcttctttcttgccctgaaatcttaaatttttgtttttcagaacacatgtgtactgtggtttattttgatgactgcatgtccatacatcagtgtaaaatatcctgtgagtccatgggagcatccaaatatcgctggtttcataatgcctgctgcgagtgcattggtccagaatgtattgactatggtagtaaaactgtcaaatgtatgaactgcatgttttaaagaagacaaatgcaaaccaaagcaacttagtaaaataataggtataaaaagttattctgtaagtctgttggttgtatcttgtatcagaatcccagtaagttaagttgtaaagactttggaataagtttcttttaaaaatatgacatagccagtgatgtgtttaattatataactgttcttactgattttattgccccctagcaataagccctttcctttgaatacatgtacaactttggtcatatgagaagcaggtgcgcagagaattccttgaaagatctgaggtttttaacatgaagtctgacgtggttttcctctagcattccaaaaggtttttgctttgaaagtgttagcagaagcatgttgatgtgaattatgatttcttcatgtgctactgttagcacactgagtttttatagttgcacatcattcctcattgtgccttgttttatccattttataaatagagtagatatttgatataccactctgataactcatataaaaatatcatcataaaaagcttaatttcatcccttttatgttggttttaaaaggtaaatgcttaccatattttataattgagaactcttacatagtagaatccattctataatacatgtgttgacaaagctttagagaaagtttcctattctcttccatttcccctgcccaaagtgctgacataggcagtgatgaagaatctttaccaagattttcagggtgtacctatgaaattgctttaaatgcactgctggtgtaaataattagcaagcaaagcgtttctgtgacttcaggtaccagcttaaagagcactagggatggggaacgaatgccaaatcagactccacctagagcaccaggaaacagcttgtaccctggtagggaaatggtgttgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattattatgggaaacaaaactatctatgttcatattttgtaatatttcatttgttaagtttatatctggatataatgttctttttaaacaagtataatcatatcgtcggaggttaagattatgaaattttagaatctctattcaagatgatgttcactccaaatacactacagaatttagtcaacattttatataatgtttcaataaatgtttctttcaataaagatactatgtgcccttcatagtaataaaatctcaatcttaaagcatgaatctaaaacataaatatttatattacagactcaattttacaaaattactaattgctctagtgcatatttgaactacaagcaactttttaggaatacctctttatacgtctacatattttagtatataaaaatagataatgctcttggacacattttgtattattcatgatctgaatagtagttagttaaaagatcatttgtaatattatgatcaactgttataaattaaggtcttaataccttttctgctctttcaaataactctaatgaatattcaagatattttagccttttaaaaagttgagatttagctcatggatatattttttggtagggaaacattagggtctccttttcttccttttacctagaatgcctcatttaaaagtgccttgaaaacatttagctccccttcttcatgagcatctgtagagctgaaagtattctggaactttagacagaaagctgaaaggaatctgcagtctcctgctgcagttcaactctgctgtttttcagtcatttcctactgtgagtggagtgatgtttgtgtgtgtgttggcaacatgcctaatgttttcttaatgatgacaacaaatattttaaaactgcatttatcattttttaggtcttcattaaattttaaaatgtaatatctgtttcccaccccctacattaggaggataatttcttaaaccacattgttttaattgatttttcttatcttgatttctttcattagaaactatccctaaatgtaaagatcttttgccttcaaatttggcttattttttctgatttatgagggtttgaaagaaagaattcacctaaaagattccatttccagttttataatgtatttcaggttctgaataacaatatttttccaaattgaaagtaaatattccagaagttgatagcctggttaaaagttagatcctctattaccattctaagcacattcacttctatattgaagttttggtaaaaattcttttttcttttttaataaaaaattaggttattactttttttataaccagatttttaaagcactaggttttaaatcagtgggtatcataaaagccatatataaaagatcctttcttatagtaagacttgtgcttgttagcaggtttttctgttagtttttcccccataacatttaattattactaaaattgtatttacaatagtggtgccaaatcaaatggtaatttaaataaaatctattctgtgtttatgtagggtggtataaaaaagaggtcttcatttagacatgtgatttctaaaattccagaaagcaaaattgataagatgttagaaatttggaccattatttataatcagggtagcattaaaatggagaaaagaaagttttctgaaaaaatgcagtaaatataagccacatttctaaagtttatttttatgaaagcttcttttaagattttgaaatctattctgcattcccaagagtttatgtttattgtattttatatgatctacaacatataaaattgtgtatttttctttggttgtccctattaacaaaaaagtattttaataaaaaattgaaatg

SEQ ID NO: 38510 - DNA, 8310 bp, Homo sapiens
ctggaccagtccggtacgctccgggcctcaccgaggaagtcccaccctgcaggggaaccgactctggccggccctaacccctctcgagcgagtcccgccccatctccggtctgtcctgaaggcagagggaagaccctcacccaacccctgcccgctctcttctaagagctgctagtccttctccaccccaggcgctccctctggctgcccctcccactcgctctgatctctctccgtccgctacttgcggtcgagccttcttgggggagccccgccactgaataccccctttgccatactcccacctctcttaccccaaccctggacttccagttggccctagctataagccccgcccctctccgagggacagcccccgctccagtctccgcggtcccacttaccctagcccctccctcgggcagcccctggactgtgacccagccagcaccgcctctcctagtggcaactggctgggaatggctgaggggctacctactgcttgcggcctgccagcgggaggaggggggcggaaagaagaaagggggcggggttgaggggggcgggcctggacctggggagtgaaagcgaaagcccgggcgactagccgggagaccagagatctagcgactgaagcagcatggccaagccgtgtggggtgcgcctgagcggggaagcccgcaaacaggtaatggggaatcggaggccaggaaggggtcatagaaccctcttgggtggaggccaagctgggtggttcaggggaccaagcagtgccagagaactcccccaatctcgctagtgccttcacttctcggggattcccagattcctgccttctgactgcagtgagcaggagcttccagggaaagctagtttgtggtgagaaaggcctgagccacagttcgagggcaccctgttgtgggtggaagcttttgacaacccagacccttaaccaacatccgggtactgctctctgtgtaggtggaggtcttcagacagaatcttttccaggaggtaagtctctggatttgagcgatttgacccagaatcttggaccaatacttgaggataacagcctctcagaatgacccccccaagtcaccctagacttaaccctacttcccttaccaagccttcacccaaagtaaccccggaattattgatagctacctttaatctgacctttcttatgactctcccgacttctggcacttctcccgtcttttgatgtggaggaaaaaaaccatggcttccaaagcaggaatatcacagtcctaaccttcgttctgccatttaccagcttgggcaagtcctttcattttcaggtcttcagtttcctcatttgcaagtcttggacccagtgatttccaaaggcccttccagttccatttgtcagacatctcattgagcatattctgtgattcccctcccttgcaatgtaacccacaggctgaggaattcctctacagattcttgccacagaaaatcatatacctgaatcagctcttgcaagtgagtagtgtgggccccttctgccccatcctatgtcctctatcccctttgcccaccctctctagctaacaactggattcagcatgcagagaatagtttcaaatagtggattaggaacattaggatggcgtgaggcatgagcctaggttgggaggcagagtgcaagtgggatgtatggagggaaggctgtgacctaggatgaagggaagaggttgggcagcccttgacagtgagctctgtgcaggaggactccctcaatgtggctgacttgacttccctccgggccccactggacatccccatcccagaccctccacccaaggatgatgaggtgaggcactcagggtgcaggacttggactataaacccaatggagaagatagcccttcaacctctgtgacttttctaaagctactttcccccctttttgccttagatggaaacagataagcaggagaagaaagaaggtaagagagataagaggtgactagggaaggggtgatggcacactgactactggatgagaaagggcctgaatcccctctttctcacagtccataagtgtggatttctccctgggaatgagaaagtcctgtccctgcttgccctggttaagccagaagtctggactctcaaagagaaatgcattctggtaagcctgggaaatgggggaagcagaaagagaagacacacaaggtgaggccctggactcctccgtagatacaagtccttcatacagagacctagtcctgaaaaagaaaacttccttctgtgccttgggcttagatcccctttgttctcctcgttctgttagacctctcttatcacaacggtacccccaaaattagagactgtgcagtatccactctgtaacctcagaacctactgctgtattgggttcatagtagaggtggtatgatatagtgagtgaattgttttaaaagattggaccctagagagagactgcttaggttcaaatcgtgattctatcagttacctagctggtagccttaagtaagtcacttagacattctgtgactcagttttttcatctgttaaatgggtacaataaatacatatctctgaaggttgctgtgatgattacatgaaataaatacatggcacagtacctggtatgtaataagtacccaattaaatataactttttttaggaagtgacagtaataggaagaactcagtatgtttgttgaatgattcttacatgatacctcttaacacaggtgattacatggatccaacacctgatccccaagattgaagatggaaatgattttggggtagcaatccaggtaagaaaagggtaactgaagatacttagagtggggagagcctcagggggtgagctagacatgaaccaggaggaggaggaagatagtgtatgaaatggggaggacatgaagtgttgtctttgcctcccgtgtcaccacaggagaaggtgctggagagggtgaatgccgtcaagaccaaagtggaagctttccagacaaccatttccaagtgagggcagctggaggaccagcattgggggcagtaggagcatttctttgggacccccagagctgggcagccctatcaggatgatgggagactttgggaagggtctgagggagtacatctccctgaacactcattcctgtggtattcccttgcttctggcaggtacttctcagaacgtggggatgctgtggccaaggcctccaaggagactcatgtagtgagtggatagtccaccagccttttagctgggtgtgggacgaggaggtgtggaggaagaagtcctccttgtcttgtttgtgactttcccaatgtggagaatattaagctaaaagcattacctagaaaaactggtttgggcttcaacaaccttgacccttttctctgctcagtcctttgggatcctatttcttggtgctaagaaggggttcattctcaagttaacctatttcctataaaaggaaaccagactcatgtcccagcctcccatgggactgactcagctttgcctcccacattgcagatggattaccgggccttggtgcatgagcgagatgaggcagcctatggggagctcagggccatggtgctggacctgagggccttctatgtgagtgtggagtaaggctttaggggaggtggatgagtgggggcaggcaggggattggctaagaacctgactcttgcactctggccttctcccaggctgagctttatcatatcatcagcagcaacctggagaaaattgtcaacccaaagggtgaagaaaagccatctatgtactgaacccgggactagaaggaaaataaatgatctatatgttgtgtggattcccttctggcgtgtgtcattcattcaaaaagcatttattgagtggcacctatgtccagcctgaagatgaatgtggtgggaaggggtgggtgtcacaaagacaaagatgacttagatgcccactgtaatcttgactgtgagaaagaggggattcaggccctttctcatccagtagtcaatgtgccatctccccttccctagtcacctcttatctcacttaccttctttcttctcctgcttatctgtttccatctaaggcaaaaaggggggaaagtagctttagaaaagtcacagaggttgaagggctatcttctccattgggtttatagtccaagtccttcaccctgagtgcctagggtggggattgttacatgccatggcagccatgcagataacctgtattttggaatgtaacagtattattttcatccagaggtctcaggaattattggaagagatggcatttgcacagagcccttatgggaataatcaggctttggatacacaaggggaaagttctgtggtcaacatcaggaatgaagaaagaaagaatcctcatcagttcaggaaaagcctagaaggagaataaggtttcactgggagaactatggagaactacggatgaatgattggactccccccacccttttttttttttttttgagatggagtcttgctctgttgcccaggctggagtgcaatggcacgatctcagcttactgctacctccgtctcccgggttcaagcaattctcctgcctcagcctcccgagtagctggaattacaggcatgtgccaccacacctggctaatttttttgtatttttaatagagacggggtttcgccatgttggccaggctggtctcgaactcctgacctcaggcgatccacccacctcggcctcccaaagtgctgggattacaaggcgtgagccaccgcgccgggcctggactccctccttaagggctaggaggggaaaaaataatgcttccaaggcactgtggtgaaggaaatacatcgcaggacattatgggaaggatgaatctgtaagtttttcttactgtcctcccccatatccccttcagccaatcactgtctttatctctgcttttcaagattcagccctgggctggtgatagagacaagggttcctttgctgtgatcttgctgtaaactccatgggattgttctttaattcagggccttatcctgtcataaaatatgagataagaatgtgctgcgaagcactagactggctggaagcctgcccccatacatatctcattaaatccttaaaggaacacgggcaaaagataaaccaagggcaagaaaacctgcagtcgcgaaggcaacacggcccattagtaagtgacagagccgatctagagtacagagccactcaacccataataggcgcaaggcggtctgctttgcccgcagcgctccggaacacccggctacgggatagcgatccatccttggggctcggcggagcgagtggtagtgggcaacacaggtaacaggcaaagccaaccaccaaccgagagcggaagtcggggaacctagccaataagagtgcgggcaattttctgtgcttcacaatggtgggttctttccagtccgctggagacaaaggcggggcaacgttggggcgcggccgctgattggacaaattgaaagcctttagccctatcaaggagcaccacgtgggcgggactccaggagccagttctgcagggagctgcagtttggtctgtctcccaggcaggcgcagagtcgcggccgccagctaggggcgcgggaaggcggggctcggatgcaatcgggacctcctcctggactgggccgggggcggactccgggacccagggcgccgggagccggcgggctacctgcgagtcgagttagcgttgtcgccgaaccgaagtgagagggcacggggaagggtcaaagagcgtgccgaagcgctggagggagcttcacggacgcgagctaggcaccggctcgcctaatccggtactaatccggcttgctgcttcccgtccaggcctcgctcgccatgggggaggtggagatctcggccctggcctacgtgaagatgtgcctgcatgctgcccggtacccacacgccgcagtcaacgggctgtttttggcgccagcgccgcggtctggagaatgcctgtgcctcaccgactgtgtgcccctcttccacagccacctggccctgtccgtcatgttggaggtcgccctcaaccaggtgcctccgttggatgcccatcccccaccgcgaacccacccaacaccccagcccaagttcatccccggtcccttggcagcagtgcgcatccacaaagccagcggcacaatttaattactgatggcccctttcctacgacaggtggatgtgtggggagcacaggccggtctggtggtggctggttactaccatgccaatgcagctgtgaacgatcagaggtgagtggcgtagccagaggaagaaggaaaggattatggcgggttggggattggaggaatagagggcgaggatgcgtggggcggtgggcggggcgggggcgcacaagatgaaccaaggtcgttccttttatctttccttcatcaaacgcttaggagcaggggctttacaccaggcactatgctgggtactggagtgagggaatataaagatgaataggacagagccctgccctggagtgccgttggggcggggaggacaactgtgtatcaacagactgattttttttttttttttgagacggagtctccctctgtctcccaggctggagtgcagtggcgcaatctcggctcactggaacttccacctcctagattcaagcgattctcctgcctcagcctcccgagtagctgggatcacagatgagcgccaccatgcccggctaattttttttatttttttaatttattattattttttatttttagtagagatggggtttcgccatgttggccaggctggtctagaacttgacctcaggtgatccacgcgcctcggactcccaaagtgctgggattacaggcgtgagccaccactctcggccaacagactgatcttgctttaactgaggtgtcccccaggggctgaaagaacagagaaatcccaaccagcaacttcaaaaataaggcagtttccttatatatatacatataggaaaagacatatatatatatatatatatattaatcatatacatggagcaattagaggtactgttttgtaatttgcgtttctccctcacttaataaatacttgacatcatcccatttccacaccaagatctaccgtaacagctatatagtctgaatatgaatgtactctaatttatttaatactttaaacattgaggttgtttccagtgttttattacagacactgtcctatgattaccataaattctttataagtagaatttctgggtcagcatatgtatagtatgtatacagtttcaatttggatggttatgccaaattaccttccaaaaagaccacctttggtttccactctcaccagcaatatctgagcacctgtctcccacagcactcaagcatcaagcagtcgtgcatcaagcatccagcaggcccgatccccgcaggccacctacagggaaaggccacagctgcgcccacacctatgagacctgggaggcccagctcaaatggatgggttttgcccacagttggctcctcactcctctgatcttccctctacacagccctgggcccctggccttgaaaattgctgggcgaattgcagaattcttccctgatgcagtacttattatggtgaggcttgggtttctgggtggggaggtgaaaagcaagtagggtggggggacccttgaaactctcacttgcccatctttgtccactcagttggataatcagaaactggtgcctcagcctcgtgtgcccccggtcatcgtcctggagaaccaaggtctccgctgggtccctaaggataagaacttgtgagtaccccactccctctacctcttcttagaagcccaaggctcctgggtctcctctgtccttggccctgccccaagggtctttctctagacccaatctctgttaagtctgtgtctggacccactacttgctgtttgacctccatgggggttactatttcagagtgatgtggagggactgggaagagtcacggcagatggtgggagctctactggaagatcgggcccaccagcaccttgtggactttgactgccaccttgatgacatccggcaggactggaccaaccagcggctcaacactcaaatcacccagtgggttggtcccactaatggaaatggaaatgcctgagccagggccagcggggcccggttccaataaagagacttgggctgatgggcagtggtataactatatttattgtgcctgagaggcaaggtgagggaaaa

SEQ ID NO: 38511 - DNA, 4475 bp, Homo sapiens
agtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcgccaacgggccgtgtggaaaggtaacagccccacccgacgggtcccccagccctggcctcttcccgccagctccgccctgccagccggcagcaaagggccctgggcaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacgctcgggctggcctctgggcctctcatgcagaccacctcctggccctgctcgagagccccaaggccctgaccccgggcctgagctggctgctgcagaggatgcaggcccgggctgccggccagacccccaagacggtgagggagagtccaggcagaccaggggagtgggtgaggagggtcccacggcccatgggacccggcctggctgcaaagccttcggggagcctgggggcctggggagacgcccaggagtcggcctgcggctggggattcacaacgtggggctcactactgggcagttgggagcctgtaggagccccgggagggacctcatgagggaggaacccagaggcctgagtgggagcctgaagcagctgggcccggcagggagggctgtggctccagggaggggcggggctggtgggggcagatcctgtagttggggtgggagatgcatccaggggcagcggggtggatggcagaaggtcacaccaaaggctgaggcggaggccccctcttccccaggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccggtgaggcctgggctgggctgtggaggggggcacccccgagtccccagcctccacgtccctggggggcagggccggagcccacacagactcgcggtgccaactcttctccctgccagagctgtcagccttgatgcagcgcctgggggtgggcagggaggcccacagtgaccacagtcatcggcacaggggagccagcagctgggaccctgtgcccctcatcagctccagcaacagctccagtgtgtgggacacggtgagctgcgccctggggtaagatggggcctcaccggggtctgcttgggcccctgagcctgtcctgccaccccccaggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagagtgagtgcccacgccgacattgtgctggcagcacagaggtggagcccgtgtaggaaggaaggagtggctgcccaggatgagggatggagagagtgagcaggggctggaagtagaaacaacagacacaggggaaggtggcgtcgccaggagagtggggctttgaggcaggagggtcagcctgagtgagggcctggcccacactgacggcctgcagctctggtgagcagcgcccgggaagcaggggctgagtctggaagaaaagctctcacagccgcctcacccgcccccagggtatctgtacggctccctggccacgctgctcatctgcctctgcgcggtctttggcctcctgctgctgacctgcactggctgcaggggggtcacccactacatcctgcagaccttcctgagcctggcagtgggtgcactcactggggacgctgtcctgcatctgacgcccaaggtctgcccccacaaacccgcgaccctggccctccgttccccaccatggactcccaggccatgccctcccagggaccttacccaccccacctcctgacccctctccctgggtcttggtgggaggcaccctgggacctcccccccagcccagcgcccctactccccaggtgctggggctgcatacacacagcgaagagggcctcagcccacagcccacctggcgcctcctggctatgctggccgggctctacgccttcttcctgtttgagaacctcttcaatctcctgctgcccagggacccggaggtcaggcttcttgggaaggtacccggcgggtgggtgtgctgggggcctggtggacactgagcacctaccctcacaggacctggaggacgggccctgcggccacagcagccatagccacgggggccacagccacggtgtgtccctgcagctggcacccagcgagctccggcagcccaagcccccccacgagggctcccgcgcagacctggtgagtgggcgccagatgccccatcccgcgcggagcccctcccaccgaccccttcccacgcccacactcccagccccaccccaggcctgcggctccgcctcccgcggtgatctggggccccgccccgccccaccgcgttcctcctccacttccgggcgggacttactcaaggctcctcccaggtggcggaggagagcccggagctgctgaaccctgagcccaggagactgagcccaggtgagcccagggggcgaccccggaagggctgggggatctggggtttgtgtggagcgcgggtggggcccaaggcttggcggtaggcgacaggccacgcgaacccacgggcctctgcgcccgcagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggtgagcgcaggcggggcctggaaggagatgggcggggccgcacggggctgggcggggagacctggaacaggtgggcggggcctggaagatgggcggggccgcacctggctgggtggggagaccggaaacaggtggggcggggcctggaaggtgatgggcgggatctgacggctgggcggggagaccgggaacaggtgggcggggcctggtggtaagagggcgggaccgaaaggaggtgggcggggcatgtagctaggagggcggagctgttaatgtggactcgcccgcaggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatggtcaggatggcgaggggaggggctgctctgggccgggagctgagcagaggagctgagcaggggcgctgacccggtgcccacttgctcctcagctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgg

SEQ ID NO: 38512 - DNA, 138587 bp, Homo sapiens
acaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccaggttggtgaatgggaagggagtgggttttttcttgtagggacttttatatggcacatccacatctagcttttcttttacagtcgggtcagacacaaccgccagcagggaaaagttagaaagtgtaggcgtcgcgggtttgcacttttctgatttccattacttttcacaaaactgttccgataactgtaaagcgctggaactttgctttcatgattccagggtattacctgtaaacttgttaatcataccaaaagtgtaaatgaacaagccccctttctctatctttatcccttataatgaatatccaggtttataaagtggttgtcttgacctccctccttgagagcagaaaccgtgtcttacctgcctttgtattcacacatggctgacagcaaatacttgttcaaaccatgccttttaaacttttagcgacctcagtgcctattgtgggggtctgcatgtaatttatttttaatgaattcggagaaagactggaatgtagcagtttgaaagagctctggagttaagctgcttaggtttaaatctctgcatagcgtttatgcgttctacaccttattttcctcttatggaaagagataataattgtccctgagtcctgaaaattaaatgaggtaatggaagtaagatatttagaacagtggctcatagtctacaaatgttagctgctattgtttctcttgctgattatattatttgcagcagctccacatagaagaggtgcagaataaacaaggtgtttgactgtttcttattaggttgctgaagtacactgatgtggttatttattttttgagacagggtctagctctgtcacccagactggagcgcagtgatgtgatctcagatgactacaacctccatctcccaggctcaagcaatcctcctgcctcggcctccagagtagctgaaactataggcatgcaccaccacactctataattttttaagttttttgtgaagatgagtctcactgtattgcccaggctggtctcaaactcctggactcaagcagtcctcctccttcggcatcccaaaatgctgggattacaggcataagcctggtagatgttgttataataaatacttattttttgagtaggttcttgctttgtcacccatgattgtactgacacagtcatggcttgccgttgcagtgatttctgttgtcctcacatatcctttactttttagcggtatgaccaatctgctcctctttgagttccatattctttccataggtctgttggtctattgattgggtatacattaatgatactttgtgtgctagtcaagagaaaattcaaagatgaaaagagaacctgctgcccaggttagaggatttcagtttagtcctgtgaggtctgatatggtagctaccagccacttttggctctgagcacttgaactttgtctggtccaaattgagatgtgctataagtgtaaaatacataccaattttgaagaaccaaaaagaatgcaaaatatctcaatatgtttttatattgattatatgttgataatatttggggcataataggttaaagtgaaatatttcatctatttttatgtttaacgtggccacaaaaagaaattttaaattaaacatgtgactcacattatgtttctgttggacagccctgctccaatggttaaaacaaataattttagcaataggatagttggtagtaaggtaagtaaagaactataagaaaacaggaagttacgtaactgagaaggttaaggaagatatcttgcatgaggtgatatttcagccaagtcctgaaagatgtgttccctaggcagaggagctggggatggggcagaattataatagcatcccagaaaagctcgttgataagaacatgaactttgaagtaagaaattccttttgaatctcaactctactaatcggtgactatgtcctggactatttagagaggttatcgtgacatctctaaataatgtttcatcagctctaaaatgataaccacttcgttaagtttttctgatgattaagtagcataatatttataaagaggttagaatagaagcacattacaaagtgctcaataaatgttaactttaacaagtgaaagtaagaaagtagtcgtttggaaattagtttttgtgtttttttgtttttttgagatggagtcttgctctgtcacccaggctggagtgcactggcgcgatcttggctcactgcaacctccgcctcgtgggttcaagcgattctcctgcctcagcctccccagtaactgggactacaaacgagcgccaacactcccggctaatttttgtattttcggtagagacagggtttcaccatgttggccaggctggtctcaaactcccgacctcaagtgatccgtccttctcggcctcccaaagtgctgagatttctgtgcccaacctggaaattactgttgatttagaatcaccaaagaggagatgccttctgggcagcgcagtgagatgaaaccagaaagaagggcgcaccccacatcctgagaaaggcaccaagatatgtgccctgttatttattgttgggccagagggcagggctctgggaggaaatacctggaattgccaatattgggaggattgattatatgaattaggctcatcaacatgaaggaatgttaggcatccattcgaaatgttgtgcattattacgaaaacaaaagatagaataccaaagtgtgtatcctattgtgattggaacatataaaattaagtatgcatattggtgaactaaaagaagttgatttgttgaggcaggattgtgagtacatgttttactttcatttagtctgtgtgtgtatgtgtaatgaaaacgtaaaatgttttacgctcacattggaaatatttctcttccttagggatggattcgttctgtccgatcccagaaggaagtcttgttcctgcatgtaaatgatgggtcatctttggaaagccttcaggttgttgcagattcaggccttgacagtaggtgagttttgttttttaaaagaattctttgatttttgtttttcacctctagtgcttctcacttccctactccagtgtttacgttggacccctgagtaatcttttgaaacagatctgctttaatagctttgaggatcaactccgaatatttggaatcaagatccttcaagctcaggcctttcctcctctatttgacattgtcacatgctgatatcccctacttatgcttcacttcagtctttcttaattacctgcggctcccttaagctgttctgctctttcctaatagcatttgtacatgttgctgcctctgcccaatacagcctcttctcctcttgtctttcatagttcctgcttagttaggcatcatctgatgttcccatcccatgattatgtcaggtaccccttttttgtgctcccatagtgtcccgtgcctacatctgtcttaaaatgtatcacattgaatggtaatcaactgtattcctatttgaatcctcctgctagactcttaatttcctgaggttaggaatggcatctcactcttttttgtattcttggcctctagcatagtgctgacaatatgacaaattattgcctgttgaataaatggaagaaactttatggtctcattcatcaggttttaaaactaacactaggtcaggcgtggtggctcacgcctgtagtcctagcactttgggaggccgagacagacggatcacttgagtcaagttaagaccagtctagatatattaaaaccccgtctctaccaaaaatataaaaatgagtttgtcatggtgatgtgcaccaataatctccactactcgggcggttgaggctagagcatctcttgagccctggaggtcaaggctgtggtgagccaagatcttgccactgcagtccagcctgtgtgatagagccctgtctccaaaaaaccccccaaaccaaaaactaacaccattttaatgttaggtatcagctctgaggaagagaacattattctaatttgttagagtgctttgctattccggggattgttagggttaatgctgtttacacattgaataggttcatggatcagagactatgtggttaactgggcagaacaaaaaaaaattgttctgatgtaatagtaacttttttttttcctggagagagtctgactctgtcgctcaggctggaatgtagtggcatgatctcggttcactgcaacctctgcctcatgagttcgggcaattctcgtgcctcagtctcccaagtagttgggattacaggtgtgcgacaccacactggactaattttttgtatttttagtagagacagaattttaccatgttggccaggctggtctcgaactcctgacctcaagtgatctgcctgcctcagcctcccaaggtgctgggattacaggcatgagccaccacacctggccctaatattaatggtaaccttttaaacaactttgtaattgttttgattatatcagtatagcaatcacatgggtctaatgggacctagattttagatttctgtaggatgactgtctctttgagatattcccaggaaaccttaggatatacttatattcatatatgtcaggtagtacatattttaagtcagagcatctcaaattaccctctcaggttgatgaaagtataccagatttccccacccataatgcaatagtggacaatcttatttatataaattatataagaatagcatatatttagcaagcaaacaaaactggatggagaatctcctgacttatttacttcaataaaatttattgtattgctatattacaatatttcaatagtttattaggaaggcacttattgtcatacttactgtaattatgaaatgttagaactagaacagatgggctgggcgtggtggctcatgcctctaatcccagcactttgggaggccaaggcaggaggattgcttgagcccaggtgttcgagaccagccttgacagcatggtgagacctggtctctttaaagaaaagaaaaaagaattagaacagatgtactatcatttaccagctccttttttgatagatgattcttaaatgagcttagatgactttccatagttgtcatacagttaatctatgggagaacttgaactcgaacctagtcttattaactagaaagtagcaccttatgtgcttagatcaccagtcaactaagtaaaaaaaaattttttttaattgcaaaaataggacagagaattcccggcaaattttattttgatttgcagttttcccatgtattctgtaatcttttaaaaagtgttttggccaactaactttttaataagggcaattgtacaacctcttaattctgaattaattatacaaattcttaactctattcccattttaaagcttatggaattcattttataactttatgctctatttatacgacagattatccatagattctgaagattatttaacccaataagggtaaaagcttttgtcattaagtattttaatattcttattgcaaagttgatattaaaatgaaggttgtatataatgatatcttgtttatcttgttttttgttactatagagaattaaattttgggagttctgtggaagtacaagggcagctgataaaaagtccatccaaaaggcaaaatgtggaactgaaggcagaaaaaattaaagttattggaaattgtgatgccaaggtatgatttctgacacttttgtggaggctgtttaggctttaattaagacagcaatctgttttaagtgtgattattaggaagatgaaacttagaatatatttcatttgtgacagataattgaaacaagccatatgacctgtagaggcagtagcaaaaattatttatgtacatagcttagtgagaggtaagtgttgatttttgcatctctgtggtgtgtgtcacagttaaaacttgctgcttttacaagcatgcccagtcagccaccatgatataccagggtgggctcattcttaggaaagccaagaatgacttttgcatgatgtagaaccgatcatccaataatggtaggctctagccacctttggctgtttggtattaaatccattaaaattcattaaaaaaatccagttcctcagtggcattacccacatttcaagtgctcagtagttgcatgtggctactggctactatattggatagcacagaatatttccatttatcacagaaagttctgttgggtgatgccgatcagtagtattgtaaggcttaggccgaatagaggcaagaaattctgtattaagacatgtttatgcctgtttttgcaagactcttctgttagcttcatatatataagcttgataaagaggttagagagaataaaagattattaatgaaattctttaaatttacagtggagaaaatgaggcccagccagatgaagtgatttgcttaacattatgagctgatgtggcacagctgaaatttatattctagccatttgaatcctctgtgtttttgctacacctgtcttcaaatatttaatgaacaaaaatgaggaaatataggaaaattgcatcattttaattcattgtgtattctttcagtataataggaagaaatgtaaggaaataaaagaagaaaatgcaatttttattaaaatgtcatccttaatttccaagaaattctaattgatgtaaaatcagaaatcaggttctaagatttctgagaaatagagtgtagaataatttggaaatcaagagcgtaatatagacggtaaccatttttctttttgttttttttagagggatctgtgattactaaaaatttgccgtgtgtttcactgtagtagttcaaccttgtctgtggttttgcttttcacggtttgttgcccacggtgaactatggtctcaaaatactacatggaaaattctagaaataattcttaaattttaaattgcatgccattctcattgtgtcatggaatcttgagccgtcctgctccatcctgcctagaatgtgaatcatccttttgtcctgcttatctgtactttatacactacctggccattgttgtggaagaaaaaacataatgtttatatggtttgatactgtccgtggttttaggcgtccactgggggtcttggaacatatcccctgtgggtaagtgggggactactatattcttaaattgttcttccttggcttctgttggtgttgatggcttcatcttccctgaagccctctgattcagtatcattttgaagtattccaacattagggaattctgacccctagaattatgatatggtcacattttcacttttagtaagtatagtgcttgtttctatacgacataaaagtttgtatttgtacaagacttagaatggatgagactgaaagaaacaggctgccagtgtagctcttttttagcttctctgttatctttttaattaaaactttgatttttgtctgaaaggatgtgtctgtcttaatcttgtaacatgaatgtgagcagtgtagacatatttcaatgtggagccataattttctttcaaattttttgtaaatctttactactctgctagatggaagtagcacgttgataatagtaatgaattgcaccaattgattatgaatgatatgggctttcaagacatataggtaattttaaaattgaacaccagccttgtgtgtacatctttaatatctacaatattttgaactcctgtgtgccaaacagtggatattttgcataattaatcctaacctatttgtaggaagtggttcacagctaatggatacaaacttgataaataacagatgagcttcagtgatattagctcagttacttggctaataagtagttgagctagattcaaacctacatgtctctgattccgtcctaccattccacttacctggtggaaataatgtggattaaaatcagttatattaagaaataaagaaggaaaggatcttagtttggttccaaagcgctatttaagaaataccctggaaactgattttattaaacagtatctcttttgacttctaatttgttcttttcatttattggcaggatttccccatcaaatataaagagaggcatcctctggagtatctgcgacaatatcctcactttaggtgtaggactaacgttctgggttctatattgaggattcgcagtgaagcgacagctgctattcattctttctttaaggtaagatcctaaaagttccctcttgaccctttaaacagttttaataactgtttaaaaacagttgtgtctttttctcctgatgttaacatgtctgttagttatgggttagttttgattggtctcttcattatgggttatggtttcttgactctacatgacctagctttgggtgccagacattgtgaattttaccttgttgggtgttgtgggtttgcacacagctattgatatcgctttgatcctttgaggtcttgcttatgtgatttgttaagcaggtctgtagcagtgctcagtctagtactatttattcctcactgaggcaaagccttcctcaggtcccgacctacagccttgagaatgatgagtttttctagtttgtggaacaggtattgtttccagccagcatgtgagcactgggcactgttttctctaatctttttagatggttctttccctagcattggatagtttcctcacacaaatgcactgatctacctaatactgcaaggtggccctctgcagctctctctctgatattctagcgtatgaactctagccacttgggtctctccagactctgagttgtgtctcttcaactcagggagtctgctgggctctaccttactttttccccttccctgtgctgtggcctgaaagatctcaaggtagtaagctggtctactggtaggggtttaccatgtttgtttcccatctcagagagagatggcttttgttgttgtcttgaaaactattgtttcatgaggtttgctttttattgttactgtttttgttgttgttttacagtgtttttggtttcctgtttctccatcttggtcatagatctatattttgtgtaaagtaagcactaattttaaagagttactggtgttgatcaagtaggtctatctaatgactaaggacattttgtctcatttagctttgcttctcaaccatttccctctacctgggaaagccacagtttaatgtggttgacaagttgctaaggtgaagggaccttctctccctgtggatgggagggccccaaagacaaggagtgatccagcagataaagtttattgttattccacgtggttttgtgaggcttcctgtggtacttctccagatccacctaatttgcagaggttgtgtaatagtggttatagacttcccttgggctgtatccaaattcacacagccccagtctcaccaagaaggttcttgccccttgaaaaagctccttcagattcacttttggtcaaagagctaaagaacatcatggctttaaggcatatgcttttgataagacaaaggaaaataaatcaaattatataatgttatcccattatagtttgtaggggtccagttacacatgctgtcagaaactttgctatgcagcttccatgtggattttcagtactgcttgaaccacacaattgtaaaaatacctttttgttttttaaccacatggcttcaacagctgataaattattagttctgaaggttttgtaggcttttggccactaggtggtggtattgacaagtagactacactatacattgattacttgaaacttttagagatatgtaaacaattaaaaagtaagacaagctaaaaaaaaattgaaataaaaaaataaagtagtcagggtgcagtggttcacatctgtaatcccagcacttggggaggctgaggcaggaggatcttttgagcccaggagttggagaccagcctaggcaacatagtgagacttggtctctagtaaaaataattagccaggcatggtggcatgtgcctatagtcccacctactcaggaagctgaggcaggaggatcacttgagcccaggaggtggaggctgcagtgatccgtgtttgtgccactgaactccagcctgggcaggagagtgagatcctgtcttaaaaatattattattactgggcacagtggctcacacctgtaatcctagcactttgggaggccaaggcaggcggattgcctgagttcaggagttcaagaccagccctggcaacacggtgaaaccctgtctttactaaaatacaaaaaaattagctgggtatggtggcgtgtgcctgtagttccagctactcgggaggctgaggtagaattgcttgaacccgggaggcggaggttgcagtgagtagagactgcgccactgcactccagcctgggcaacagagcgagattccatctcaataataataataataataataataataataatactgtgtgtgtgtatacatatatatatatatatatttttttttttttttttttttttgatacagagttcactctgttgcccaggctggagtgcagtggcatgatcttggctcactgcaacctccgcctcctgggttcaagggattctcctcccacaacctcccaggtagctaggactacaggtgcgtgccaccacacccagctaatttttgtatttttagtagagacggggtttcactatgttggccaggctggtctaactcctgacctcaggtgatccaaccacctcagcctcccaaagtgctgggattgcgggcgtgagccaccaaccctggccaaaaattactaaaatgaaatttgaaaaacattcatggccgggcgctgtggctcactcctgaaatctcagcactttgggaggccgaggcaggcagatcacgaggtcaagagatcgagaccatcctggccaacatggtgataccccgtgtctactaaaaatacaaaaattagctgggcgtggtgttgcgtgcctgtagtcccagctacttgggaggttgaggcaggagaatcacttgaatccgggaggcggaggttgcagtgaaccgagattgcgccactgcactccaacctggcgacagagtaagactctgtctcaaaaaaaaaaaaaaaaaaaaattcaagtggttggaaataacttgaattttagcaccattcgtgatagagtagttacaaaaatagacactttttgagtagtaataaattcacttagtatttgtaaagacctggagaatataattctgttacctacctttatgtgtgatagttatctacctttatgtgtgatacttaggattagttgtttaaagaaccctttctgtagtactataaggcatattaagtaatagttatatgttacctagtattttgtagtgtttctttgatctgttactttgggtttgctaaaagatgttaagcctccaaataaaaaattttcgtaagtttcagttttgttaattaaaatatagaaatgtgggggaaaaatggaaacttgaacagtacttttaagacactttaaggatctaaggttatttcttggtttgagtatgaaaaatattttttgtataaccttgtttgctcataaaactgacatacttgttatgtactaaaacttggctatttagaatcctcaaggaatgagtcattcagtaaagccaagtttctgaaataactgaggaattttctctttaggcaccaattttttctaaattccagtggaagtgttcctaaaatgaattacttactttcccctcttcctcagtgagccagtagaaaagattctgctctttctttctcagtgagtcgaggttcttcctgtgagtatcagggattgttcttctctgtatggcagcgttttcaaagcctgccactgactatgtgaagtatttttgttgttgttgttttgagatgaagtctcatactgttgtccgggctggagtgcagtggtgcagtcatggcttactgccaccttaatcccccaggcccaattgatcctcctacctcagcctcccaagtagctgggactataggcatgcaccactgtgcctggctcgttttttttaatgtattttttgtagagatgggatctcactgtgttgcctaagctggtcttgaactcctaggcccaagcaatcctgcctggaccaaccaaagtgctagggtccagatatgagccactgtgccccagcctatgtggagtattctttacctttgtgtagaatgtctccaaattgctatgcctttgagttcctgtgactgctgtttatgttttttgttttttgttttttgttttttgttttttgacagagtctcgccgtgtcacccaggctagagcacagtggcgtgatctcggctcactgcaacctctgcctcagcctcctgagtatctgggactacaggtgtgcactaccacaccgggctaatttttgtattttttagtagaaactgggttttaccatgttggtcaggctagtctcaaactcctgacctcaggtgattcacccgcctcagcctcccaaagtgctgggattacaggcgtgagacactgctcctggcctctttatggaattttaaaatctgttcttgctgtcactttatgttgtctatggcctgcctgtggctagcaattcctttcacgtttccttttttgttgattctgattaaataatagttatttcagtttcacgtgaaagaaaaagataatctattagtcttctcttactgatgtgtatgggccgtaatgtatgaactttataattttgggatactcagagccttataaaatatctggttttagaatgtgtattaaaatatttaaatacttggaggtgatgggtggaatctgaaaaattgggtgaaagtggttgcttttatttttggcctcttttctggccttcatgtttctacttaggagcccctttgctgcgggacagtataaataagtgacactggaaacctatttgaggcacatactgacaatacttaaccactccttgctatttactttccttttattctttttactcccccacccgctttcacttttttggactttgtttgcacggctgtattattcttcctttgtactctctcctttattagcatttggtaacgttaggaactttgataagccttgctagcagttttaaagcagcgaaagctgctgggcccttttgtaatgtttagcattagttaagtattaaaaataattcccactaggtgtgtgatttaaaaaaaaatctcagttattttcctaagatttacagtgctgtttcttgtggcatttgaccagttctaacttgggcaatcatgtttagccgttaaattttctcctccctctccacctccccttccccaccctcgtttcctttggatttttcacttcctttctttgtttactgcactcatgttcatagttgcctacgttcatgtggaagaaatgtttcatgtccatgattcttggctcctaggagataaaaattttatgcagtaatgttattgatcagattttattggttttctataatgtgctctgtgcagcacctctgggcatgttgctgtcagattaagtgtacattttaatactttctgagactgctaatttagagcttgaatatttaatcagtccacatcataaggcaagttgttgactgaatactttgtattatagccagaatacttgaatttgagaaggatcatattcgggaggtccctagtaatgcatagagacaatctacactccaccaaacttggcagagatatgtatttaagaatttattgtattgattccaagaccaaaattttgcattaagcatgtactatcctacatttctattataaattcacttttcgttacctgcagtcccaccctgcaaacatctacattgtgtgtaaccttttgcttacatccatagtcaaaatgaaagaagcataaccttgaagttgctgactagcaacagcttttgtggttcactaatggaaatagtctcagacttttgttcggaagagctccatttggggacctcggtaatggatggatttgctgctgctcagaatattccttcaggcaaaggaagtacactgcctgtgccatgtggagtccattgtgccatcagtttaatgacagagacctcctaaagatcatttctgcctttttttgctgtttgtttattcagtctctatttgtctactttttctccttttttggtggttcattacaattgaggtcatatttcaagataagtttatactgatcgctttgtattcctctagcaacgtgggcagcatcattatgcattagcctatagtgtgcgtatgtgtttgttaaatcaccaccaaaatgttagagaaatgggaagagaatatagtactaaagagagagcatgaagacctaggttctagtcctggctcagccactgactaattgtgtaacttgtggaaagtcactaaatctgtctgggccttaacttccttatctttgaaatgaagatgttggactagttaatgtctaagtgtgttcctgaattaaaattatttgtgcccctgtgggtagttaaaacactcaactgattttcagtagtcttaatatttaggggattagggagggatttgatacagcatctgcttagtgtgccattttaatactataagaggatgtgtgttcttggaattgttgaatgtgcaaatatcctgaaaacagtggttttctttttcaggacagtggctttgtacatattcatactccaataatcacatccaatgactctgagggagctggagaactttttcaacttgaagtaagttttgcttcccatcttgaggggtacattgctgtttaatatttttcatttgagggtttgaaatttaataatagttttgtggacagaagactatgagcagcacctgaaattgtcaataaaaatccttgaaaaacttacatagacaattcaaaccagtctcatttcctgtagtaccagcagtcttatgctgtgacaggtaagaatgaatttttttttttttttttttttttttttgagatggagtctcactctgtggccaggctggagtgcagtggtgtgatctcgactcactgcaacctccgcctctagggttcaagcgattctcctgcctcggcctcccgagtagctggtactacaggtgcctgccaccaggcccagctaatttttgtatttttagtagagacggggtttctcttggttagccaggatggtttcgatctcttgaccttgtaatccacctgccttggcctaccagagtgctgggattacaggtgtgagccaccatgcctggccaagagtgaatttttaatttagcactctatttacttttcttaagttactgtgaattgctgaactagagagatttgaagaggcaaatgaggattttaagctctctcttacgcagattcaatccacagttaatatttgtggacgtaagtcatattttaaaatataaataaaaatagaagagtatacatgtgaatatcattttctttttcaaagtctttaaaaaatacattttttcataagaactgatttatattttgttcatcccatgaaggctcttaaatttgtctagcaatcattttttgagttcctagtatatgccaggcattgtcagcctgcccttactgcagatattttttaagttatcagtttttcttattggaggcagtcgaaagccttgcatttaccagtttgatagctatttaaaatcattagccggttgtataataatggacagagagaatggtatgatcatgagtggtactttggtacttcttttatttgtttactgatttctttatctttaagatgtcaggattcttgtttatatatttggttgattctatcaaatgacaaaatttgtatgtaactgctttctccggttcagtgctttttgactcttaataatggtggtggtgctttatattattgaacaaagtagtctctgggagaagttgtcctgataggttgaagtcattcagaatgataatcaaatgccgtcttcattatacatgactggaagaattcttgacgttgatcagcattctgcaaaaaagcagaataaaaatgccttgttgaacatttagagtgggggtattagcatctgtgtatatgagttcaaagaaggcagcaggtgacaaaataaccatatgtaaattctggaaaacattctcttctaggtgtttattttctctttgcactttaattttctgcatagtgaagccaagaattactgtaaatacatttctaaatcccttagtctaaaccactgaatattcaataaatggctgggaaaaaaaggtataatttaaaggagtctttacaaataaaaaggaattgttaaagagacccaaatgaaacaagtaaaaaagtttttaatgtgcataaataaagatacatttggagataactgcattgctaccagggaaatcccataagcagctctgagtgattgtatatatataaaatataagagagatatatatatataatataagatatatatgatatatatacatattttatatatatatcttgacctctaaataacctaagacaaattatcagataagtgtgaataaataggaagaggaaaaaaatgtatttctgaagctaaacaaatgagaagtgtactatgttcatattatttcagagccagggaaaggaatttgtgggattgaatttgcccatgcagaatatcagaaagagaaactcttgaattcattgatcctaggctcctacagtcaggatctagctcaggtttcagctgatctgtgctatctggcttttatgctgtgtcgacctactgtctttgttgctttcagaagtttgactacaaagacttgtcttctgtccctgccaaccctctatcctttgaaagcagagctccttcttatcccacctcacatacttcacttccaagattcattgtgttgaattcctcctggctgcctgtagaagcataagaatttgaattttggtaccccttttaggaggaggtgggctttcatatttaaattcttgcttctcgtaatggtgcacattttttctctgacagaaatgaagtgtcattaagtactgcatttaaagataagagggcagctttaagaggtcaccttgaaaaaacacagtaagaacatgcacttctaatattctgttgagaagtgaatgcatgctctatcattttactcttcctttccctcatctccatttcctactttgatatttgttaaggtttggggactactgaatacattgtaagaagtttccttcaaggcatttgttcgttattaacggacatttggtgccatctgtgttcaagatgctatgctgtaaagatgtagttgaggttctatcctgtcaagccggtaagttggcaggagttgataagggaaggagcatgcttttcattcactgttgatgttacttatcctacaaaattccttgtttgtacacgttttcctctttgtcctaaggccctggctgagttcccaaaattaggtttggtctttataatttggaagaattagtttgtctttgaggagataaaagagattaaggcaagaattgtaggttgtggctgtcaaagacaaaattactacaaatttagtttaaagatcttaattgactttcatttgccattcaagaatcaggcaacacttccttctataaaatagaagaggctagttttatagatggaaaaaggctgaggaaagcagaaacaaaaatcaaaaagcaattgatctttacaaagttatttttcttgtaaaggttaaagcaaaggggacttccttatgctggctaaaattgttctctttggtgatgtggctgttactcctcttctgacttctcagaaggtaacgtgaagatcttagttttggcttggtggcgatgcacaactgtatacagttccatggttttcagtataactagaagttgatgggaaataaggtggaattgctttatgtatacatttgaggatatagtgttaccagttataagtggtatggaatctagaggaaaatgaggtaggtcagtgagtactgacttggtcagaaaaaccttcaaaatgaatatgtgacctgactgtaccttagggagaatattccaggtaagagcaataatgtaagaagaatcagataattaaaatgaggcatagacaatatacattcttcttgtcttcacgtggcacctactctaaaaccaaccacataattggatataaaacaatcttcaacaaatgtaaaagaactgaaagcataccaaacacactctcagaccacagcacaataaaatagaagtcaacacaaaagcattcaaaatcatatgattacagggaaactaaacaacatgctcctgaataacctttgggtaaataatgaatttaagacagacatcaaaaagttttttgaaaataatgagaacaaagatacaacgtaccagaatctctgggacacaagtaaggcagtgttcagagggaaaatcatagcactaaacgcccacatcaaaaagttagaaagttctcagattaacaacctaacttcacaacggaaataattagagaagcaagaacagatcaaccccaaagctagcaaaagatgagaaataacaaaaatcagagctgaactgaaggaagctgagacacaaaaaaacattcaaaatatcagcaaatccaggagttagttttttgaaaaaattgatgataggccaccagctagactaattaggaagagagaagatcaaataaacacaattggaaatgacaaagggaatgttactactgactccagagtagtaaacaaccatcagaaactactacgaacacctctaaattgctggaaacatacaccctctgaagactgagccaggaaaacattgattctctgaacagaccaataacaaaactctaaaactgaataaataataaatagtctaccaaccaaaaaagcccaggacctgatggattcatagctgagttctaccagatgtacaatgaagagctggtgccattccaacagtaacttccaaaaaattatggagggggaacttctcctcaactcattctgtgaggccagcatcatcttgataccaaaacctgggagagacacaacaaaaaaagaaaatatcaagctagtaaccttgatgaacattgatgcagaaatcctcaacaaaatacttgcaaactgaatccagcagcacatcagaaatttaatccaccatgaagtaggcttcattgctgggatgcaaggttgcttcagcatacaaaaatcaatcacagtgattcatcacataaatagaactaatgcagaaaaggcttttgatataattcaacatctcatgttaaaaactctcaataaactagatattgaaggaacatacctgtaaataataagagccatctatgacaaacccacagccaacattataccaaatgggcaaaagctggaagcattccccttggaaaccagcagaagactataggatgccctcaccacttctcttcaacatagtattggaagtcctagccacagcagtcaggcaagataaataaaggacatctaaataggaagagaggaagtcaaactatgtctgtttgcagacaacatgattctatatctagagaatgccatagcctcagcccaaaagctccttcagctgataaataacttgagcaaagttgcaggatacaaaatcagtatacaaaaatcactaacattcctatacaccaacaacaaccaaactgagagccaaagcagaaagtcagtcccattcacagttgacacacacacacacacacacacgcacacacgcctaggaatacagctaaccagggaggtgaaagagctctacatgagaattataaaacactgctcaaagaaatcagagaagatacaaacaaatggaaaaatatcccatgctcatgggtaggaagaatcaatatcattaaaatggctatactacccaaagcaaattacagattcaatgttgttcatatcaaactatcaacaacattcctcacagaactagaaaaaattattttaacatttatatggaacagagcccagatagccaagatagcccagatagccaagagcccagatagccaaggcaatcctaagcaaaaagaacaaagctggaagaatcatgttacccaactatactacaaggctccactcccaaaacagtgtggtactggtacaaaaacaggcacatagaccaatggaacaaaataaagagtccagaaataaggccgcacatctatgacaatctgatcctccccaaagctgacaaaaacaagcaatgaggaaaagactccctatttaataaatggtgctgggacaactggctagccgtatgcagacgattgaagctggacctcttccttacatcatgtacaaaaatcaactcaagatggattaaagaggcttaaatgtaaaacccaaaactgtaaaaaccctggaagacaacctaggcaataccatcctggcagagatttcatgacagacatcaaaagcaattacaacaaaagcaaaaattgacaaattggatctaattaaacttaagagcttctgcatagcaaaagaaactgtcagcagaataaacagcctacagaatggaagaaaatatttgcaaattatgcatctgataaaggtctaatatccaggatctataaggaacttacttagaagagaaaaacaaccccattaaaaagtgggcaaatggctaggcatggtggttcatgcctataatcccagcactttgggaggccgagttggatggatcacttgaggtcaggagttcgagaccagcctggccaacatggtgaaaccctttctctactaaaaatacaaacattagccgggcatggtggcacatgcctgtaatcccagctactcaggaggctgaggcagaagaatcgcttgaacccgggaggtgcaggttgcagtgagctgaaatcatgccactgcactctagcctaggtaacagagcgagattttgtctcaaaaaagaaaaaaaaagggggggtgcaaaggacatgaacagacacttgttagaagacatgcttgaggccaacaagcatatgaaaaaaagctcaatatcactgatcattagagaaatgcaaatcaaaaccacaatgagataccatctcacaccagtcagtggcgataattaaaaaataaaaaaataacagtgctggccaggttacagagaaaagggaaacccttatatgctgttggagggagtataaattagctcaaccattgtggaaagcagtatggtgatttctgaaagagctaaaagcagaactaccatttgacctggcagtcccattactgggtatatacccggaggaatataaagcattttatcattgtgaagcccaaatattgtgaactccaaaattgacaagtctcagtcaatttaggaagttgattttcccaaagttgaggatgcgtgcctgtgacacagcctcaggaggccctgatgacatgtgcccaaggtggtccgagtgcagcttggttttatacattttagggagacatgagacatcaatccatatacgtaagatgaacattggttcgatccagaaagatgggagaactcgaagtggggagggggcttccaggtcataggtagataagagactagtggttgcattcttactgagtttctgattagcctcaccaaaggaggcaatcaaatatgcatttatctcagtgagcagagggatgactttgaatagaatgagaggaagtttgcccaagcagttcccggcttgacttttccctttagcttagtgattttggggcccaagatgcattttcctttcacaccataaagacacatgcacgtgaatgttcattgcctcactgttcacaatagcaaagatacggagtcaacctaagtgcccatcagtgacagactggataaagaaaatatggtacacatacaccgtagaatattatgcagccataaaaaggaatgagatcatgtcttgggggaacgtggatggaactggaggctatcatccttagcaaactaatgcaggaacagaaaactaaataccgcatgttctcacttgtaagtgggagctaaatgataagaacttatgaacacaaagaaagaaacaacagacactggtgtcttcctgaggggggaggatgggaggagggagaagagcggaaaagataactgttgggtactgagcttaatacctgggttatgtaatatgtacaacaaactcccatgacacgtgtttatgtaacagaccttcacatgtatccccaaacctaaaatataaaatgaatgtaggggtttttattagactctgggtggagagatacatgagaaggttcgtattggtgaatcataggaaataaagttggatagctttaggaatgagatggagcagggttgtttttggtgggttttttttgtttgttttttgtttttttttgagacaaagtctcgctcttgttccccaggctggagtacaatggcgcaatcttggctcactgcaacctccacctcccaggttaaagcaattctcctgcctcagcctcccaaatagctgggattacaggcgcctgccaccacgcccggctaatttttgtatttttagtagagacgggatttcaccatcttgaccaggctggtctcaaactcctgacctcaggtgatccgtccgccttggcctcccaaagtgctgggattacaggcatgagccaccgcgcccagcctggagcagggtttttaaaaaactattttattggaacatatctcacataccataaaatatgaaagtgtagtcatgtgccgcatagcaacattgcagtcagtgacacatcacatataccatggtgatcccataagattataatactgtatttttactgtaccaattccatatttagatatgtttacatacacacacgcttaccattgtgttacaattgccaaagtattcagtagtatcagtaacatgttatacaggtttgtagcctgggggtagtaggctataccccgtctgtgtaaatagactccgtgatgttcgcacaacagtgaaattacctagtgatgcatttctcagaacgtgtctgcctcaggctatgcacaactgtataaagttgcatggttttcagtatgttctcagggttgtacagccaatcaccacggtctaatttgaggacatttttatcaccccaaaaataaactgtacccagtagcagccccttgccattcccacccttagctctaggtaaccacaaatctgctttctgtggatttgcctcttctgaaacttttcatataaatggaatcgtacaatgtatggtcttttgtgtttggcttctttcacttataaagtattgtagtatgtatcagtacttcattcctttttatatcaagctggtcccttttgtggatgtatcatgttttgtttattgatttatcacttgatggacattcgtattgtttctacataacctttaacctgtttcactatgaaaaatgctgctatgaacatttttgaaaagtttttgtgtggatgaatttatgatttaatttctcttgggtagaatttctgggtcatgttgtaaaccttaagttcaacatttttaaaaactgccaagctatttttcggagtggccgcagcattttgaggcttctcctttccctgcatcctagcctacatttgttattttcagtttctttgattataatcatactaatgggtgtaaagtggcatattattgtggctttgatttgcattttcctaatgactatcaaaagacaaaattacaacaaattttttaaaatttaaatttcttcatttaacaattctagaatgggctaacgcttcattctgtaaaatagaatgtattctgatgagctgacctgaggttttatagacagaaaatgactgaaggaaatataaacaaagaacaagaagtgtattggtcactttaaagttactttccttgtaaggcgcaaggtgggaacagtgaaacagaacaatagaaagtaactgattggttaacattaggtcacttcaggttacattttgttggaaggattaaaggtcgagggaactttgttatcatgctgattaaaagtggcctgcttgagaaattcagccatctccctctcctgatttctaggaatgccagataactcagtttcagtttgatggtatggaactttagtgtgagtgactccattactgcactatgcctagtgcagtagcttagcccaaaacaatgccttatttaacatgactaaggatgttggacgtcttttatgtacatattgaccatttatttctcttctttggaaaaatgtctatttaagtcttttgccttaaaagactttaattgggttgtctttttgttgttgggcctgtaggaggtattttatatattctagatacaagtcttgcccctctcctccctcccaccccctaccagtgtgaagcctctgatgctgccactcagggggaatagccttgagtatgcccacaataaggatggcactggttttggtagagctttctttggctgtcttttcccctgaccacacccacctcttaagctccattacttgcagactgattgtgctattgttttcaaagtctggggcataaattgtttcacaaactgatccaatcaaatttatactcctttgtggacatagttttcaagggcagcgtttgagtttgttctgaccccaaaaaggctcttcccagctgtttctgtttctttccagcatactaggaaatctacagtttagcctttatcaccagtgactctttcaatctgcctttcatcacaaccaccactattctggagagcaccgttcagtttggacttttacatactttgttgcaatgaagtcagttcctttgggtaaagatttggagctctgttttatggcctgcttctttgcccagtcagtgttggagtcaggctccagtgctggcggaagggacaatggatcattctcactacaagacctcctgatttaggagctgagtgttcagtggagcaagaggcagcagcccaggtttcttggcttgtctctcctggcatggaacccccaccccaggatctggggcaaaagctgtcaggaccctagtgttctcagcagcaccatgcccaaggtggagcctccatcccccaagtgggactggggctgaggaagggaggctccacctctcagccacacttgcccagaacttagcctcagctacaggtggctgtgagaaaggggagaaatgcctgcatgctgcccctcttgctagagccctgtgatcttggctctaattggggggtagagtttctgtcttgccaagctgtgaggggaaaggaggaagagggctctgtttcagacattacagactctccttgtcctcaccgagctttagtagatttttttgaatagatgtttcttcatttgctgtatacccttaagacgatttctagagactttaaatggttggattaaaaaaaaatttttttttaaataacatttacgcatttcactgaggaatgggtctgaggagctccccacactgtcatgtcagaagggaggaggaaaaacaggttagccacctcttggctactttttaccaccacgatcctcaatttcctctcttgtaaaatgtgaagaacactattcttatcggttgtaaggattagtgaaatgacatatatgaaaacttcatattgctaatccaaaataggtaaaacagtgtgcagaagcaggctgatgtaagcactagcatttctcttctctaaactgttgtgcattctagaaatggtaacacaaagttactagacctcagaaattctggtgcttatacatttttatgactaagttgtttatggcacacatcattttggttgtgctagatggtttcactttttgattactcttacctattttcttttaaacgtttttagatggtatgtgggctaacccaggtcaaacctcttctcaaaacaacttttttctagctaatattaatacctcccttgttccaactcctgttaaacttgtattcagttgctatagctggttttattttttgtttttgagtcacagttttgctgtcacccaggctggagtgcatgcacttgcactgtcatcgctcagtgcaacgtccaactcctgggctcaagcagtcctcccacctcagcctcctgtgtagctgggactgcaggcacacaccaccacacctggctaatttaatttttagtagagacaaggtcattatgttgcctaggctggtctcaaactcttggactcaagcgatcctccaatctcagcctgccaaaatgctggaattacaggcgtgaaccaccgtgcctggcctactatagcctgttttaacattcagttgttcatcaatgatttcttacttaccagttttggttccctgtgtagatggtaagttccttttagggaagacctgtgtcctccacactacctggaacacttaaatacttattattattttctaacggcaattttagttttgtagaactttcagccttaagactagtctagtcatacgttcataaataacataatgatgttcatgattattagctaccacacccagctaatttttgtgtttttagtagagtcagagttttgccattttggctgatctcaaactcctgacctcaggtgatccgcctgccgtggcctcccaaaatgctgggattacaggcgtgagccaccatgcctggcttatacctgctttgttcattttgttcacgtatcagtacctcttactgcttctgcctcattcttttaaaagtatgtgctgtttcagtgtatcaatatatgtatttcaatgtatttaacctattcttttactgatggagaattcattggctatttttttttcctgttacatgatagtatgcacaagttagtattgggtcctgtgttgagaattttgaattaaaatttgttctttaaattaaaatgagctggttctcaagaaatgaacagtttctgagttctttttttttcttcttttacctcaagtgatcctcccactttagcctcccaggtagctggtagctagtactatgggtgtgcaccaccacacctggctaatttttaaattttttatggatacagggtcttgctatgttgtccaggctgttctctaattcctgggctcaagcagtcctccccccatggcctcccaaagtgctgagatgacagtcatgagccaccatacccagccacgaaatgtatagtgtttatccagaagataaagctgacacgtgaaatcgtagcagaataattaaatgtttaattggcttttaccttttttaagggtaattatacagaatatacagaattgttgcatcaagtagtgcttcactttttataagtgctctaggagagatttctgacaaggaaaaactaggtacaggagtgatcagagatgtccacaggacaaagcaatgtgtatgatccttgtttatagttccgtctttgatttttgttccaactttgtcattttctacttccaaaattatccagattcataccaggtacctttcagaaaggcaaattggtaagattggggcagagtgacctatagtgagaagcaaggggatatagtgaattattgatgtatatcacttacctaatgcaataatttattccttttatcaattaatattaattgactacatgacatgtgctggaggaaaagtggtgaacaaagaatctctttccttgttgaatgtatatccttgtagaagaggagacaataaatctaaaagtaaaatagagaatatgttaagtattgtggtaactgtccaaagatagctgcctagtgcactatgcttcccagtcccacatctttctgttgtcctcacccacagttaaagagtgggctggttctgtgtaatcagtaggacatggtggaaatgaaatatccttgcctttgtttttttggaatggctccgggggaagccagcatctgtgtaagaggtactgtgctactgtgagacctcaaactatttgtgtgggaaggctgcatggtaagacagagatacctggctacacttcagctgtttcagccatcccagctaaggcaccagacttgtgattaaggaggtcatcttggatatctagctgaatctagccttcacatgactccagtgccggcagccatttgactgaaaccatgtgagagactccatacaagaaccactcagttgaagccaggcaacccatagacttgtgaaagatagcagtagattatcattttaagccgctaaattttagaatgatttgttgctcaccaataggtaatcagaacagatggtgatttgtattgcgaagaaaaataaattgggaaaaaggttagggagagagagattctagtttaaattggatggtcaaggaaagctttactgaaaagatgttcaaaaagcatgagtggaccaggtgcggtggttcacacctgtaatcccagcacgttggtaggccaaggcaggcgtatatatcacttgaggccaggagttcgagaccagcctggccaatacgacagaaccccatctcccatctctactaaaaatacaaaaattagctggccacagtggcatgcacaactgcaatcccagctatttgggaggctgaggcacaagaattgcttaaatccaggaggtggaggttgcagtgagccgagatcacaccactgcactacagtctgggtgacagagcaagactctgtctcaaaaaaaaaaaaaaaaaaggaaaaagcatgacggacatatgggagtaagtaatgttgatacctgggaaagaacatttcagtcagaaggaacagcaagtacaaagattctgtggctggagcagcctcaggttttcaagaaacaatcatgaaggcaggtatggatcgagcataggaaagagaggaagattagtgggaactgaggttaggcatagaggttgggagtaggtgcaaattatatatgtgagtgatgttcatctttatgaggtgtaacacttttgtaaaaaagaattttcataactccttttctttcccaaatatagataatatgtataatgaaatgtagatgatataaactttttatacacttaattggaaaaatatagtgcttccaacttaatataaaaaagaaagaaaagtaatataatcagtgtattttattatgtaaatactgtggtctagaagaatgtaagtagcctttatatagagatataaagaactgctgactttgaccactataaattaggacttaaacaggtgtgttatattggtgactcacatatcatgaacagtttgctatttgtgatgagaatactggagtgcagtggcgcgatctcacctcactgcaacctctgcctcccgtgttcaagcaattcttctgcctcagcctcctgagtagctgggattacaggtgcccaccaccacgcgcagctaattttctgtatcctttttttttttttttttttttttgtgagacggagtctcgctctatcgcccaggctggagtgcagtggcacgatcttggcttactgcaaactccgtctcccaggttcacgccgttctcctgcctcagcctcccgagtagctgggactacaggcacccaccaccgcgcctggctaattttttgtatttttagtagagacggggtttcaccgtgttagccaggatggtctcgatctcctgacctcaagtgatctgcctgcctcagtctcccaagtgctgggattacaggcatgagctactgcgctcagccggtaactcattcttgataagagttccgcatgaaagtattagctttcccttgatttacatggaagatgcattctggaaaattcagagcatattaaaataatacaatttacctaattcactaacatgaatgttccattgcatatttgaaacttggggtagtacccactaaatttcagtagctctccccagttatgacaaccagaaacattccctctaaaaaggactttttaggccattataagaatattggctgtgagtctttggagagttataagcaaaggagtaataaatcacttatattttaatgagatcattctggctgctatatggagattaaatcagggagaggtacagaagaagagaaaccagttaaaagtctaatgctgtattttaggtggacagatagtgatttacacaggagttgaaattgtacatcctcaaatgtggttggattctggagagtgagagagagttttttttttttttttttttttgagacagagtcttactctgttgccaggctagagtgcagtggcacaatcttggctccacctcccgggttcaagcgattctcctgcctcagcctcccgagtagctgggactacaggtgcgcgccaccacgcccagctaatttttgtagttttagtagagacgggttttcaccatgtcggccaggatggtctcaatctcttgacctcgtggtctgcccgccttggcctcccaaagtgctaggattacagccatgagcctctctgcctggccggattctggatatatttagaaagtagcttatgcatcttggatcttggtaccagggtacatgttttttgtttttgttgtatctattcctgctgtgtattttcccagaagtgattatgttgaatagttcacctctgctagacttttgaacttttaatatagagagaattattttttttcctacaaatggttatttccattgctaattaaaagtagaaaagtagcgtttcttctttttaaaaaacatgaactttcatgttgctagtctggacattagaattcaagtaatcataaatgaaaagaaaatgtcagcttcataaacactggaaagttttttgagtttatactctttagggccaataccatctaattattaggggaaattggtttttgttggaaattagacatttattttatgcatgccatctttgaaggaagcattccatggcattgttgacttcaagagacactttgatctcaaaaaatgatgtgaatcccttttggataatctttggatagcatcaaaatcgtgacttttatatgagtatgctttataatggcttattctttttttttgacacgtagttttgctctgttgcccaggctagagtgcagtggcaccatctcagcccactgcaacctctgcctcctgggttcaagcagttcttgtgcctcagcctccctagtggctgggattacaggcacccaccaccgtacttggctaacttactcttgattaccacagccagaggtaaagggcaaccaagcccttctgttccagttatcaataacttaacttcctccttgcagcaactgcaagaaagtatattttgtgggggggtttgttttgacccaaggtctcgctctgtcgccctgttgggagtgcagtgatgagccagcgatcatggctgtctgcagccttgacctcctgagctcaagtgatccacccactccagcctctagagttactaaaactacaggtgcgcaccaccacacccagctaatttttaaagtagagtcagggtctcactatgttgctcaggctggtcttgaactcctggtctcaagcaatcctcctgcctccaccccaccgaagtgctgggatttataagtatttattgagtacctgctgtgtttagtggtagtcaagtcctttgtgtggatacgtggtttggagacttaactctggagcataggtatcccttctcacagaagtcctagttaacggactaggaccatatcttatcatattcatccttaaagccccaatctgacaatgaataagccaaaattaatatttttcaagcaatagtgaaaaaaagtttggttcatttttcaccgacccctttacatttaggaataagtttgctgttttgcaattttacatttgtgtttatctcctgtaaaagaaaaataaggcagcattgtatattcactttctgttttgcctcaaccttaccctctaatattagactccacgcgtcttttcttgattcattctttctcagactgctcagcaggaaaacactgtttacaaacagtctgacttaataacttcctttcctgctgatcaaatagttgtttaaatgaaacctttctcagggctgagtgggtgttctagttagtgggtgttctggaatgtaaatgaacccttattttaagaaagattatttttatactagcagttctgtgtacaccaagatacacatttgtagcaagtggaaagtatggaaacataaactggacttattggaaatttttagattagtgaaagacctacatatatggcttgttaataggcaaatcccaaaactaacataaccggcaaaatagaatgcagtttattgagcctgtttcccttggctttggtttttacgtatgagatgcagtctaatggcatgcagaacaatttctgcagcaatgatagcaactgcatttgagatacagcttgatagggatcatgaaactaccaacccacaaatctttggagactgtatgacagatttagttcctatgattgattgcttggttggttgattgattttagaggcagagtcttactctctcacctaggctggagtgcagtggtatgatcataactcattgacctcaaactcctggactcaagtgatcctcctgcctcagcctcccgagtagctggaattacaggcaccctccactacacctggcttgttttatgttatatgatcagcatttcatacttaggagagactaatattaaaagcattttaatccaaagctttatttcaacactacaggataaaaaatgcgagagctgggcacagtggtatatgcctgtagtcccatcggaaggcagaggtgagaggatcacttgagcccaggagttcaagaccagcctgggcgacatagcaagaccttatctcaaaaaaaaaaaaaaagtgacatgacttattggaaaggtgattgtactagaagctgagaaacctggattctacaactgatcttaccaaaaagtagttgtatataacatttattctaacatttgacatttaacatttttaagctttagcatcttttacaagagggaagttgaattaaaatttttttttttgagatggagtttcactgttgtcactcaggctggagtacaatagtactagtttcagctcacaacaacctctgcctcccagagtcaagcaattctcatgactgagcctcccaagtagctgggaatacaggcgtgcgccaccacgcctggctaatttttgtatttttagtagagatggggtttcaccatgttgaccaggctggtctcgaactcctgacctcaggtgatgcgcctaccttggcctcccaaagtgctgggattacaggcgtgaaaaaattaaagttttatctaacttagatttttttattctttactatctgtatcgtgaaaggcatagcctccctctaatctcttaattgggatcaagaaagaaaataggatattcagtggttatatggagcttacagatggtgagtactctcccttttcttcatgatcttcaaaggaaattgcagattgaggtaaacaggacaatagcatgccattatgattttaaaccttttaaatttctgaaccatgcttcatctttatgtattctcttcccaactttttgtctctgggattatgagtaaatagaactgggtaaaaggtgggggtagggtacaaagtagaaaatggaaaaagtaaaaggagataaaaatagattgggtgtttcagtgattgtagaggtcaaataagttttccattgttgattatattcctttccactgttcagcttactgctatttactctcgctccttgctatatattttacatggagacagagtcggacttgtgtgggtttttctatttaattctcctgagattgtgaaactgctcagctaaatttgttctgctgtgagaacaaataactggagggcaattcaaaatacttgtttaatattttcttggaaatcctcaaagaaacagggaggattttagatccgtgtggtaagaaattcactgggatacacacattaaaaaaatttttttggtagctcttggtttcccctttcttggctgtgctatttactgtcttccagtggcagaataacctagcaaaaatttttgttttgcataatagagaaaggctaggttaagttttattgcactaacgtaagttttatatgatcagggaaaggttagtctatcatggactgtttaggatgggaggtaatcatcctttatattgattttcaaacatttttgttcaaaagtgttttccaaacaaaatcttataccaagaccctctatagaagatagataaaaggaatgactttgtttatcagatagctcaaatccacgtggttttgttgatagactatatgaatgccttaacagagcattgggaacttgggagattgcaggaaaaggcttagttacgcaggactttgtatatattgcaggacatgttggactcctgcccactaaatgctctacagactcctgaagtattttctagggaacactatcatcatcaatgagaagcactaatctgtaatctctcccctggcgattttattcacttccaaggctttatgtaccataccatctacatactgactgccaaactgtttatctgcagtcccaaactgtttatctccaggttctgtttctgagctccagatttgtagaagcatctgcctacttgacatttctcctttgatgtctaatatgcattcaaacatagtatgtattaaataaacctcttgattttttcctccaaagccttttcctcttctttttttatctcagtgaaagttaccatctactcatttgcttaagtaaaaaatctagatgtcagacttaattcatacctcccctgcctgtctccccaaacctcacatctaatttatccgtcctttgttggctcatctttaacataaatcctcaacctctccatttctctgtttccaatgttaccagtttaattcaagctactcttcttgtcttctgattggtgcccctacttctactcttatccctttattatctgttctccgctaagacactagaagaattttttaactcatcatgccacaaccccatgcttacatttcagtggctgctctgtgatcttagaataaaattcaaactccttatcatgatctataaaggacccataatctgatttctgcctacctgtctaacctcatcttttttttttttttttttttttttttttttttgagacggattctcgctctgtcgcccaggctggagtgcagtggcgcgatctcggctcactgcaagctccgcctcccaggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctaacctcatcttttaacagtcttactcttgagtccctcaagctacagtcacctgccttccactctcgtaaggtatgacacccccttcccacgtactgatctctctactggctgttccttgtgcctggagtatttttcccagtttatagtatagcagatacattcttatctttcaggtctctgcttgcttgttactgcttaagagcccttcccataccccagtacccaactcatttatcccagcttgtaattatcttgattctttattagtttacatgttattttcttttttccccattagaatgtaagctctttgagagcttatgttctcttatttattgctctctctcatgtagcacagtgcttagatgaatgaatgaggtgtatatacagattatcacggaaatgcagagaagggtcatttttactagtctaggcatggagttgggggctattagcagtaagaaggcctcatggataagtgatttttgaggtgaatgtattgtgctgtggtcctaaactgctgtgaggtgaacaacgtaggcagtgtgacatcagtggaccaggtagccaagactgctgctaagtgactataagattggtagcatatagagcatggataccccagacaaaggaatgattcatgtccagggcaggatggagtgggacagcctgagatttcatcatgctactcaacacagtgcagtttaaaacttaagaattctttatttctggaattttccatttaatatttccagactgcagttgactataggcgactgtaaccatgaaaagtaaaactgtggataaggggagactactatgcctacttaaggaatgttttgaataatgtgataattaagtcagacaaacatgtatgtatgtttgcatgtatgtatgtatgtacgtacgtattagggacaagatcttgctctgttgccaaggctgcagtgcagtggtgcaatcacggcttgctgccgccttgaacttctgtgctcaagcaatccttcctcagcctcctcagtagctggaactacaggcacgtgcctccatgcacagctaatttttaaattgcatttttagacatggacctctcactatgttgcccagggctggtctcaaactgctggactcgagcagttctcccaccttggcctcccaaagtgctgggattatagttgtgagccactatacctggcccctcaaattactggttttatcatctaattctgaaacttctagacacattttcaaactgttaaaatcctgtttctgagtctcatcttagcaataaagaagctagagtaaagatcaagttgtaccctacatgaatacaagccacctcttcagcttcctggtactatctgtactctgtctgaggactttatctccctcttggtcacatttgccgagattgatagaaatgaatccaggcactcattcattcatttgtatccacatgcacatttttttgtatcgtgacttaacacacacacacactctctctgcatctctccatccatatatggtcatgtgtcgcttaacgatggagatactttctgagaaatgcacccttaggtgatttcatcattgtgcaaccatcatagagtgtacttacgcaaaccgagatggtatagcctaccacacacctaggctgtatggtctagtctcttgttctttaggtacaaacctattcagtatgttgctgtactgaataccctaggcaactgtaataaaatggcaagtatttgtatatctaaacatacataacatagaaattgtacgataaaaatacagtataaaaggtttttttcttttaatggtacacctgtatagggcacttaccatgaatggacattgcaagactggaagctgctctggatgagtcagtaagtgaattataagtgagtaggaaggcctaggacattactgcaaactttgcaaacctatgtacttaagctacactaaatttattttttaaaatgtcttcagtaatagattaattattaatactagattatcttagcgtactctaacttttttactttataaacttaattttttaaaatatttttactctttcataatacttaaaacacgttgtatgagtacaaaaatattttctttcattattctataagcttttttctattagagatttcttttttactgtttatacatttttgttaaaaactaagacacaaaaatacattagcctaggcctatacgggggcagcatcattaatacagaggtggaatcgctgtcttccacctctgtatcttgtcctactgaaaggtcttcaggggcagtaacacacatggagctgtcatctcctatgatggcaatgccttcttctagaatacctcctgaaagacttgcctgagcttgttttacagttaacttctttttttaataagtaggagtacactctaaagtaatgataaaaagtatagtataataaatatgtaaatcagtaacatagttgtttattatcattatatgactggaagtgcagtaggtttgtttacaacagcatcaccacaaatacgtgagtaatgccatgctctgtgacatcactaggaaataggaatttttcagctctattataatcttatggatgcgtcatatctacagtccattgttgaacaaaatgtcagtatgtagtacatgactatattttatctgtattattcatcatatagagtactgtggctgctctgtgaatatagttattgtatgtatttctttaagggaaaatgagttctgagatgcaaaataaccaagttaaaaatgaacttgctgggctcggtggctcacacctgtaatcccagcactttgagaggctgaggtgggtggatcacctgaggtcaggagtttgagaccagcctgaccaacatggagaaaccccgtctctactaaaaatacaaaattagcaaggcgtggtggtgcatgcctgtaatcccagctacttgggaggctcacttgaacctggcggggcagaggttgtggtgagctgagatcgtgccattgcactccagcctcggcaataagagtgaaactctgtctcacaaaaaaaaaaaagagctttctggatctctgaatgttatatttctgctgtatcttaaaagcaaacaaaataattaaaaataaaggaaaaattaaaatctttgttgcaatatcaaaacacaataatgacaaaaataaataagaagtgtgagacaatgagataaagtatttttgctggtttatgttcagaaatattttttataatgaataagaattctgattttgagattttatctcaatgtgcagtactttaaaaaatgttttttatattcttttatattgtaccatttctctcaaggatttgaaagaaatatattgaagatgggatcaaagtagatgaatttatgtaccattgtttcaagaatcggaagtgacgacttaggtgctggaaacaacagaaattaccacagcattactatgcagagattccttggcgggggaaaacacccatatattcacatcacactatctgccacaatgtacaaaaaaattctgcagtttatttctggttgatacagttatatggctacccagttaactggttctacttattaaaaagttcagctttgcctcactgatttgatataatacttttatatgtgaaagtctgtgtttaggctttcagttatatcccacaggtttacttgtgtaccactaatatactgtattaatttagaggctttatactatgttttaacgtttggttattcaaacatttcttttattgctgtattccttggattacattattccttaattcccaaggattaacacaaatggaggtttttttccatgctctttccattgagaaatttgtgtcctcgctcagatttaggtatctcccatatttccaggtcctacttcaattcgtttttcaattgaagaaatatttactgagtaactgctattcccaggtaataggctagatgcaggatccagtaataagagagaccgtgtcccttaggagccccaatatttcttaatttgatgagataacactgtgaaacaaaaggtatttagtatgaatctttgatcttaagaggtttgagaatttgtgaatgtatctggaggaggttacactgacaaagttctgatttattcactcattatcagtcagtcagcagcctaaaggaacttacagaacattccccatgtttcttactttttaggtgtaccaacattccaagaaattctggctcatagattcctaaaaaaaataactgctactcagtgtaatggctgaaggtagtagtgtatgaaccatgtgatccgtagaaaatgatgcacaaagcacactaaaaagccagtcagtaccactatgtacctattgagcggccaacatccataacactgacaacaccaaatgctgacaaggatgtggagcagcagatttaacagccactttgcagtatagtttggcagtttcttgcaaaactagatatactccaaccataagaaccagcagttctgctccttggtatttacccaaaggagtggaaaacttatatccacacaaaaacgtgcacatggatgtttacaaagcagctttattcataattgccaaaacttggaagcaaccaagatgccttttattaggtaaatggagaaataaactgtatctgttacatccagacagtaaaatattattcagcactgaaaaaaaatgagctatcaagctatgaaaatacctggagaaactttaaatgcaaattactaagtcaaagagaccaatctgaaaaggctacatattgtatgatttaaactgtgtgacattctggaaaagacaaaactatggagaaagtaaaaagatcatggtttccaggggttaggggaaagggagggataactaggtggagcacatatttttagggcagtgaaactattctgtatgatactgtagtggtggatacatgtcagtatgtatttgtccaaatcctgtgggactgttacatgttatgagtgatatgctctgacactcctgggagactccttggttgcctaaggtgcctttcagccaggaggtacagttccccttgtctttgggacttttcttgtgctcataaagtcttttataaactttggtcactcaaaaggaaattttaaatgtgccaaattgaatggagctttagatctggccagtttaagaaaatttgcctaagctgtagacattcacttcctcttttcaaagagaaactgctttctccatgataaaatttcaaatgagagaaaaggttacaaactgtagtgaataagacaagcaagactttttaatctcagagaaaagtgaaaaaatcacaaatatacacaaataatggaataagagaataacaaactaaacgcctaccttaaagtagtgcttcaattccagtctcatcagttgttgaatcaggttccataaagtctgaatctcagtcaagccagggagattcaaccttgagagtagtctgaccaagggcttctgcagtcttcagcgaggtcagttggatgcaacggtccatgctggtgctggggctccagctgttggcaaaacagcaggagtcaatgaaggcctaatttgggtcccatctggttcaccaaaatgtcaccctgaaataatcaagaggcccagaatccaattttaaaagagtttgttcaagtgcaaaatttgagactggccacccagaaaaaacaagactccagagtagttgggtcattgctgagaagtggagaagctgaggcttcacttatataagtagaagcaaagaagtttacaagtattaccacatttttaatacaatgctgatttatgagttacagcagtttgattggttacagcttattctttttcaggaaagatatatttaaaattgcatccctatcaatttggtagtcatggggcctttcgccatctggtctgagctgggtacatgaaaaaggaaggatgttaatctataacaaagaattagtaactaagaggtaaggggcaccatttaatctttcacaacgttttacagggcaagaaaaataagaaagaaggttaatctgtaataggaagaaacaaaagttgtagtgacttgcccgtatgagctaggtcttacaatcaatcacattttattcaaggctcagagtaatttaaagtttcagcagctttcatttaaattattttcacattagccatttgagtcttcatttctgtatatcttctttctcatttggggagcagattattttctctttttttgttttcttggcaggagttccttatatattctgtccattaatcacttggcggttttagatgttgcaaatatttcattcataatctgtcatttgtctgttaactttgcctatatcttcctttattaaatagaaattcttaattttaacatatataaattcatcagtttttccttttatcgttggcaatttggagcttttgttaaagaaatccttccccactgataaagtcacaaagttgggtgtttaattcatatattgtattgtttctttatcactaccataagtacgtaagattacaaatttaagattacaatcctaaatcttaaatttgcaatcctaggttggtagtttttgaagctactaagattcaataattactttcaagaattgaggtgaaatttatgtcataaaattaagcattttaaaaggtacatttcagtggcatttagtacattcatagtattttacaactgccacctctgttaagttccaaacatttttaccaccccagaagaaaaccctgtgcccatttagtagttacatcccattttcccctctacacaaaccatgactctcatccatctgtctctatggatttacctattctgtatgtttcatataaatgtaatcatacatagccttttaagtctgtcttctttcacttagcatgttttcattgttcatctatgttttaacatacataagtacatgctaaaacatttaattttaatatataggtatatacattccttatggctgaatgatattccattctatgtatatatcatattttgtttattcatttttccattgatggatatttaggtggttttaccttttggctgttgtgaatggtgctattttgaacagttgtgtgcaagtgtttgtttatgtacctcattttaattctttttggtatgtacctaggaatggaattactgtgccatttagtaactcaattttaactttttaaggaaccaccaaacttttttccctagtaaccgcaaccccttattgtacatttctagtttcgttccatagttatcaaagaagataccttgtgtgattttagttttttaagatttattgagactgttttatggcctattatatggtctactctggagaatggtccctgtgcacttgaaaaaaacgtatattctgctgctgttgggtggagtctaccatttttaatttgccttttttttggctcagcatttgcttgattgctataaacctttaactctcttcgagagttcccacaattgattctgacagttttgttcattttttttcttttatttttctgtggcaggacagtcctttggagctacctatcctgccatatttgctgatatcactttttgtaattactttttacaaccaatattttatataccctctttaatattctgagataaaatatataggtgataatacaaagggaagtttaaaaaatcagtataatactttaattgtaatataaaagaaaagtaatttatagtaaggtagtatcagtttgttacgtaaacgctaacatgacattggaaagcataatgaagtagtggtatgttttaaataagttgaattaaagaaatgtaagaaaaatcagaaatcattctgtacaagtgctgataaatgaaaatctaaaatctagtcataggccgggcacggtggctcatgcctgtaatctcagcactttgggaggctgaggccggcagatcacttgaggtcaggagaccatcctggccaacatggtgaaaccccatctctactaaaaatacaaaaattagctgggcatgttggccaatgcctgtaatcccagctactggcaggctgaggcaggagaatcacttgaacctgggaggtggaggttgcagtgagtcaagatcgcgccactgcacttcagcctgggcgacagtgtgagactctgtctcaaaaataaataaataaatcttattattaagaccagactttttttttatataaatacaagaaatgagagaaaccatctgaagtgaagttaaattagtacaaattatagactaaagtggtgaaggaaaggagaaagtatggtagtcttataaatttgttggacctcatttcggaaagcaattctttagtaaataatgaagaaatatcagagaacagatcttttattttaaaatcttaacatatatcagatcaagtatttagtcttgagtactaaatatctttggaagcaataccctttcattgataatgagatttaaagatggactttttcataaaaaaggcattcatcgatctctgactagtatcaaagtaagtttgaaaaaaaaaggcagttattataaaaataaaagattcaactgataatttttacagtacattttttatttatccacagataccgatacatgatatgcagtatttttagaacaaccaatgaaattaaataactttatttcctgtgttgccataatttaatatttggtactaagcctgttaaaagagtcttacattctccattacatattttaaattggctatattgcttttacagtgactacacctttacactaaaacattttcaaataagtgcacagtttaaaatacaagaagctgggctcagggactcatgcctataaatcccagcactttgggaggctgaagtgggaggatttcttgatcccagaagatcaagaccagcctgggcaacataatgagaccctgtgtttaaatcaacaaaaacaagtgtaactttcttccccagaaaaggatatgatactcataacttgattcagaagctttctttattatactgtttgtgtttagcctccaggtagtttgttttagcttaactcttaacaaatgttgaatggcttgtttcctactcatttcagatggaataatcaccctttctatattgtaagttcataaaggttttgttgctcagtgtatcttttaaagatagagtcatgcttttcctgctacctagttatggtgacaattaaatgaaatactgtttttgaaagttcataatgtgtttataaaaatctgtgttaaaagcattactattaatattttaataataaatatgacctcgcatgttccagaggctattctcttgagataattaagtctcaatcataagtcaaccttttgaggttatgtaattcttcacattaaaaattaattcataatttcttgccttagattgcctcttaatcagaatcactttttagggggaagtatattttgtgacaaaggtactttggtcctttggttattgtatgttttgaaaatatggaacaaacttccttgcctttattagcactttccaagctggcgttttgtcttagatgtgtaactacctttattttcctgagaacaacctgccttcacatagatttaattgcattgtgatttttagttgtgacatgtatatgaatgtgaaatgcaaagcaaaacatttaatagttttttgtggcttatgtttttgatttgcagccttcaggcaaacttaaggtacctgaggagaatttcttcaatgttcctgctttcttaactgtctcaggacaacttcatctagaagtgatgtcagggtatgaaattttcctttctcttttgctttgatatattatggtttggttgagagtgcttcccttcccatgctcaaacctaaaagttgaaattagtctttatcattagttcacttgaattttccaaaatatttaagcttcttacttgtagtacagacttttgtttttagtgaaaaatgtaacactgaaaatacaaagttgtcatttttttctttttactaatttttcttgcttgaatcccaaacatgtaatcagaatttatttaaattaatcatatttatggaagtaaaggcaatttatagtttatacctgaaccgggtattagtctatttcattttaaagagagtagtatttgaaacagacggaataatttttttttcagtaattggtttaaataaaattaactcatacctacattttgagaggtgtacagcaaattacatcttttaagtcagatcaaatgaattttagcaactgtcagacctctggaaagtcactgtattccttggggcctaccttttctttaaaacgggattgagaaagaagacctttaaaatcctgtctaaatcttatattctgtaattctgtgggtaattcccatttatttttattttttttagaggtgggatctcgcttattgcccaggctggagtgtagttgcacagtcatagctcacaaactcctgggctcaagtgattctcctgcctcagccttctgagtagctgggactacaggtatataccaccaaacctggctaattgtttgtagagatggggtcttgctatgtaccaaggctgatctcaaactctaggctcaagtgatcttcctgccttaggcctcccaagtaactggaactcaaggcatgtgccagcacacttagctaatttttaaaattttttgtagaggtgggttctcaccatgtgtcctaggctggtctcaaactcttgactcaagtggttcttccgcctcagcctcccaaagcactgggattacaagcaggagccactgagcctggcctctgggggtaatttgttaatgcagactcatcaagtactgagttttctttatgtatctttttctttaaatattttctcattatagagattaggacttaaaaaaatcttttctggaaatagctcacttgaaaggaagggaatcttttggtgttttccattgttttaaaaatgcacagatgagaaaactcaaggaaaatgtaatagaatagtttgcatatttacttttgtactttgctagaagaatggaaagtcagtggtggaataaagatggtcttgaaagtaacatgttcttttctgatttatctttgaaacaaaaatatgttatttgatagttccaataaccaaatgactggcaatattagcagaatactatgcagaaaaagtgtcataataacatggtgagattataggatttgcagatctggatgtaggaaaggccgtgtcaagcctgtcatggaatgttcttatgcctacggaattataatttaaaaaaattaaaaacatgactcattcaaatacaaaatgaatttgtatcaaagttttcattcagttgattatattacagaggaaacaagtaaaatagaaaactgtttcaaagagcatctgaagacctctgtatttatagacattttaatagttggaataagagtgctaggtcagttataaactggttaatgtcctacaggaccaacacaccctaaactttgggattatctcttctacctggtagagttatttgcaactctgctgggaaagatctgtaaattagcgtgtaacttcacttaatacgggttatttaattcaatattaaatagactaatggaacaagtacatttccctttccctaagtaattaagtaatcgtcgaatgggcctttgtcccctcattgtgtaataccttgaaaggacatcacctttttaaggctacagcttttggccttatattcaaggtttggataacctttcttaacagccttttagtattcatttctattatttataaagttagaagcaaggtgtctcatccctcagaagtgtcatatgtgaaatatataaacttagcaaatgtttgtttctctattataataccactagtgtattaaatatgcctctttcccagtaaagcgcagtgaaccacagaacacagtgttctgtgaaacttgacggaagattaaattggtagaatactaggttttgtattttttagtgtgccatgaagtatttgtactactgtcattcaaatgttcctagtttaatatgcacagttctaggactattaatatgcagaacataatgtttttgattaaagtatgatttattctccaataagaaattgttagtcctttttccctcagctttgttttttcttgaattcaatttaacagactttgtaaaaggcaaaagatttatgcaatctgaagagaaaccagagtattaacagacttttaaaatggagaaaatggtagttaaatttagacagttaacattttccaaaaggatatctctgttgctttagtgggtttatggttccattttaaagctttttttaaagtaaatattctatgttggaataatttttaatatatagaaagttgaaaagataatgcatagttttgtgtattctctatccagtttcccccattgtaaacatcttccatgaccatgatacatttgtcaaaaccaagaattaaatgttatcacattactattaatgaagctctagactttatttggatttcaccagcttttccatcaatacccttattctttttccaggatccaattcagggtaccacataaaacttagttgtcatgtttccccagtctcttccattctattacagtttctcaatttttcttttttacgacctgtggaatgtactctaatctgggtgtgtctgacatttttctcatgattagactagggttatttgggtattttgaaagaataccacagaggcgaaggcttgtcccgtcacattgtatcagtggatacgtgatatccatatgatgatgttaaccttcattacttggataaggtagtgtttgccaagtttctttactgaaaatacactattttttcccttttcttactctaatttttggaagtgagtcactaagtctagtctcccctcactggggatgggggtttgggaagagggagatggagttaagaactacccgcaggagggagaatgtttggaattctatatgaaaatttgttgtctctttatccttctttattttttatttgtgtaatcatttatatcttaatagacttgtatatttcatagtttgggttataattcagtgctgtgttatttactttgatgcttaaaactgttttagtttttgttgttgggaactcattcagattgattcttacgcccctttgatacgcccctgtactttgactaattccttattctctgctactgcaagatgcctcagctttgtttgttgtttgacattcattcaccacctttatttgtttttattttttttatagtcagtaaagttacactgacatattattattcctccaaagtccatagcttttacgagcattcactcctagttgtctgcattctatgcttttggacagatgacatacgttcaccattatagtaacatacagaatagtttttgctgccctagaacttttctatgctctgcctagccattcttccttcctaaccactggtaaccattgatcgttttaccatctccatagttttgccttttccagaatgtcacgtagttggaatcatacaccatagagcccttttagattggcttcttttgcttagtaatatgaatttaaagttcctccaggacttttcatggctggatagctcatttgttgtagtgctaaataatattctgttgcctggaggtaacacaatttatcagttcacctgttgaaagacatcttttggttgtttccaagttttggcagatttcccaggcttattttttattttcccttccctagtcctaaaaattagttatttctccaaagagccctagttccttttattagaagatggtatttagaagccaaaattgggtcactggatatgtttgctgttactgagagattattgcttttaaacctttcagtagacagagtttttttttttaaactagagaaagctaagtgagttttcattgcattttgcttatgaatataatttataagtggtaagttcattccaagagagatttaaattgtaaaacctgcaattaagaaatgtcacataatgaagtattccatttctcatcagttaaagtcagaattggagaaaggctcagcctaaaaagaaagaatgtttattattattagagggatttgtttccttcttgggcattttaatgcttagccatgaagtcaagcatattttaggttaaaactgatgcttttctcttgactgttgttgttggaataaattagtacagtttttctagaggaatacctttttacccagaatttcatttctagaaatttttcttaaggaaatgatctgacaactctgcagagaagcctaaacaaaaatgttgaaagcaacttttatttataatagtgaaaaattactaataatctaaatgtccattcaagatttgttaaacctaagtataccaagaaaaatagtcatcatcatttatcatctggggctaatgggccttatttttaaaaaatattttaaagccatcttgtagttaatacacagaagtataaataaagggacagtgaagatcaactttattagaaattttcaggagaatttaaacatagcaagtcaaaaaaattaaattgttatattgagagagaacgtatatgccctaaaattcaccaatttgaagtgtgcaattcagtgggttttagcatattttgaagatattcaagtatcactgacataattttagaatactttccaatatttataattttaaggttttatcactcccaaaagacaaattttttccattagcattcactccctatcctcttctttgcccccacccctgggcaaccactaattaagttctctctctatgagtttacctattctggaatatttatcgtatatagatagaatcacacagtaaattgtattttgtgactggtttatttcatttagcaaatgttttcaaagttcatccaacttgcagcatgtatcagtacttcattcctttttattcccaaatagcattccattacatgggcatataatattttgcttcatttatcagataatgagcatttgggttgtttctacttttggctcttgtaagtaatgttgctgtgaacatttgggtggaagtttttgtgtggacatgttgtcatttctctttggtagatacctaggagcgaaattaatgggtcatgcagtaactatgtttaactgtgtgaggaattgctagtctgttttccacagaggctggaccattttacagtcccaccagcaatagcaaaagcattccagtttctccacatccttgcaaatgcttattattgtctttttattgtagctgttctgacaaatgtaaagtagtatctcattatggttttgacttgcattcccctgactactaatgatgggttttcatcattaaagtcaatgagcacatgaaaaggtgtggagcgtctttccatgtgcctgttggccatttgtatgtattttatttggagaaatgtctatgtaagtccttgagttatttttaaaattggattgtctttttattgagttttgagagttctttatatattctgcatacaagtcctttattaaatatatgatttgcaaatattttttccctgtttggtggattttcttttcacatccttgatgttggcaaactcagattttcattttcacttttctgggttttgaaagtactccagatgggcatagcctattgaattcagcaaactgctgaatactgccatgcatgaacctggaacatatgctgtcctttgaatactgattccagatttttaatacatctttaataggctctaacttattattacttctgaaacttatacttacattataaaaaaaatgcttttgagtattttgtccccttataattttgttgaaggaagagtggccatcttttttgccccataattgcaaaacatttttatttttagattgtacaccaattagaatgatcaaattaatgaattcttctgtttctacatcatctttttttttcctaaacacctttataaaatacttgcttcagcatttgttcacttattaaccttagtaagtaaattttggtgtacaaatatcataaatgatgaaggaatattgccacatatccttttagaaaatgggatggtccaaattcttataaattattacataatgaaatccttcttgtggaatgactcattggatggaagtactgaatttgttttttgacttgaaatgtatttttcacttaacagttcttatgtttgagaaaattcacttagataggtatcattatctgaaagctctttgtctgagatttcacttacacaaccaattttaccatcatcattagagagtagattgtcaaccaggcacagtggctcatgcctataatcccagtgctttgggaggctgaggtggaaggatcacttgagaccagaagtttgagaccagcttgggcaacacacgaaaccttatctctaccaaaaaaaaaaaaaaaaaaattagctggatgtagtggcacataccagtattccaaactacttgcgatgctaaggcaggagggcgcttaagcccaggagattgaggctgcagtaagctatgattatgccactgcactccagcatgggcaacaaaaaggggaggagattgttgctgcctctttgcattcatgttctgatttgtctaataactatgaaatacctttatcattttaattctctttgttagtgtgagtgaaaaataaagatctgaattctgaactgtgatctgcaaaaactacaaaaaggctacaaccatgtatccgggcttttcttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaattttttgtatgtttagtagaggcgaggtttcaccattttagccgggatggtctcgatctcctgacctcgtgatccgctcgcctcggcctcccaaagtgctgggattacaggcgtgagccaccgcgcccggccccgggcttttcttataccttctttaaagatgacacaggcctggcgcagtggcttaagcctgcaatctcaacactttgagaggctgaggcaggaggatcacttgaagccactagttcaagaccatcctaggcaacatagtgggacctagtctctacaaacaaacaaacaaaaaaaccaaaaaccaagcatggtggcatgtgcctgtagtcctagctacttgggagagtaaggcaagaagattgctggagcccaggagttgtagactgcagtgagctgtgatcacaacactacactccagcctgggcaacagaatgaaaccccacctcttaaaaaaaaaaaaaagaaagagagagaataagaaaacaaattgatataatgttgacaatttatcttacttttgcattttcctcttcgcacccatcattcttctactttttttttttttttttggagacagagtcttgctctgtcgcccaggctggagtgcagtggcactgacctcagctcactgcaacccctgcgtctcgggttcaagcgattttcctgcctcagcctctcgagtagctgggattacaggtgtccaccaccacacctggctaatgtttttgtgtttttagcagagacggggtttcatcatgttggccaggctgttctcgaactcctgacctcaggtgatccacccgcctcggcctcccaaagtgttgggattacaggcatgaaccactgtgccaggcctattttcttactattttactcttacttaacataattaggaacaattagtaatgatgaataattactaagatgatgaaatggcaaaatgttttaagacacaggaaaaataacaccaaaaccccatatatagcttagatttatggaaggattcagtgggctttattctgttgttaaaatttaatataaatttctgtttttatggataaacctccacagttgcttgaaccgtgtcctgaaaaaagacaagtcctaacctgtgattgcaaccttttttagaaacagggtctttgcagatgtaatcaagctaagatgatgtcatactggattagggtgtgccctaaatccagtgactggtatttttataagagaaaggagagagagatttggatatagagatgtaggagacacacacacagggaagaatgctaagacagagcattctgtgaagccaaaagcagagatttgagtgatgcctaggattgctgagagccaccagaaactaggaagaggcaaggaaggattcttccctagaatcttcagaggaagcacaaccttgctggcactttgatttcagatttgtagcctcacagctgagagaatacatttctgttgttttaagccaacagaatatagcaatttctcatggcagccttaggaaactaatacaacctttaagagtatatgagtcgtgaattattatttttttataaatatttaaaatattttaaaaatattagctgtttttataaatataactgtttgaccaagaaactcaaaaactagctggacgtggtggctcacacctgtaatcccagcactttgggaggccaagacaggcggatcacaaggtcaggagatcgagaccatcctggctaacatggtgaaaccccgtctctactaaaaaaattagccaggcgtggtggcatgcgcctgtagtcccagctactcgggaagctgaggcaggagaatcgcgtgaacccaggaggcggaggttgcagtgagctgagatcgtgccactgcactccagcatgggcgacaagagtgaaactccgtctcaaaaaaaaaaaaaactcaacaactaaaattgggtataatgagtcctggcagtgtattaaaggttaaattatttatgatttgttcatataatggattactgtacagctattaagattgatcataagtctttacatcatgctgttttttaagaagtggttatgaaacaggtagagtatgattctggttttttaactgtatacatatatttatagaaaaagattggaagaatatataacaatattcaacttgtaaaaatggctatttctgctaatttttattttcttcctcaagtttattttttcagatttgaaaaatcagtgttcattacttttataatcaggaaaaaacttagttattttcagtttggggcaatcaacttgggctttgggctgatttcattcctgtttggttaattgattagtttgtgattggtacatgcagttctaaattgactcccttcgattatttaatcaattcagataatgagctcaaaagccatgaaaaattcgtactcaggatgctcttaccctgttttgtggctgtggtgggaatgtcatcatgtgaatctgagttaaagctttacaattgggtgtgaaactgacttcccatctgcttataagactttctcattcttcattcccttgatactgaattttgttcatttatagtcatttgatttttgagatctttttgattatgattcgtgtcttgcatgtttgcgtttctgatgctgttctctatagcattagattgcgttttccatatgtggtcattcctaaaggctcaactgaaataacgactttctacttgactctcttcctgcttttctcatagaaattatttttatctttttctgctctcttatagtactcattcatttcacgtcataaagaaaaattctggccgggtgcagtggctcatgcctgtaatcctagcactttgggaggccgaggtgggcagatcacaaagttaggagatggagactatcctggctaacaccgtgaaatcccatctctactcaaaatacaaaaaattggccgggcgtggtggcgggcgcctgtagtcccagctactccagaggctgaggcaggagaatggcgtgaacccaggaggcggagcttgcagtgggctgagattgcgccactgcactctggcctgggtgaaagtgcgagactccgtgtcaaaaaaaaaaaagaaattgtttgtttttaacatttagccattttgtagttctttttcatatgtaattctcaaaggttttaaatcccttgaagacaagtctgtctcagctccatgtcctcataatcactagcaagtagtagttaaactgaatttgtaaagcataaattctcattcttttataattttcctctactggtttatacagttcgtctccatatatctgagggggactggttccaggatccctctccagataccaaaacttgcagatgcccacgtatttgcatataacctatgcacatcctcccatatattttaaattaatctcgatttcttataatacctaaaaccattaaatgctatgtgaatagttgttatactgtatttttaaaatttgtattattttttattgttgcattattttttgttttttccaaatattttcaatccaaagtcggttgaatctgtaaatgcagagggccgactgtactatagtgttgagcccacaatgggagttaagtctatgttaataattccttttacttcatggaaattatataaccgtgaaacctaggatctttattgttattgttaactgaatgtgtgtgaatgatgataaatacacttctttaaagggtgtattaattaagttcaaagttaaccctgtgtggatagaaatatgaattaacagactatcggtataaatgaggaacttcgtcataaactccttgccaattgcattttctgtatagtattgacagaaggcaagtgtttatggcagatcgatcagcaagtgcaatggcttttaagtaggaatatttagcttccctgggttaaaatagaatgtagatattttagttaaccaggggttgggtatcactaggtgaatttgatggaagtaaatagacttagaaggttataatgatggaccaaggaatctgctgggtaagaagtgaggaaatggaggtagagggttataatggaaaaaatggttgaacataaagaattggaggtcttaatgaaaaattgttggagtggaaatactaaagtaaaaacctggatgaatacgaggtggtagtcaaagtattgctcttgtgaaattcctatttctaacatggattctttgctcagctccccacctatgaactgaatgccagttgtgttctttggttgaggaacaagcaccttaaactcaacatgttcaaaatgaaattcatcatctttttccctaaatctgttttttcctgaattccctgtctcaggaaatggtactaccaaccttcctgtttgtcagatgagatttatggaaatcattctaaattcttgttccataccctttgaatcctttcactcatttgcttccatgtccctttgcttcagctctcctaaactgcttataatattctaagcacatcatcccatttcacacatcatcccatttgtattcctttgcatatgctgtttttttgcctggaatttgctttcgccatgcctttgtctggctaactcctgcctattaggctaaactcagcttaaaaatgatgtcacccagaaccttaaccaccaccatcacctcctccttgtttaaatgtccttctgtgtgcccatgttgctttgtgcctattttgtaacatggaatcgttggtttatttctttatagctttgactgtgagcttttcaatttagggattgtcttatttaattttgtaactattaatacaaaataaagacagttatctattggaaaggggtttctatcaattctatttatcagaaaatattgaaattattatcttatcttcccattagcctataaagtccttaatctgtatcttgttcctctttgttgtcttagcttctgttactatcatgttgcctgatccagggctcaaaaatcagtctcagttcaatttattgagaaactgtgtgtatcaaaaagtagacatgaacaagacagatataatttcaaccttcgtgaccctatagagtctgatgagcaagatgagcattaaacgagaaattaggagtgtgattactgtcctgagggcaagaagagcatatgtcaagaaaattttgccttgtctacgtcaaattgaatttagaagtaaccttatcagtagagtgattacacggaagtgcatttttaaatgtcattcatgtttaatgaccattggctgttatatttgatgtagattctattccttttgtattcttggacaaacagaaatccagttaatgtagctctttctccccattattgtagagcattttatggtgtacaattttttagttatcctaatacatgttgtttgtgtttggctctgggatgtctctgtacttttatgtcatgtttgatatattatacttgaataaattctatttagccacattatccaaagatagaaaactgtagcttttctgccctgtgtctttatcaacttccaaatacttagaatcttttataaacctttacatgaagaagttgttcctttatagcccaacttttcatggcccagagaaatggttgaagatactggatatgtttagtacagggaagacaaagaggagacatgattctgtagttgttgaagtctatctggtgggtttctgtaagagatatatacagaagagtaaatgatttttttaaagaacaactttattgagatataattcacataccataaaattcatccattaaaagtacacagttcaggccaggtgcagtggctcagggctgtaatctcagggctttgggaggccgaggcaagaggacggcttgagcctagagtttgagactagactggacaatagcaagactccctcttaaattgttttgtttttttttttttaatcagccaggcatggtggtgcacccctgtagtcccagctactttagaggctgaggcaggaggattgcttgagcccaggattcaaggctgcagtgagctataaacacaccactgcactccagccagagtaacagaaccagaccctgtctcttaaaagaaataaaagtaaacaattcagtcgtttttactatgatcacaaagttgtataaccgtcaacattacctaattttgtaacatttttatcactccaaaaagaaactccaaacccgttagcagtcacttcccattttctcctacccccaacccctagcaaacactactgaatcagaacccctgggagtgggacctcccaacctgtgtcacaggccaccaggtgatgctgatgctgagaaccaatgctttagagaaagatcctttgttccctgagtggtgaggacatctggcttctagctatgctgatgggtgggtgggggagcatttactgttcatatgtaaactcttaatgcatccccatttctcctacccccagtctcaccaaggttctgtgtgtcagtcactaattttctgctgcagcatacttcatattccagataacagcttccatgctttgccatattggtcatcactcagccatctgttttctgtccttcagtaatttgtcgcgacctcttgtccactgaaggcccccttcatgattcttccttttagtttttttattattattttaaagttgtctcaggaagaagtgaatagaaatatctgcttaattcaccattttaacttcatttttactagcttgaatggtattaatttgcttttctttaattgctagttaggttatacattatttgcataatgatttagtgtctctgtctaatgtgctaactctgcagtgtctgcttgccgcctttggaaatctaaatactggattctctacccgtttctagtattgaattcctttgtgaagggaatactaacctgccttttctccatttcaagtgtatgggactccactcttctgttacctaattcactgaggtctgtctggctaagcagaaaaagtatatgaaggattgagtgcctttgtaataagcaagtttcatgtgagttgttttaaaaaattcccagtgagccttttgagcaattatataaatagaacacattgtgcctgaaatgctgtgcctgttgatattctctaaaagcaagtgcaggttactgtagtgagatgtgttaggcaatttttgcactgctataaagaaatacctgaccaggcacattgggtcatgcctgatatcccacactttgggaggctgaggtggtcagatcactttcagcccagaagtttgagaccaacctgggcaacatggcaaaaccccatctctgcaaaaaatacaaaacttagccagacaggtggcatacgcctgtagtcccagctactcgggaggctgagggtcgaggatttattgagtccaggaggtcgaggctgcagtgaacagagatcgtgccactgaactccagcctgggtgacagagtgagaccctgtctcaaaaaagagagaaatacctgagactgggtaattggtaggaaaataggttgaattggctaacggttttgtaggctgtacaggaagcatagtagtgtctgcttctcgtgaggcttcaggaagcttctaatcatggaagaaggcaaaggagtatgcgtctcacatggtgagaatgggagcaagtgtgtgtgtaggggggtgtgtcacatacttttaaatgatcacatcacatgagaacccaccgtcaaaaacacagcatcaaaccatgagggatccacccctatgatccagaaaccacccacaaggccccacctccagcattgggtattacaactcaacatgagattggggcagagacaggtagcccaactatatcatgaggcatcagattaatccttagtagaccaatatgtacagtaattggagttataactgcctcccaggttcaagcaattctcctgcctcagcctcccaagtagctgggattacaggcgcccaccactacgcccggctaatttttgtatatttagtagagacgtggttttaccatgttgaccaggcaggtctcaaactcctaacctcaggtgatccgcccgcctcggcttccctaagtgctgggattacaggcatgagccaccgcacccggcccacgtgttcttacttatttgtgggatctgaaaatcaaaacaattgaactcatggagatagagaataagatggttaccagaggctggcaagggtagtgggcaggtgtgcaagtgaagtgggggtggttaataggtacaaaaaaaaaaaaagaaagagtgaataagaccttagtattttatacttaatatttgattgcacaataaggggactctagtcaataacttaattgtacattttattttatttttgagacagtctcactccgtcacccaggctagagtgcagtggtgcagtctcggctcactgcaacttctgcctcccaggttccagcgattctcctgccttagactcccgagtagctgggattacaggcacccgccaccatgcctggctaatttttatatttttggcagaggcagtgtttcaccatgttggccagggtggcctcaaactcctgacctcaggtgatccacctgcctcagcctcccaaactactgagatttcagatgtgagccactgtgctcggcctaattgtacattttaatataactaaaaatgtaattggattgtttgtaacacaaagaataaatgcttgaggaaatggatacccaatattccgtgatgtgatttttactgattgagtgcctgtacacaatatcttatgtatcccatatttgtgaataaatatgtattcacaaaaattaaaaatatttaaaaaattttaaaattttttaaaagaatatgagatagtctcatatagagggtgaccagtgctgttagagaatgaagtagctactaagataatgttatgcttgccaaaaagtactgatcttgttcaaatgaatgattgtgttagttgaggtaaatgcagtacagagataaattggaattctggctactttatatactagttttataagcttaatgaccgagcctccacttcctaatctataaaaatacattatagtggccacattacagagctgctgtaagcattggataccatgtaaagcccagtgtttactcctgtgcaggcactgaaatattaggtgctatgttgatggtaatgagagcctctgggtcctggagaaccttgggtgaattataaaggactagttgcagagaaaagccaaggtagtgtggccaggaagaaatagctggcaggtaataatcaaattattttatattactgacagaactggagttcatacaaagcagaggattggaacaagctgctgggtttcaggactctcacaagacagatcagaagtttaaactaaatcagcacctggaatggaggaaagaattaagacagagaaatcaattaactgtcagagtttgaagactaagtcagaactgaactaagaagtgagagcaagttagggtataatctgccctaagagctgtagtcatttatgttggcaatgaggtgtcactatgttccagattcttttgttcttggaaggacgttgttgttgtgccccttctggggttcctggagcctgatacttctgcttttatacaatagttggaacaagattatagtttaaataattaagtagcagaataaaccagtttattggtaagttattcctgttatcattgtttgtttctttttctttttttaaataccttcaaccagcccataccagttaatgttgtttcttaatcaactttattgaggtatactttataataaaaatgaacccatttaaaatacatcgttttaaatatattttaaatacatgttttgacaaattctttttttttttttctttggagacggagtctcgctctgtcacccaggctggagtgcagtggggcgatctcagctcactgcaagctccgcctccgggattcacgccattctcctccctcagcctctcgagtagctgggactacaggcgcctgccaccacgcccggctaattttttgtatttttagtagagatgggatttcactgtgttagccaggatggtctcaatctcctaactttgtgatccgcctgtcttggcctcccaaagtgctgggattacaggcataagccactgcgcctggcctgttttgacaaattcttacacctcagtaactacttccatgatcaagatatagaattaggctgggtgacatggcttatacctgtaatcccagcacttggggaggacaaggcgaggggatttcttgagtctaggagttcaggactagcctgggcaacatagtgagactccatctctacaaaatattttaaaaattagctgagcgtggtggcacatgcctgtagtttcagctacccagaaagctgaggaaggaggatcacttgagcctaggaggtcaaggctgcagtgaaccatgattgtatcacttcactgaagcctgagcaatagaataagaccctgtctgaaaaaaacaaaaaacaaccacagtaacaacaaaaagaattatttctgtcactcaaaaaattccttgttttcctttggctcgagtctctttccccacccctgctcttaggcaaccaccgatctattgtccccataggttagattttcgtttttttagaatcttatataaatgaaatcgtatggtatttattctttgtagctgtcttctttcactcagcataatgcttttgagatttatccagtagtttgttcctttctttgctgaatattatcccactgaatggatataccatcaaatttgttaattcgttctctttttttgcatttgttgtaccattttaagtatgtagttcagtgacattaagtacattcacaatttttataaccactagcacacatttttaatgaatatatattcagttttagtttgaataaataacacatgcacatatgaaaattttgatcatttgaagagtgttctgtatatgtttgttagatctggttttattgtattaagtcctctctctctctttttagttatcttctgtctggttctttacattattgagaggtttccaatagtattgtaaaactgttttttcccttcaattctgtcattttttgctttatatttgatggtccatcattaggtatgtaagtatttataactgttgtgtctgattgtattgaacctattaatgcataatgtctttcattgtttcttgtaacccttttgtatttagtctgttttgtttgataatagtatagccacccgtgctctcttttgtctcctatttgcatggaaaattttttttccatcctttcactttcagtttatttgttctttgtatctaaagtgaatcttttatagacagcatataattgggtcattttaaaaaatccattctgccaatctctgtcttttgactggagagtttaatccatttacatttaaagtaattactggtaaggaggaacttctctcattttgctatttgttttctatatactttatagcttttttgtcccttgttttctgcattactgtgtttttctttagttggttctttgtagggaaacatttaaatttctttcttattttcttttgcatatattctatagctattttctttgtcgttaccatggagagtacattgaagatcctaaaattataacaatctaacttgaatttataccagctcaacttcagtaacatacaaaaactctcactttcttttcttttcttttcttttcttttttttttttttttgagacagagtctcactccatcacccaggctggagtgcagtggcacgatcccagcttactgcatcctccacctcctgagttcaagggattcttgactgcacttttaacagccccttcttcacccctttcagttgttgatatcacaaaattacatctttatacaggtgtgccccaaaacatacatgaataaatctttgaaatgcattaacctcttaaattaaagctgtagaaaacagaatgtggatttacaaccaaaatttgcaataatactagttttaggtttttttttaaagtgtattagtttcttaagtcagttagaaaacaaacagagcagttatatacacctgaggcatcaggtttatataatttgattatgaggcatcaaattaatctttacaattataatcatgtgtttactttgattaagatctttatttctttatatagcttcaagctaatgcctagtgtactttcatttcacccggcaggaccaccttgagcatttcttgcagggcatgtccagtaacaaactcttttaggttttgtttaagtaggaatgtcttactttctcccttacttttgaaggacagttttgccaaatataagattttttattgacatttcttttagcactttgaatgtatctgcccactgtcttctagcttccaaagtttctgatgaggaatctgttgataatctttttttttttttttttcctttttaaagacagagtctcactctgttgcccaggctggagtgctgttggctcactgcaacctccacctcctgggttaaagtgattctcctgcttcagtctcttgagtagctgggactacatgcgtgcaccactatacccagctgatttttgtatttttaatagaaacaggatgtcgtcctgttggccaggctggtctcaaactccgtgcctcaagtgatcctcccacctcagcctcccaaagtgctgggattgcactgtgcctggcctgttgataatcttattgaagattccttacatgagatgagttgcttctctcttcctactttcatgattctttgtgtttggcttgcaaaagtttgattataatgtttcttggcatgaacctctttgaggttatcttaccatcttggagttcattgaacttcttgggtgtttatacattcatatctttcatcagatttggaaagttttcagccattatttcttcaatggttttttttttgttttttgttttttttttttgagatggagtcaccctctgtcacttggctggagtgcagtgtcatgatctcagctcactgcaacctctgcctcttgggttcaagtgattctcctgccttagcctcttgagtagctgggattgcaggcatgtgtcaccatgcccagctaatttttgtatctttggtagagacggggtttcaccatgttggccaggctgttctcgaacccctcacctcaggtggtctgcccgcctcggcttcccaaagtactgagattacatatttcttcagatactctctttgcctttttctctcttctcctttcgagactcccacatgcatatgttgggtcgtgttgtggtatcccacaggtcacttaatctctattcattttttttcagtcttttctttctgttcccagactccataatttccattgtcttatcttcaggtttgctgattctttcttttgcctgctgaaatctgcctttgaggttttctagtgaaattttcatttcaattatacttttcagctgcagaatttccttttgttttcctaggtgttctttttttattaagattgccattttgttcatacatcattttcttgactttttccacatcttctagttctttaagtgtctttaagacagttgtttaaaaatcttttttgagtagatctggcttgagatctttctcagggacaatttctgtggatttatttttcccctctgggtcatatttttatctttctttatatgccttgtgatttttttaaaaatgaaaactgggctgggtgccagtggctaacgcctgtaatcccagcactttgggaggccgaggtgggtggatcctgaggtcaggagatcgagaccatcctggttaacatggtgaaaccctgtctctattaaaaatacaaaaaattagccaggcatggtgtcaggcgcctgtagtcccagctactcgggaggctgaggcaggagaatggcgtgaacccgggaggcggagtttgcagtgagcagagattgcgcccctgcactccagcctgggcaacagagcaagactgtgtctcaaaaaaaaaaaaaaagaataaaagaaatgaaaactgggcatctgtatctaatcatgtgagaactgtggaaatcaaattctctctcttccccagggcttgctgtttttatttattcttttggacttcttttttaaattgttgaaggctgtctctatgccaggcttcagcccaaagtataaacttaatgtcttctcaggtctttctgagcctgcctgattctttccctaggcaggtgccatcactttctcattttccccatatatgcagttgtttttgaccatcctagtctttaatgtctgactcccaaaggaaaataaaagaaaaatgaagtggagaagtccgctggctctttaaataataccggggcagggtggggggtggggaggggcgtgtaacaatcagaggaggtgactgcctctctgtatctctgtgattagaaaccacaatcagcaatctaggcctagattcccagtatttggaggatccttttttctccaactcagctccctcaagctgtgtgcacggggttccaggaagacgtgcacagctgcctccctcagggctgggagaggggtatgggcaactgctactgtgctaagagctgaaattgaccaaaactaactacaatttactgtataagcctttctctggaagttgcgggtattccatagactgcaagtttcaaaaacagttacatcaggccaagtgcagtggcggatgcctgtaatcccaacactgtcggaggctgaggcaggtggatcgcctgaggctgtcaggagttcgagaccagccttgccaacatggtgaaaccttgtctgtactaaatatacaaaaattagctgggcatggtggcacattgcctgtagtcccagctactcaggaggctgagacaggagaattgcttgagcccaggaggtgaatgtagcagtgagctgagattgcaccactgcactccagcctgggcaacagagcgagactccatctcaaaacaaaacagttaaatcagacaaatactactagtgcacttgtctaggtgggtagacagattcctggtggtttcttctctgccatcttcccaaaatactgtcaatccatctgtcgtttgatacttagttgtttcctgcgtgtggagctattgtgatgatgaagctctctgaaaattcatgcaggagtctgtgtgtggacatatgtttttatttcccttgggtaaataactaggaattaagttaatgcttaactttgtaagaatctaccaagtaatttgctgaagtaattgtattatttacatgcccgctagcagtggatgaggatgccggttggtccacgtctttgacaaaagatgatgtcgtatttttaattatagtcattctagtgagtataggatatgtcattgtggttttaaattgtatttctgtagtgaccagtactgttgaacatttttttcatgtgcttactggctgttcatatatcttgtttttgaactatcttttcaatttttttcatccaatttttactaggttgtttgttttattattgggttgtaagagttctttatatattctggatacaagccctttatcagatataggtggtgtactttttttccccagtctgccttttctttccattttaaaatagtttttttgaagaccagaagcttcttattctgttagtgtattatagtctttttcttatgtggttcatgaatttctttatcctgtccaaaagattgccaacatttttcttccatgttttttcctagggattttatatcttagcttgtatttttaggtcagggaagaccctgctagtctataaactttttgaaggtacaggccatacctgatttacctctgtattttccacagtgattagtagtctaataaatatttgttgaatgaataaatcaatatgacttcaggtagataatgatgataagatacagacagatagctaggccctaagcttctgtatccattccttctttgctgctataacctgtgagcttgaattacttccatgcttttgatttagttcaccagtatattctagttggggggaaaaatcagttaaaaaaaaaaaactccatcagaaaatgcatttaaaaacttgaaatactatgctatgggatctgttaggatatcttaaagtacccttattatgtgaaactgaaatttctttttctcttttaacataagatatatacatacgtatgtgtgtgtgtgtgtgtgtgtgtgtgtgtgtgtgtgtgtgtgtgtgtgtgtgtgtattttgttttctttaagagacaaggtttcattatgttgcccaggctggtctcaaactcctagggtgaagtgatcctccctcctcagtctcccaaactgttggaactacagacatgagctaccactcctggcttcattttacattttcatgcagtgggtgtgaatttctcgtgctatgaattcagaaaatttagtggtttttttttttttaagtcaaaattgtaaaaatttacctgtgaactgtgtgcatgaattatagaaaccacggaaacatttccgtgtattttacttcactgaaacccactaacaaccttaagtgcagttctgggggcagagctggggcatctaaacaaggacactttaaagagtgaaagggagggctgataacagttattctggagcagtcagcataaaatggttttttcctgggcaaaccaagacctgtgatcaccctaaagttgatagatacgaacagattaaatttctctcttcaccggtgttatatttgcttgtttttagggaaccacttaatagaaatgcctcataggctgtagaagatgtgctgtaacaaagactgtaggaaaaaataatatgtgtatgtgtgtttgtatgtgttttacagaaaataaaaggaaattttatctttgctcctttagaaaaaattgccaataaattcagtcatggttttccttccctctcacaagtaaaagctgataacaaataagcttagtcacatgtattcgttgctagccacattagttttatttattttgatgtcaattcctattttatttcccacatataccctacacagaaaaaaaaaaaaaaaaaaaaaactggtgttttgccacatgaaacaggtgtaagggacggataaacagacatgtgtcacatagatctttacagttggagaatatgcaaaacccaagccagccttatttcacatttaagaggtggatttagcatgtgaattaggataaagatcaggaggtagagacttgttttttgtttctggaacattctttagggacttttatttagtttcttcaactgggtaattattctgggctttcctcctgattctcctttaggacaatatggtgtgaagttcagtggaaaaatttgaattttaggcagatagtattttagggactactgtagaaagagttatctcagaagttttcttagccaaaatatatgtatgatttgatgatactggtatttcctatatagctgtggagggttggctgtaacttgggaatttggagataacggttcaaatagttcaacccagagtttctctgccttttgtataggtcatcccatgatcctatcattaagagtgttcatttttagtattcatgcagcctacaaggcctggcatggcagagcatgccattcttcctcttcttccttctcctcctcctcctccttcttactcctccaattcagggaaaatgaagagggatttttcatatattctttctataggctaactccttctgtaaaagcagtttgcctatttctactttttgatggttcctttgtgcttttatgttcataaaccaagctctgtttgatttggagtctgtcaagagtattagaaaatttttatttcattcatagtatataggcctctgcaagtgtaccctttttatgaaatactacctttcgtatcaattatctgtgccttttactttcaatcataagtggtaattagaagagctagatcaggctgggcatggtggcttatgcctgtaatcccagccctttgggaggctgaggcgggtggatcacctgaggtcaggagttcaataccagcctggccaacatggagaagccccgcctctactaaaaatacaaaaattagctgggcgtggtggcacgcgcctgtagtccctgctattcgggaggctgagacaggagaatcgcttgaacctgggaggcgggggttgcagtgagccaagattgcatcactgcactccagtctgggtgaaggagctcagtgtaccattcagcatctgtgctgaactttttactttttaagagtgcacacttgcagcagtacagtaagtgggccctggatttggactgcttatgttaaagcagctttgattgtggtgctctggactatttactcacttgtctaagcctcagtttctgaagttataaaatggaatgaaatcacctctcttatagggtagcaaggatgaaatgaaatgtgtgtaaagtgcttgatagacaatctcgtcattcaacctttttttttttttttttttgagacagtctcactctgttacccaggctggagtgcagcggtgtgatcttggctcactgcaacctccgcctcctgggttcaagcaattcttgtgcctcagcctcccaagtagctgggattacagtggcatgccaccacgcctggctaatttttgtatttttagtagagacagggtttcaccatgttggccaggctggtctcagactcctgacagcctcagctgattcacgtgccttggcctcccaaagtgctgggattacaggcgtgaggcgccgcgcctggcctcagtcaacttttaaaaaatgtgttgtggcaaaatacacataagataaaatttaccattagtgacattgtacaaccaacatcactgtctagttccagaacatttccgtcaccccaaaaggaaggcccatacccgtaaagcagttgttctctgttatgtactgaattgcctctcccctaggattcatatgttgtattgtcctaacccctatgtgattgtatttgaagatagtactgttaaaaagtaaagttatatgaggacataagggtagaaccataatccagtatgactggtgtccatataagaagagataccaggggtgcttgtgcacaaaggaaaatccacatgaggacatagcaagaaggcagccttcagcaaaccagaaagagaggcttcaccagaaaccaaccctgctgtcactttggtcttggatttccggcctctagaactgcaggaaaattaatttctgttgtttaaggcacccagtctgtgatattttgttataacaactcatgtaaaatagtgtactctccatttcctccccacccaatccctggcaaccactttctgctttctgtttttatagatttgccttttctggatatttcatatacaggaaatcatatagtatgtggcctttggtgtctagcttctttcacttagcctagtgtttccatccatgttatagcatatatcagtatttcttttttatggctgaaaattattccattgtatgaatataccacatttagtttattcattcattgatgaatatttgggttatttctgttttttggctatataatgccactatgaacatttatgtacaaagttttgtttgaatacctgtctttattatttctttgaggtatacattcaggaggaaatagttgggtcattctatgtttaatttattgagcagccaccaaattgttttccataacagttatacaatttcacgtttacaccaacagtatacaaggagtatctctatatccttgccaacattgttattttttattttcaaaatttagccatcaaaaaaccttttaaaaagtatattaattagaggtctaaaccttttttagggcagtatttctttatcaggattcacatcataattactagtagagcttttaaatatatccgtgaccaggacccttcttagactttctgaagagaggtcttcagaggtagagccctgaactaatactcttcattaagaaccattgccaaagatagtggttctcagcatatggtctggatatctctggggcttcacatcctctcaggggaatccttgaagttgaaactattttctaatactaagacagtaactgcctttttcattctcattgtctcaagattttatatacagtattttccagtcttcatggcatgtgatagtgcaacagattgaatgcaaatgtaggtatgagaatctagccaccttttgttaagccagacattaaagaaacttataaaagtgtaaagcagtgtcactcctcttactaatttttttgttttgggaaaaaattatgtttcataaaaaatatgttatttgtaacacataatggacttgtcattgtttttgttttgtgtgtgtgtatgtgtgtttgagacagggtctcactctgtcacctaggctggagcacagtcacattatcacagctcactgcagcctcaacctcccaggctcaatcaatcctcctgcttcagcctcccagctagctgggactaaaggcgcatgccaccacgcttggctaatttttgtattttttgtagagacggggtttcaccatgttgcccaggctagtctcaaatcctgccctcaaaagatccacccgcctcggccttccaaagtgtttggattacaggcatgagccaccgtgtgcggccttgtcattatttttaagtaacacaaacataattttaatttatcaattttagtagtaaacgttggtagatacaacctagataaaccaaatttctttgagatctacaataatttgaagtgtaaagggatctttacaacatggtgaaacccccatctataaaaaaatttttaattagctgggcttggtggcacatgcttgtggtcctcgctactcaagaggctggggcaggaggattgcttgagcccaggaggttgaggctacagtgagctgtgtttgtgccactgcaccccagcctgggtgatagagcaagaccctgcctcaaaaaaaaataaataaataaaatcaagcaaatgcaaactgtagcccgatggaaaggaaggagacaaaaagtaactttgatccatttgttctcttaccatatagttggtgttaggttaaccttttgatgtatttatttcatttcatctttataataacctccatgacatttatatactcaccctcatctttgcatggggaaatttagtcttacagaaattaagaacttagtttgttcataagtggaggagccatgatttcagcttgggtctttagactacatgttcttaatcagtaccataaccttaaaaaagtgagtcatctggacaggacttgagtccaggaaattgttgatagttcaatgctataatgactcctctacctctgtagtatcaggcctgagaaaagggaacctttgaaatatttgtagacttaaataacacttaaacactatgtagtacatgtaactaaagtaaagtacttacatgttgttctctttagtggtcctcagagcaaggaccactaaatatgagaggtgtaagagggataatttcgacacgagtaagtgccgttgacaaaattatataggtaattttagtgtcttattgagacataaggataaatattcagttagaaagaacagtcaaatttgtgaccttttcaaataatgttattttctaagcccccatatccagtcagtcctgaagagtccattgttgcaggaatgaagtggcatttcactcaggagccaaagaatcatatactgctgtgtttacatagaatagactaggataattattttcttgtagtaatgttatagttaatttaaaatttgttctaattagagcagttcacccgctctagtccttttcaaagattttcttgttgacagagcaaaaatatgtgacagtttttaaaaactgatgctgttactctctagtgccttctgtgaactattatttcgcagaacagaattattttttgtttagtaattgatattctatttaccttccttttctacccttaatcccatcccactgctgtttcaaatattcatttgggaagctgggtgccatagtgggcatgtgtaattcctccttcttggaagcctgaggcaggagggtcacttgaccccaggagtccagtctgggccacataggagaccccatctcttaaaaaaagtgcaatttggggatcagcatattttatagaagaagaattacttatttgacaaatattgactagtatgtgttaggcactagattaagactgaggatgggccgggcgcggtggctcacgcctgtaatcccagcactttgggaggccgaggcaggcggatcacgaggtcaggagatcaagaccatcctggctaacaccgtgaaaccccgtctctactgaaaatacaaaaaattagccgggcgtggtggcgggcgcctgtagtcccagctactcgggaggctgaggcaggagaatggcatgaacctgggtagtggagcttgcagtgagccgagatcgtgccactgcagtgagccgagatcgtgtcatccagtctgggtgacagagcgagactccatctcaaaaaaaaaaaaaaaaaaaaaaaaaagactgaggatgaggatgccataatgaaccaaataaaatatatatatatgtatatagtcgctcatgaaattttcaatataatggagatggatgttaaataatcacatcgattgatgtaaattttttattttgaaaggtgctgtgaacagtaagtagtacttggtgttattaaagagcatattggttttttcaccaaaccaacaggaaaaaaaaaaaaaaagagcgtattgggaagattggcctaggaaggttgggagacgactgaaatcaaagtggaagctggggggagacatgagttcagtttgtgacaagtggaaggaccaaataagcagatggatatatacttttggaacttagagaagagggctggttagaaggtataaatttgtgtgtgccagtaagtagttaactgaaatcattggccaagggaaatcatataaggaaaagtatcgggagaaaagttaaaggttctaggggtaactttggaggagtgctactgcttaatgaacagctaaagcggcatgtaaaaggaggcagaaatagaggtcagagcagtatttagaaggaaaacgaggacagtactaggaaaatagtgttaaatgtttcaagaggcgagggtatttcaaggtgtatcaaataaaatctggtcactgcttactgtgtttacaaggaaggccctgcatgttctggtcctttccaccatctcttatcattgatcctgctactggcctacacctgttctttaaattctttaaacatgtcaggctccttcctaccttgggacctatgtgttggtgtttgctttgctagaatgttcttttcacatgtcatctcctcagatggttagctaaccttcctccccctttagcaggattgttgtcagactctgtcaaacttggaatttcatcatataatttagattaaattttgcttgggtctcaaattcagttccaaaaaaaatattaagaacatgttaaaggaaattatttggcacaagtttttggcaataaagataagaatttttagaatttagaattcaccctccctaaggcatcttgacatgacatgattgttgaaatggtgaaggctgcatctcttttataatccctttccaccaagtgtattgcatggtggacagataggggaaagctgaaaagggggtatctggagtctactcttttaggcatgtagaaataatgaatgcaaaatatatcacagtattgacaatccagtgaacacaaaacagtagtaaaatagatgttcattttcctgaatgatgagaaaagcacttggcaaaaacttttaaaatccagtttaatagttttctgggagttcacttaaggtcaatgaacttttactaaactaacagtaaagaagtgatatggaggttgggggtggtttgggaagggtgtagtgaaagttgctgatcagtcttatgctgaataagttcttcccaaactaaagaatagcagttcctctgttctttcaaaatgttaagattcactgtgaaatttcagggccagaaagaataaatggccaggcaatcagtgaccactttatattaatctatttgccatcttgagggcttcataaaactccatacacgggagaaagtgaactttgtagaaccttttttttttttttttttttcaattttgctttttattttccaaagagccatttttgtagctatctaggttgatgtgtattgaatgtacttttgttatactaaacattaactccaagctcatggattttccttatatagctttcctctcttcatagtttggcacaagaatgattcttagtgccgagtgttttctttttctcctggtctcttctcagagcaatactggcctttcacctggttttgtatcttattttagaaatggccttgttctcagattttatttaaatgttggttggttcagtctttgctgcaaatggctttcatgtctgtggaagataggaaaaaagaaagaaagaaacataaattaaaatagaagtgattccacatgcagctagagacaaaattattgcaaaagacagtagagatcaatgccaagctgtccccaacccctactcctataaggatttgaagaccagaaaagctaaataacttgctaaagattacaaagtattgacgagaatatatcattctcattattttcatgaagataacattctagagagctgtattttaacacgtaaaacaagctattcataatatgccaaactgcttcccctagttatctttgagaagggggaatatactaaaaatttttctttctaattttctgagtttgcagtgttgttttgagcatcattgttgttagtatcatggttaaggctatgagcattagagtcagaaatgtggatttgagtttggcttccaccatttactaagctatgactttgacttttgggaaagcttcttaacccatctgaactgcagtttcttattctggaagataagtgtattaatacatacgtagactgagttaactatgaagggattaactctaaggttcttgtccatttagtgcttggcccataatgatcattccataatggtaaccactagtactactactactattgctactattacttataatagaacacttgatactgaacagtatctttggatactgacatagggtgatcattattgaattatttaaacattcatctgcttaaagattagatgctttcttacgcaatttttcaacataccttccagttcattttatcactctgttactttagaggaagcactgtggtcattagttcttactctatcaaaatgatatttaactctcagatacctcagtcagagcctgatccttactataattgaaataaaaattattgagcctcttctgtattttatactagagaccttgccctgcattgccagggaaaatcattaaccactgcaaaatttaaaaatccctattgctgctcatcttggagcatcctgtgctccataagtatacacacaatttcttgtgataaagtaccagaaatgtcattttacttatttagatgtactgtactattgccaacctacctagagatggcacagtcacagattggaaactcagggccttgtaattgttgaatttattgtttgggccagacctggattgtttgaccccttttaggtactgagggcgtcagtgacatatatctgagtatttttctatatttgtaatgttaccgtttgtgaggatgtgctttttagtttacaactgaggaagcctgtcatcatcattagtactcattcattcagcatgagcacctgttttatcttaggcactagagatgcgaatatgaataaaacatgattcctgttctggaaaacgctgggggagaaaaataacttagatagttacatttcaaagtgatatgttctatataataaatatgaaaaagtgttatagtaatatacgagagggagcaataaacttgggggaatggtaaggattcaaaggggaagtgacagttgagccaagtattgaaggatgaatgggaattttctatttggagggtagaggagcaggggaggaggcaatacagggtagggaagagcctatgcaaaaactaaaggacatgcatgggacacgctaggaaaggagaaggtcttcagagtggctggataaaaggatgtgtgggaaagaactgagttgaaattaggagttagaattttattctttggtactaaggaatcattgaagattttaaaattagggctgacataatcagatttgagtttggaaacctatagtttgggactggaggaagacaggtgccagacaccagttaaaaagctgttattttctaagcagtagacaaaggtttacactgacaatagctgtggagatagagaaaagctgcgagatttcagagttttccaaggtgtaaacaactaaattttgtgatcaaaatgataagggccatgtaataagctggggaatgtgggatctgtcttggttgagttggtggattaactgagattaacagagctggaggaaatgtaaaaagaaaggcaggattgttcattttgtcttttgtttgttttggggaacagggtcaaaattttcattctgcataaggtaggtttagtctttttcaaaacattctagtaggcaagtctgtagctgaatcttggaagaaaggcaaccatagtaatatttttgagttcctactgtttattttttcaataaaaactaaggttctcaggttagcagatcatggtcttaggaaggtagctgtagaaccaaaatataacttcctaagcttctaccaattgggtcttactgaaatggcaattgagagagaagtaaatctcttggttttcaccatagttactttatgtttcctttcccagagtatctttactaaaaaaaaaaaaaaaaagaaaaagaaaaaacttatatatatacaaaatccatctattttctacactaagttttctgatcttaatattatttggctaaatgacagattaggtgtgctcaggatcaaggatcatagctaaggagcctcaaacagcttgctttgttctaacaaaaccttaacatttaaagattaagtcctcaagaaatatttattacttcatatgtgcttgatctaatctcagctgttacttggtttgaatgtgagggaaacaataagtattaaagaatgacggatgtagtgtccacttcactataggagtttaagaataagggatttttctccccatttggatggttgagctatagtcctctggaatcaagggaataaagtagttcctcaaaatctctcacctccacatttcaggggtcattcaccattgattgaaagacaggtggtcgtcaaggacttgagtgggctttgaacaaggtgaactgcaatatgtatctgacgttcttttttcttgtgtttaaaaaataaatgaacacaccttatctacatgaaattctagttttcactgttattatctagattttctgtggggtttcttgggctgcggtgtttttttctttactttgttcttgattgctgtgaaatgtagttgcctgctgttttaaggcagctgcagtagagtgcacccagaagtggttatgtttctatatttagtaaaaccataggatttgtgaagcagttgcagattccttcaggataaaatggtttctataaatgtaacttttttttttcttttttttttttgtttgtttgttcatttattgagacaggatctcactctcgcccaggccagaatgcagtggcatgaacatggctcactgtggcctccacctcctggactcaaacgatcctcctgcctcagcctcccaagtagctggacctataggcacaggccatcacacctagctattttaaaggattttttgtagagataaattttcaccatgtttcccaggctggtcttgaactcctaagtttaagcagtcctcccaggaagtgctaggattacagacctgagccactgtgcccagcctcaatgtaacatttttaatgaaactgttattatcacctattagagaaatatgtagcagcaaatatgtgtcagtctgtggacaagacagaggcacacaaaactttattttccgtaagagctcactgaatatttaaatacttaaaattaatcatgtgaattctatttgcattctcttaatcttgaattgcagagcttttactcaagtgtttacctttggtccgaccttccgagctgaaaattctcagagccggaggcacctggcagagttttatatgatagaagcagagatttcttttgttgacagccttcaagatcttatgcaggtaggtacacaagttttaaaataccaggtatctgtgacattaaaatgtttctgtatatatttttacctcggacgtttatgtgttacaggtattcataaagtgaaaagaaggggtaactacttaataaacacttattgaatgcctttactgtaatagtttaaaatacaagagtcagacagatttaagtttatatcccagctctgccattagctttgctatgaagttccctgactttcatgatctttaggttcctcaactctaaaatgagaataattgtgcttactcctaaggttatgtgaggggtaaatgaaattgtatatataatataatgcatatagcatggggtctggaacacaagcaggttcactaaatagtagctctgatttgctaggaaaatataccaaacatctttataattatataaatgtctgtaatacttacataaacccctatgtagctatattagaaagcatccacaggagctatcagctcagttgagcaggggacaaggctggagagatggtcatggtcaggcaacagatcatgaaagaccttgtatttcagtgccatagtaaggagtttgaactttacccaaaatttaaggagcaagagttctaaattggaaaatgaaggtcagagctatattttaggcacatctttttagcagcaatatgaacaatgatttagaggtagataaaagtagagaggccttgttaggaggctgtagacataatccagacagtgcacacaagtggaattgaatggaccaagatttgatgcttaaccactcacatgctatgtgaccaacttagacaagggacttaatgtctctaggcctcagtgtcttcatcaaaattccaatacataggaataaaaattcctactttataggctacttgagaagatcaggtagataaaatctatatatgtgtgtgtgtgtgtgtgtgtgtctgtatatatatatatatatatatgaagtacttagcataatttatggcacttagtaaatacccaggaattgttaactgttaaattatgaattgtctattcagaagcattgtggttactatcttagtttggatttgtaattatgggatgtttattttagtgattttcatcaactctcctttctgttcatttctatgtctttctactcttacccagtaaatgacctatttccacttaaaacataaataccatatatatcacaaatagaacagactaattattttattaccctgtcttgagttggatttcctagtaaacaaaactctctaaggcagagatgtgtgggcaggggcgttattagggagtgctcttgagaacagtattcataaggaaaggaagaaagtcacattgaacagtgggaagtgtgaactgtgatccatttacaaacagaggccttagcttcttctgtgaagaactttggaactggaatggtcctaaaccagatgggaacagttgtcccatctaaaagcaaggcgttagcactttgtgccttcccatatcaaccaatcattggatgtgattagccactggaaggggcataaccttgagtaaggcagtacctttgggtctcgacagttcctgatgaagcactcaactataaaccatcagcagttagtaatattcctggattcccatatagggcacttggccctgaaggggcattcggccacacaatatagcatttcacttccatgctccctttacacttcccgctgagcattttggatcagtccccatgggacatttttggttatccctattagggaatgggcagggaagggggagagtggtcactactagcatgtagttggtaaaggcagaagtgctgttcaacaacctaaagtgcacagccaccttctccccggtaattagctggcccaaagtatcagtagtgctgctgttgaacaaccatattctggactgtagggattcaggatctgagcttcagaaggagtcagtggcattccttaagtagctttcacttgagcccatcccctaattctttattaatctttgttctacaattatattttaccatatgacagggttgcaagatatcgtttatttttctcagttatattagtaaaaacattgaggaatagataggttaagctacatacctttttagtaagtgtgagcagaattcagttacagattttcacctttgcattcagtcaacagtgccatgaaattattttattctgctctaaaccggagcatttcaatctaaacttagggtttaaaattagtcatttctttatttcattttcttttctttattcttttttttttgaaacagggtctcactcttgtctgccagggtggagtgtggtggtgcagtctcagctcactgcagcctcctgagtaactgggtctgtaggcacacaccacatgcccagctaattttttggtagaaacggggttgcccaggttggtcttcaactcctgagctcaagccatccgcctgcctcagtgtcccaaagtgctgggattacaggcatgagccagcatgcccagcctcattttctctttttcttccatttcttgactttgtttttatctgtagatgccctgactgatggatttttaggctagtttcttaagctttggtgattaatgtccaggaatactgtgaaccagaagaaaacacagagtcattttattcagagcattgccttgtactacctttgctggtgttatctcagatatattccaaaataagttgggaactgattaaaaagggttggactactccagagagatcagttatcccaggagaacagttacttgtccagtggctttagatggggtgggcctgggcaaggaggtagcttcagtgacgttactccctgagagttgcataataggtgtctgaagcagttttgatttatcccttcaccagttgaaggacatttagtttattctgcttttgaaagtaatgaacaaagttgccgtaaatatttatgtgcaggttttatatgaatgtaaagtttcatttctggttttttgttttttgaggcagggtctcactctgtcacctaggctggagtgcagtggtgcagtcatagctcacttcagccatgaactcctggggctcaagtgatcctcccacctcagcctcccaagaagctaagactacaggtgctattttttaaattttttatagaaacaggatctcactgtgttacccacgctggtctcaaacttctgggcccaagtgatcctcctgcctctcagcctcctaaagtgttgggattacacatgtgagccgcagccacccagactcatttctcttgggtaaattcctaggagtgggattactaggtcagtgtttgatgtgatgttttatagtcttcattatacagatcttggttaaatttacgcctaagtggagttatcttttggtatccagaagggattggtttccagaccctccccactccctgccattatggataccaaagtccatggttacttatgttccttatataaattacaaaatttctttcattttatagggaagaaatctgttttccaaaatgactgttccattttgcattcctaccagcaatgtatggaagttttacttgttctagttcttcattagtaccaagtactgtcaggcatatgtggtggttttaagccattctaagagctgtgtattagtatctctttgtggttttaatttgcatttccctaatgcttattgatgttgagcatcttttcatgtacttactggccatctatatgtcatctcctgtgagatgtatttttattgcccattttccatatggcttgcttgtttttttcactgttgaatttagagaattctttatatattctagctactagttccttgttggatgtgtggtttctgtgttctcctaataagtagcttgacttttcatccccttaattttgatgacatctagtttatcattttttctttcatggattatgctttttgtgtcaagtctaagaactctttaccttgccctagatctcaaggattttatgatgttttatagctttagctttacatttttcatgtaagtctatgatccattttgagttaatttttgtgtaacgttagacagaagttcttgtcccttcctttcctttcctctcttctctttcccctttcctttctacctctggataacttcttgctccagcaccatttgttgaaaaggctgttagctaaacttcatgtattgaattgcttttgggtctttgtcaaaaatcagttggtcatatatatatggatctatttcagaatcctctattctgttccgtattctacttttttaacacttcaagtaaaacaacagtcttactactatgtatttccctttaccttcacccctttatcttatagttgccatatgcattacaagttctatgtattaatttcctattgctgctataacacgtcaccacaaacctggtgggttaaaacaactcgaatttattattgtatacttctggaggtgagaagtccaaagtggattttactggtctgaaatccaacactgctaaaaggtgtcagcagagttgcattcctcttggaggcttcaggggagaattaggtcccttgcctcttccattttctagagactgcctgcattctttggctcacagatcttaaaaaccagcaaggtatcatcttcaaatctttctaactctcaacaccctcatgcctccctctttcacgtaaaggatccttgtgattacattagtcccacccacataatctagaataatctcatcatttaaagattcttaatcacacatacacagtttttttttttttttttttaccaggtaggctaacacactcactggttctgggattggagcatggacagctttggcagagggataaatattattctgccaatcacaattcacataccttgaaaacctctggtgatgtttgaatttttgctctcaatcaccatacatattttaaataatttcagaagagaaaaaaacatctgttgtatttacctacatttggtagtaatagtaaattactgtttctgttgttcttgtttcattactcaagttccagatttccttctggggtcactttgcttcagcctaaagaatttcctttaacatttaaaagcatttctgctggcaatcagttcttagtttttcttcacttgagaattttttcattttactgtcatttctgaaagatgcttccacaggatatagaattttggcttgacagttcttttctttcagcactttaaatatagtctgctatcttttgacctctgtagtgtttgagaataaatccagtcttgaattgttttttccaatgtaaagggtcatttttctcggtttctttcaagatttttttctttgtctttggttttcagcacatggattatgatatgtctaggtataattttcttcgagtttatcctgtttgtgatttagtgagctccttgaatatgtctttagccaacttgggggagttttcagccattatttctttacgtatttttttctgtgcccttttttgtcttttctgcttctggtactccagtaacacaaatgtaaaaccttttgatattgtcccatggtgctgtgatgctctgcttattattaacgagtctgtctgtctgtctttctttctttctttctctctctctctctttttctttctttcttttttttttttttttagacagagcctcactctgttgcccaggctggagtgcagtggcatgatctcagctcactgtaccctccacctcctgggtttaagcatttctcctgcctcagcctcctgagtagctgggattataggcacctgccaccatacctgactaatttttgtactgttatcagagacggggtttcaccatgttggccgggctggtctcaaactcctgacctcaagtgatccgcccacctcagactcccaaagtgctgggattacaggcgtgagccaccatgcctggctagtattttttctttctgtaattcagaattgggggcatttcaactgaactgtcttcaaacttactaattctttcttcttttgtcttcattatgataatgagcccatcctgtgaaatttttatttcacatattttccaattctaaaatttttatttatttatttttagtttctttttctccactgagaagttcagtctttctctttaagaatgtttccctttacctgtggaagatgtttataatacctgcatcaaattgtcagataattccagtatttgagtcttctatgtgtatgtgtctgttggttattttttctcatgagaattcataagattttcctggttctttgtatgtccggtaatttttaagtatatcctggctgtttttaatgttgtgttctgacactctgggttctgttaaaatcctttggaaatggaattatttttgttgttgtttttaccagttattagactggttagattgagactgtaagttttattttactttctattggcattggtctccatgtcagttaagttttcaaagcctctgctgtgctatttgagtctttctgatgcgtgtgctactcatagtctggaaattgcacagtgatttgtagttcattgtcagaagcattcactgtgcttctttgggtctgtttcacatatacatttcttggaggtgagccctagccttatgttacttcatacacaattagagggtcaccttctcctgttcttcagaatttccttcacactgtctggccccccattttggtttctctggccagaaagacagatttctcccaggtcttagttgccaccatgttattcatttccaggtgactgtggccaccattgggtctaactgacaagagaaaatatttaaaaaaaaataataggctgggtgcagtggctcactcctgtaatcccagcactttgggaggccgaggcgggcagatcacctgaggtcaggagttcaagaccaatctggccaacatggtgaaaccctgtctctactaaaaatacaaaaattagctgggcatggtgacatgtgcctgtaatccgagctacttgggaggctgaggcatgagaatcgcttgaacctgggaggcggagattgcagtgagccgagatcgtgccactacactccagcctgggcgacaagagcaagactccgtctcaaaaaatagtagtaataataatagagattacccacatccacgctcttcaaaacagcagtctgcctttcccagttcctctgttggagaagtaggtcttctcttggtgttttaggtgcttgtgccactgtcaccctgacagtgccactccacaactggggctacattttggctaggaacagaagagagaaaagactgggggacaaaacaaccaaggattttcctaaaaacactatcctacagggactttaccagactagtagtaggagctttcttctagaagttttgcttcctatgcctactaaacagatcaacaacgttttatccccaaatcaaaaccaggagacaaaggaggtaaaaatggaactaaaattcatctccatttcaggttattaatcaagttgactagttcccattccacctatcattgtttatttttctgagtccttaggtagttgctctttgtattctgaccagagttttttttgtttttttttactttaagttctgggatacatgtgcagaacgtccaggtttgttacataggtatacatgtgccatggtggtttgccgcacctatcaacccatcatctaggttttaagccccacatgcattaggtatttgtcctaatgctctccctccccttgtcccccatcccccaataggccccagtgtgtgatgttcccctccctgtgtccatgtgttctcattgttcaactcccacttgtgagtgaaaacacgcagtgtttggttttctgttcctttgttagtttgcctagaatgatggcttccagcttcatccatgtccctgcaaaggacacgaactcattctttttatggctgcatggtattccatggtgcatacagtatccagtctatcacagtatccagtctatcactgatgggcatttggattggttccaagtctttgctgttgtaaatagtactgcaataaacatgtgtgcatgtgtctttataaagtagaatgatttaaaatcctttgggtacataccccgtaatgggattgctgggtcaaatgcttttctggttctagattcttgagaaattgccacactgtcttcgcagtggttgaactaattgacactcccaccaacagtgtaaaagcattcctgtttctccacagccttgctagcatctgttgtttcctgacttcttaataattgccattctaactgatataagatggtatctcattgtggtttttatttgcatttttctaatgaccagtgatgatgacctttttttcgtatgtttgttggctgcataaatttttaagaagtgtctgttcatatccttcacccactttttgatgaggttgtttgtttttttcttgtaaatttgtttaagttccttgtagattctggatactagccctttgtcagacgggtagattgcaaaaattttctcccattctgtaggttgcctctttactctggtggtagtttcttttgctgtgagaagctctttagtttaattagattccatttgtcaattttggcttttgttgcagttgcttttgatgttttagtcatgaagtctttgcctatgcctgtgtcctgaatggtattgcctacgtttttttctagggtttttatggttttgggttttacatttaagtctttaatccatcttgagttagtttttatataaggtgtaaggaaggggtccagtttctgttttctgcatatgaccagccagttttcccagtaccatttattagatagagaatcctttccccatttcttgtttttgtcaggtttgtcaaaaatcaaatggttgtagatgtgtggtgttatttctgaggtctctgttttgttccatgggtccacatatctgttttggtaacagtaccatgttgttttgattactgtagccttgtagtatagtttgaaatcaggtagtgtgatgtctccagctttgttctttttgcttaggattatcttggctatacaggctctcttttggttccatatgaaatttaatgtagttttttctaattctgaagaaagtcagtggtagcttgatgggaatagcattgaatctataaattactttgggcagcatggccattttcacgatattgattcttcctgtccatgagcatggaatttttttttccatttgtttgtgtcctctcttatttccttgagcagtggtttgtagttctccttgaagaggtccttcacatcccttgtaggttgtactcctaagtattttattctctttgtagcagttgtgaatgggagttgactcatgatttggctctctgcttgtctattactggtgtataggaaagcttgtgatttttgcacattgattttgtatcctgagactttgctgaagttgcttatcagcttaaggagtttttgggctgagacgatgtggttttctaaatatacaatcatgtcatctgtaaacagagacaatttgacttcctctcttcctatttgaataccctttatttatttcttttgcctgattgccctggcgagaacttccaacactatgttgaataggagtggtgagagagggcatccttgtcttgtgccagttttcaaatggaatgcttccagctttgcccattcagtatgatactggctgtgggtttgtcataaatagctcttattattttgagatatgtttcatcaatacctagtttattgagagttttcagcatgaagggctgttgaattttgtcaaaggccttttctgcgtctgttgaggtaatcatgtggtttttgtcattggttctgtttatgtgatggattaagtttattgatttgtgtatgttgaacccgccttgcatcccagggatgaagctgacttgatcgtggtggataagctttttgatgtgctgctggatttggtttgccagtattatattaaggattttcgtattgatgttcatcagggatattggcctgaaattttctttttttgttgtgtctctgccaggttttggcatcaggatgatgctggcttcataaaatgggttacaggactccctctttttctgttgtttggaataattttagaaggaatggttctagctcctctttgtacctctggtagaatttggctgtgaatctgtctggtcctgggcttttttggttggtaggctattgattactgtctcaacttcagaacttgttattggtctattcagggattggacttcttcctggtttagtcttgggagggcgtatatgtccaggaatttatccatttcttctagattttctcgttcatttgcgtagaggtgtttatgcttttctctgatggtagtttgtatttctatgggatctgtggtgatatccctttatcattttttattgtgtctatttgattcttctctcttttcttctttattagtctagctagcggcctatttgttaatcttttcaaaaaaccagctcctggattcattgatttttttcaagggttttttgtgtctctatttccttcagttctgctctgatcttagttatttcttgtcttctgctagcttttgaatttgtttgctcttgcttctctagttcttttaattgtgatgttagggtgtcaatttgagatctttcctgctttctgatgtgggcatttagtgctataaacttccctcttaacactgctttagctgtgtctgaccatatttttaagttataattgtttagagagataggttgtagtcaatttatttcatcttggacagctagagaaataaagtggtttaattattaatatttcttttgactctcaaaagtgtcccagcttggatagttcattacataattacacacaaaggtttctgactaatttcatgagtcttagtgttgatcttcatgaaactaataataaattgacacttaagaatattcatgttttggtgtcatgatttgctactccagttcttatttatttggtactccgctggtggtagtcagggtatataccgttcttgaatgatttagttaattgtgatatacacttttttcctgaagactagaaaaaagtgtgctgtccccaaaagtaatctgcgtctcttaattttcttccttttacaaattactttccttggaaattagcatctttatacagagtggtctcttaaatcagaatgttctaacaaagaatattttccccttatgagctataagcaattaggtattgctgttatagtacaactaactaacatttttaagacatctgagttacgctaacccttctgttaggtttctgggtttttttcaacttatttgtggagtatattgtgaatgtcaagattagggcagccagagattttcttattctgctggaaatgtacttctcaggaaagacaatgatttaacaaccccagtggtcaaagtcttcatcttacaaatgggtgtactgtgtccctcaacagtgcaggcatatcatctaatccacctgctctttattcctcccaatgtgtattagctttgtttaagtgattgaggcatatgagcctgcataaatcattatgttacttagtaatttatttatctcactgctgaattgaaggtgatacaggctcaaggtgaaggatctttagcttcctgttgttctcctttcatcaagttattccttacccctatacccctctcaccctccccattggattcatgtggttttctttattttcctttcttttcctccaatagtttagaatctatacattctgtttttattattttagtggtttaccttatattttttacatgaaataaaaagttaggccaggtgtggtggctcatgcctgtaatcctggcactttgggagactgaggcaggtggatcacttgaggccaggagttagagaccagcctggccaacatggtgaaatcctgtctctacaaaaaaattacaaacattacctgggtgtggtgctacacccctgtaatcccagctactcaggaggctgaggtaggagaattgcttgaacctgggagatggcggctgcagtgggctgagatggcaccactgcactccattctgggtgacagagcaagactctgtcttagaaaaaaaaaaaagaaagttaaacatttctcccctttttaggatacaagatccttagaaagtttactttaattctgcttattcccttcagatttatctttactattatctagtcttttgattcttttttcccaccccccccaaattagttgtcattactattttatgtgatcagtgccttaaatagccacatgctcaccaatttttttttttttttacttaattagatatacatgttggttggaaaaataaatgaccatagtaatagaatgtaagaaaataggctgggcgcagtggctcacacctataatccccacactttaagaggccaaggtgggcagatcacctgaggtcaagagttcaagaccagcctggccaacatggtgaaaccccatctccactgaaaatagaaaaattatctaggcgtggtgacacacacctgtaatcacagctgctaaggaggctgaggcaggacaattgcttgaacccaggaggcagaggctacagtgagccattgcaccactgcctgcgtgagagagcaagactccgtctaaaaaaacaataaataaataaaatgtaagaaaataaaccaggaatgcagtatagcttagcaagatgtctagagcaaatgccactaggccaggtgcagtggctcatgcctataatcctcgtactatgggaggctgagaagggaggatcgcttgagcttaggagttcgagaccagtctgggcaatatagcgagacctaatctctactaaatatcaaaaaaattagctgggtgtggtgatgcatgcctgtggtcccagttactcagttggctgaggcaggaggatcgcttgatcccaggagatcaaggcagcagtgagctgtgattataccactgccctccaacctgggtgacagagcaagaccttgtctcataaataaataaataacactaacaatgactgaaacatcatgaaatagatctggttgtcactggtatttaagtgttttcctatatctggttatattaatgtacttcaatagacagttacgccttcactatgcttccagcctcaagaggatctactggtatgcaacagaggaagagaagatacctgcctttaaggcagcctctactttatacatatgtgcacctttatgaatacaccatttagaagacgtaatattgtcttgttgatttaaaaccaagaatgttagttgtgaataaaaacattttagaaatatttttcattccagtcacttttttccttctaagaacaagcttctattatgagtctcctatgggcacccatggtagaatacttttttttgttgttttttgagacaggatctcactctgtcacctaggctggagttgcagtggcgtgatcatggctcactgtagcctcaacctcgcaggctcaagtgatcctcccaactcagcctcctgaggatctgggactacaggtgcacacaccactatgcccagctaatttttctttttatttttgtagagacagagttttgccatgttgcctaggctggtcttgagaataagttcttatatactgatttttgctgtatgctgttttatgttatttttattttggccattagcaaagcaaaaatgtatatatttatatttagatatatcatcatttctgtaattttaaagttgactttcatttaccaatgagcgaatgaaccacttttcaaaatgttcttacagttcacaacaactgatgtttgttgtgtgtttctctgagccagtactaagctaagtgtgacacatggtttatctcatttaattctctcaaacatcctgtaagttaggtgctattattaccctgattctaccagtgagtttattgaaatttagagaggcattgatgagttacagctgttcatttgacatctcacttctttaccagcattgaaactgtcaacataagattaaaacatttccttttttcttcctccctgccacccaccaaggaaattgagatgcctggaaaactgaaccaattttccatggtacattcaaggattaaaagacttggtggatttatagttgctaaagcctggaatgcggtccttattgagtcctgaacaggtttttcatgtaaaattgcttacgtgtcaggtgattctatttcatttctcttaggttatagaggaactgttcaaggctacaacaatgatggttctctcaaaatgtcctgaagatgttgaactctgtcacaaattcatagcacctggccaaaaggtaattagttttatggataaagcccaatacatctactgtttaatgtgttaattatacataatgaataaaattatatttttaaaattttcttttttgtctttttattaaggacagattagaacatatgctaaaaaacaactttttaatgtaagtagatgttatactttttgaactttattcattatcactgtatttatcacactatattataattttttaaatttatatctgcttatatagatcctatatatataggatatatatatagacatattatatgtctatatatagacactccccagattccaggcaagacccatgttctaattatttttatagctcttgtgtttggttcatagttgataatcagtgtttcatcaataaattaataaatcatagcaagataaaatctagtaactattaactatgtaactataattcaaacttatactaactttagtcatcaaaatttggcttgatttaaaaaactgtaaaaaccatgctcagtgtaggttacaacaagacaagaattcaggaacagaaaactaagagattaccacagtgatctgcgtgagagttaatgatgatttggactgtgtattagagttctccagagaaacacgaccaaccacgtttgagggcggggtgtgtgtgtggagatagagagagagattgagagattattctaaagaattggctcacgtaattgtagatgcttgttgcatttaaagtctcggggtaggtggacaagctggagagtcaaggaagagttgccattcaagtccaaaggcagtctgctggcagaattccttctttctcaggaggagattagtctctgtcttagcaaaatcttcaactgattggatttagcccacccacattatgaagggtaatatgatctgcttttttcaaagtccactgatttagacattaatttcatccaaaaaacaccttcttagaagcattcagaatactatttgaccaaatatctggagaccatggcgcagccaagttgacacaaaattaaccatcacagaccaggatggtggcaagagttctcctattccgaatatattttagagatagaacaaacaggatttactgagggtgagagagaggagttaagggtgacttcaaggttttttttctcctacagctgcaaaaatgaagttgctattaactgaaattgggaaatgcttaagagagtattggggcaggagctttgagaggaaggggtggtatcgggaacacagacatgttaagattgagatgcttttcagatatccagccatagatgttggataggcaactgaaagtgtgggtctggagttttataagacagtcttgggcatgagtatattgataaaagtggtcattaagtagatgaagaaagaagtaatttggccttctcaaggaatctctgctggtgacaaaacaaccagggaaggatcttagttttccagctcctatctaatgaaaagattcaaaatgcagaaataatattcaccatttgttgaatatttacccagacagtgataaaatttacatacatcagtagctcattttatcttcacaactccaagtagttattattctcattctacagatggagaatccctgcaaagaggttgagtaaaagatgaaatggtgattcaagctcatgttcatctgatttcaaagctcagacttttaacctgagattttcatatatttgggagggtactggaattaagggtagagtggttgtagctgccccactatcattacgactcttacatgtcacttaactcttgtgctttggagtccttgtccataaaatgttaaggttggaaaatgtcctcttgggctgcgccatttcaatcattgtcattgtcataatccattctgcatactacaaatcatagttgcagtttaaatttgtggggagagggacatcagcaagatgatgaatagagggtcccagccttcaccacagaaagtccatttggcaactagtcacatacaagaacacctttttgaaaatcccaaaatttgggaatgaaattgagacacgcagatggaccacagagcaaaaagtgcattagaagggtaggagcaatggtctcagtttgactgaatcctcccttccctaagtaggcacaataccacacacagaagattccccttggcacacagttaatgcagtggaaaaagagacagctatccagtttccccagcattctgtgatgcttcctaggaggcccattcctgtctcacagggaaccctgggggtaaggcctagactaccaggggtcaagtaggaacaaaggagtggggcagtgctcacagcaaccagtacacggatcttagtcatagctgtgttcctgccagcagtagcacctgatcagagataccagccagtggcatagcccatttacaaagcctagctggttgctgcagaagctcagtaggaaagtctatctggtttgagcccctacagggcagccaccccacctagcctcagcatccacccccatgctttgctcaggcaggcagacatcacaaatgttttacatttgtgtaagatacagatggccaataggtttatcaaaaagtgtccaacatcactaatcaataaaatgcaaattaaaaccgcactgagataaccactcacacctgttagaatggctgttatcaaaaagtagaatgagacacgttggctcatgcctgtagtctcagcactttgggaggctgaggtgggaggatcacttgaacccaggagttcaggaccaccctggccaacttagtgagaccctgtctctacaaaaaataaataaataaattagtcaggtgtggtgacatgtgcctgtagtgccagctactcaggagactaaggtgggaggattgcctaagcccaggaggttgagttttcagtgagctatgatcacagacgctgctgcactccagcctgggagacagagcaagaccttgtctcaaaaaaaaaaaaaaaaaaaaaaaaaaaaaagtcaaatgataacaggtgttggcaaagatgtggcgcttgggaacccttttataactgttagtggcaatgtaaattagtagagctattatggaggatagtatgggaggtttctcaaaaaaccaaaagtatatttaccatatgattcagccatcctacctctgggtacatatgcagaactgaagtcagtatgtcaaagagatatctgcacttacatgttctttgcagcactattcatagtagccaagatatggaatcaacctaagtgtccatcagtaggtgactggataaagtaaatgtgtatatatatacacagtggaatactattcaaaggaaatcttatttgtgacagcatggatcaacctggaagacttaatgctaagtgaaagaagctaggcacagaaagacaaatactgcatgattcactttgatgtgaaatgtaataaagttaacactacagaagtagtgagtagaatggtagttaccagtggccggtgaggggttcttgaagggaatggaaagaaattgtccaaggggtacaaagtttcagttagaccagaggaataagtgttcaggatttattgcataacaaagtgaccataattaattgtaatgtatatctcaaaattgctaaaggagtagattttaaatcttctcactgcaaaaaaaaaagtgaagcatgtgagacgatagatatgttaattaccttgatatattcatcccacagtgtataataccaaaaacacattgtatcctgtaaatacataaaatatttgtcaattaaaaattcagacatttttaaataaatgtatatgtgtgattatttgattggtatctactacctctgtgatgtcagaggctatgtttaaattgcttactcttatacccccaggacttagcccagtgcctttaacaggaactcagtaaatactgagtaattgagtggacaaacaagtgacttgagtaactgtggctgtaaaggtattctttaggctggatcctctcctgaggtttcttattggctaatatcactatttatttcagtcactgagggtagtgaaccatgattcagaaaacctggattctaatcctggccctaccatttactagccattaatgagtaaattattattttttaacaaatatttattgactgcctaatatgagttaggcactttgctagttcttgagaataatgaaaacaaacattgatttatttttttatggagttgaaaatctagagaaaaagatgaacagttaaatatttatatgaataatgtaattacgactatgaacttgattaatagtgaatctttaacttttctgaacttcagtttcctcatctataaaaaaatactctgccttatattgttgaaaggatttaatgacaatactgttaaaagcaatatgtcagactaggtaatttgaaaacactctttctgcaaaacatctaaaaataatacttaaaatattataagattcttttaaatacgttgttgaattcactagaaagtaggagaagttccaggtgctagaaatgaagaaggaaccaaacaccagagtgatatggacagttggtgtgatgctgaggattctcagggtgtagggtagggaagctggagggcgattttccagtttttgaaaccagagattttaacagcaatgagatgacatgagaatagacgtagcagaatgaattagaatcaagatatcccctgaaatgcatgcacagatatacacacaaagctagaactggtcaaggactacacccttaatgaaagggccaattagaaaataagcaaacaaacagaaaattgagctagccagcatagagaatttacaaagaagtgtagaagtatatctgctttagcctgggcttaaggatagagacaaaacagaaatagtcttcattgagaatttgcagccacagttggcccttaagtgagcctagagtttgaatttatgtttcctgtgtagttcaagaatcttcatgccagggcattaaaataaaaaattgtcttcagttggtgataatgctggagtagctatagaaatcaatataaaaccaaacttgaagtttgtaccctcaacccaagtggcatgatattctcaaaacaaactctactgaagataatctcacactccaaatacacagggaaatacctaccatgagcaagaacagcagacataacaaacagcattagattcccaagaagttcaaagaacagtaatgacaatagattgataaaatagtatcttcacatagttgaaagaaaatacctgttaccttagaactgaaatactgggcagcaataacttgtaaaactggagaggcacgttgatagttgaaatgttagtccttttgttgtttgaaaggaagagagagaaactggtgaactttagactttttgtttttaagagacaggaccttgctgtgttttccaggctggagggcagtggtgtgatcatagctcactgcagccttgaactcctgggctcaagcaatcctcctgcctcagcctcccgagtaactgagacaactggtgcaggccaccacacccggctgctttagactgttaagtcagatatgcatgttaaaatgtgcggggtagccactgaaagcataatgagatggtgctggtctgatgacagtgattattaagtcatcaacatcagaggtatcaagttgagaaatagattgtgtggtggtgccctctctaccactttggcatcacctttctgctgttacatgccttttaaggcattggcactgaaacttctgaaaatactggtgtagctgaatctactattgagttaatcctaaaaacagtaaagagaaaagaaaaaacagggagatggcgaaagagaaactgttgtcctttatgcagactgcactgttagttattgaatctgtatagataccatgtgacttgtattcttttgagtagatttcagtgtatttttcactacctgttacaattattttatatgaaaatgtgctgtttcagcaactcgtgtagtaatggaatttagcctttatgcagaaattgtattcagtttattttacatttcctttatattattatggttctgaaaatgtagagtacttaccttttttatttgctcttcatttatctttgtgtgtgaatttgaggcgaaggatgacaataattatctttgtagttgagcaattttactcttaacagcttcagaataatgaattttctttattcagcaatgaaaaatgtggaatatgaaggtagtttgatgctgtatcattctctaccacagtgttttttcctcctttcctcaaagtactttggaaacagtttctggaaaggagaagagatattattttctatacatatcaagaaaaatacttaatagagttgatggaagccattaaggatatcaaatgtcagaactgtaatttgaacttgaaagttctgcctctaatgaaggtattggggagtggagtggaagacgtggaataacaggagatatttagacatgagagtcatttcttaataatgaaacagtaacataccaatggtacaaaatcttactgcttattattttgactgctctcatatttctcagtgtgattggtagatgataccaagtaattgatataatagaacaatagaatgcctaagcagaaaagaactttatgtggcacatatacaccatggaatactatgcagccataaaaaatgatgagttcatgtcctttgtagggacgtggatgaaattggaaatcatcattctcagtaaactatcgcaagaacaaaaaaccaaacaccgcatattctcactcataggtgggaattgaacaatgagatcacatggacacaggaaggggaacatcacactctggggactgtggtggggtggggggaggggggagggatagcattgggagatgtacgtaatgctagatgacgagttagtgggtgcagcgcaccagcatggcacatgtatacatatgtaactaacctgcacaatgtgcacatgtaccctaaaacttaaagtataataataaaagaaaaaaaagaaaaaaaaagatagttcaatctccttattttacaagtgcaaatacttaatttttaaatgtttgtataatacattacaaaaattaataacatgctttcactacgttgaagtgacttacatagctagtagtagaatcagatgaagtggtagaatcagttgagcccattttcttttgttttgatggaacatatgaaactctaagtgtttcagtcattatcttagccgttaaaagcttatactctggagtcagcagatcaagatttactatttacttacatgagtaacctttggaaagttattgatcctctctaaccttctgcttcccttctgtaaaatgctaattttaaaatcgttattactgctactaccaacaccactgccaccaccattattaccttagaaattacctattgttattactagattttaatttgaatagattcttaggaaaaaacctgtctttcaaaacatagctttaggggctttattgtactgtatgacacaatacaactctttctggttagttgttatggatatgaacttcatttttgcttcagagaacaagtttgtgctggataaattattttttgagctcaaggtctttcaggaagtttgtagatttttttgtaaaaaaaaaaaaaaaaaaaatccaaaatactgatgcagtattttacctgtaatttacaagcaacctgacactttcatgttactggtgggtataaattgatataaaagggggcaatatctttggcaaaacctttcagaaaatataaaaattgcaaattttcatctaataattccacttttgcatgtgaaaaatcagtgtataataactttgtaatattaaataggtatatataggcatgttttataatagcaaaagattagaacgtgaaatatcaggtcactggttaactaattatgacacatccacaaaatagaatattatgtaatacaaaaagtgaagaatgtcttcatatacacacagatctgcaaggtatattagtaaaattaggtgtgaaagagtgtgtatgttatgtatgacatctgtaaaaaaggaagattgtgtattatttacattatctgtataaataaaatcctctagagggatgttcacaataccaataacagtgattgtgtgaaaggaaaggaactaggtttctctggaaccgcaatggaagggagatgtatactcttatacatcttgattttttttaaaactatgtagacaagttacctattcacatagttaaattaaaacaaatacttgctttgacttactttaggcatgagggtgtctcatggagagaatcagtattttcctacatagtcttataatgcttagaatatattaccaggcccttactatgacctgaaagagtccatgtgatctgacttctgactgcctttcctatgtaatttcctgtgcattcttcctcttgttcagtatgctctagtcacgctgactgccctttttgttctgtgaacaagccaaactgtttctcacttcaggtccttgtacttgctgttccttttgcctggaatactcctcccaagatacttctatggttcatttccttactcggtgcacgcttctgttcaaatgtcacaaacttaggcctttcttgaccatcatatctaaaatggcaccccaaaccccctctgccttcttattccactttatttttcttcatagcacgaatagctacttgtttatttatctgtctactctctcctcacctgcatctctcgctctctctctctctgacacacacatgcgcgcacgcacattgtctccatgaaggctgagctttatttttatctccagtgcctagaattgtgtgtagtgcctagtaggtgccaagtatatgtctgttggataaataaatgaattaatggtgaattttaggaaaaagtattttgctgttgtagtcttttaatagggcattggcatatcatggattcagagaataatctttacttgcttaagtgactagcttcactgtgtatattgcaagtagatgaggagttgaggttattgaatggttacttgtcttcaggcagatcattctttcataggattagatcagccttaattcctgattattcatgacctcacagtgtgatataggagtacgctttttctggttttaaaatgaactagttagcagctccattgtattgacttttctctgcttgtatcctgttttcctccagcatttcttatactgaagcagtggagatcttaaagcaagcatcccagaacttcacctttaccccagaggtagtattttgtgtgtatgtatatatgtgtgtgtgaaaatgcttccttcttgtctttagcttactgtgttaagaatctttcaaaatcatcttaattctcttattagcaaaatatggcatttgctcatttgtacacagacttaagattttgatgtttgctgaatcttgttgagatacttaaaacggaattaattaagaataaaaataaattttatcatttggaatagcagtgactaaagggttataaaggagtctcccacgtttaggaagatgaaaattctaaaaaagaaagataatcatagactattactgtagagaccaggtgttggggctcacgcctataattccagcactttgggaggccaaggcaggcagattgcttgagccccaaagttcaagaccagcctgggcaatacagtgagaccctgtctctacccaaaaaaaaaaaaaaaaaagtgaatttttaaaaaaagaatattactgtaaaagtcaactagttctgtgttttccaaaatatattctgaatgacattaaaagatgaccaggctgggtgcggtggctcacacctgtaatcccagtactttgggaggctgaggcgggtggatcacaaggtcaggagatcgagaccatcctggctaacatggtgaaaccccgtctctactaaaaatacaaaaaattagctgggtgaggtggcgggcgcctgtagtcccagctactcaggaggctgaggcaggagaatggcatgaacccggggggcagagtctgcagtgagcagagatcaccactgcattccagcctcggcaacagcgagactccatctcaaaaaaaaaaaaaaagatgaccaacaaaagaagttatattatcaaataagtttaggcaacataactaaacaggtgtgtttttctttttcttttttttcttttttttttttttttttcagatttagtgcttgcagaagcaggtttgtttttcagttgaactttacggagccttttagtttatgagccactctggaaaatactggggtttttttgtttgttttgcttttaaagaactttatatttaagagatggaggtctcgttatgatgcctgagctcatcttgaactcctaggctcaagggatccgccacttcagcctgccaagtaactgggactagaggagcatgcctcagtacccagccaagaattcttttttttttttttttttcaatacttacttgataaacaaagattgtataggccgggtgtggtagttcacacctgtaatcccaacactttaagaggccaaggtaggattgcttgagcccaggagtttaaaattgcagtgagccatgatcgactacagccctccagcctaggtgacagagaaagaccttgtctcgaagaacaacaacaaaagaagattgtatatattcagggtatacgacatgatgatttgatacatgtatacattgtgtaacagattatcataatcaaattagttaacacatctgtcattacccacactgtacattagatccccagaacttgttcatcttataactgaaagtgtatacactttgacaaatatcacctcatttgccccattcccagacccctgacaaccactgtacaactctctctttctgtgaaggaactcctttgtttattttttattgtatttaattaattaattaatttatttatttatttatttatttattttttgaaagacaagatctctctgtgttgccgaggctggagtgcagtggtgcaaacatggctcactgcagattccacctcccaggctctcatcattcctcccaactcagtctcccaactatctgggactacaggtgcgtgccaccaggtctggctgatttttttattttttgtagagacagggttatgttgcctaggctagtctcgggcttctgtgctcaagcactcctcggcttcccaaggtgctgggattaaaggcatgagccaccatgcctggccagagcttttttattttattggcaatgatataggtccagagagaccacatggtctgtcaatggacatatgtataatgttggaggcaaaactcttttcctattccagttattttttcctgtaactaagatactgccaaacaagtggtagtaataagataatgttaacctttgtgtttaaactattccttgtaccggttcaatcccaattaagtcagatctttatgtattacaaaagtaacctctgtttgttatatttatgatcaattctttgtgtaagttttcatttctttttctcctaaccctggaagcttcatgaagtcagggattataactttttcttaccactatatccagtatatcatatggtacctggaatttaataggcacattagtatttgcttaataaatatattgaacagagttaataaatattcatcaaagagcatctcatacatgagttgactctttttatttaaaaagaagtcaccggccatcactgtggctcacacctgtaatcccagcactttgggaggccaaggtgggcagatcacgaaatcaggagttcaagaccagcctggccaacgtagtgaaaccccatctctactgaaaatacaaaaaaaatagccgggcatggtggcgggcacctgaagtcccagttacttgggaggctgaggcaggagaatcacttgaacccgggagacagaggttgcagtgagccgagattgcaccactgcactctagcctgggcgacacagccagactctgtctcaaaaaaaacaaaagtcaccaagagaagtcatttagccaaagataggctcaatattaggaatattatcttctatcatttaatttcctgagacttaggaacaataacgtggaagaagctgtaggcactattaaaaattgtgattctgaagtcaggtttttttttttatctccttgtaaagtagactttgttttcctgcaggtgctgtattgtctgctcctggggggtgggggtgggggagcaatggggacacagtaagcatagtgtctatctactggcctcagctttcatctttccaggcctgtaggtgttcttgttaacaaatatctctctcttgtttagtcagctgtgtaaccttagcagctagctccacacatggagcctcaggaagatgaagcccttagaattgatgcaggttattttcagctgcttaattgtatatttcacctctgtctcctcttttggtcatttctttcttctcattacagtggggtgctgacctacggactgaacatgaaaagtacctggtgaagcactgtggcaacatacctgtcttcgttattaattatccattaacactcaagcctttctacatgagggataatgaagatggccctcagcacacggtaagaagagatactaaataaattggggttagtcctcttaggttgggtttttcatttagcctttgtgatcttttcttaaatgtcatctatcactctatctcttaaaatgataatgtttttcaaagacatctcttaaaaatttttcccaaagaagatcccagtgttctataaacgtacttcctcatttctgtcacaaggtcttcttcttagtttagcaggtgcaaatctaggttttctttgtttcgttttgttatgtttcattttgttttgttttgttttgtaatgactgagaggaagtggcctagaacactgtatggctataccaagcttgttagtctgtggtgaagtactggttaggagactcctaggagggaaggcatactgggcaagagatgagagcagtggcactgagaggtgacagcgtgctggtagccctcacagccctctctcgctctcggcgcctcctcggccttggcgcccactttggcggcacttgaggagcccttcagcctgccactgcactgtgggagcccctttctgggctggccaaggccggagccggctccctcagcttgtggggtggtgtggagggagaggcatgggcgggaaccagggctgcctgcggtgcttgcgggccagtgcgagttccaggtgggtgtgggctcggcgggccccacctgctccgggcagtgaggggcttagcacctgggccagcagcagctgtgctcaatttcctgccaggccttagctgccttcccgtggggcagggctcgggacctgcagccccccatgcctgagcctccccacccctccgtgggctcctgtgtcgctgaagcctccctgacgagcgccgccccctgctccacggcgcccagtcccattgaccacccaagggctgaggagtgcaggcgcatggcgcgggactggcaggcaggtccacctgcagccccagtgtgggatccactgggtgaagccagctgggctcctgagtctggtggggacgtggagaacctttatgtctagctaagagattgtaaatacaccaatcggcactctgtatctagctcaaggtttgtaaacacaccaaacagcaccctctgtctagctcagggtttgtgaatgcaccagtggacactctgtttctagctactctgatggggacttggagaacctttatgtctagctaagggattgtaaatacaccaatcagcactctatctagctcaaggtttgaaaacacaccaatcagcaccctgtgtctagctcagggttgtgaatgcaccagtggacactgtctagctactctggtggggacttggagaacctttgtgtggacactctgtatctagctaatctggtggggacgtggagaacctttgtgtctagctcagggactgtaaatgtaccaatcagcgccctgtcaaaacagaccactctgctctaccaatcagcaggatgtgggtggggccagataagagaataaaagcaggctgcccgagccagcagtagcaacccgctcgggtccccttccacactgtggaagttttgttctttcgctctttgcaataaatcttgctcctgctcactctttgggtccacactgcctttatgagctgtaacactcaccgcgaagatctgcagcttcactcctgaagccagcgagcccacgagcccaccgggaggaatgaagaactccagacacgccgcctaaagagctgttaacactcaccgcgaaggtctgcagcttcactcctgagccagccagaccacgaacccaccagaaggaagaaactccaaacacatccgaacatcagaaggaacaaactccggacgcgccgcctttaagaactgtaacactcaccgtgagggtccgcggcttcattgttgaagtcagtgagaccaagaacccaccaattccggacactgcacaatcaggcaaaggaaaagctggcttggcagagcaggaggaggcttagactgctttggtttggactatcaaatagaaatagtgaggggagggctatgaagggatacaggcagtctaggcagattttccctgtctcagctcttgtctgaccgtctcttctctgtctgcctgttttgtctctctcatccctttaccgtttcttgtcctgtggttttttttttttttttttttttttgaccttaactatagttgtcttttttttgagatagaatttcactcttgtcacccaggctggggtgcaatggcgtgatctcagctcactgcaacctctgcctcccaggttcaagtgattttcctgcctcagcctcccaagtagctgggattataggcgtgtgccgccacacccatcagatttttgtatttttagtagagacagggtttcaccatgttggccaggctggtctttaactcctgacctcaggtagtctgccctcctcagcctcccaaagtgcttggattacaggcgtgagccactgcacctggcctgccttttttattcttttggtttttacaaaattagctataacatggccaggtatagtggctcacgtttgtaatcctagcactttggtagtccaaggtgggaaaattgcttgagaccaggaattcaagaccagcctgttgaacataggaagaccctatctcaacaaaaaataaattagccaggtgtagtggtgtgcacctgtagtctatctactcaagaggctgaggtgagagaattactggagcctaggaactcgaggcttcagtgagccataatggtgtcactgtgctccagcctgggcgacagagggagccccctatgtgaaaaacaaataattaaattttaaagttggcaataatataaagtaagaatatattttacttttctaaatatttattgaatagttatatatgtaatattattagttgtaaaagtctatgagacagattatattgatttcaaaataggcccaaaaactacactttactgtctgatgcttttcacttatttgtggataaatatacaaaaatgtagattagggcccactagtaaacagaatgtccctgtcaggtatacagggttatctgtttgactgtatttcctgttttttcattttgtattaatacagctgtattagccaccgtttactagatgcttaggaatcaagcactaccatctcatctctaaatccagaaacaactttgcttagaagcttgtttccccattttataaatgaaaaactggagtgcagagatagattgcatttccaaagctacgtagatagtaagtagttagtattcactcctgattctctttagctttaaagtgtatttttaaaatatatgtatttttttctagactgcagactgttttataaagtctgtgtttttttccacttcttccaactgcctaaaaatcacaaataatataaaattactttttagccatttattttactcatcctcacctttcacacaaaatcatccaaaactagtgagcaacataattgatgtatgattcttatattctcttttttctaccaaccctctagtgtaattggcccccaggttgccagcaaaaaggagacattaggacctagattatctagtcctacataatttagtattgagcctatattacaaaacagaagactgtatctgttggctttttttcatcactccagcccattccaattccagctccccctccaacacacacaccatgtatttttctcatttaatttccctagattaagcatctttcagtcactcaattttgtacttaagtactttgcttaagaattttcttctctataaagatttttctgggttacccagctactttgagccttccttttttggatttttgttgcgaattagcgaaactatagcattgtgtctatattctgtaatctcttaatgagttttgctttctttcttttcttttttttaaaagacggaatcttgctctgtcttccaggctggagtgcaatggcacgatcttggctcattgcaccctctgtctcccgggttcaagcaattctcctgcctcagcctcccgagtagctgggactacagacgcatgccaccacacccggctaattttttttttttttttttttgtagtgggtacgggatttcacagtgttgcccaggctggtctcaaactgagctcaggcagtccatccgcctcagcctcctaaagtgtttggattacaggcatgaaagtttgctttcctaaacaaaactgaacaactttaggatgggtattgaatttttttttttttttttttttttttttttaccagcacagcatctcccactcattctatactcctacttctttgtagtttccacccctatcacaccgttgaagtagctcttgttaggatcagtaatgatcttcatgttattaaatccagcagacttttaagtctttattttacttggccggtcagtgctaatcagcactattaatgacttttttattcttataaccctctactcccttgacttctgtgacatcacattatccctgtttttctcctttctcagcatttattctttcttagtctcctgtacagatttatccatttctatctattcatcaggtgttggaattcctcaaggcccagtccttggtggtctttattttcctcatgttatttcatctgtatctattgcttactgtttattctctcagaagtttttatctctaatccagacttcttctctgagctctagactcatatacattcgtccctcagtatcctcagggattggttccaggacaccctacccactagccccctctcagatagcaaaattcgaggatactaatgagtcccttatgtaaaatgacgtagtatgcgtatcacctatgcacatcctcctgtatactttaaataatttataggttacttataatacctaatacaatgtaaatgctgtgtaaatagttgttatgctgtattgtttagggaaataatggcaagaaaaaaatctgtacatgttagttacagatacaaccatctatttgtttttcctgaatattttaaatctgctgttggttgaatccacaaatgcagaacctctgaatacagagggctgactcattgactgcctcattgactgccatttacatatctcaaaggcatctcaaacacaacacatccaaaactgaacctatgatttctcctctcctcccagcaaatttgatcttctttcaatattctgtattcatctaattgtacatgccagatacctgagtcatctcagaagtcttcctttctcatttcctccattgactaagttctgtcagttttgcgctcctaaatatctctcacatccattcatttctcttcatttcctcttttaccttttcagattaagatactgcctagactaatagcctcctaactgatcttcatatatccattctttcctcttctgaatcagttctcccattttagtgtgagtttttataaaatgtaaatcctggctgggcacagttgctcatgcctgtaatccctgcactttgggagcctgaggtgcacagatcacttgatcccaggagttccggaccagcctggacagcataatgagactccatccccattaaaaaaaaaaaaaaattaacccaatcatgttgtcactcttcttaaagccattcagtggcctccctttgctcttaggataaaagccaaaatcctttatgtcgcctacaatgcctagtagaatgtggctgtgtctccttctctagtctgttatactgtgggactccactttgttctctcctatcaccacccttcttctgtgtcttcagacgtgcagttctttctctcacctcagactctgcgtatattattccttcaatctagaacagtcttcttcatctaaataattttgcttactgatgtttatactcaatcaccatttcctcagagaaacctttcttgaccctctagtctgagtcagaggcccctgttagatgctgcagtcgtaccatgttaagtttcacacccagagatactaactcttaatccatcataacctttaacagttgtaattttacatctatgtgcatgactatttaattaatgacactttcctctatgtcaaaagacgtgaggacttccatgttagtccattttcatgctgctgataaagacatacccaagacgggaaagaagaagaggtttaatggactcacagttccacatggctggggaggcctcacagtcatggcagaaagtgaaaggcacttcttacatggcagcagcaagagagaatgagagagaagtgaaagcggaaacacctcataaaaccatcagatcggctgggcgcggtggctcactcctgtaatcccagcactttgggaggccgaggcgggtggatcacctgaggcaggggattcaagaccagcctgaccaacatggagaaaccccgtctctactaaaaatacaaaattagctgggcgtggtggtacacacctgtaatcccagctacttgggaggcttaggcaggagaatcgcttgaacccgagaggcagaggttgcagtgagccgagattgcatcattgtactccagcctgggcaacaagagcaaaactctgtctcaatttaaaaaaaacaaacaaaacaaaacaaaaaaaaaacaacgacaaaaaaaaccaccatcagatcatcagattgaccggcgccgtggctcatgcttgtaatcccagcactttgggaggtcaaggctggtggatcacctgaggtcaggagttcgagaccagcctgaccaacaaggtgaaaccccgtctttactaaaaatacaaaaagtagccaggcatggtggcaggcacctgtagtcccagctcgggaggctgagacaggagaattgcttgaacccagtaggcagagttgcagtaagctgagatcacaccactgcagtccagccggggcaacagagcgagactccatctcaaaaaaacaaacaaacaaacaaaaaaaaaacccaccatcagatctccttagacttactaccacaagaacagtatggggaaaatatccccatgattcagttatctcccacaacaagtgggaattatggaagtacaattcaagatgagatttgggtggggacacccagcaaaaccatatcaacttctttttcattcatcggtatattcctagtgtaatgcctgggacgtggtggacacctagtatccgtgtggtggatggatgaatggattaatgaatcaaatccaacaaagtttaagacacactgtcgacgagtagtgagttgatctgctgtgaatttgctgggaagctaaaaagcatctttaattttgtgagtggtagcaacatagcataaaggaaagtctagtggctatagagttagacactcttgggttcaagtccccaccccacctctgtgtattataaactatgtgattttacatatgccacctaatctttttgtgtcttaatttcctgatctgtaaaaatgagaccataatatattatggagttgtgaggattaaatcaagtaatataagaaaagtagatagctgtgttttaggaagtaggtagtcaataggtatgaagttgtctcttcctactttctaaattttaataaaatttttcccctttcatgtttagttgacatgtaataattgtatgtatttatggaatatagaatggtattttggtgtatgtatataatactgatcaaattagggtaattagcatattcgtcacctcaaacatttttcatttctttgtgttgtgaacattcaaaatcctctcatccacctttttgaaaatatacaataaattgtagttaaccgtattcaccctatattgctgcagaataccagcactcattcctcctatctagctataattttgtatctactaaccaacctctccccacccttccaagcccccgttacacactgttctactatttcccatgagctcaaaaaatgttttattcccacatatgaatgagaacatgcaatatttatctgtgcctgactttaaattttgataaaatcttatgataaagtacaatgtgtgtgtgtgtgtttgtgtgtgtgtgtgtgtgtgtgtgtgtgtgttgttacataataacataagattccttaaaaggtagttctctcatagatcgcactcacaagtatcttaccttcaacagtactgggaaaccttcattatgacacagtctctctagtaatgtggtctcacaccctaaaggcgttatactgggactttaacatacttccataatttatgcagtactagagtatatagcttctcagagctaaactattcaaatataatttatttaaacttgttacattagccatagagaataacattggtacattagcagtgtacatttcttttcaatccatttgtatgaagtgcctgcttctatccctcatttgttgttttctggtgaaggaagaagctttgggccagatgactaaattctgtttcttttagtagggctgtaataactggctgtaagttcgcaagagttcctgtaatggatgcagtgcagtcttgaaaaaaataagacaggtgtgtttcataggtgccttctttagggaaccaaaagagaaggatggggaaatatctaatctacacttgtaacttttggccagagggtaataaatagtaaaatggtatgtttttacagttataatttatcttcctttctccccacctctcagtagaaatgaaggtatgcgctgtggtgtactgaaaagtacacaggatgcagagtggttctgggtttgaaatctagataccttactagttacctgtgtcacctcaggcaagtctctgtgatctttcagcctcaatttctccctctgtataatcagagaattggattaagtgacctctaaagtattacctctctaagattctctgatttcctgtagcctaagtttttcttcatatgcatggataagactaacttataaattactgagcatatttgatcatttgaaagggacagatcatgggaaaatgaatctaagcaaatatgcaaaatgccatatgcctctgaggctggtctccaggtaagtccctcaaagccaggtggcagatgttcagctgggggagtggcttcacagagaagaatagtcttttattctacacacgtgtaattaggaaaaagtgactgcccctcagtccttgatgagatgccacaatcaccaggtagtgttctaattttcaaaattatatcagtattacttagcaaaccagagaaaggtcagcattagtgggcattcagtaaagtacatactgtgaagtcaactcagaaaggagaatactcagccaaggggtgtgcaataaatttcccagagctgtggctaattaaccaacctgcatcaaaatagctcgagccaccaaccaacagaaatagtgatgaagggaattgccaattttccccatatctaggactaaagagaatcctagaaatttttgtcaaaattgaaagtatccatttcagtctgtcgtaaaatactttgagattctttatcatgacatattttatattaatactttgaattgtagagttagggaacatagggaagagaaatccttttatgtgtgtgatacagacttctaaggttttgttaccaaactgtttctcccatttcagtcttcccagtgtgtcttaattgaacaagtttggttaaagcaactgagataaaagtgaacgtaaatgcctcctaagtcttttggtagagtaagagtgtcgaggaatcttcattattaaaagtagcaaggaaaagacatttagggagttgagaaattatttatattgtctcacttaactaaataagattaactttgtaagattagagattacttaaaacatggtagacagaggaaaatggaagaaaagattaacaaagattaaatttttgacgttccaaattgacatctattattgagtacccgtgtggcaagcataacgttaaaacattcaaaagagaaaacaataatgtttatcgagtatgtgccgataattaacttttatccctttcttacagatgaggctgctacctctcagtgcagcagtatagtcactcatgcaaaatcacaccgctagcaggtattgaagctaggctgtaaaggcagaaatacagcatatatggcagcttcattagaatcctgatctttctgggagtgaagagtttgtgtggggtggcaggaagagctatggacttagagccaggagacttgggttttgttcctggatataccacttgatctttcttgtcctcagtattctcaggggatcatagtcaatctctggtgatagaggtcaggaaagaggttacttttggtaggggtagtaactaaaagaagaccttaggaggacttttttggggtactgctattgttcagtttattgatccgtatggtgcttcatggtgtgtttgtgaaaatttatagaactgtatactagttatttgtgtactttttacacatattttatactttaagtttactttaaaagggaattacacacttgtatcatcacaggtttgttgtggaaatcagatgaacaaatgtttttaaaattgctttaaaaattaaaattctatgctataaaaataatggagtaaggaattattgggtgataaagatggctagacaagataggaacaattatggagagattggagtgttacagatagcttgggctttatccagtaaaaaacagagaggcattgtatgtattctaagatactggcaagatgaaaaaattaacctgacatatagaatggattggggaaggggggaattaaagacacataagataattatgggacttttgcttataatctcaacagtgaaaatggagagaaagaaatgaacctaaaacattctgaaggaataaacagtggtctgtgtgttagtccattttactgaaatagagttgctctaagttgctataaaaaaatacctgagactggctgggcacggtggctcatgcttgtgatcccagcactttgggaggccaaggcaggcaaatcacaaggtcaggagttcgagaccagcctggccaacatggtgaaacctgtctctactaaaaatacgaaaaattagctgagcgtagtggcaggtgcctataatcccagctacttgggaggctgaggcaagagaatcgcttgaacccgggaggtggaggttgcagtgagccgagatcacgccactgcactccagcccaggcgacagaatgaggctacattaaaaaaaaaaaaaacacctgagacttggtaatttataaaacaaagagttttatttggctcgtggttctgcagactgtacaagaatggcatcaacttctcagcttctggtgtggcctcaggaagcttttactcatgacaaaaaggcaaagagggaacaggcatgtcacacagcaaaacagagagcaagaaagaagggaagcgatgtcagtctgttttaaacaaccagttctcatgtgaactaatagagcaagaagccattaccatcggaatggcacaacgccattcatgaggaggccacccccatgatccaacacctgcccctaggccccacctccaatattagagggtcacatttcaacgtgaatttgggagggcacaaatatccaaaccatatcagtctatgaaataaactagaaagaaaagataaggaagagagaagagtcacaagtcattcccataggtcatactttaattataaaaagtagagtggtgccgtttactgaaatgttgtcctctctcaagtggaggaactcataagtgaacctttgtggagttctcaactgatgttttcttctggttcacttgaaatttagagctcactaaggaaggaagcaatgtggtaaaacagtcttgaccatgagggaaagggaatacatgtttgggagcaaggtaagaatttcattcctttgaagccattagtagtatctttgcaaaatgtaagacttttgcctctttcagacagcagcagtagtaaaactggctagccattatagtagccaaagtccattttcagtcattgttgcctgcagcccatctgcatctcttcaccatcacatctggaaagccctctttcctaattgtacctagtttgtttttagggccaaaatactgtgtatttcagcagttacagcaaaaaccacaaacatgtttcctatggtttgtggaacattctttttcttctgatactagtgtgtaaccttgccccattgttggtaacagcctgtgagaaactgaataaggaggcgttcaatttgtggttttcatcaatatttaaaaatactgagataggtgagaagagaggtggcagaggaagggccattaaactttttccctctttcagctttagcgtggacaaggttatgtattgtaagccttgttcctatctagcctatgttttttttttaattcagggtctgagttttattttcagtgcattgattggaatcaaagagtcagaagggagtgtcataaatagaaatcagggtttgttcagcttgaataccaacacaaactatttctagacagcatgccactgcagctgtgtgacttaagcagaatcaaaactcatattaactggaggaagatgtgtcagagagcattctgggcctacaagatgtacccaaagtggaattggttttgttaaggaatagaggaattagggaaagcttaggaaaatgatctgtagtctccattgttacctgtgtaggagagtaaaaggtcggcagagctaaactccttctgcttagttcaagcctcccaacgatgcacagaaacacaatagagatttttagttgcaaaagtgctcaaatttggtcaactttaaagaagttttgctctgcaaccagtgaattccttaatgatagatttagttctggttcctgttcattatgtaactcattactcccggtaaccgccagacctacagataaactatgtgtatcttctggtcctaccttcctttctctttgaattatatctttttccataaagtacagacgattgtccattcagaaggacttttaaaaattcaagtttatggctgatttttggctgtggttaattgaagttccaagaaaaagagtaatataggaaggctgaattatttggagggttcctatgccattatttatcatcttagaaataatcatagagctgggcatggtgactcatgcctgtcatcccaccactttgggaggtagaagcaggaagatcgcttgagccaaggagtttgagaccagtgtgggcaacaaattgagaccctgtctgtacaaaaaaaaataatattaacctggtgtggtaacctgtgcctgtaatcttagctactcagagaggctgagttaggaggattgcttgagcctgggaggtcaaggcggcattgagccacactcataccactgcactccagcctgagtggcagagtgagaccctgtctcaaaaataaaaaaaaaaatcggccagacacggtggctgacgcctgtaatcccagaactttaggaagccgaggcaggtggatcacaaggtcaagagatcgagaccagcctggccaacatggtgaaatcccttctctactaaaaatataaaaaattagctgagcatggtggcgagctcctgtagtcccagctactcgggaggctgaggcaggaaaatctcttgaacctgggaggcagaggttgcagtgagtgagatcgcaccactacactccagcctggcaacagagtgagactccatctcaaaaaaatttaaaaaaaaaattgaaaaatttaaaaaaagaatcatagttgaaactcataaataagtatgtgtttggtcatctaactaaaagatatggatacttcgtaacaggaagttcaaaagcttgcagctcatttcccagggcaaaggtgatgtgctccagcttgcttaagatgtgctctagagtccggctatttggagagcctggcatgcaacagccaaatgggcagaaaatgggtattgacggttgctcaatttcagagtcacctttgcagtactctaaaagcacactggaattggctggaagagccattagtagacaatcaatatctgagcttttgatagtgaccatggtctatatgattatttgtggtactttatctgtatttttcttgtagcacctaatgctttatggttagctatgataaaatctaatctctgctgtagcactttttatttattcatgaaccttccccactttccctaatcaaagttaattcctcctgtctttattgtccttggctctataagccagtctcagcctcccataaaccacagacctgcctgcccataaaggcaagttgtcatcacccgcaaatgccaactttcttgtttccaacctgcctgcactcttaaccggctcccaataacttgtgaaacacacaatcaagtttttgtcattacttctccaagaaatttgtgtaattgcctgtgtgtttgtattatatctttatgtaccttttatctctaggagaacccaggagaaagaggtagtttttctagtaactagcccagttgttatcagggggagatacaaggtagaagaattctacctggaatttcaatcctaactaaagagtgtgaaaatttgagggaattgttctagtgatctttagagaatgcagtatttttgatataccagaagaaagtacactctgtgtattcaaaatgtgtctttatttgtaattgaagaatactctgctgtattataacttctcagagagtgtgcagaatctttagctaggtaggaggatatagttataaaagaaaaacaggaagtattagaatctgatacggtggaagggaacctaaacctgaagtaaaagagaaaagaagaatgttacatggaggaagaaaagacaacaagggctgggcacagtggctcacgcctgtaatcccagcactttggaggcccaggtgggcagatcacttgaggtcaggagttagaggcctgcctgcccaacatggtgaaaccccatctctactacaaaaattaggtataaaaattagccaggcgtggtggcatgcatctgtaataccagctactcgggaggctgaggcaggagaatcacttgaacctgagaagcggaggttgcagtgagctgagatcacaccactgcattccagcctgggcgacacagtgagactcagtctcaggaaaaaaaaaaaaaaaaaaaaaaagacaaggcttttgtgggcttttcttcagaggttcacctgaccttgttgaaaaagaaatagtaccatttggtcctgaaataattatgagacattgtaaaggaatgctttgctcaaaagatacaggtatcttaagaggggaagcaactttgcactcttgtcaaggaaacatgtaggagactgaccactggagagaatgtgaattttcagaccatgtaggcaaagaaagaacaaagatgatatgtgttcctcctgcataccattaaattagtaccaagtaaagatatagtagtggtgtgggactgtatccagatgtcttctaaaatttttatcccgtgaaaatagcctattttggtaagttcttccatactgattcgtttatctcccagagtacagaggaagaaaataggagaactactgttcttcctttaattctaattaacattgaaggattgtttgggagggtggaagtttaagagtccacgtagatgaggaaaaagcaacatggaaaactgttttatgtgcacatatagtttgtgcttctccctcagtgggaattatgcttccccgtcccattaatgtgacctgagtcatatgacttgcattggtcgaggaatgtgagaagtgacatacatacgttgcttctgtacaaatgcttttagtacatagtcatacatgatctttttcccatctgccccaagaccaacagtaccctagaaagagattattctatcagttttagaccagggtggacatgtggcctgtgtttttaaaaggcctttcattgttttaaactagtggttctcaaccagggattattatgttcccctctttcttcaccaaggaacatttgtaatgtctggaaatgtttttggttgttacaacaaggggagtataactggcctatagtgggtagaggctagttatgcttctcaatatcccacagtgcacagttgaggcctccacaacaaagaagtatctagttaaaaatgttattaatgttgagattgagaaacctggttgtaagcttctggggttgtttgtgactatagcttagcctagcctatcctgactaatacaacaactttcaccttaattttatactaagtgcagcaatagttgtgtataaccagttaggtacactggaaattaggaaggcaagtttgggagaaaaaaaaatttttttttttaacgtagctatcctaccatggtataaggtttttaaggtgacttggccaggcgcggtggctcacgcctgtaatcccagcactttgggaggctgaggcaggcggatcacgaggtcaggagatccgagaccatcctggctaacgtggtgaaaccctgtctctactaaaaatacaaaaaaattagccgggcatggtggcaggtgcctgtagtcccagctactcgggaggctgaggcaggagaatagcatgaaccggggaggtggagtttgcagtgagccgagatcgcaccactgcactccagcctgggtgacagagcaagactccaactcaaaaaaaaaaaaaaaaaaaacattttttaggtgactcaaaaggtttagaaacttccagttacacaactataactgtgcagttgcagatattccagataaataaaagccagagagaaaagtcagtgtggttgcacagtgaactctctcctgaactcaaatattaaaggaagtttataatcaaaataaatatgagtcttttatattcctttaaacatagcattaaaagaattaagatccaaaattaacgtggtttagatctgcatgcaaagatacccagaggacttttgtttgttttagttatcttagcagcaagatccagcaacaagtacatctctcatttgatgctcatgaactgcatagagaaagcagaacatcttaccaaggattgcctcatcttcctcatcactggccaccagtctcatctggtctacctccttccggttattccatagtctctgattctccagcatctttttgaggcagtagacctttctaaccctggctttaacctttacatgtacttaaagtatcaaaagtgattactgccgggcacagtggttcacatctgtaatcccagcactttgggaggatgaggcgggtggatcacgaggtcaagacctcgtggttcaagatcaggtggttcaagaccagcctggccgacatagtgaaaccccgtctctactaaaaatacaaaaattagctgggcacggtggcatgtgcctgtaatcccagctactcgggaggctgaggcggaggttgcagtgagccaagatcgcgccactgcactgcagcctggcctacagagcgagagtccgtctcaaaaaaaaaaaaaaagtgattactacccacccttgtcccatggaatcactcctattttgaagccttgaaaatgataggttttgaatatacctatcccttcttttttgttttgtttcgtctggttctgacaagtcattgtttcatatatataataagtatatgcaacattctaacgttatggggtataatgtactgttttgatatgtgtatacaatgtggtatgattaaatcaaactaattagcagatccttcacctgacttatctatcatttttatagtgagacatttgaaatttactcttagttattttaaaatatataatatgtattgttgactctagtcaccttgtatgtaataaatctcaaaatctattcttctgcctgaaattttgcaccttttgattaataactcattcccctgtctcccattcctctgtccatctgaaactttgtaccctttgatcagcaactcttcgttcccttccttcccactccagcctctggtaaccatcattctattatatatttctattcattcagcttattagattccatatgtaagtgaaattatgtggtatttgtctttctgtggttggcatatttcacttagcacattatcctctggattcatccatgtgtcacaagtgactggatttacccccttcttaaggctgaatagtattttattgtgtatatatatacacaatatttgtccattcatctgttgatgggcacgtaggttgtttctgtatctttactattgtgagtaatgctgcagtgaacattagagtgcagatatcaccaccaatatactgatttctattcttctggatatatatacccagaagtgggattgctgaggtgtatgttctgtttttaggtttttgaggaacttccataccatttctcataatgacggtactaatttacattcccaccaacagtgtataagagttccttttctctgtatcctctccaaacttatttttcatcttttttataacagccattcaaagctgggcctgatggtggcatgtacctataatcccagctacttaggaggctgaggcaggagatcgcttgaacccaggagttcaagtccagcctgagcaacacagcaagaccccatctctatttaaaaatataaatgtaggaagaaaaaaaaaaacactaacaggtgtgaagtgataactcagtgtggttttatttttcattttcttaataattagtgattttgagcattttttcttgcacctgttagtcatttgtatgtttgtttgttttttttttgagaaatgtctgttcagttcctttacctttttttaatcacgttattttcttgttgagttgtatgagttccttatgtattttgggtattaaccccttataagatgtatggtttgcaaatattttctcccattctttgagttgtctcttcactttgttaattgtttcctttgctgtgcagaaactttttagtttgatactgtctcatttgtctggttttgcattggttgtctgtgcttttggagtcatctccaaaaaaatcattgcccagactaatgtcatagaactttttctctatatttatttctggtagttttatgatttcagatcttatatttaaatctttaatccattttgagttaattttagagctaaacaaggatgaaatgctctgtttcaaggatactgtttctcaggctttaaatattttcaagcagaagccagagagccactggttgactattcttttccaaagttgattgcctataattctaaatttaacactctggattgaaggtaagaaaagaacaaaatttttaccatgtgtctctcaactcctatcatattttagccatatctaaaagcaagacaccaggaaataaagataccagacttcctccttgctctgaggacagaagggataactgcagggtcctgattagagcccagccatattaattgtgtagctgttcttgctcactctgattcagcctagtgatgagggtcagagctgatgtttttctctttaatcatagtaatgaggataaggtatacagcactgggggtacaatcttgaattattctttattgttgattattcataaagtatatctcaatcaaaagtttctaaatcaaaactgggaaggggatggcttaacggcaaagtgaggcaaagtttttaaaatgtttataatgtaatgtgacatttaaagattaaaatgtgttttatggatttctcatttttcatttgttacatgaaatcttagttttttaccttcaggttcttgggcttaaaaatgtctacctgcccaaaagacaggaaagtcacaaaataatacagatagcaaataaatatatatatatttttttgagacaaggtcttgcctgtcgcctagactagagtacaggtggtataatcatggctgactgtaacttcgaactcctgggctcaagtgatattcctgcctcagtttgacaagtagccgggaccacaggcatgcaccaccacacctagctgcaaataaacattttaaaattattttgtagggacggagtcttgctgtgttgcccaggctggtctcaaattcctggcctcaagcagtcctcccacctcagcttcccaagtagccaagactacaagcacatgccactgtgcccagccacaaataaacatttaaaaaaaatttttttaattgttttttgggagacagacaaaatctcgctttgtcatccaggctggagtacagtggcatgatcttggctcactgcaacctccgcctcataagttcaagcaattcttcgtgcctcagcctccagaacagctgggactacaggcatgcgccactgcacttggctaatttttgtatttttggcagagagggggtttcactaggttggccaggctggtctcgaactcctgacctcaggtgatccgcccacctcggcctcccaaagtattgggattacaggcgtaagccaccgcacccggcctgaaaaattaaatattactaatttaataattgaagaaatataattaatttagtaatactaattagtaattgaagaaatacaaattaaaatattaagctatcattttcccttactaagagttttttgatgttttctattataaaactataatacctgtttagtatagaaaataagaaaatacaaataaaagaggaaaacaattttaaaatacttgtaatctcatcacagtagcaacacaacatctcattatgtagatgatagtcttttttctatccatgtctaaaacttatctaatagtctgttgatgtacatttgaactttttgtcataagtaatgctgtaataaacatcttgcatgttaatctttttttgcatctctgattttcttaggataggttccttgaactgcttgctgagtcaaaacatattgcatttttcaggcgtttggttatctgttgccaaattgctgaccagaaaagttgtatcagttatatgagcttattggtttatccattctataatctgtattctttattttattttcctatattttttctttcagacttagtcttgcagatatattattttcttatcacccttttttttttttttgttttgtttgagacagagtcttgctctgtcgcccaggctagaatgcagtggtgcaatcttggctcgctgtgacctccacctcctgggtttaagcaattctcctgcctcggcctcccaagtagctgggattacaggcatgcaccaccaagcccagttaattttttgtattttagtagagacgggggttgtaccatgttgcccccaaggtggtcttgaactcctgagctcaggcagtctgcccacctcagcctcccaaagtgctaggattacaggtgtgagctactgtgcccagccatcatctccattttgataactccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttctggtactgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccaggtactggtcagacctaaaagaaacacaattgagaaattgagcataaggcgctcaaaggtggtcattgcatagtaacagagtgaagaccctgggcctcggcgcctgacagaactggatctcagattctctatgtccttgagcaagttgttagtttatctctgagcttcccgttcttcaggaatggaactcttacatgaaaaacccacagtgatatttgcccatttttacaaacctttccctatggaaagtagctttttaaaaagttaaaatgtgaagagagagttcccccttaaagcttgtcctacatttttttttaatttttttttttttttttgagacggagtcttgctgtgttgcccaggctggagtgcagtggcgcgatcttggctcactgcaagctctgcctcccggggttcacgccattctcctgcctcagcctcccaagtagctgggactacaggcgcccgccaccacgcccggctaattttttgtattttttagtagagacagagtttcaccgtgttagccgggatggtcttgatctcctgacctcgtgatctgcccgcctcagcctcccagagtgctgggattacaggcatgagccaccgcacctggccagcttgtcctacatttttatcttatctgtgttctttatttactctcaattatgattggcagacttctataaggacataaagacaaactctgagccagggaaaggatgaagttggggaaagaaaactagtcagatagcatttagaataagcacatttcacttcctcagattctcttctatgtaagggtcttgatttagctatttgaataactttattctaacttgctgtttgagaactgggaaacaaatctgtaaacacatagagaatgttttggagatgggaagtaaggaatcatgtttcaattgaaccgccactcctacatatacatttatatgccataatgacttcctaaactaaccatacctgttttccatgattcctactttagtaaaagtactgccagacttaaaaaaaaaaaaagaaagactttaccatgtctgtatgcttcattctctccagatagtactgggtttcatagtaatctggaaaagccataattgtttaaaaatattctgttagccatttgtgaggccttcttttcctaatggggaaatgctttaaaagttgatgctttttcaaggtctcaacctatatgtaaatctcctgggtaacttagttttgttatcccactcatctgaactgctctactgggttaggatccaaaagaaaggggatggataaataggtttgaggaagactgtattcgttagacgactaactccttactactattacagcattaaaaaagtcctgagaaagttgtggaattgaaggtcagactctagttgaaaaaatctgagtattctctatgttttttaaaaagcacaataaaaatcacacatggcaagaaacctcatctgttgaaagattaattggtctgttttctttgcttgcttccttcctccaggaaacctttcctcgtaacattaaatgtttacctaatacctgataatagccacatctgtctttcgtaatgaagtggatatatatgattccctatttcagggatctgtctatggctgctcttcatgttttctgtatttttgtatatttgaatttttcatattcctggtcacattagatgcactgtggtccaaaacacattttttaaagggctgagttgaatttcaattaccactaagaatttaaaattttattaatagttctcaaacaagaatcaatgtgcaaccatattatgaaggcagcctcagaatctatattattgttttaatgttgaagaatgaaagttatatctctgtgtcccttgtctgtgtgtgcctcccaacaaccttaactagtaataatagtgcttttcttttctttttttttttttgagatggagtctcactctgttgtccagactggcgtgcagtggcatgatcttggttcactgcaacttctgcctcctaggttcaagcaatccttctacctcagcttcccgagtagctgggactacaggcacacaccaccacacccagctaatttttgtatttttagtagagatggggtttcaccatgttggccaggcttgtctggaatcctgatctcaagtgatccacccaccttggcctcccaaagtgctgggattacaggcaggagccgctgcaccctgcctaataatagtgcttttcttatgtcacaggataataaactcatctcaggtgaatcccttcctttggactctggatcatattttctttctataacatttattgtgtaaaccatttatttgataacaccttgtgctattggttaagttactgtatggtttcagctcctcaactatattgagtattacttgagagcagaggctttgtcgtctacttcttcataaagagttctttgcacacacccagaataaatgtctagtggttaatatttatcttattgccgttccctgaaagaattttattttcctttaaacagatcgggacttacagaagtctaccaatggtaagaatgtggcccctaataattcttactctagctgcttgtctgactgttgcctagaagcgtttttacttgtatccccaagaccccatgaaagagtgttaaaaacaatgaacttaactgttcttaggtcagggaaggggttgggggctcagaagattacttacttcctttgggttcttgaaaaatagtaataatagctctcatttacttactgcttattgtgtgccagataattatgttaaaaattttatgtatattggctgggcgcagtggctcacgcctgtaatcccagcactttgggaggccaaggcaggtggatcacctgaggtcaggagttggagaccagcctggccagcatggtgaaaccccatctctactaaaaataaaaaaattagccgggtatggtggcaggcacctgtaatcccacctacttgggaggctgaggcaggagaatcgcttgaacctgggaggcagaggttgcagtgagctgagatcacgccattgcactccagcttgggggacaagagcgagacttcgtctcaaaaaaaaaaaaattatattatgtcatgtaatcatcctaccaccctgtgaattaggtactattatcctgacccttcttattactccctaggcatgaggcccagagatgttaactaacttagccaaggtcacacagtttgagggatagagatggggcttgatctctctgaatcaaaatgcttggctcggccgggcatggtggctcacgcctgtaatcccagcactttgggaggcctgggtgggtggatcacttgaggtcaggagttccagatgagcctggccaacatggtgaaaccctgtctctactaaaaatacaaatactagctgggcatggtggcgtgtgcctgtaatcctagctatttgggaggctgaggcaggagaattgcttgaacctgggaggcggaggttacaatgagccaagatcgtgccactgcgctccagcctggtgacagagcgagactccgtctcaaaaaataaattaattaatttaaaaaaatcctttgctcttaagcattatgctgcaatttctttatgtgtgaaattaggggcttgagctaagtgatccctaatgcccccacgaactatagaaatccaagctgcttagggaggaccacgtgtctgtacttatacattcacttcctcaaagttgttttggttttccttatgcagactttttcttcaagtacttttcaatatatatacattttttatttatatttctatattagcactccttcaggatcttggtataataataccaacaatattattaatccttgtgctgtgctcaggaagaggaaggggcaagttacctacaccctcgccttttggtatggaaggagataggtttcagagatgcaaaaaaatctaaaattggcttcaggtgatggcctttgaatgccttatattaaccagtaatgaccttaggcatatttaatctctccgagtcttgtttttttggctataaaatggaatgatactatctccttcacagagttattgtgcggatgaaatgaaacaatacaggttaagtatctacatagagtggaagcttagtaaatgctagtttcctaccccctttcttttctttgttctgagtcttgctattaggtagataagcctgatgattgagcaagcttatgtattttatagtttgtaaaaactagccttaaaaaaagctaaaccactagccttaaaaaaaagccaaagccaccgtgggtgcggtggctcacggctgtaatcccagcactttgggaggccaaggcaggtggatcacttgaggtcaggagttcgagaccagcctgaccaacatggtaaaaccccatctctaccaaaaataacaaacattagcccagcgtggtgacaggtgcctgtattcccagctactccggaggctgaggcaggagaatcgcttgaacctgggagatggatgtttcagtgagccaagatcacgccattgcattccagcctgggcagcaagagcaaaagtccatctcaaaaaaaaaagctaaatacagactgcaccccagcctgggcaatagagtgagactccatctcaaaaaaaaaaaaattggttaaataagtttaggccttgaaagtctttattaatcattcttttcccaactaaagttttcagatccttaagatctccttgaatttgcttccttctatattagtatattaaaggtaaaagagaccttagacatcttcatatctgtgatgtctgctagtgttccaccatacggtgagaagccaccccagatggctaagaatttactcacttcctatttctgtaccccatatgcaaattaaatctgtaactagttccacaaatttcgtagcatctcttccataatctcgctaccctggaaccaatttaacaacaatcaaacaaatacatatacattagaaaatttttttcttagaaatggattttttcatctatcaaagcaaaggcaagaaaaatgctacagactgaacccctctgctgacagtttgcagatattcatgccagtgtttcaatatcaatgtatgagaaatttagacccatctaaaactattgctggactttgtagcagccaggtcaggtcctgtaggcatctgtgacaggtagtttggtgtgctgttcatttcatcactgagtcaaagtgtactctttcccgctgcctcgtaaactttaaagttaatttagcaactaaacatttcagttattcaagactgaataactgaatgtgcctcccattatttcttatagttattactaatctgaagttttatactagatatccctgtaatgttggtctcttacctgattacaactcatctgtttggagttaatcttttcctttaaaaagataagtgcttagacttaactccttgcaataccagtatatgtagccattattattaatggtggggaaataggttgatggacagtctttatgactgaggaaccaagtggctacaagttatgttgcttacgtcttattatagaactgattttacaaatcattcaagaaaatataaacttgcttggtttttgtctttttttttttttctttcttttttttttttttgatacagaatctcactctgtcacccaggctggagtgcagtggctccatctctgctcactgcaacctccacttcccaggttcaagcgactcctctgcctcagcctcctgagtagctgggattacagacgggcgccactacgcctggctaattttcctatttttagtagagacggggtatcaccactttggcagtgctggccttgaactcctgagctagtgatccgcccacctcggcctcccaaagtgctggaattacaggcatgagccaccacacccggccgataaacttgttttaatcaatattatataactcaagaatttccccacaaaatgacataataaaatatttatagttgcccttttcctcttttcttcctaaaactttttccagtgctggtgtgttagaatctgagtttcagtcatgtctgtgccattgtcttgccatgtggtctttagtgggaaaagaatgtgcgtggatgggtttcagaggctgtctagcatgtcagctaaatgactctgggcatcttcactaggcctaaggcagagaattaaaggtttctcctcactccagcattcaagcatatatttttgtgccttcaaacaaaacttcatgtaattaacacctactctagagctccctggtgataaaaagttgaatgaagcacagttcctgccctgttgtagcttataatctaatctataggatatcttttcataatgtaacaggcaaaactctgcactctcctctgtgtattgaacaatatgattttgggaaggaaaagaaaacattgtgattaacctaccaagaaataaaagaggcgtatattttcaagaaaattagtaaatctatagaaaattttctgtagcctcctgaggcaagttttctgtcataaatgcataaatataatagcttaaaaaggaaaagggaccaaagcccatgactgtatgacaggatccactgctgtttctctgggtaaccttggatagattattcagcttcttcctttccattgtctgtctgtggaggggaaagactggtctatcacagtgaggtaaacaataacaaatgattgcaaaatacgtttgaaacattaaattctaatcataacatctggtcttatactatatatagatgatgattttctatttttgaaaaacaggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaa

SEQ ID NO: 38513 - DNA, 108958 bp, Homo sapiens
acctttgagcgatggcggcgtctggggaaccccagaggcagtggcaagaggaggtggcggcggtggtagtggtgggctcctgcatgaccgacctggtcaggttagtccggggccagttactcagtctgcggctcgggggaggaggcgtgccgtgcgctatgcgcccagtggagcttttgggcgctgggtctccagggatagacagtgctagctttgggtatgagctgcaggttttcgaagccttcagcctaccttcctggcatgaaagaacttgagtatataaaggtaaatctcaggggaggggacgtaataggccagggtttagtgaaagctctaatattactcaaagcgctccccaaagacctgccctccaaagacttgcgcccccaaagacctttcttggcccggctgctgagcctttccccaaacgagccagggaactttgcccacgtcattttacctccgagaatgtgcctacctcacagggttgttgtgaggactaaatgaagtaaagtgttttgtcaagcgtaacattatccaaattgggtattattcgtctgagcttattgtataaaataatgagttgagcagaaatcaaaaagactgtcacctttcaccatgttgattgtcggcattactgcagtattttatatttacagcgtatttttcagcaagccaagtatgaatcaaaataaaaacataaacacagtatttacaacctctgaaaacgatgatcaaattatgatagaaaatatgccaaatgaaaattgttgagttaggtcagtaagattgagtagacagatccttctgatttttcttttttttaaattaaggtagcttttctgattacaaaagtaatgtatgttcactgtaaaattagtaataaattcagatattccaagaaaatcctaccactccaattactgcagttcagtcttttgatgaatatcttttcagttgtaatgctactttgtgttataaaaatgatcaggtatgctacagtaacacctcattcgtcctgaaatgttgcttttccaaagggtaatagagaacgtggaactaaacaaaaaggctttgggacaatcaaaataagtcaccaaattgctgcaccaaaccacctgtattctactcagaaaataggtctagggtcttcatgtaaccaatttaaccttaccttaaaatatttataagctgtgttaccaaatttccactgagattagaaaggtgggagttagagaagagactgctagaggcagttatagtgactgacgaaaacttgaggatgagtaggagactgtgtaacgagaagaagcaacaaaagaattttaaataccaatgacctttatttttccacaaatattagaactattctgtcagacactgtgccaagataaaaatactttcctttggtgacagagcataaaattgaatctagttggagacatttgttgaagaggcctgtacatctttttctagagcaagagtaagtaaacttttctgtaaagggccagatagtaaatattttaggctttgcaagccgtatgtggtcaaggtcacatttttttttaacaacattttttaaatgtaaaaaccattcttacctcccaagccttacaagaacatcctgcaggccatagtttgcagacatctgtgtagaaagaacattactgtgtttacaacacaatatagcaattgattttactggtgatgactcttttcaagaaaaggttatatggtacttactaaattttgtataaaaatagagcatgtatttcactttagaaaaagtttcatcaaaaattcataaagttgagttacataaaggaataaaccttcatctaaaatgattcattccatgggaaatccaccaagctaaatgtttaccatgattttatgtgtgaagtggcagaagagtaagaaaactaaagtggaccgggcgcagtggctcatacctgtaatcccagcactttgggaggccaaggtgggcagatcacctgagtgaggagtttcagaccagcccagcgaacatggtgaaaccccatctctactaaaaatacaaaaattagctgggcatggtagctggcgcctgtgattccagctactcaggaggctgaggcaggagaattgcttgaacctgggaggtggaggtagcagtgagctgagatcgcgccattgcactccagcttgggtgacaagagcaaaactccatctcaaaaaaaaaaagaaaagaaaagaaaattttctcatacatcctacctgaataaaagtgtcagggttaaaattcagagctacttccttgttaccaaactgagagctttctgtgaagcttgaccatcagatactaaaaataactatagtactttgtggggtggggtaggggagtggtgtcaaaggcccattttagcatccgtcagggttttaaagtcttatttcagagctagaaaaatttggaaattatttattctagtccttcagtttttagataaataaactgaagcccagagaagaatttctcctcttggccatattctttccttcataaaatatccaagtttcttctcttcacatgaatcagtaaaaattttactgatgattagcaaaatcactagtaaaaattttactgatgattagcaaaatcactagtaaaaattttactgatgattagcaaaatcattagtaaaatcatcagtaaaaaatcattagtaaaaactgtattcccatatagactctctctgctaattcccacagcttttcaacaaacttttcatgatctctcgttacttatgacactgaagatctttacaaaaatctgcgtataggattttcatttaaaaccctgcatctgtgataaacttgggtgcaacttttctagttacagttagtatcatgattatattagttatctactgctgctgtaacaaattaccaaatttaataattaacgcaagtttatttttttactgttctggaggtcagaagtctgatacaggtctcactgggctaaaatcaaggtgtcagcagggctgggctccattctggagactctagaggaggatctgttttctttccttttccaccttccagaggctgcccacatccttggctcatcgtggccccttcctccatcttcagagccagcaatggttgttcaggtctttctcacattacatcactctgatccccagtcttctggctccctcttctacattataagaactcttgtgattacattaggcacaaccagataattcagaataatctctttattttatggtgacttattaggaaccttaatttccccttgccacgtaacaacatattcacaaattctggggatttggatgtggacatactttgggagaggggagcagagagtatgttatttttgctaccacagtggttaagcttgaagtaaaaaatcctacaatatttagttctcagagactctttgaagcctatcattctatcctcacattttacaagtgagataaggaagagagcttcaatgacttactccaaatcacacagccagtaagtggttacttactggctagtaagtggctagtaaaggctactacccaggtctcccaatccttaacctttcttttttatttttttaaatatatattttctattttttattttgttaaagatgggctctcgctatattgcccaggctggtcttgaacccctgggctcaagcgatcctcctacttggtgtcccaaagtgctggggttacaggcgtgagccaccgtgcctggccccaattcgtacctttccattatatcattctacctctaactctgactagtgtttattgcccttttcatctacagtacatttgatagcttgtagtctgtacattcattgttaactttataaactgataaggaataacaactaaggatttataattttcaagtctaaagatagtatctttattactgtgccttattcctaaatttaactgtaactagcctggacacgcatgcctattctttagtatcacttcagaaataaaactgcttcaataactaagcccttttagatggcatccaagcccaacttactttatatattacattactgtgtgccagacactgctaattcaatcaatgaataaccttttttttcatttctaatttcagtcagctatgaatagtaagtcgtatgtagtaataatttttaaaaatcattagctcatacagcatggcaaacaattgaaattatttaatactcacttatatttttctcatcatcctcttccttcttgaacactcatctctaaagttacacattacaaagatacaaggaatcaaccctggtcttatgggatataaagtcaaagattttccaaagacagatttccacaacaaaacaacaatgtgtgaatatttttagacgttaggctcataggcctttgttaatcatgttttcattagtaaaccttattttttatgacctgtatcacccatttttttaattattcattcaagaaatatttattgaatttatactatgtgccaggcacttcctgatgtgcagaggatacagcagtgaaaacacagacaaaaatccctgcctcatgaagtttacattctagtaagacagtatcagtagaaataagttaattacatagtaagttaggtaaaagctaaggagaaaaattaaacatgtaaggagggatgggaataggaagtttagattactggcttcagaaagcctcactgaaaaggttatttagagtaaagacctaaaggaggaaagaaaacaagtcataatctgagggaagagcattccaggcagaaggaatagtgtactcaaaggccgtattcagtgaagaacatggagtccagtatggatgaagaagaaaaaaagagtcaggagacagcaatcagtgattaaaggacattgagtcatactttggatgagatgaaaagctagtggaggatttgagcaggggagtgacataatcttattttgattataataggatctctccaagggctatatgagaataaatagcatgaaggggaaggcaaatacagaagcagggacacaaattcagagtcaatcccaacaatctaggcaagaaatgatggtagcttgaaagcagtgaagtggagagaaagcatctttctattatatttttggggtagagttgacaggattagtggaagttgacctctatgaaaacgcagaagattgtatgcagagaaagttgggtgggagagggctgtatcaggagcacagagtggaattgggagggttgaggtacctactagatatcaaattgaggaggtgaagaaaatagatacaagagtttggatctcaaaggagaggtccaacccggagatataaatttcagagtcatcagtgtatcaatggtatttaaagccatgaggctggatgagatcactgagggtctgacctcctagggcactacaacatttaaaggataaatttttaataaaattgacttcctgtctctcttcaagtctctctgcagtcctaaaacttgctttgagacgtgcttaatacaaacctatgtttatatttccatagcaatagactctgatgtcaactaaaactctgtgttatctttttacatgctgccaattaaaagtgatggcttgagagataagactcgtgttcacccaagcatctaagcttaatcctgccaaatcaggaaatgagtgcctaattttcaaaaggtttaattggatagtggaataagtgaatttagaagcttttagatccaaagcggatgaagcattggacctagattacttaaaaaaaaaaagttatggccaggcatagtggtggctcaagcctataatcccagcactttgggaagccaagcgggtggatcgcttgagctcaggagttaagactagcctgggcaacatggcaaaacccggtctccgcaaaaaatacacaaattagctgggcgtagtggtgtgagcctgtagtcccagctactggggggctgaggtgggaggatcgctggagacccagaggttgaggctacagtgagcctcgattgtacactgtacttcagcctggacaacagagtgagaccctgttaaacataaaaaaataaaagagagttatactgtacctatcaaagtttgtatttgtttgacataatagagtactttgtaactgggacacaggttacagagtcaagaagcctcttggcttgtcatatttagaacagagaaatctcttttacagtcacattttcaaaaactaaaaaaggaatattgatccaaaaagtatcatgctttcccagtattcgaggaatataatatccttcattattctttctgcttcttaaattggtctgaaaagttgcttatcagttaccaatcatttattaaattagtattttgttaaacatagttgtgtcaactgtattccctaatatcaaaagtaatcattcatgggaaatttggtatgtccctttaatgaaaatatacattaaaaaattatggctgggtgcagtggctcatgcctgtaatcccagcactttgggaggccgatgtgggaggattgtttgaacccaggagtttaagaccagcctaggtaacagggtgatgagactctgtctcttaaaaaaaaaaaaaattgcatatgacaaagaaagagcacctactgtgtactattacaaagcagtccctttagcaatccattcctttgccagctctctgtgccttaggcttttcatgtctgtaacctaaggagaacaaagtaaggtggactttgtgatgagttttgctctagtattttgatgacttgtttataatgctgaaatacttatagtgtgctaaacactaagaatactgcagttaggaggctgggcgtggtgtctcacgcctgtaatcccagcactttgggaggccgaggcgggcagatcacgaggtcaggagatcgagaccatcctggctaatacggtgaaaccccatctctactaaaaatgcaaacaactagctgggcgtggtggcagacgcctgtagtcccagctactcgggaggctgaggcaggagaatggtgtgaaccagggaggcggagcttgcagtgagctgagatcgtgccactgcactccagcctgggtgacagagcgagactccgtctcaaaaaaaaaaaaaaaaagaatactgcagttaggaaaacatggttactgcttgtcttgtcttagtcccttttgtgctgccataacagaatacctaagactgggtgatttatcttttttcacttttattttaagttcagaggtacatgtgcaggtttgttatataggtaaactcatgtcacacgggtttgttgtacccaggcattattattttttttttgtcacccaggtattaagcctagttctcattagttatttttcctgatcctcttccctcctttcaccctccaccctcaggtagaccccagtgtgtgttgttcacttctgtgtgtccaggtgttctcatcatttagctcccacttataagtaagaacatgcagtatttagctttctgtacctgtgttagtgtgctaaggataatggcctccagctccatcatgttctggcaaagtacatgatgtcgttctttttaacaactgtgtagtattccatagtgtatatgtaccacattttctttatccagtctaccattgatgggcatttaggttgattccatgtctttgctattgtgaatagtgctgtaatgaacatacacatgcatgtgtctttgttacagaatgatttatattcctgtgagtatatacccagtaatgggattgctgggtcaaatggtaattctgtttttagcttctgaaggaattgcaaccctgatttccacaatggttgaactaatttacactcccaccaacagtgtataagcattcctttttctccgcagccttgccagcatctgttaatttttgactgtttagtaatagtcattctgactggtatgagatggtatctcattgtggttttgatttgtatttcgctaatgatcagtgatgttgagctttttttgatatgcttattgcaaataaaataaaatgtatgtcttctttagaaaagtgtttgttcatgttctttgcccactttttaatggggttgtttttttttcttgtagatttgtttaagttccttttaggtgctgaatattagacctttgtcagatgcatagtttgcaaaaattttctcccattctgtaggttgtctgtttactcaatagtttcttttactgtacagaagcttttagttttctttagtttaattagatctcatttgtcaatttttgcttttgttgcaattgcttttggcattttgccatgaaatttttgcctgtgctatgtccagagtggtattgcctaggttgtcttccagggtttttatagttttaggttttacatttgtctttaattcatcttcagtcgatttttgtatatggtgtaagaaaggggtccagtttcagtcttctgcacgtgcctagccagttattccagcactatctgttgaatagggagtcctttctccattgcttgtttttatctgttttgtcaaagatcagatggttgtaggtatgtggccttattttgggggctctttattctgttccattggtttatatgtctgtttttgtaccagtaccatgctgttttggttactgtagccctgaagtatagtttgaagtcaggtagtgtgatgcctccagctttctttttccttaggattgccttggctattcaggctcttttttggttccatatgaatttttattttattttattttatttatttatttattttgagacagagtctcactctgtcacccaggctggagtgtagtggcacaatcttggctcactgcagcctctgcctcccagattcaagcaattctcctgcctcagcctcccgagtaactgggactacaggcccacaccactacggctggctaatttttgtatttttagtagagacggggtttcgccatgttgaccaggctggtctcaatctcctgacctcgggtgatttgccagtctcaacctcccaaagtgctgggattacagaggtgagccactgtgcctggccttatttttcttgagacaggatcttgctctttcccccaggctggagtgcagcagtgtgaaagtggcttactgcagcctcaacttccaggctccagcaatcccccgacattaacctcccaaatagctggaaccgcaggcacacaccagcatgcccagctaatttctgtttttttgtttgtttgtttgtttgtttgttggttggttggtttgcagagatggggttttgccatgttgctcaggctagtctcgaactcctgggctgaagcaacccacccacctcagcctcccaaagtgctgggattacaggtgtgagccatcgtgtgcagccccatttgaattttaaaatacttttttctagttctgtgatgaatgtcatggtagcttaataagaatagcattgaatctgtaaattgctttgggcaatatggccattttaatgatattgattcttcctgtccatgagcatggaatgttttttctatttgtttgtgtcatctctgatttcttcaatcaatattttgtagttttcattgtagagatttttcatctccctggatagctgtatttctaggtattttattttgtgtatgtggtaattgtggatgggattatgttcttaattaggctttggcttgactcttggtgtataggaatgctggtgattttttgtatcttgattttgtatcctgagactttgctgaagttgtttatcagcttaaggagcttttgggccaagattatggggtttcctaggtatagaatcatgcaaatagggatagtttgacttcctctcttcctacttggatgccttttatttctttctcttgcctggttactctggcaaggacttccaatactatattgaataggagtggtgagaggaggcatcctcgtcttgtgctggttttcaaaggaaatgcttccagctttttcccattcagtatgatgttggctgtgggtttgtcatagatggttcttattattttgagatatggtccttcaatacctagtttattgagagtttttaacatgaagcagtgttcattttatggaaagccttttctacaactattgagataatcgtgtggcttttgcctttagttctgtttatgtgatgaatcacagttactgatttgcatatgtcaaaccaaccttgcatcccagggaaaagtctacttgatcatggtggattcgctttttgatgtgctgctggattcaattttctttttttcttttgccaggttttggtatcaagatgatgctggcctcatagaatgagttagggaggagtccctcctcctcagttttttggaatagtttcagtaggaatggtactagctcttctttgtacatctgatagaatttggctgtgaattcatctgctcctggcctattttttagttggtaggctatttattactgattcagtttcggagctcattgttggtctgttcaaggattcagtttcttcctggttctgtcttgggagggtgtatgtgtccaggaatttatccatttcttctgacttttctagtttgtgtgcatagaggtgtttataatattctctgatggttatttgtatttctgtggggtcagtggtaatatcccctttaagactggataatttgcaacgaacagaaatgtgttggctcgtggttctctccacaatggagagtccaagatcaagggcatctggtgagattgctatatcattccatggtagaagaataaagcaggttgaggggaagagagagaggtaaaagggggctaaacttgtccttttattaggaactcactcccttgataacaaacccactcccatgataatggcattaatccattcatgagaacagagctctcatgacctaaactccacttaaaagtctcacctcccagtgccatttcactggcaattaaatttcaacaggagtttaggagggaacaaacatttgaaccatagcactgctcttggggaatttacagtccagagaagaaggcagactcaaaaagagattattatagtatgacatggtaagtgcctgcaggttatgcgagagaacagggaaaacttcctagaagagatgcccccgagccaaattttcaaaaataagcaggtggtaacccagaaaaaaaggggaaggaagacattccaccacttggggttacacacagaagcaaaatcatggatgtgcttgtgtggtatgtgctgaggcacatatggcttgcatggtatctgctgaggcagcaacccttgggtcttagaacatcaggatatacagtggtgatgaaaggcctaatcagccatgctgaggtgcttaggttttattctttaggccctggaaaccagtgaagggctcaaagtacaagaatgacagccagaacaaccccatcaaaaagtgggcaaaggatatgaacagacacttctcaaaagaagacatttatgcagccaaaagacacatgaaaaaatgctcatcatcactggccatcagagaaatgcaaatcaaaaccataatgagataccatctcacaccagttagaatggcaatcattaaaaagtcaggaaacaacaggtgctggagaggatgtggagaaatagaaacacttttacactgttggtgggactgtaaactagttcaaccattgtggaagtcagtgtggcgattcctcagggatctagaactagaaataccatttgacccagccatcccattactgggtatatatccaaaggactataaatcatgctgctataaagacacatgcacacttatgtttattgcggtactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaagcaaacaccacatattctcactcataggtgggaactgaacaatgagaacacatggacacaggaaggggaacatcacactctggggactgttgtggggtgggggcaggggggagggatagcattaggagatatacctaatgctaaatgacgagttaatgggtgcagcacaccagcatggcacatgtatacatatgtaactaacctgcacattgtgcacatgtaccgtaaaacttaaagtataataataattaaaaaaaataaaaaataaaaataaactgattaaaggcaaaaaaaaagaatgacagccagatttatatttcacgtagttcacttagtgctaaagtcagatttaaaagaagccaatgttttaaaggcatcaaaggcattcttcttgaagacaggaagacctatttgaaaggtaaaacagtagtattcacaaatgttgatgatggtgcgaactaggacagtagtgctgggaatcaaaaagaggaaaaagcttaaagaaatatttaggggctaaaatagttggaaacaactgtttagtaaagtgggcatgaatcaagcattcactctctgatcttttataaggaaacactaatgttgaaactttattttcccacattgacaagacctagaaggtagagtccttggaaagaatcccatcttatggaacaaaagcattccatgcttactacttttattgggggggcaggggcggttatattccttaaaaatcaaaataaatggtatcaaataattaagagatagtcaaattctctctaagggaaaaaatcctaattttgttttgagatttaagaaaaaatacaggtattctttcataattgtaatggagacgctaatgacaaatttagctcaaaaaatttacaaatattaactggaggcaatgaaatgacagaagatataaacataaaaaagaatgttaaaatacaaaatagaatcttccatataccaatacagcattcttaggggaaaaaaaaaaactacacaaagctcaaccacccatgtaacaaagatatttataatgtgtaaagtgttgtcggggacttagagactgtggaactagagaatatcagagtagcaaagaaacttgagttcatttttgtgttgaaatgaccaccctgttcatgttaaatataggaagcacaagtctagaaagaattaactgattttcccccagctaatacctaattaagattggagccaggattaaagtttttaccttttggctctcaagtactaacacattgtgttattgtgaagttttgagtagcatttcagaagtttgacatgtactggatttgcaagagacaaagtgttcaaaagtgctagtaaggaccgatttccttgaaaaagaaaacaaagctaatattgcaattatcaatatcagagtacttagtattattgtcctttagaatttttttcagacctgcaatttttattatatatgcataatataacatttaccatttttaatttacaattcattggcattaagtacatccacatttttttacaaacatcaccactaatcatttccaaaacttttttcatcttcctaaatggaaatgatgttcttattaaacaataactccctatcccctcctcccctcagcccctggcaactactattctactttctatccctatgaatttgactactttaggtacattatataagtggaattatgcagtgtttgccgttatgtgacttacttatttcacttagcataacgtcctcaagaaagggtaagtgaacttgaagacatagtaatagagattatctaaatttaagcataaagaaaaaatgcacagagcctctgtaacctgtggaacagtctaccatatgtataattggagtcaaagtatctcatataggtggagtctttgtaactggcttacttcacttagcataatattttcaaagtttatccatgttgtagcatgtttcagaattttcttccttttaaggctgaaaaatactccatttatgtacattacacattttgtttattcatctatcagtggacatttgggttgcttctacctttgggtattgtgaacaatgctgctattaacatgggaatacaaatacctgtttgagcccctgttttcagttcttttgagtatatacccaaaagtgggattgctggatcatatggtaattctatgtttaatttttttgaggacccaccatattgttttccataacagcaacactgcttttccttttagtttcttgcatcttctttgtaaagtccctattctgcatcttactcaccaagcctccttttcttatttcagtttagcctattttttttgtttcgtctcccatttgtaatccctcttttatgtcctcttatgcaattttgcatccccatatgtatgtatatctgtcatgtctaagtatacgtttgtgcaagaggaaaaatgtgtctgtacaggcaaggagctcagtaaacctcataccttctctgccaccctcaatctcagccccagcatttttgtggccatttaatactctgttacgtagagatacaaaaatttgttgattcagtgccctaaataaatacttttaagttggttctgtttgctatgatgaacttctttgaacacttatcttttggactcatgtctgtttccttaggtaaattcctagagctggaatttctaggccaaaggaaataacattcttgtttttgttttgttttattttgagtcaaggtctagttctgtcacccaggccggaatgcagtgttgcgatcgcagctcactgcagccttgaccttccaggctcaatcaatcctcccacctcagccttctgagtagctgggactacaggtgcataccaccatgcccaactaatttttatattttatttttggttgagacaaggtctcgccatgttgcccaggctgctctcgaactcctaacctaaagctatctgcccaccttggcctcccaaagtgcagtgattacagacgtgagacaccatacctggctggaaataacattttttaaacttttgaaatatattgcctatttgccttcataaaagttcttctgaaatacactcctactcacagtgtatgaaaaaggcctatttcctggatttttaacgaacacattactagttgagagatgttaaatgttttcatgtttgattacaagaggagatgttgaatgttttccagatgtttgttagttatttgtgtttcttttgtgagttgccagccatgggtcctttgtccatttttctgttggacactccttaagattttaaacaagacagttcaaagaaaagaaaatgtaaagatgctggttaagagttctgcagcaaagaagctaatagtataagagtgaaaggagaattttaagactctggctagcataaaatattgtggaaatatggatgagagagattctcaaccctggttgccctttagagtcagttaaaccagcctctccagggagggaatccaggcatcaatttttgttttttaaactccccataaattttaatgttccacaggggtagacaaaaagtgacttactgataaaagcaggaactatgaagtagagtgaatgtgacaaaatactgtagcaatttggagaaattaacctttaagagaaaggggttggagttattcctgatcaaggggagtcatgattggcacagataaacacatcagcgtataagtggcatcatacctggttatccagtctctctgctgtggtaatacagagtcttcactcttgacgacgtgttgtgtcacatgatgctgtccagtgatatcagttcttgaatgatgtgagttccgcccaggacagttgcctcctagttgagtggctgcaccttcctccattctgacagtgattgtacaatgttaaaactaagctgtaagctaagtgaggacagggtctgaatatctccagaacttcacacagagtctggaatgtagtaattgtaacaaatatatgcggagaatggactgagtatcataaaaaggatctgagattattccaatttcttccatagttatcatactaaatcaagattttcttcattgaatacaattttaatcactttttagtactttctacacagtgatgaacaacttttttgtcatatgatcttcaaggacaagttttctttgaattgtagaaggttcctcttatgacaactgattgaagacacgtttgaggccttaaattcttcatatgagcatttaaaatatttctatctgccttgccttaccttctttatgatttttatatcactagtttgacttggagtgtttcttgtatacatacagaaggctgctataaattatctctgtttgtatatggttgatgtgttttctaaataaaagctgagagttttgtttttgctttgggtttggggttttttgtttcagggtgttttgttttttttttgtttgtttcccagatacatcacatattaggtactggcttgtctctcatggtcaaaaatacgttcaaatgcaattcttctgtatcattgcagaaaataatttgtgcaacagttttttaagtaccctttaaaaattatattttacatctggatttttaccaccagtttaaaaaattacaattcatacactgttatagcaacaatattggttttttctgagttagaggtcttcattttgaagtgagaaatacaaacctacatttttagttacctaaattttcaaccaaatactctgccaaaagtcttttagaaactcaattttaaagtccttcaggctgtctcaatgaaaatcataagcagttctttggtattctgtcaagaccataaagaaaatagagtattatctaaaatgtttcttttaagccatttgaaattatcacagtaccttgctcaaagtagttactcagtgaacatttgtggagggaaggagggaatgcttgcatgccacagttgcccaagaatagcagctgtgtagaatgtctgtgtggggaccccgattccagcagaactttaaccctattgacagctgcaacaaggaaactgcattatttaactggttagttatttgggttgtaatgagcagaggatcatttcagttacttcaagaatggatacttgtttgcaaggtgacccagaattagcttaacagccaggtctcaggaagagcaggaaccagggaaggttcctaggaaatggattgttctttaatttttaccccagtgctccatcattaccctggccccactgccctcctcatgtgtgttccataccctcactcctctccccatttgcaggctttctctgcgagtatagcacctgctcattcccaaccctgccagtgttttgcctttactggcctcctttacccctctgcatccattcaagcttctgcttccaccacaaattgcttccttcttgccatgtttcttatttgatgggtgttcagctgtggtgtttcatatacattcattaagctaggctgactttctgtctgcttgacgttttgcttacctagggaattgcattaacatcacctaccgtgatggtggatttgacaatttcttgttgttgttatatatttttttggttttatgtattttacggctaatttattggttatacttagacttgaattattacattttcctgccgagtttaaccttttttctccctttcctgtggtgctgatgaatttaaccttttgattaaagtgagttaccatattttatctgtctttgccttaagcttttttattttttaatttttggctgatattgataaagctatccaggtttgttttagttgctatttgccttgtatatcttttcctgtctttttttcttttcacccttcaatgtgtctcataaacagcgcatacctgaattttagtcttttgttggcttgttttatttattaattttttttataactgcactacttttttctttttactagagaatgtaatccagtcacatttgttgggagttctgatttatttgaatttattttaaatgtgttacgttacaataaacggctctttagaacactatttttcaagctcattaagcctgtagagcaggggtccccaacccctgggccacagaccagtactgatctgtggtgtgttaagaaccaggctgcaaagcaggaggtgagtggcaggcaagtgagcaaagcttcatctgtatttacagccactccccattgctcacattacctcctaagctccacctcctgtcagatcagcagtagcattagtttctcatagtagcgtgaaccctatcgtgaactgcacatgcaagggatctaggctgtgcactggttttgagaatctaacgcctgatgatctaaggtggagctgaggcactgatgctagcattgaggagcagctgcaaatacagattaacattagcagagaggtttgactgcacagagaccatcataaatcaactgcttgcagacttatatcaaaaccctatcagtgagtggcaaatgacaattaagctgtatctggtggcaggcttaactttatagtggcaagtgagttgatgtacttcagttgtacagctgcatctggtagcaggccttaagtcagaatccaacagttattttagcccacacatggcccacccattattttatttaccatgcctctttctcacactgcacacttgtctcagtcacagttttggtaagcccatgagctaatcctagccaaattagtaaaaaataaacgtcactggagagcttctttgaaaaggggggaaagacccaatgatgagacagcagaagacttttaagactggcaacaaaatgaaagctgcatttaaaagaaaataccaagagtcctatttaaattacgggtgcattgaacctgctttgtataatatgtggtaactagctatccaacgaagccatgaaaccttcaaaactgctttgctacatggagaccaagcacctcgcattaaaaaacaagcttttgggtttttttgtttgtttgtttgtttgttttagtgaacacgaagaacagaagcaatcattgaaggccacagcttcatcaaatgtgtctgtactgagagtatcattgttagtggctaaatgcattgctaaagctaagaagtcctttactgttggtgaagagttgaccctgcctgctgctaaggacatttgtcttgaacttttaggagatcttgcagttaaaaaggtggcacaagttcctcattcagctggcaccataactagacaaattgatgaaatagcagaggacattgaggcacaattgttagagtggattaatgagtcactgtgatacgcagtccaggttgatgagtctaccgatgttgacaaggcaacaatgcttgttttgtgtaatgtatttttcaggaggatgtgcatgaggatatgttatgtgcacttttgttgccagcccacaccacagctgcagaactgttcaagtctttgcgtgattacatgtcaggaaaactgaactggtcattttgtgtgagtatatgcatggacagagtggctgccatggctggacagcttctggtttcactactcacatcaaagaggttgcttctgaatgtgagtctacacaccatgtcatccatagagaaatgctggctagccaaaaaatgtcacctgaacttaacagcattttgcaggatgtgattaaaattatcaaccacgttaaagtacatgcccttaactcacgtctcttcgcacagctctgtgaggaggtgggtgcagtgcacacatgtcttctctcacacacacaagtgagatggctttctaaaggtagatcactgatcagagtttttgagttacaagagccactccggagatttcttttagaaaaacagtcaccactggcagcacatttcagtgacacagaatgggttgcaaacctggcttccttgtgtgacatattcaacctgctcaacgaactcgatctgtcacttcaggggagaatgacaactgtgttcaaattgtcagataaaggggctgcattcaaagccaaactggaattatgggggtgacaagtgaacatggggatttctgacatgtttcaaacattagcagatattttgaaagagactgaaccagggccttctttcccccagctggtgcatgatcacctatctcagcttttaaaggagtttgagcattacttcccaaccacaaaagaccccccagactgggaaggaatggatctgcaacccatttgtggataagccaaggtgaatcgactttgtccgtgctggaaaaggaccaactgcttgagatcgcaaatgacggtggccttaaaagtatgttgaaacagcttcaaatcttcacacagtccggattgaagtcaaggcataatatccagagactgccccaaaagcactgaaaagcttgcttccatttccaacaccctatctttgtgaagcagagttttctgcagtaacagcaaccaaaacgagattatggagtagactggacataaacaacacacttcaggtatcactgtctcccgtcacccccagataggaccgtctagttgcaggaaaacaagctcagggctcctactgattcaacattatgatgagttgtataattattccattatatattacactgtaataataatagaaataaagtgcacaataaatggaatgtgcttggatcatcccaaaaccatttcctccccctggtccctggaaaaattgtcttccacaaaaccagtccctggtgccaaaaaggctggggaccactgctgtagagcacaggtaagtcacactttttgtggaataccacagaacattaagcttaagttaactatattcatacttcccatgaaattgtatgctctcttctgctagactataggttacataaagaatactgcactcgggtttaagaagaaaagttaaatttgataacatagtgtccattcacttaatgccttctgaattaagtaggaaaggagcaccattatttggccttgctgtctcagcatcttggttcagcttgaagaacaccagtgttcttcagaagtataattactattaaataaaaattacacaataaattataaaatcctaaaatataaataggtccaaggagctttaggtacatttctggataatattttgtaagttttggagtcagatcaaccttgctttgaatcctggccctgccatcttctactgggtgaacatggatatgttttgtaatctctctgattttcattctccttatctgtgaaataggatcaaaataataataactttctcatggggttattgtaatgattaagtgaattgatagttataaagtgtttagtgcagtatttatcatataataagtcctctagaaatatctgccattattaatgtattagttatttcaattggacttactatattaggactcccaaaggagatgattgtctgagttgaattttaaaggatttgaatggattagctcagctgagaagcaaaggaaagaactttcaggcataaagaataggctatgcaaagatatttgaaatacaagtaagattttaagaatgaacagtgtcaagagaccacgaggaaagccaccattctttcctgtgtaacatcacctagtgacacactcaaaacaagaagtggtggaaagggatgaaatataggttgtttttagtatagaattattgtttcttatgctcttatataaatgactgttaagtaaatatttgtgtgttttatgtattgaatatccaacattatagtcaaaattgaaagaataccaattgtcaaagaaagtagcatattgtggttaaaaactatagcaatggagtcagaagagctgaattaaaaattagctcaacccctaacagctatgtgtttttttgataagccaataccttttgaactctcactttttccctaaaacagatgatgataatgcctaccctagatcatcttacaaatatattgttaagctcaaaataacataatgagttcttgattatatatgatcaccaaaaatagtagataaattaaaatttaataattgattccagattacattattttgtcttatgctgatttatccttctaattatattttgcttaggataaaattaaaatctgtttttatttctttaaactacaccagcagatggcaaaaagatgtaacccagataattataatgtagtgacagaagtcattctggaatttaaaatttactataattaattggcaaaatagaaaataaaatattggttttgtagttatttgtcactgtcatttttattattttacaaatgcatacttttcttgtcttcagtgaatttaaaagcagttcatcaggaacttttgacaaatgactttgttccaccaaaccctttctgctctgtttttcagcattctgattttcccactttccagttcttgtacacatacctttgccatccaaaatagttgtccaatccccacttcctaatcccctatacatacatatacattttgcctgcccttgcctcttgcaatctctaattccaaaattagctcattccccacctccctatccaaccttttttcttcctctaggactgagctcagctggaaggaagtatatatatataattatccaaaaagatttgctgagcttaggtagtattttaatttttatgtgtatgtttaatattttgagtgataagcctctcctgacaccttgtatactcagccctccatgccatactggaagaataaaaaggatgtgccccttttcgtccccatttttctgaccatattcccaactaagtttataaagactcccgtcacataacttcattttcaattcggaaatttcataactggcttactttttcccttgggcctctgtcatacatagcacttttgccctgttctcaccccattgtattatttattatgtacctaggcatctgtcttctcaactttctataatataatttcttttaagctgtagaccgttcattcaaaaatatttacttctgcccatgttggagtaactagtgagcatccagagatcactagacatgcaaagaatcaggaaaatgtgatctataaccaagagtggggagaaaaccactcagtcaaaataaacacagaaaaacagggatggtggaattagcaaaaaggcattttttttttttttgagacagggtcttactctgtcactcaggctggagtgcagtggtgcaatcagagctcactgcagcctcaacctcctaggcacaagcaatcctcctgccccagcctcccaagtagctgcgaccacaggtgcacgccaccatacccagctaatttttaaattatttgtagagacaaggtctcactatgttgcccaggctggtctcaaactcttgagctcaaacaatcctcccacctcagccttttaaaatgttgggattacaggcatgagcaaccatgcccagccagaaagggattttaaaagacctgttacaaatatgctcagtgatttaaagaaaaagatgaacagaagaaaaatggaagatctatagatgaaccaaattccaggtctaaaaaatgaaaaatgcaatatctgaaataaaaaatccactggatgagcctaatagcagagtgaacatgacagaagaaaggataagtgaacttgaaaaactagtaaaagagattatctaaactgaagcacagagaaaaaaaatgcacagtgtctgtgacctgtggaacagcctaccatatatgtcactggagtctaagaataaaaggagagagaagcagagaggcactaaaagcgtttgaaaaaataatggctgaaattttttaaacttgatgcaaactatgcaaacaatgaacatccagcaggatgagcatgatataaactacatcagagcacattgtgatcaaattcctgcaaatcagttataaacagagactcttaaaagcatccagaggttaagaaaaaaaaggtacacattacatatagaggaacaaagattgattgcagacttcctgtcagaaacaagatgcaagtcagaagaaaataaaatctttaaagtgcttgaaaactaaactgtcaacatggaattctatatctttccaatataaaggggaaagataaagacttcctaaagactttttaggaaaataaaagaatttatcaccagaaaactcacactataataaatgttaaaggaagttcctttaggtggaaccaaaatgattccagatggaaacccagatccacccaaaggaatgaagacccccagaaatggtaaatatatgggtaaatacaaagactttttcttcacttctcaatttctttaaaaggcaattgacatttaaaattaataaagtaataacagtattgtgacgtttacatcatgtggaagtaaaatgtatgacaatagcacaaaggttaggaaggggaaatggaagaatatgtaaagtagattacatttttaagtaaagtggtatggtactgtttgaaaataaagtgtgatcagtttaagatgcatattgtaaaccctagatcaaccacttttaaaatactaggggaaaaaatcagccaggcatggtgacttatgcctgtaatcccaacactttgagaggccaaggtaggaggctcactttaggccaggagttcaagaccagccctgggcaacttactgagatttgtctctaccaaaaaaaaaaaaaaaaaaaaaaggaggaggagaagggaaggtagaatataacacacaaacagggaacgtaaaatggaatacagttaatccaaaagaaagcaggaaaagaaggaaatgagtattgtaatgtcatgtagtgatattgctatgaagaaaattgttgggaagcaatgcttcatgaatgttttcatgtttctgcatgatcaggactttctgagcaaagatttctggcaccggattaaagaattttgtttgtttgtttgtttgtttgtttgagaaggagtctcgctctgtcgcccaggctgcagttcagtggcgcgatctcggctcactgcaacctccgcctcctgggttcacgccattctcctgcctcagcctcccgagtaactgggactacaggtgcctgccaccacgcctggctaattttttgtatttttagtagagatgaggtttcaccgtgttagccaggatggtcttgatctcctgacctcgtgatctgcccacctcagcctcccaaagtgctgggattacaggcgtgagccgtcgcgcccggcctaaagaatgtttgaatggcaaacaagccttggaagttaaagacctgtggagagattcagagacttctccccaagataatttgttttccttctgaaggttgtaaacctagagaccctccccttctctccctgagaggatttgtttacaaagcaaaggtcagtaggtcatgtgcaggtgatgcatgctgcttcttcccccaccccagaggggagaaggagcagcagctgtgtgtgaaatgtcctatataggctccaaaatttactattagggagttattcttatcatgtaaccttgtgggggactggagaactaaagtataagtatttaaatgctgtctctgattcaaaaacctggtttttttttttctcagaatgaatgagtcaatacttaaaaattatattaagaagggagtgtctcctataaggtggtctgggaagtcctctctaaagaggtaacatttgagcagagatgtgaatgaagtcagccctgtaagactgtaacatgggagaagaccatatgtactaatctttattgtctctctcattgcctggtacactttttcacacataagtaagttttaaataaatagggctcaaggatatgacattgtgaaaggctggtcacttctggctagagtgttgtttgtccactctacaaattccagagtagctgcatcttcagacaaaatgacattttagtcgcagacattttagctaggaaaagatatgagtttcacgcctgtaatatcagtgctttgggaggccaaggtgggaggattgcttgaggccaggagttcaagagtagcctgggcaacatagcgagaccccatttctacaaaaaaaaaattagttgggcatggttgtgtgcccccgtagtcctagctaatcagaaggccaaggcaggaggattgcttgagcccaggagttcgaggttacagtgagctgtggttgtaccactgcactccagcctgggcaacagagcaagaccctgtctcttaaaaaaaaaagatatgggttagtaatcaaaatcagttaaaaactgcataaagcataatttatgtttcattaccttaaataaataacatatacgtctgcaaatgaagggttagggaacatagaatgaatttttagttgggagatttttttacagaggtagaaatagatgtcactcacttgattttgaaattactctcagccttttaaatgtggcatatacaaatgctgagaagaataaatatggttgaagaatacaggcagtaagaataataaattagtgtaatgaattttaattgggtaataattaatagtacaatctcctgttatagaggcttctgttgtcagaagcttgcagccaaaaggagaaaagatcagtgcaaaagccaaaaagcaacacatttggtgacttttggctgaagccaatattagcatgacctctttggttgaaagacttttcatccccctattaccgggtcattccttcctttggttcgaataatctctgagaatctgtaaaaaccacatcattgtcaagaagttaaaagcaattgataagttgttctggtaacacctgtcagtgaattaactcagagcacaaaacccaggcatttaaggagttgacaagtattattaaacctgttttgcaagagaagaagctggttcaaagagggaaaagctgtcaaaagtaatacaatcagtaagtggctcaggcctcctgcctggcacacccaggctctaaccacgtggcctctcatggcagggaagactggggccatgtatgaacatttatcactgttcctttcagtccaacctgaagacattgtggcattttaaaagctatgaatttgttttaaattcaaatatatttcttaggcatggttttctctgttcaggttttctccctcattcagaaatttacactatttttacctttaaatggtagtaacaatgtatttctactaatactgtttccttttctttttaatttgagcaatttaatttttctgtctttgacactctgttaaacctctttttttttttaattagaacaaatcatagtaatgctttcatcccaggagacggtgctttgtgcagatgctttcttgaacctgaacataatttcatgatttcaataaggaagaaagataggaaagtctcattcaaattaaattaggatttataattcagaaatgcttctgcctgtttgtaactaacttcctagttgctctctccactcttcagtttatttactttataaaaaattaaatccgccataaactgtcttagtctgggtttaacagaaaccagagcctaagacagaggcttaagtgcacatagtcagttagcactataacccccgagtcaagagcaggggacagggaagaaggaagagcgtatacaaaggtatttgacatttgcaagttgaccactggctgctcagtccttcaggacagtctgaagagacagaagcccaggggtggaatgagagcagcattcagtaaggctctgttaggtgacacctgcgagaagccagctggtgcccaccaagaactggtggctagtaaatgaggcagaggccacgtgaatctgatgtagtgacaagtggtatcgtataatacactaaaatattcttgtcgtatgtatttatgtgcataagaatataaaataacacacaaacttttagtccccacctttctttgtgaatacctgtcatttaacttttcactttttatgcatgtacatatcatgggagaacatatacctatatctttttccttttaaataacataaatcagccaggcacggtggctcacgcatgcaatccctacactttgggaggccgaggcaggaggatcgcctgagtccaaaagtttgagaccagcctgagcaacatggcaaaaccccgtctctataaaaaaatacaaaaaattaaccaggagtggtggtgtgcacctgtggtcccagctctctgggaggctaaggtgggaggatcatctgagcccaggaagttgaggctccagtgagccatttttgtgttccactccagcctcagcaactgagcagactctgtctcaaaaaaaaaaaaaaaaaaaaaatcaggccaggcgccatggatcacacctgtaatcccagctctttgggaggctgaagcagggggatcaggagttcaagaccagcttggacaataaaatgaaaccctatctctactaaaaatacaaaaaaaattagctgggcatggtggtgcatgcctgtaatttcagctactcgggaggctgaggcaggggaatcatttgaacccaggaggcagaggtaacagtgagccgagataacaccactgcattccagcctgggagacaaagtgagactccaccccccccccaaaaagaaatggaacatactaatctccttattccgtgaattattttcttcactcgtgtattacttgcatcagggttaggtttaatgccattgtcaacaagttgattttgccttgtaggagatacatcaggacacagtgatgaacatttgttgaattagtgcatgaatgaaggaatatatgacttctagttacagttcttgcttgtggaagaggaatgctgctgatactgggagtgcagtgggcaagatctggtaaaatatggagttgttattgtcggacagttgcccagtcatccctgccagtctccccctgcttccctaatcaacacctccacatcctcatttcagaacaggaatagatgctatacgggggagacacagaaaagagacaaagggaggctgggcgcggtggctcatgcctgtaaccccagcactttgggaggctaaggcaggcggatcacttaaggccaaaagttcgagaccagcctggccaacatgatgaaaccccctctctaccaaaaatacaaaaattagccttgcctggtggcgcacccctgtaatcccagctacttgggaggctgaggcaggagaatcacttgaatcaaggaggtggaggttgcagtgagccgagatcgtgccactgtactccagccttggtgacagagagagactctgtttaaaaaaaaaaagagagaaagagagacagagacagagacaaagggagactcttacaaaaatctgttcaatcagcaaatatctgttaacctcgtgtcaagtgacagacacattgcataaaatggagaacatgacagacttggtccctgtcctcatgcagggaaagtctacagttaagggaagaaagagacaagagtaggggaaggatgcagaagaaaaagaggagaaattagtaaaataccaaaagagtgaagaatttcagtgatcactgaattaatacaatgcttgtgttaatagaagttgtttagaaatgagtttaaatcccagccatctgctcccacatcaaacacacctactgtacccatgattttgcccttcccccacatatatatatacatcccagtaataatctggtgatttttaaatgaattctcacagttagtaataaaaattacacttgattcaaaccagtgaattgtaacccagatctaagtatagatgtagtggaaatcataagtttctttagtgacagtcttactaatcaagttatttggcctgtttttagccacatggtatattttttctttttcaggttgctctgagtgttgtttgtagcagcatcagtaagccaagaattcacatagttactcaatcacacagattactcatcattgcctgttcataacagaatcctaagatgtttaagatttctaatgcaaatcaaaatctcatcatcacttgtcattgctaaattaaatgacaggataataacattacattaaaaccatttttctcttgattgagtacctttttcagaagtgaaccttctagatgtatattttttttcatcagtactataaatgcatttagaatccaagataaaaatagaatttaaaggggaggagtgggatgttttcaaattattgatgaggctcttttgaatctcaaccatatttgacagtgtactgcaagggaatggagtagttcagctcaatttattgacacttttagagctatataaaggaggttaacaggttgagcttggtctttattgaagcaatcgtgtgttcttagcatcagttatatgtcatcccgttgcaaactggctgttaggacttgtcattgctctgttctaatataagatactgacttcagatagatcacaacctatgtggaaaattaatataaatttctaacctgtaaaagcagtgtaggttctcagtggccttaccattgtgaacttacctctttacctttctttcctatctaaagctagttaaccttttttggtcacacctaccctctttttatctgctccctctggcccttggcccacttctctgtggccagctagccagtgttcgtgccacctgagcccatcttcttcacttgccctagaactccccagaatgcctctttcattttaaagtcaatcatttccttccatccttcaaatattttatttcctcacaccttccatctttaataatatgaaatataaaaatcttaccctggatcaaaccttttattctttttgcctcacttaatactatcatcattaggcaataatagcattatggtaaaaattcttacctcttagagaagctgatgaaggtattgactcaaacaagattggctatgaaacaataagtattaaattattaaatctggatgataggtgaatgagggaaagggaagccagtatgctgttttctctacttttataggtttgtaatcttccataataaaaatttaaaaataacttagctctttagtgttccttttttaaaatagacaccctttttgagtgagcacgtgaaatgatgtggtatgcaggatggactaagactaaaacctgatcctgctctctgaacaccccactcttactctaccccttagtaaacaaaaaagattctttagcacctggaattgtaacttccctcttctccttaggtcctgtacttgattatcagaatcctggtctggtttaacacttcctgcttcttggtttaacacttcctgcttcttgttaaagtgaccagataaacccatatagaaatatacattaatttcatcccatttattaaatcccactgtgaataaagttctgtgctggcattaagaaagagaatatgaaggaaaagtattcatgaataaccctgatgcagtacaacactagccacagtagtggtctctaggagagagagaggaattctgtcaaggagactcattcttgataatgatgcaaactactaaatgtcatcctaaaggaagagataatcttcgttgcttctgcttatagttctaattgttaagactatttagagctctaccatatagccttccctctcttctaaagaacttaaattgattacagttaccaatatgcttttttcttctctttttaaattacaatagtcttacttctcgtttgccaaaaactggagaaaccatccatggacataagttttttattggctttggagggaaaggtgccaaccagtgtgtccaagctgctcggcttggagcaatgacgtccatggtgtgtaaggtaagtacaaagtatagtggagaggactctagaggtaagaatctggttttaagactggagttcattgtttttaattttttcaaccattttagagtgaacagttcagtggcatgtaatacatagagtggcatttaatacattcaaccaccacttctgtcttgttccagaactttaccatcattccaaaacaaaatcccttaccccttaagcagttcctcctcattctgtcttccctttaaagccctgggaaccaccagtcttcattctatctctatggatttatctattcgggacatttcatataaatggaatatatattatgtgacattttgtacctggcttctttcacttagcatactgtttttgaggtacaacattgtagcatatatcagtatttccttcctttttgtggttgaataatattccattgtatggatataccacaatttttttattcatcaatgaatggattgatggacacttgggctgtttccaccttttggctgttatgaatagcagtgctactaacatgcatatacatctacttgagtacctgctttcaattcttgtggaagtttattgtttttaaagatctaaataacagagaatagtctcccttgtcctttatactaatttctacctcattgaatcctctgggaagtagcagttctcaaataacttaatgctgcattccctgaatgtaatgagtttgtaactggggtgtgagaagtgagggaaattagcgtactccaatgggtttctgtcatccagcttctaaacaacagcatgagtcaccttgtttttagcaggtttcaccgcagcaacacagcttttggaaacttcttgtaataaccggtgatttactcatctctaagtcattttcttctaatgctgtatcttagatctgaaaagaatctgggccttaatgagctacatataactgagcttttggcatagttttgttttcatgtatgtagagatatgatattgtaacatacagtattcctatttttatccatgctaccgaaataatttgaaaataaatgggctgccaaaagttttcacttttcatttttcatgaaattttaaggcgctagcattatagcattagtataacaggaaaggtagatgattgtgtttctttgatttttagggaaagccagcctgtgtctgcacattattaaagggcaagaaaaatacaaggaacttaaaagaatgagctttctcctgtgaactatgtagattttaccaaaaattctcgaaatgtcatttttcattgcagtcagcacttttctctccacaggagttttaaatgatgtataaactatacaattatcactccatctgctagtaaactgtaattttatttctaacctatgattaacataattttcacatggctatttggtcaaaaacatcacgtgaagcatcagattcaaagcaagaaaccctcttttgctaagattgagctcttgatagatttaaaatatcagtgtaattaatcagcaattaattatgttccaggaattatgggtctgtgagaggtggctgattaaaaacttaggcctgacccatctcatacctgattagctatggagcgtttggagagtaatcagatggtgctgacttaattaagaggacctgggaactggaaagaggatgatataatttcctgtgtaggaaaacttggacatagaattggcgttggaagctatgcacccaaaatggcttcgctgggaagaggggagttcctagagctggagacattaaaggagagattagagaacccctctcttggatgttttatggaagctatttatgtagccattaaagtcaagattggatgtcccctgggatctcttccaaccctaagattatgaaattgattttattttaggtctgttgaatttgaggcaaagaaagaaatgacaaagagaaatatttgagttatggaactgaacgtgggaaatgaatcctaaaaccatatgagtggataggagaggaatagaagcagggggctgtattttgggaaatgttccagttaggaggttgattaaagcaaaggtaccatttgtgtgtgatggtttatgttagcatctgtacaattttgaaagttctatacatctaccatgcccctgatttagtcacctaatgcttagcaccacagtggattttagcctgtgtgtctgcctagcagaggatcaaaaaacatgactgcagctaaaacctatccagggtaactttggttagataacttggaacctttagacatggaattatttaaaagcttaagcaaattgcataatattctcagacttcttaaaaagaaaatcatatatttttgtaaaagaagttattatctgtccattaatcatattttatccattgtgagatacatttttattaagcaaattagccaaacttgctttatagcagttttttaaagatgacaagttctaagtagaaaccaaaaccatgaaatttatcaagataaaaatgaacagaaggagcaaaagaaaaacaggtaaaaattttctatggctttctcagcaagatttatttacctcttgctacctataacaaactaaaattcaaactcttatgaagtaagattgatggcccaaacaaacttatattgagctagggagaaatatttgttaagatattgtgacaaagaatattaaatgagttacctcattatttatacagtgatacatgtataatgaaacacttcaagtacttaagagttagtcagtatttagctgagtcatggaccaaagctacagtctagtgataactggagatggtattttcagatttaaaatcctggcagatattgtataaaatgaaagtcttcctcccagggcaaagagcctattaggacatctttcttaaatcttcacctgagttaagtgtttcctgctccattccattgaagccaaatgttaagaagaggaagttattcctaaacatcaaaagttggcagttcaggagaggaccatggtcaagtaaggaactcaagatgcactggcccagtatgagcacagaaaccatgagcaggtatgaacccaaatgacccaggtcaggaatcagcaaactggaaacaccttcaagaaattaccctgtcttgcttccttcaaatgtgagactatcaaactatccttcaaatatgagactatccttcatatatgagactatcaaactctctaatacaggtagctatctgttttcccttcagaaccatcaagcatgaagttttgtgacagaggtgatactgatgcaggctgccctgaggggcttagccaaggagggttcttggctttgcccaggcaagaatttaagagtgagccaaggataagaaaaagcaactttgtgtggtgggggggcggggggtagtaagaacacttaacttgagatctaccttcttaagagcattttaagcatacaataaagtattatgaactataggcacgatgtggtacagcagatctctggatcttattttatcttgccaaatgggcaggaggaaacttggaggtgatggatgtttattacactgattgtggtaatggttccacagatgtatgcatgtattcaaacccatcaaaatgtatacattaaatatatgcagggtttttattataattatatctcagtaaagctgttaaatattaaaaaaaaaaaaaaagaaaaagcaactttgattgaaccagtgctgcagggctaactgataggctatgtgcccagagggtagtgtatgggctgttagcaactatatttacatgtactttaaattatatgctaattaagaggcaggttattcagaactttttggaaaaagggtggggaatttccagaactataaaaggtaacttctgggccattgccatggcatttgtaaactatcttgggtccagtaggagtgtcttgtgctaatgagcagtgagagcaactagaggtcactttcctcttttcagccagcgtcttcattgcaccatgttttgaccagatcctgcttccaccagcagggtccaactggaaaataagacctgctggcctcctaactcggtacattaaggtggtgctgttcaaagtccagtcctcaggctggtgccaggctgcatgcagattgtcaccggtccaaacagcacaggaattgagagtaagcagttaggatcatttatagcaatttgacagaataactttacaaccgttgaatataatagtaataataaattaggccttgtagtttgtatgactcttttttgttttcatctccttgttattgtattttataaaattgttagtccacaatggattgaaaacaagaaaaggaaaacaaggccagtgcttctccacggatagcttgaaaagcagtgcattagagtatccatcaccttaaccaaaaagtaccttctgtgctagattactgtgggagaatcatctgatcatgcattgagattttcattttcagagatcaaaaattagtcaccaggtctttccaggtaatatataatgaggtgaaatctgtcctttcctgaactctgttgaaagacagctagatataattagttggctatgttgattggaatgcttagccatatgttcaaacaaatgatcctataaccaagcaaataatataaaccttgtataggaagaaatggtagaaatgagagaaaataactggattatctcaaacctatcaccactctcagataatcaggcctaataatggtgattgcagcattaactttgtatattaaaggtctttatttttttctgagacaggatctcactctgttgcccaggctagagtgcagtggtgcaatctgggctcactgcagcctcaacctccccgggctcaggtgatcttcctgcctcagcctcccaagtagctgtgactacaggcatattccaccatacccagctaatttttgtattttttgtagacaaggttttgccatgttgcccaggctggtctcaaactcctgagctcaagcaatctgcctgccttggcctcccaaagtgctgggattacaggtgtgcaccaccagcccaaaggcctttttttttttttttttttttcagagacaggttgcctgggctgtagtactacggtgctacagctcactgcagcctcaaactcctgggctcaagcaatcctcccacctcagcctccagagtagctgagactacaggcatgcagcaccacacccagctaattttttaattttttgtagagatggggtcttgctgtgttgctgaggctggtctcgaactcctgtcctcgagcagtcttaccacctcagcctcccaaaatgctaggattacggcataagccaccatgcctagcctaaaggccattattaaggtaaacacccctttatctaggatttaaacaaccagcaagctttaataactgagattttatatattcttcttatgtattttgttataaggccacaaatgacaagttaaaagttaatatgaaggatttattcaaaaaagcaacagctgggttttgtatgacaacaaatgcaacttagtctcctcaaccagctgttcactataaccctcaggcactgaaaagtgacaaaatgtcttcagttgcaaggattaaattatattcatcttagttttagtgttaaacatattttctgtattctaatgctttgaaatcggtaacctgttttaatatatgtgataacttcttgagcagaatattcaatttcatgtggccttgggtaggatgttttgatatcctgtgttttatttaccccaaatgtatgttgaggagtagaattactagatggtttctgccatttgaggattccaagcagcctaaacaaccattcctcagtcattttgcaaaatagaagttatgatgctgactgaagttgccctccttagcttcaggtcatagttctggactctggaagccctcccaaagctcttcttcaatgcagaaagatccctcccagtgataagagtgaaggaagcacctcagtccccttagctgaagaaatgctcttgttcctcatacacccagcccttttgctttccatgacccttgctgcattgtcaaatacagaagccactagccacatgtggatatttagatttaaatgtaatcaaagttaaaaaattgaattcctgtcacacagtctgtatttcgagtgtctgtattgggcagaacaaatagaaaacattttctgtattggacagcacagatatagaacatttcatcattgcagaaagttctattggatggcactactctacaatattcagggcggaactgagcctgggatttccaaagagcatgttgagttctgagagttcccttttggcttatgtgcaggtgcttgtccatagttgctcttgacctggcttccttcacgtggaacaagttaacacagacaggttatctcagactatgcgggtttccaagaatctttctacccaaaagtatttcactgctgtagtcaaaagagtgtgagggtgccttcaaggaggctgttggaaacaaaaccttgtatggaaccattctagaatagtttgggtgcttgtagtcatgttccttcaagaatggaacatgacagccgggtgtggtggctcacgcctgtaatcccagcactttgggaggctgagatgggcagatcacctgaggtcaggagttcgagaccaccctggctaacatggtgaaaccccatttctactaaaagtacaaaaattagccaggtgtgatggtgcacacctgtaatcccagctactcgggaggctgaggcaggagaatcacctgaacccaagaggcagaggttgcagtgagcggagatcgcaccattgcactccagcttgggcaacaagagcgaaactccgtctcaaaaataaaaaaataaaaaatttaaaaaaaaaagaatggaacatgactacaagatgggtccaaggaaaatgaacagaaggacaactaatgtgatcaaatcctaaagaatctccagtaagcttttaagaagactagactaacaaatatgaaatcgccaacaatataagatggtattgaactatgggcttgattaggaatgtcataggaggtgtggagatgagaggattaacaagggccagagtagggaaggtagaccttaagctgatacttgaaaaacaggtgaggtttgatttagtggaggagagagggcaaaggacttctaagttctcagaaatgatggtaaggaaacagacaggtttctttctattgatatatccagaaaggaacaattttctgtggaagaatagaacacaccaggagtgactgaaacctggattgagacatagtccattgaagtaatgctcacctgcaggacagaaaaatagaagttcagttcagaagtatagttcagaggtagcaagactaaaggcctacaggagccaagcaggtaacagaaattgcagtaggctaggtgaagccaagagtctatgagcactttaaggcactcacctctcagttccaggtggtttgccttgcaggaatgtggacccagtgttaccagaacctctgaattttcagaaccccctggacatctgtctgtttttgtgaagtcttctaatatttaagtattgagaactgataaaaatagcagggcatttacaccaaaacctgcacacagatatttatagcagctttattcataatttcccaaacttggaagacatcctttagtagataaatggataaataaactctggtacatcgagacaatggaatatcattcagccctaaaaagaaattagctatcaaggcataaaaagacacagaggaactttagttgcatattactaagtaaaagaagtcaatctgaaaaggctgcatactgtgtaattacaactgtatgatattctggaaaaggcaaaactatggagacaaaagattagtggttgccagaggctagtggggagagaaggatgaatatacaaagcatagaggatttttagggtagtgaaactattgtgtatagtactataatggtgggtatatgacattttacatttgttaaaccctatagaatatccgacaccaagggtgaaccctaatgtaaactatggagtttgagtgataatgatatgtcatgtaggtttatcagttgtaacaaagtaccacttagttgcaggatgttaatagtgggggatactagttgccggaggagacagagagtatatgggaactctgtactttctactctcttaggctgagaacctaaaactgtttttaaaataaagtctagtttttagaaaacagtagtagggcaaacaaaacatatctagcagtcagattgaactttcagcccaccaatttacaacctctgctgtagattcaactgtagagttcaagccaaggtccagccaaggtagcagtcagacaaatggttagcattagaggggtatgggagaagataacaagggtgtcctgactagcacagtgattgcagcaccacggaggccagaaacggacagtagggagatgtcgataagatgccagcattagtatcaaaggccttgcaatcatagttttctggttttgagccacagacctaaaggcctggcccctgcaaatggctggccaggcagagaagagtgcctgttctgaaagagctagagggctaaccagatgattaggatacacactcatgctgacaaaaacaggggagatccagttaccaaagtggaccacaaagcaagaatgtggtcacaggatccagtcacagacaaagctacttaaattatagttcagtggttcagggttacactaggcactaggctaactagctttttcttttcttttttttctttttttctttttctttttttttttttttttttttttttttgagacagagtcttgctctgtcgcccaggctggagtgcagtggcacaatctcagcttactgcaacctccgcctcctgggtttaagcagttctacctcagcctctcaagtaactgggactacaggcgtgcgccaccacacccggctgatttttgtattttcagtagagatggggttttaccatgttgaccaggctggcctcgaactcctgacctcaggtgatccatccgccttgacctcccaaagtgttgggattacaggcatgagccaccgcacccagcctgaagctagtcaggactttgttaataacagacaatagacacccaattcaaaatagcttaagcaaaaaaaaataaaataaaatttttaaaaagaatgtattgcctcatgtaactgaaaagcccagtggtagagctggcttcagatgacttagggttccattaggctattaggagtctgtgtctgtttgtgtctgtcaccctcctgctttctgttatgtttctctcttttctttctagctgtctccacatggtgagccccagtggctgcaggcttacattctcttatagccagcaatcttactgggaagaaaacttgtcttccctggtagtttcagtaaaagtcccaggactgagtcttattggactagtttaggtcacatgctcattcatgaacccatcactgtgactaggatggtggaacacacttttttttttttttttttgagacagtctcactctgtcacccagactatagtgcagtggtgtgacctcggctcactgcaacctccacctccgggttcaagcaattctcctgcttcagcctcccgagtagctgggactacaaggaacatgctttttaatcaggcctgggtcccttggccaacctaatcttgttgtctatagaatgggacagaaataggtgtccaaaggaaaaactgaaatacctttaacagaatagatgctaggatgcaaaaacacaattccattataccaagttacccaagttagctagggcctttaaaatttccttctctttgcctctatgtgtcagtgtcaagggagaagataaaaagattctggaacatcaggcaagtcatgacaaagatacccatatttacagtgaagtacaaacagctgagattcttcataaatattgaggattgatgatggtagataactctatctcagtgggaattatcacatgaacagctcaaaatgagaatgacttaatgagtgatgttcattaaatacttcacattttaagtaggatataagtgaaacattatataacaattctttgggctgcaatcaagtctagcatcttatattaagaagattaattagttaatgtttataaagtactgtgcagatatgcccttttaaaatgctaagtattctaaaaactacattgtagcattttactaactctaaaagatctaatattcattatttctttggtacaggttggcaaagattcttttggcaatgattatatagaaaacttaaaacagaatgatatttctacaggtaaaattcccaccttttttaaagttagtgtttatagcttttttctgtgattttgttatgagaaaaattgaatctagaggaggattattagaccttcccctggtggccagagaatttctatgcacagctttgtccattcttgcttaaatgtccttgggttgattcttccctgtacattcctccagatgggaataaaatgataggaggttacaaaccttcatctcatgaacatgtgacaaatgacaaggagaaaaaggtgctgcattcacaaaagatgttttaagaatgttatagctggcaacaatcattagaagccatacaggctgaaaccattatttcacagaagagaaaaccgaaggtcagagatgttctgtgatttctgcaagagcacacagttggttggagctagagccaggactagaatgaagatcttctgattccagttcagggctctttgctgctaccaaaggctgcctggtcaacatttctgtttatatgccagaccttggttcttggtgaaataacaagcttatgagaatgaaaataatcaaacaagttcattttatagatttgacctttactttttatctcaactctgacattcctttcaatgaagaacataagtgtgttggtctagaaaaatgcatatgtatacaattatgaataattggggggaatcgaaagtaggagcagtttggtgggttgttactaatgcagagaaaaggtgcaactacatgtaaagctgtctatttttcttgttgtatagatgatgggtataaattagcactaattacttatttttttttatcattccagatggttaaaggttaaaaaggttttccaaggattagtgttgtattgaaattgttaaaataaattatccatgccagcctgtatacatgtgattgtaattttcttttttctttcagaatttacatatcagactaaagatgctgctacaggaactgcttctataattgtcaataatgaaggtaagtgttttgcatattggagtgtcatttcataagacagtgtatttccagagttagatcagaagcatcaatttttaccataatcctatggacctcttactatacccatcactccaaggcctaaaacatagtttttccaatccaaatataaatgtgtttccctttatttatacttctcacatggatcgttcagataaatttttggacaattttcaaaattgtcaatccaatatatatgaagttgcctcaaaataatatgtatatgctgtaatgtccccattacccttcatgtgaacttataattgacatttgtctctaaaagcagtcaagcattcatctgtcatttcagttacactaggtaagtatatgtaaataggtgcaaagaaaagtttgatgagtcatatttatagaatatgttctgagcaaatggcagcaactaattacatccaacttatcgttagtgttcaattttgtctttcaacagcaatcaaatctcaaaagtctatatatacaactaagtctgccacaaggctttgccatagctgatacatttatcttttaaaatagtaattgggcctggcacagtggctcacacctgtaatgccaatgctttcagaggctaaagtgggaggatcacttgaggccaggaattcaaggctgcagtgagccacagtcccaccactgcacttcagcctgcgtgacagagtgagactctgactctaaataaataaatgcatgagtgaatgaatgaatgaatgaatgaattaaaacagaggctgagcgtagtggctcatgcctataatctcagcattttgggaggccaaggcaggtggatcatttgaggtcaggagttcaagaccagcctgaccaacatagtaaaaccccatctctactgaaaatgcaaaaacaattagccaggcctggtggcaaatgcctgtaatctcagctactcaggaggctgaggcaggagaatcgcttgaactcacaaggcggaggttgcagtgagccaagattgggtgactacactccagcctgggcgacgacggagcaagactctgtctcaaaaaaaaaaaaatggtaacaaccttcaagtcaagttttcataatttctgccaactgttttaattataaaaacgcctacataagtttttttaaatcagaatcaatattcagaaggaccaagcatttcctggggcacctaggacagaacctcatgtgttgtggacagcgtgcttgtgttaaatgaggatttgtcacaatgtgtcttttatttataatgcagctttgcagcatcatttctcacagaaaatatggtatttttaactcggctttagtgattccaagtagcaataataacgatatatttcacctaaaggtggtagataaaagtttgcattctaactatagaaagcctgtgttcatttaagctacattttaagtaactattcctgccaacagcagctcattccttgtcttaaacctcttttgttgttgttgttgttgttgttgttgttctaggactatcctcaagttctctttcttatctatgaacaaaatctgcattttccatgcaaagatataatgtcatagtgtgtgtcaagtgcctatttggtagaccttgcctggtttacagtgtacggtaatgccctcaagactataggtggtaatagaagaattaggacaaatacacagagatgggacaatcagctcctttaaatgaaggagtgagtttgcaagataaagtaatgagtttagttttgactagttaaatttgaggcatgaataagctagccatatggcattatccatcagacagctatagtcttgggcttgctgcttagcagctaaggccaggccaaaaatttggatctgggagacagcaacatggaagcagcagctgactccaacagagaaaatgaggtcactgaagaaaaggaaggagagatgctgtctttcagcaagtgggaactttgaatttttctaggactgaggttaggtttatgctgaaccatccccactttattaagtcttcctcgtggccaacaaacacatctgtggtaagatgataggatagaatttgttctgtgttgagaggtgattttaggtcatgtctgtacaagatcagcacgagcagcccggagcacagaaaatgcctgctacaactcattcctccagatcagtgttgtccaataaaaataaaatgcaagcctcgtgtggaattttaaattgtctagtagccacattttaaaaagtaaaaaggaacaggtaaatttaacttaggccatatatttaacccaatatgtccaaaatattatcattacagtgtgtaatcaaaaatttatcttggctgggtacggtagcccacacctgtaatccccgcactttgggaggccaaggcgggtagatcacatgaggtcaggagttcgagactagcctggccaacatagtgaaaccccatctctactaaaaatgcaaaaaaaaattagccaggcgtggcggcacacccctgcaataccagctacttgggaggcttaggtgggagagttgattgaacccaggaggtggaggctgcagtgagccaagatcgcacgactgcactccagcctgggcaacagagtgagaccccaaaatttatcttaatttttttttaatttttaaaatggtaagaataaatggatattttaccttatttcctttgtactatctttgaaatccgcttgtattttacttgaagcacacctcagtggactagccacatttctttttttttttttttttctgagacagagtctcactcactcttgcccaggctggaatgcaatgacacaatctcaggtcactgctacctccgcctcccaggtttaagcgactctcacgcctcaggctcctaagtagctgcgactgcaggcacataccaccacgcccagctaatttttgtaattttagtagagatgggttttcaccatttgaccaggctggtcttcaactcctgacctcaagtgatctgcccacctcggcctcccaaagtgctagaaattataggtatgagccactctgcccagccaggactagccacatttcaaatgttcaatggccatgtgtggctcgtgctcatgactaccatgttggacagcacagctcttaagggttcaccttacagatgaaatgcaccaccacccctgcctcattcaggtgggattatagacagcaggtccaagtaataagaatatatcagattccttagttctgtttctgtttgatccattatagtataagccaggtatccctctctcctctatatctgatacaattttctatctgttagatatttaaaatgtgttttgattgacagaatcactttttagaataccatagggtacacacatgaactgcttgcatactacagtgtcatacaagtttattcctatttatattcatctctatggcatctgtcatttaggattcagaacctttaccgcatacatatactagctattttctataaaagaaatgtttaaagtatgttatatgtcatttctcaactaatattctttatatataagaatattgggaaaatctttttaagattttgcttaaggtgatcagaataatgtgcatcttacagagatattataaaagatacatttggaactcaaagttcaagctgaataacctagaaatgctaaaattaatacttaataacacattttgtataatgactttacaagggcgattgtattcataacactgcagaatatcatttgcttggctttgtttagttttaatataataggtggaatttctttataggccagaatatcattgtcatagtggctggagcaaatttacttttgaatacggaggatctgagggcagcagccaatgtcattagcagagccaaagtcatggtctgccagctcgaaataactccagcaacttctttggaagccctaacaatggcccgcaggagtggaggtaattatacatatttgtcattctttctataaaagcttttatcgctgtcttaattaaagttaaccttttaagttaagcaaagcaatactctttctgtcgtaaaatattctttcttccatctgtgagattcacagtcttgtggttcttgataatgttagaaaaccttgcaaacagggtaaaaaaaaaaacatgagtagcatttccgatatcccgcaatataaatcttcaatgtagctggcagaaatggtacaagtagaattagaattcctgtaattccagctactcaggaggctgaggcaggagaatcgcttgaaccctagaggtggaggttgcagtgagccgagatcgctctgctgcactctagcctgggtgacaagagtgagactccgtctcaaaaaaaaaaaaaagaattcctgaatcagccccttgtccaaggtacactctaggtggtgaaatgttttctactctgagaagcagaggttaagctgcatgtcatacatacaaatacatgcatacatacaaaagtaactggggcagcccagttactttttgacaaacatctctaggaattgaagattaggttttttctcctttttgtaaaactttatcatctttcaataaacaacaaaagattatttatatgtaatattttctatgttatcaatgtccattgacattgcctcttttgtttttgattttggaaattttcaaacctacaaaagcagcagaattgtacagtgaaatccatcacccagcttccagttatcaacctgtagctaatcttgattcatcttttctcccactcactcctcttttctcacctccagcaaataacaaactttttaaaaatccagatgatttatttgtttgcttccttttcaccactgactagtggggaaagcatcttctgaattagaatcccatttctgtcccttgtcagcttcgtggtcctagcagaattacctgatttgtctgagccttttcagtaaaatgcatatagaaatactccatctgcagaattgttctcaggatggaataaaataaaataggatgccaagcatggtgtagtacatggtggtaaatcccaattttttcctcttcaatccacttctctctttaaagttaggataatatcctgatcaagcatcatttggtgaaaaaaatcaaaataaatagtagccactctaacatgatgacttcttgatattgtggcaatagttctgtgatttttttaaagaataaaatagagaaccacactgactatttctcaagatacaaaactaaaaagaaaaaagaaaaagaacagtgtgtgtgtgtgtgtgtgtgtgtgtgtgtgtttatataagtgatttctcccaaagtgtgtagtgttctacatagaaataaatggaaaataagtcactgaaatgattttgtggagaattttaaaatgttcgtcctgatttaacaaattttcctcttggcaaaacaacatgctgtggtaaattttccctgacatttagtgtatttttaatggacatgaagctgtcagaaagaattctaagccaaaacccatttggttccattttcttggagtgtcacagtaaagtctaatgcttatggttacgcattctctgcaccgtgcccatctcagcagagtgatgtgaatacagggtgccaccctgctcctgctcttgtctttctttgtatagatcaaagcacattctcgtgtaacttctctttttttcctactatcccttactgctcagagatcactgttccctctgtcctagtctagttgcctgttacctaccctgcttgtgaaggagagaaagatacagcagccacagttgaggagctaacctttcacaggtgagaatagagtaatccggatgggcaggcagcctaccctggggctgtcattgggtggggtccagaaaggcttcctccatcaccttccgtgtagctcttccagttgggagctggaggacccaggacagcaggaagcggggtaggtgacagtgggccacagaccacttggcctacttcacacttttattaagagccagcatgccttggtattaattctgcatgaacttccttatataataatagcagaaatagtaataccatgcatttatatgtactttacatcttataaagtactttcgtacacattttaccctcagaaaaaccttatgacaaagatatggcaggcattgttctctcagattaaaggtgagaagactgagactgagaggttaagtcatttgttcaaacagtgtcgcactttaagttgaagaaaccatgatttcagactctaagacccaagttctgtctcctagtttaaaccacactttaaagtgccacaacccattgattccaacaaactgagcctttatgaagagtatctctagaaaagtcaagtccataaattttaacactgtccagcacgtggcctaagctttatgtgtttttgctgctcaagaaacagagaagaggctctacagtgttttcagcactgtaaccccaatagaacttacacacacacacacgaacacacatgcacacaagcacacacactcatgtgtccattactcctccagtccggtggctttctctggccaagtcagctggtccctatttggtagataccggccagatgcagcttagattctattccatgaggagggtgtgtgtgtgtgtgtgtgtgtgtgtgtgtgcgcgcgcgcgtgtgtgtgtgtgtgtgtgtgtgtgtgtaatgcatcatcattctcatatgcaagaagagtggtatcccagcactttgggaggccgaggtgggtggatcatgaggtcaagagatcgagaccatcctggctaacacggtgaaaccccatctctactcaaaatacaaaaaaattagccgggcatggtggtgggtgcctgtagtcccagctactcgggaggctgaggcaggagaatggtgtgaacccaggaggcggaacttgcagtgagctgagatcgcgccactccactccagcctgggtgacagagcgagactccatctcaaaaaaaaaaaaaaaaagaagaagagtggtataatgaaaggagaccattggtttgggaattgtgaaatatggctttaaattcataatcaatcagcaaatgggggatctcagtcaagtaagtcagttcctcactctggacgtcattttcttcttctgtgaaaccagaattgggctgacagctctcacagttctttcatgtcactttggactgatcccagagcagagtgggcttaatgatctcttgagcactgagcaccctacccactgccccaggaagctgcctatgtgctgaacagcattattccgtcttcaagaacgatgataaagtcttcatcgtcatcatcatctatgggttttcttatcacagttccattatctttactgcttacaggtagtgaattttgaattaagcacattgcataactagattatgctaatatatcagttatgaaaatccagaggaaaagatccctacatctttgaatatactgtctcaaaactctctgtcgctatcaaaatgaaagcattgatttttaaagacatagtagctacaacaccaaaaatcggtagccctgtatagccacccccatccccaccaggccatgaagctatgaggtaggcccactgaagagccagtgctgcagctgcttgtgatgaaattatgcatgttggttctggtctttatatccatttccaagcaaatggaacagtacataaacaattataaataattgagattgtaaaattgccaaagttaaattatcagtatgatacaaagtatcttttaatgccacttcagtccttttgcctttggcaaacaaaacttcttatctggccatccagactttcacaatgacattgtccagcacatagcccaagctttgagtgtttttgctgctcaagtcacagaaaagagcctctagagtaatggacagcaaagccagtattttgagtgtcccaacatgctcacagtgtcttcactcagggtgattttcttccccggtttctctgagctaataattagggccttcctaactgtccagcccctgccctccgtgacaacaccataaagagtttctgcctcattttcctgccttttagcctatacaactgctcctccaggcctcaccagttccttattgacattattgtgctatccattaacatgcagttaagataactaggagtttagttcatctgacactgtaattaataataattactgttgggtgctaccagtcacctctgcaactccaagttactccatggtacagtctgtgttctctagctctgcctggtcccaggatgacatcatggcttccaccttgtctattacagatttgcattcttctttgattaactgcatctactaatttatgtttctttcatcatggtggagtatgctcatttgtggtagcacaagctgagaagaatgctttctttatggcatttacacttttcccctaaatttagttaccagtcagactctaagcctatgtatccagttactattgaagaatgctgtccctcagtaaagtacaggcaaataaggttgatttttatacagtatttacagtaaaattatggaattccttattctagcaattggtacctaaattttaatgtaattttttccttaaaatttgcttttattgtggaaaatttcaaatatatatagacatacagagaatagtatggtaaacctatatatactatcatttagcttcaacagttaccaacatgtggccagtctttttttctacttttaaattccatcttttattttagacacgggggtacatgtgcagacttgtttttgttttgtttttgtttgtttgagatagagtctcattctgcccgcccaggctggagtgcagtggcatgatctcagctcactgcagcctccacctcccatattcaagtgattcttatgcctcagcctcccaagtagctgggattacaggcaggcaccaccacacccagctaatttttgtatttttaatagagatggggcttcaccatgttggccaggcttgtcttgaacttcttacctcaggtgatccacctgcctcaacctcccaaagtactgggattacaggcatgaaccaccgcaccaggccttcatatgcagatttgttacatgggagtattgcgcccaggtagggagcacggtactcaataggtagcttttcaacctgtgcccctccctgctccagtactctgtagtgtctgttgttcccatctttctgtccatgcgtactcaatatttagcccccacttataagtgaatacatgtggtatttggttttctgttcttattttaatttgattaggattatggcctccagctccatctatgttgctgccaaggacatgatttcattcctttttacggctacatagtattccatggtatatatgtaccacattttctttatccagtccaccattgatgggcacctaggttgattccatgtctttgctattgtgactagcatggtgatgaacatacaagtacatgtttcctttaggtataatgatctgttttcctttgggtgtgtaccaggcataggattgctgggtcaaatggtaggtctattttaagttctttgagaatcaatctccaaactgctttctacatgactgaactaagttacattcctgccaacagtgtataagtgtttccttctctctgcagcctcaccagcatctgttgtgttttgactttttgttttttgtttcgttttgttttgttttgttttttgagatggagtctcgctctatcgcccaggctggagtgcagtggcacgatctcggctcactgcaagctccacctcccagattcacgccattctcctgcctcagcctcccgagtagctgggactacaggcacctgccaccatgcccggctaatatttttgtatttttagtagagacagggtttcaccgtgttagccaggatgatcttaatctcccgatcctcgtgatctgcctgcctcggccgcccaaagtgctgggattacaggtgtgagccacctcggctggcccttgactttttaataatagctgttttgactggtgtgagatggtatctcattatagtttgatttgcatttctctgatgatgagtgaaacgatgagtagtttttcatatgttttttggcccactcgtgtatcttcttttgagaaatgtctgttcatgtcctttgcccattttttaacagagttgttttttgcttgtcgatttatgtaagttccttatagattctgcatattagacctttgtcagatgcatagtttgcaaatattttctcccattctataggttttctgtttactctattgaccatttcttttgctatgcagaagctatttagtttaattaagtcccacttgtcaatttttgtttttgttacagttgctttgggggacttagccaaaaattctttgccaatgccagtgtcaaaaagggtattttctaagctttcttctaggatttttatagtttgaggtcttacatttaaaatatttaatccatcttgagttaatttttgtatatggtgaaagataagggtctagtttcattcttctgcatatggctagccaggtattccagcatcatttattgaatagggagtcttttccccattgcttgtttttgtcgcacatggccaatcttgttttatctgtatcctgcctcatggctccctaccccgcactgccaccttgaattatgttgaagcaaaacccagatgttatatcatttcgtttatagtatacctgttttttgatgtaagatactattattagtagtagtattttttgagacagaatctcactctgtcaccaggctggagtgcagtggcatgatctcggctcaccacaccctccgcctcccaggttcaagcgattgtcctgcctcagcctcccaagtagctgggactaacaagcgcatgccaccacgcctggcaaatttttgtatttttagtagagacggggtttcagcatgttggccaggatggcctcgatctcttgactttttgatctacccccctcagcctcccaaagtgctaggattacaggcatgagccactgtgcccggccagatactatgtgttttaagagtaatgtctttacctcatacagcacttaacctgtagtcaaatttagtcctatcagctttttataactaatggctcattagtttggtgagaaacctctccgacattttttccttctatgtaagtgtataaatgtaaatacacatatagttatgtgtgcttgttatttgttcttattaaaaaggggaggtaggccgggcacggtggctcacacctgtaatcttagcattttgggaggccaaggtgtgaggatcgcttgagcccaggaattcaagaacagcctaggcaacatggcaaaacctcatctctaccaaaaaaaaaaaaaaaaaaaattgcccaagcatggtgataggcccattagtcccagctacttgggaggctgaggtgggaggatcacttgagtctgggaggtggaggttgcagtgagccaagattgcgccactatactccagcctgggtgacagagccatctcagaaaagggggggtggggtgggtgggtagtacaaaacttccttgttcacttataaataaattatagaaatctttcttgataaacggagatctactttactctttttaacagctgtagtgatctacatcagacgtgtcataattcttttttttcttttttttttttttgagacagagtttcgctcttgttgcccaggctggagtgcaatgacgcgatctcagctcactgtagcctccacctcccgggttcaagcgattctcctgccccagcctctggagtagctgggattacaggcacgcaccaccatgcctggctaatttttatacttttagtgaagacagagtttcaccatgttggtcaggctggtctcaaactcctgacctcagttgatccacccgcctcagcttcccaaattgctgggattacaggcatgagccaccacgcccagcctatgtcataattttttaaaccaatcccctttagtaaaagtttctttttgtgttttctattgcaaacagagctgtacaaacaacattgtatatcatctttgcatgcttatggatttctgtaggatgggtttagaaaaggaattacaggatcatgcatctttgagggaaaaaattgatcttttaagaatggctctaccatgttgttccacacttgtagctttgctctaatctgtgctcaaatgctgatgaatgtagatttgtggattacactaggtgagcagttgtttccatttaatgcttgaggaaaactgggaacagtatattgttctgaaaacctaaaaagtttaagtgagtgtgttagaatactggacaatgagagcctttatgtgtaattgacatctctaagacctctcagaagtgagagaaccaatgagagagactgttgccaggctacaaactccagcagaaggcagaagagatgggtagacaggcgggggtgttgggctatctgtaaaggacaatataataacagtaataatcctttacatttgtacagcaggttagattttacactgggcttttacatccattttctaatttaagctgcacaataactctatacaaaaatctgagcagccaaaaatataccatagaatttctgtgggtggacattctggattctgaaataacaaaaatgtgggaatagtgttagcctatactggacaagacccactgactgaatcaaaatgctaggtaagaccaaggaaggtgcagaagtagactagatgtcctcaccaggctgaagcagtagacagtttccattagccacgtgctgattagcatctccccaagaatgtggaatgcattagtgccaagctggctatgtgagagcctcatggagaacttgtgaatatgcagattccctgatcttacccccagagattctgattcagtgggtttgaggtcagtcctagaaattatgcattttaacaagctttcctagtgatgctgataggcaaccaagtttgcaaagcactgttattgaagtctctgagaactgcagctagagatttttacactatgggtctatagtcaaatgagactacttaacacgcaagtcagtggacctgggttgagaaaaagaagactaaccaatctagtactcaagtgaattagtgctttgacaaagaaggagcttcctatgaatgtaatttctaaagacttgaaatatatatatatctacatttacgaagtcccaaaccaaagggtgttttaaaatattgtgaattggcattgaggtatgtgttggtgtggacagagtcctggcctagagaggcccctttttctagagtggaccaaaccgtgaacttaaagccagaggaccctgagtaggggtccatcttaattgtgtcccaatgtatgaactgagacataggacctcatctttctgagcttcactttcctccctctgaaaaatggccatgatattctcatttccctgtgtctgctattcccatctatccttctcttgtagcctctccgtctgagctagcaccagcctctgactgaattcctcctcctttctcaatcttttttttaatattcccagattgctcacagaagccaagaatgtaagcttttgtgtaagtgcatatgtttgcaggagtaattgtgatatatttgggaggcatacataggtgtacaaaatatgcatacgcacatgagcttcccgcttactgttcccaccgggagaattctgaacctttcattgtttattttctatcgtctctttttcttccctggaaaatgggtttatgaactagccttgaaaccaagcacttaaagtaacccacaaaaatgtccaccagcctgttcacattcacacatgccctttcatgccacagcatttttacttttctctaatgttcctgttgcctttgccttaactctataatcacgttgactgttatattgctcttttccctggaagctgaaatgttgtaaagtacaaagtaaagaaaatggaaatagggaattggtacccagctgtcgtgaagattgagatttcagacttttctctacatccgtaactaagtggatatttaaccagatgaagacaaaaacgaactcggggattttccctactgaatgttgtctgtaaatgcaccatgttaaaaatgaaaactaataataacccccttttccattcctttgtagtgaaaaccttgttcaatccagcccctgccattgctgacctggatccccagttctacaccctctcagatgtgttctgctgcaatgaaagtgaggtaagggtgaattgctttgctcattctatgagaaaccaaaagtttgtacaagtggataaagcaaaggggcagaactaaccacatcaatttgatgacgtgaattctcaggcatggtgaaaacagattttttcagtttaccggggtgtggagaaaaggaaattagtaaatcctaggggggaaaaaaggattctctgagtcacttccatattctggcacttatcaaacctcagttaattttagtcccttccttgccctcacactgttggtgttttgttttcttttctaattatttcatgttctgaggactatattaaagttgccaggtttagcaagtaaaaatgcaggatgcccagttaaatttgaatttcagatagataataaataacatacctaacaaatttatactgtaaaattacctgtcatttatcttaaattcaaatttaactgagcttcctgtagtttgtctgccaaacgctaattagtatacaactcctggaagatctgctacattctgtagtgaagaccctgtgtcatgatgtatcatctgaacagactatctatcaactggtacaataagaaaggatattgtaccaccctttcttaaatattgttgggaagaaaatttcaatatttctccctttttataagccagacagcattagaacagagctctcgcccatcaatgggatgcaggtatacacgttagtaaaggcaacatggagagaaagaaattaatgaaccataatagttaaatttctactttttgtttttgagacaggaactcactgtttcacccaggttggaatgcagtggtgtcatcatggctcactgcagcctctacctcccaggtttaagcaatcctcccacctcaacctcccaagtagctgggaccaccacgcttggctaatttttttattttgtgtagagacgggatttcgccatgttgcctaggctaatctcgaactcctgggctaaatcaagcctcccaaagtactgggattacaagtgtgagccactgtacccagcctaattttccatttggtttaaagtctatatgaaggcttttaggatttcttgacctgctttcttgataatttcatctctcaaaacatagaggaaacaagaaagaagactgctacaaagaaactaattttaacaaaccacaataggttatgcaatatttttgagcaaccaccatgctaggaagaaggaattgtgggaaatagcgatcatttcacaataagaggttagagtaccctcaactgccaaactggcctaaattttcctgctagatacttgaagagcactctatttattcctcaaatgttcatcacagctcaaattacttattcaattcttctgtcttctccattaaattacaagttccatgaggtcagagacatctgtcttattcactgttgtatccctgatggctatccctgtgtatatagttatctattgctgcataataaaatacctccaaaatgtactggcttacaacagcaataattatttattgtcactctcagtttttgcatgtcaggaattcacacaggggatagcatggtttgactctcccacgcgatgcctggggcttcagttggaagacgcaaaggctgagagctggaacttttcttcattcacctgcttgacagttgatgctggctttcagctgggggcataatgaggttgttggccagaacatgtaaacatggcctctacgtgtgacttgggcttcctcataatatggtagctgggtttcaagatccagcttcccgtgagaaggagacacagaagccatgttggcttttatgagttagcttcggaagtaacacggcatcacttctgactcattctattgatttaagcaggaaggtccaccctagtaccccaccccttactagaagattgtcattggcacagtgtaaaaccaggatgtgtgatatgatataggttaatacagttatctttggaaaataacatctgctacactgtacctgcacatagctggcacttagtaaatgcttatgaaataaataaatgaaagaactctggtctttaaggaaactggtctcagaaacttaatggaagaaagaaaaacattaaaagcttaatgttctggagccaggcgcggtggctaacgcctgtaatcccagcactttgggaggccaaggtgggcagatcatgaggtcaggagttcaagaccagcctggccaacatggtgaaaccccgtctctactaaaaatacaaaaattagctgggcatggtggcacgtgcctgtaagcccagctactcaggaggctgaggcaggagaattgcttgaaccaggacctgggaggtggaggttgcagtgagccaagatcaggcggctgcactccagcctgggctacagggagactctgtctcaaaaaaaaaaagcttaatgttcttatagatgaactctaatcacagcaataatgtaaattcatgcttatgatactcactctgctccaaacacaaaccactgatatgtaaatactaatggacacaatgaaaagatacttacaagctctaaaacaagataaataactccacagatcagaaatggaacagcctcacagagcattcagcccttgatatgctggctgtacactagccccagaaacaggcagaagtggcaggaagttcacccgctgtgggtcatggatactaaaagtgtgccatttatagcggactggagccgagcccacagatggaaaccatacatgctaggctgtggctcccctgctaacagtgaaagggggaggaacctgctacccctgctgcctgaagcatatttaaggcccccaaactgaggagttagcaggacagagacacagcctctgaccaagaagtaaaccaagccaaccactgacttagtgactggactggcagtagccccagaaacagcagagcaagaactccctattgccaatataatacctggttttggtttagagactcttgtgtacctgggggaagctactgtaaaaccactgagggctgggcgtggtggctcacgcctgtaatcccagcactttgggaggccaaggcaggtggatcacgaggtcaggagatcgagaccatcctggtcaacatggtgaaaacccatctctactaaaaatacaaaaattagccaggtgtggtggcatgcacctgtagtcccagctactcaggaggctgaagcaggagaatcgtgtgaacctgggaggcacaggttgcagtgagccgagatctccccactgcacttcagcctgggtgacagagcaagactcttgtctcaaaaaaaaaaaaaaaaaaaaaacactgaaaagcagggatcaaccaggtgggaactgatgtgtgacagctttccaactcacagtaagtaaagtgagcctgcaaatgaaaaacataatgctacaaaattcacccagcacaatcaacaacctacagatgaatttgcccaagatgaaattcatataataaaattcagccaggcgtggtggctcatacctgtaatcccagtgctttgggaggccaaagcagttgaatcacatgaacccaggagtttgagaccagcctgcggaacataatgagacttcatcctgtctctacaaaaataaaagattagctgtgtgtggtggtgcatgcctggagtcccagtatttgggaggctgaggcaaaaggattgcttgagcttaagagtttgaggctgtagtgagctatgatcatgccacagcactccagctggagtaatagagcaagatactatctctaaataaataaacaatgcaaaaaatactttaaatagtataattaagattaacattcattatgaaagaagaaaaaattttgtgaaagaaaaacagaatcaaagcaacaacatgtgaatatgaaaaacaaccaattagaagtcttgaaaacctaaaaagtcatggaaatgtttttaaatcactcagtagaaaaataaacattagaatggaatgaaaaattagtatattgaaagagaaattgggagaaaaatatggatcttgttgaaagccccctgattttacagattgtaattggtgtggggaaggtcacagactgaatgagtaggagaggcctcctgaatgccagggcattgcgttttctgctacctgtcattacctctcctaatctgcttccatcttctctggcaaaaacaaacaaaagaaataagtagtctgcaaacatggaaagcaaaaactggaaatttgagaagaggcattatggcccaagagaggcttggaagaattatgtccttaggtgccaaacttacaggtgcaatttatgctaaaattcttggcagtggccctttcctttctcctttcctgcctcccctccaaccttcctttttcttttttttttggtagacttctctttgttgccccaactctttgttaaaattattatatgtgcagaaaagctgaatgaacactctacatttcacctaaacatttgctaacattttgctgtatttgcttttcctcttccctgtatgtatttagttttgtttttgttgaaaagtaagtggaaaaaaaagtattttgttgttgagaataagttgcagacaacatgatgcctcaccccaaatacttcggcatacatctcctaagaggaaacacaataccattatcacacctaggaagattgtcagtaattccatgctatcatctaatatccaagccacattcaaatttccccagttgtccccagaatgtctttcattgatggtttttgtcatcactgttattgctttatttattttcctgtaccagtatctatcaaggttcccattgcattggttgttataaaaaagaagggagacattttctagaaaaacgcatctggaagtggattcaggttacttattttcaccactgtttctgttgacttttgtgtattctaggctgagattttaactggcctcacggtgggcagcgctgcagatgctggggaggctgcattagtgctcttgaaaaggggctgccaggtggtaatcattaccttaggggctgaaggatgtgtggtgctgtcacagacagaacctgagccaaagcacattcccacagagaaagtcaaggctgtggataccacggtaagttttaaaatttaagaatcatgtttagcctttgaaaattgttacttagtaactaattagatgctgtacctgaatttttggataatgaaacaaagccctagtaagtgatatggtaaaagagaagaacaaccaggcaggggaactgtattttaatccctctctaactctctgtgggactttatgcaagcagcttgacctctctgagacgtagtttcctcattcataaaatcagaatagcagtaaaattatacctgtgttacctgtattcattcatttatccagtcattcatcaacaaatagggatttgtggaatacctatcatgtcccagtcatatgatagttgctggggatatagcaataaataaggcaaagtctctgcccttgtcgggcttagattctaggcagtgaacaagtagctgtgtcttacaagcttctccagtgaaatgaacagcaaggagcactggttagcagagatcattcttttaaccaacaaattctagcagctaacatttactgcatgcttgctgtgtctcttttgcatacatctcatttaatcttttttttcatttaatctttaaacaattctgtgagacaagtattatttccattttacagaagaagaaatttgtacaggatcacattgctggtaggtaacagagctggagattcgaaactaggcatatggactccacacagacattttttatgtaaggtactgtgctgaggacaagtgtgctaagtgaacaagccatggctacagagtaggaatgaaaaggaaacaagttagaaaaaagactcatggttcccctaaagctggggaaacacaaattgtttgtttattgttagaattcagaagagcttgccaggcgccacttcacacttgtagtcccagcactttgggaggctgaggtgggcggatcatgaggtcaagagatcgagaacatcctggccaacatggtgaaaccccattctactaaagatacaaaacttagctgggcatggtggtgcacacctgtagtctcagctacttggggggctgaggcaggaaaatcacttgaacctgggaggcagaggttgcagtgagccaagattgcaccactgcactctagcctggcaatagagcgagagtccgtctcaaaaaaaaaaaaaagaaaagaaaaacagattcaggagagctgactagaaaagtaagtaaactagacttgaggaagaataaacattttagagtttttatttagaagaaacagataattattcataaaatatgttttggtttgtttttatgcttagaagcgactttaaaatgtgggtcattatgaaaaaagaaggctgaggggatctgatgaagttttggatgtgaatatactttgaaaaatattcaagtgcaagaaatggttatgtgacatgaaattaacatcctggttgcctttcaaaatgtgctttaccaggtatttgataaagtgtgcttggtgttgctattctcttcatatttagtcatttctgaaactattagtttattttctgttttgtcaaggacaagaacctgaatttgaggggatccttagttctgaaatcaatccgccattagactaacactactttcactaaagtgaaaagactctatgcatctcctgctaaaagtaaaatgaggattcctcaaagacctacatggatgcacagaagtggcttagcccctattctcagtgtccatgttagttactatccctttgggttgtaagcaccagaagcacaactcaggcttatgcaggaaaaaggatttatttggtgcacataattgcaaagtgtaaagatatggcagaatgcagaggctgaacagtgtcatccaggcaagtcaggtcacttgctcactggctccctccctgtcagctctgccttcctcatagtgggctatgagctcaggtgggtccactccctacccacgctgtgtctcatgtcatgtccctgtccctggtttcagatacaaatcactcttatcagaggatagggaagtggatgctgacaagaaaacagtagaatgtccagtgtgttttaatatatctagagatttttcattttcttgcagaatttgaagatgaactattaattggtacataggaaactgaggaaaatgtttaagtaaagcaaattttcccttctaggtcatctagaacctaaggggaaaaagtatgattaagtgaatataatctttgtacatgacgtggctataaatgctataaatgcatagtcataacaatgtaaatgctaattctagatttaaccagaaatggagattagaataatattgtgaagatgggaggataaagtgagtgtgcatttgcacatggggggacataagaaaactaaatgcttattttccataattggaactcaagagataatatctaaaattgacttttttttttttttgagacaggttctcactctgttgcctaggctggagtgcagtggctccatcttggctcactgcaacctctgcctcccaggctcaggtgatcctcctgcctcagtctcccaagtgtttggaactacaggtacacgccaccatgcctggctaatttttatatttttagtagagacagggttttgccatgttgcccaagatggtctcaaacttctgggctcaagcaatccacccacttcagcctcctagagtgctgggattataggcaatgagccaccatgcccaaccctaaaactggttttctaaaagcagtataagtgtattgccagaaacatcagataattaccagaagaaaccactaaaagaatttaaagtatttgcctcatgaaaatgggaatggagagggattgggcatttatacttaagccttacatgtgtccacaaaaacttgtatgtgaatgttcatagcagcattattcataatagccaaaaattggaaagaacccagtgtttatcagcagatgatggataaacaaattgtggtatatccatacgatggaatattattcagccattaaaaagaatactgatacatacaacaacatggatgaacctccaaagcattatgctaagtgaaagaagccagacacaaagtgttaacatattatatgattccatttaaatgaaatattcagaatagatcaatccatagatacagagcatagatgggtggttgctagggactagggggaggaggaatggggagaaactgcctaatgggtaaggagttttactttagagtaatggaaatgttttgaaactagataagaggtcggtgattgtacaacattgtgacaatactaaatgcactgagttatttatgttaaaataggtgaattattaaataattcttttttaaaaggaatgaagtactgattcatgctatgacatggatgcaccttgaaaacatactactaagtaaaagaagccaggcataagaggtcatatattatgattttatttctatgaaatatccagaataggtattataaatccatagagacaggaagtcaactgatggttgctggaaggggatggagagtgactactaatgagtatggagttcctctttggggtgatgaaaatgttctggaatcagtggtaatggtcggacaagcttgtgggtaatactaaagaacactaaagcatacccctttaaagagtgaattttatgatgcatgaattatatttcaaacaacaacaaaaaagctccacctaagcaattcacttatgaatggatattcgtgataaagactctccactgaattgccctgctgaatatgcgtgaatggactctcagcatcccccaggtggagcagcagtgacactgacaggaaccagggtagtgattttctgggtctagaatcttcctcatcttttttatgctgtcttcgtcctctcatccagcactttcattattaaaattcttacctgttctgcacacagctgtgcagcctcttcataaatctgataaagagaaggtaattcacgtggcgagtgaggagctcccagggaggcattttcttctgaacaaatgggctccttcacttttctgtcaggagggtattacttgctctcagtcggtttgtaaccttctcgcttttctcttcctcctaatcccttattaaaaagtcagggatgacatgggtgctggaaacatctttagttggcatgttgtccactcaaggcagacagcctgcctagaagaagccatttcccgttctacgtcagtgcttctgcagactgctatattcagttttgcctcactgttaatagttgaatatatcacttctatttttacatctgtttttcccgttgtactagagtgagatggtggcagtagctgcagatgtcctcagctcagtttggaagacatgacagatgtgtctcttctcccatttctatatgttatctgaatctcagcctccaaatgacagagagtgcatgtccgccctctcttcttccaacctgaatgttagggggtttgcctgcttgcatttgggattgcactgagtaagcactccatagtcagagacacacacctaagcatggtatattttaggattattgtgctactgtgatatattataacattagttatccctgctttataagcactgaaattcttgacatataaattgcttttctttatgtaaatggttaagtcctggaatctacaataacactctcaagaatttagtccgtaggctaaatctgtcttctcaagaatcactcactctgtaataacgcatgggtatgtaagtaagctgagaacaaacaaaagccaggggcacagggaatttatctttcctattctttattctcctttctttctatccttcacatttgagtcctatagtgttcagagttgctgatgaggcactaggcagcagcagccagctgcatgggtgtcccataactactcagagcttgagagttaactctaaattaggattgcaccagtaagaagtagagataatttctgttaaagtttgcacggaagcactttcttaggatgaggtgattgctggggctggcaggttacttgcaggtttcccaggtggcctcttgtattcctctcatcctggggtctggcccgcggccatcccggctgtctcaaggatggggttaatggacccaccttttaggccctatccagactgacagttcaatctttgaaaacctagcatctgaggggccatcattcccaacttggtgtgacctttcctccaccctacattctcctctccccacccttgtcactgccaccagtagaaagtcaaactaatattgcaaaatgtactcagaactaatgaattgaggtgatctcaagaggtgtttctcaacccaggcaacatgaggccctgttccctgcttagccatagtcctgctgggaagactgaatactcagcagttcttgcatgggtactgccagtactagtctccgtgactttccttgaactgtgtttccccagcagactcttcttcttcttctcatctccttctttctgatcaacatatactttctttgcatgtagtaattagttgagtttctgaggggatttatggctcaaaagccattttgtccttgaatagagcctttgcacatttctgtccagaagcttctgttatagccaagatgtttcggtgtcccttactgtttactggcaacacttgagaaagggctgggtgggtaaaataatatggtttaaaaaatggtcgaatcttgggtgctgaagaggtaaagtaataaggctaattttgaactgcactgtcaatttttcttatccaagaagtgactgttgtttccttcaaaccctgactttaggagacttactctattgacacagctactactcaaagtgcctttggaaatcctctgttagaattgccttgagagccttcattatcacctttattccactaatcactttattggggcttttcctacttgtgaaattaatacatactttagtgttcaaggagggaaggagagcagcaacacagaaaggtataaagaagaaagtcaagtatccatgacccatccacttaaaagtaattgttaaccttttggtgtaaatctttccagatttttttctatgcatagtcatacacttttgaatatctacttacagctaatttgaatatttgcaatattataggattaatatgtgtaattgcacatattacaacaaaaaattacaactaaaaaatagtgtaattacaactaaaaaaatcaagtatttccctagaataatataaataggcaagtcactgaataagaaatacgaaaaaaataaagaaatgagacaatgcttaacctcattagaagtcaggattatacacattaaaataacagtgaggtcctctttattacccataagtttggccaaaattaaaatttgagaatgtttaagtccaaatagatcacaaaacaaatattatacaatcatgtaattctggtgggaatgtaaatttgtacagtgtttccagaggggaaatttgacagtactaatcttttttttttttttttttttttttgagatggagttttgctctgggtgcctaggctggagtgcagtggcgcagtctcggctcaccgcaacctctgcctccccggttcaagcgattctcctgcctcagcctcccaagtagctgggattacaggcatgcgccaccactcccagctaattttttgtatttaatagagacagggtttcaccatgttggtcaggctggtcttgaactgacctcagatgatccacccgccttggcctcccaaagtgctggaattataggcgtgagccaccatgcccagctgacagtactaatctttaaaatatactttccctttgaaaatagtaaatcttggctgatcatgctggctcacacctgtaatccaagcactttgggaggccgaggcaggaggattgcttgaggcccagagttcaagagcagcctgggcaacatagcaagaccctgtctcaagaaaaagaaagaaagagagagagagagagagagagagagagagaatagtaaatctccttctaagagtctatcctacaaaaatgctcacatacacaaatatttgtacaagaatgtttaattcaactttgtttgcaataaccaaaaattgagaaggtgtgtcctcctaatcatcaataggagaagggcaaatatgaataataatgtagtgccatttacttgaaagtaactctctagctatctctaagtaaatgcatattttaaaatctggaaaaaacctcaccagctgttatgatcattattcctgggaaggggtataggctggggagaaggtgttataaagggggacttctgtctactccatactctactgaattatttgagtttttccataagcctgtatttttcatgtattactttgtaatttgaaataaatgtgactttgggcatgaccaaaagctatttggagccacatctagcaaataagatcggtgatatcatttctctgagggtgtactgggcattatcctcacaaagaacctctcaagcagttcataatcttcatgtaactgggccgaggagccccttgacgtaggataaactctgaatggatggactcctagtgccaaaaacttagatctccattaccttcctattgagggcacttgaggctccttctgtctggtagtttgttatatactttgacaggtttttttccttaatctttttaaagaaaccattcctcagaaaacatgttattttatacagttcttcttggaaataccagaataaatgtcaaagcatcactgtttctgttcgtcattcaaatgtacagcagatcttcagacaaattttcctcacgttcaggttttctgaatgaatgaatctgcttatagatttccatttaactcttcaaccctcagtctcacaattaatcatagcttgagtgatattaactctggcttttgccacattgcttggtcttcagttgatggattatctggagttgtaaaagggatcggccaataggtgatgcctcatgtttaggtatttggtagttcacgtacttcatctcccatttgaaacagtcctggatggaatggttcatgaaagatggaggaacatgtaacaccatgctgtggactgaattgcgttcccaccaaaattcatatgttgaagccttaacccccaatgtgactgtatttggagataggaaaagaaagtaattatggttaaatgaggtcataaggggtagggtcctggttcgatgggagagagctctctcgctctctccctttttctctctctctctgtgtgcacacaaagagtcatgtgagcacacagcaagatggtggccacctacaagccaagagaagaggcctcagaatgaaacctactttgccagtaccttgatcttggacttcccagcctccagaactgtgagaaataaatttctattatttaagctattcagtccatggtattttgtcacagcagccctagcagcctaatacacacaaggaatcaagtgaatgtgcttcagaagtgacctgaagtgaatgctagaaaattggctgttctgtaaggagaaagtaatccaaagcaaactaagaggactggcctaaatcatctttttggtgaaatatctcaggggtttttgcatatggtttagctgtagtcatcagtcccagtggcctgagttctaaccctgatttagccattaactagcggtgctgctttgggcaaatgatgtcttatgtttggggctcaggttgttcatctaagcatgatgtgtctggtgtggctgatctctgaggcacctctgacctctgaaattccttggttcattagcctctgaaattagattctttgggggcatgaggattctttaggctaataataaaagctgggcaccacactgtgccaggcatcatgctggactctatgcattacttcacattctcagaacaacctgcaggatgggtttttgactgtttgagggaggaggcaactatggttctcaaaggttacatgacctgcccaggggcctacagctggtaagttggcagagccaggattgatttttaagttggtcggtctgcctatctgtctgtctgtctgtctccaacacccatgtacttgctacctcagtcaccaccctgcctcttgatttggtgacagtctgcctagtcttcactctctcttatttgacattccagcactgactttccttgtcacttgtcatgatacaggctccttgtctatagatcttcagaagcggccagatcttgaaaaggccttgcttactttgtacagtacactgcagcctcgtttaaatgaaataatccacgtataccctgagaacagtgcctggcacatgtaagcccttagtatgtgttagttcttactagtacatccctatatacctgattgttcactttaccactttatggatcatttaggtaccaggtagcgtagaccaggagcttgtatcacccaccattaagcagaatggatattctcttggctctgtatattagtataatgcaccatgatgcaactccagcttcttcctaccatggtaaggagcaggaccacgtggtgatatagtttggctctgtgtccccacccaaatctcatctcgaattgtaatccccaggtgttgagggagggacctggtgggaggtgattagattatgggggcacttttcgccatgctattcttgtgatagtgagttctcacgagatctgatgattttataaggggctcttctcccttcccttcacatgctctatctcacctgcagccatggaagatgggcctacttgtgacttgtcatgatacaggcgtctataattactccttttctgtagaccttcagaagctgccagatcttgaaaaggccttgcttaccttgtacagtatactgcagcctcagttaaatgaaataatccatgtataccctgggacagtgcttccttccaccatgattgtaagtttcctgaggcctccacagccatgcggaactgtgagtcagttaaacctcctttctttataaattacccagtcttgggtatttctttatagcagtgtgaaaatggactaatacacatggacagtgatgttgcaggatcatgcccattccagacagcaaaggttctggaacaactcatgttcattcattctcatcagtgaatgatcaaacctggaggagaggtgcaccactctcagacactataaccaaatcatttttttattacatttctttaagtagaagctaaactataaactgctaaactataaaggtagtgaaaatgtgattcttcttttttaacattcacaaaccagctttttagttgaggcaaactcctgcccatccttaaggtccatctcagaggttctcttggggcaaccccactgcttaatacaatgcttggcatataataacaggccctctgcaaataataaaagagttctggttccttctgggaaagtaactagtttgagtgttaagagtcgcttaccctccctaagccttagttttctcaggggactaggggatcaactggatttcttacattccttaagttctacatttaagatgcccagggaaacaataaatcttagatataaatgctccttataaatgatttgaaaacagaataattgcccagttttccattttaaaacatatccttaggccgggcgcggtggctcacgcctgttatcccagcactttgggaggccaaggcgggtggatcacgaggtcaggagatcgagaccatcctggctaacatagtgaaaccctgtctctactaaaaatacaaaaaattagctgggcgtggtggcaggcacctgtagtcccagctactcgggaggctgaggcaggagaatggctgaacccaggaggcggagcttgcagtgagccgagaccagcctgggtgacagagggagactcctcaaaaacaaaaaaacaaaaaaacaaaaaaacacatatccttagattgttttacctacagtcatacaaagaccaggccaaaaaaaactaagttacagagagtgcacaacatctctgaaatcagcatcatagaataaagaaaacccaaatgaggttccgaaacagccctcttaaccttagaaatgatgttagtaaaactctgcacactctggtggctggaaaaaatgaagaagacaaaaagttgttcactgactgtaaggaaaggacagaggacaaggtaattgcagaagagatggatagacaaggcacaagacatctgtcatgcccagggggccatattagctctattacattacttccacatcaacagatcacctcatttattagctaatcaggcagaattcaatattttaaattatctttcttaatcctgcgtgtgatcagttgaatacccagggctctagaaatctaattgtaactgcttaccagaaatgtcatcttcactttgaggaattgaaccagggccaaatctaaggctgttttttccattttcccaaggtactgtcccacagacctggacatgcgtgtacatgtgactaccgcctgacagcttaggggctccctgaggggatctgggcccctggccctgcttcagaactcaaatacggccagggactgaaagaggaatatggtagtagaagtggggtatggaagtggatgtacagtacagaaaaggaaccattgtttcagccttggaaaaagtcaagagagaaagaactaaatctagatttagaatgttctgtggacctagacatgaaatagtccctctgcccagtgagagggcattgtataaggttatgggagcttgcttacccatctacgattaggatttcgcttcctcttagcttcctacgtctaagccccacctgtccaccctccttaagcttctaagacattgatgtgataatatggcagtgagcctgtggtctactcctcgcccatcttcctagggtgttgtaatggtgttctcaggagcaaaactgccaggacaacacaaaagattttcttagtggtttccattgagtgacaatgtttctagggtagacctgaaattatgaggaggtgaaagaaaaccacctagagctaggcgcaatggtgcaagcctgtaatcccagcactttgggaggcagatgtgggcagattgagctcaggagtacaagaccagcctgggcaacatggcgaaaccccatttcgacaaaaaaagttagccagcatggtggcacacgtctgtagtccccactacttcggaggctgaggcaagaggatcacttgagcctgggagaccaaggctgcagtgagctgagatcatgccactatattccagcctgggcaacagagtgagaccctgtctcaaaaagaggggggaaaaaaaaccacctagagccaaaccatagagcccatggcagtgggagccatgcccactgccctcaatgcccattgctgctgatggagttggacaaggaaatagaaaaagaggtgtgtggttcatagcttgctgaactctgccctttgtataaaagtgtgtgcatgtgtgtttgtgttgtaggttaatggtgtgtatactttgcatgtctatgttgatggcatgtactgtgaataaacagttaattgcatgaatgtcatgtgcttatgtgtacgtgtgtgtgtgaacagaatgtactgcagtgggacagagttcagctataaagcaattcattcttgctttcctcttcctatttcagttcctttaagaacaaatacagaagtgttctatactgtggtacaacctctgaaaaagctatggatttggagatcaaagggatccagaggttaggtgaagtacatctcccctaagagatgctctaaaaactgaaaatgttacattgttttctttccttggtcaagcaaacaaaaattagaaaaagattatagtgacatctgctaggtgccttccgcatgactgtcctgttcccaattaggaaaatctttttccttcatttagtattctctttaacttttagttttaatatgtaggaatctaattgtttagatcaagttgtatgtgactataatttgcattaaatacatacatttatttcgcccctcactagtccaaggcaaatcagattgcctctctttccttccttcctttcctccttttatcctttcttccttcaaatgaaatatttcaaccacactaaacagtatagagaataatatcatgaacatccattgactcaccacctagctttattgatttttaacattttgctatttttgcttctgatagttttaagaaataaaatattacaaacacactatgacacctgtgtttaagatgcttaatgttatgaagaggttagctttttttcttttaagagatcgggtctcactctgccacccatgctggagtgcagtggcaccatcatagttcactgtagcctcaaactcctgggctcaagccatcctcccaccttagcctcctgagtagctgggaccacaggcatacaccattatgcccagctgatttttttttttctagagctggcgtctcactttgttgcacagccttgtcttatactccttcctggcttcaagcaatcctcccacctcagcctcccaaagtgctggaattataggcatgagccaccacactgaaccagaacttagctattaataatacatttgaagacagtattagcttattaaaatgtctcgttctttgtcattctgcagttttactacagggaatctagatctgaatttatttatactgctcgtgactcttcttcctgaatctcagtatttatgtttttcatcaattctgaaaaactcacaaccattttctcttattgttgcctttcccctattttctctgggaaccctattagatattcgctctctctctctctccatacatatatatatatagatatatagatatagatctatgtagaccttctctttctattcttcatgtcttttaaattttgtctctttcataatttctatatcctggactctcagtactatattctgggttatttcttcaggtcttttgcccagttcattaattgtcttcttagccatgcctaatttgtttagaaacctgtttttgtgtttagaaaccgtatttttcatttctaaaatttccatttgattctatctcaaacctgtccattctttcatatggtagattcttattttaaaatttcttattttgtctttaatcattttaaacatgtgtctgtagtttcttttagctgactctattatctgaaattgctgaggactaatttcatgtctaactgcttactcttcatggtagattgttttgtcacatgttttataattgcgggctgtgagcttatcttcagtggtacttgatctgtgagaatcctatgtagtctaggttgaaggtatttcttgccagagaaatttgcctttgcttctgcctgctgccccaggagtatccctagctgaggaatacttttattttgatctcttggcttgtgaatttctggccacacaggtagtataaatttctttttttttttttaatggcttctttttgtctgtttatttctgctttatattatgaaacctttgttaaaatgtactacagcatataaaactacatattttagatgatctgttcttcaggtctatctctataccttaatcctaactttaacccttttttttttctaagcacttttctaagtactttattttttattttattatactttaagttctaggttacatgtgcacaatgtgcaggtttgttacgtatgtatacatgtgccatgttggtgtgctgcacccattaactcatcatttacattagatatatctcctaatgctgtccctccccgcttcccccaccccacaacaggccctggtgtgtgatgttccccttcctgtgtccaagtgttctcattgttcaattcccacctatgaatgagaacatgcggtgtttggttttttgtccttgcgatagtttgctgagaatgatggtttccagcttcatccatgtccctacaaaagacatgaactcatccttttatggctgcatagtattccatggtatatatgtgccacattttcttaatccagtttatcattgatggacatttgggttggttccaagtctttgctgttgtgaatagtaccacaataaacatacgtgtgcatgtgtctttatagcagcatgatttataatcctttgggtatgtacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgttgtttcctgactttttaactggtgtgagatggtatctcattatggttttgatttgcatttctctggtggccagtgatgatgagcattttttcctgtgtctgttggctgcataaatttcttacaaatttacaagaaaaaaacagccccatcaaaaagtgggcaaaggatatgaacaaacacttctcaaaaggtagtataaatttcacaacccaaactgcttaggaagaggatcacattacaaagtctcagtgacaggatttgttgctgtttctctgagccagtggtggaatttttttttcctggttcatcttttctgtaggagtcttagttccagcactccactttgcttgaaacccaccttttgtccaaacatggccattaaaacccaagccccatgattacccggaccagcaaactgcttggatggccatagtttatgctcttgccgtgctagtttttagaactctctttgtttttggactctgggaaaatcttatttctattttttagatatattaatagtaataaggcttctgttttatcccagagttctgagtatcttgtagaaggagagttttcagatctctaggctacaacattgctacaaagagaagcctaaattgggtttcttcacaggcagtgatcacagtcaaggtcctcaggctgcctttcatcttattctcagagcatcgtgggagttccaagactaatgatacaaaagcagcctctagaactgaaaacagttccttaagaaataggaaatattctattggaaagaatggcaaaatggaatgaggcacatcccactgtacactttcttattcagcacactctgaattttccacatgccacacagtggatatacactggtatgccagggacacactggcataataagacagtccctggccacaaagagcttggaatctagaagagtgcatagtccatacagctagaatgagaagtcccatggtgatgcagtggagggggcccacctagcctgaggagcccagggaagctgtttgagagggtaagggaaggagctgagctgaaggataaggcagaggcagcttggtaaagtggcactcaggcagaggcagcagctcatgaagcagctaaagggagcatggcatatttgtgctgcttcaaatagttccatttggaaagacctgagtacaaaggagagttaaggatgaagtggagaggtggcagggttgggttgtaaagggcttcctttgccacttctgagaattcacacttctgagggcaatggggagccatttaagcaagggatacatttgatcagatttatactttataaaaagattaatatggctgctgtgtgaagaataaattggagtttacaagactggagtcagggagaacagtccagagactgtcgtattgatctgggtgagagatggtggcagcctggactagggaagtggaaatggggatgctgagaagtgggtttgagagctcatgggaattcagatgacataaagatagttcatttccttaaaaaaagtgggggcagtggggcgataactaagatggttatttcatagttgaaacaaacagatcattctgtcagtctgagtggttttcagcatattttttactccgactcacataaaggctaaaacctactcccactagaaagagttcctgtcatcagtgattctctgcagatagcacagaaagatgcctgtataacttacaaaaaataaaattaaaatctcaggtgatccataaatgcccttccatccggtaaatgcccttccatccagtatgcctgccttctagggaatgaatgatctgtgtaacaggcaagcatttggagcagaaatcaatccttcatttaaagtaactgacatttgaaggtaactcttttgcaacataatgctagttcagatacttgccctaccacctgtgccttagacactagcttattcctggtagaaacacagccttcacgtaactatgcatccttccctgataaagtgacaaatcagccagtatatgacgaatttgggttgtgtagacaaatataccaggtgcaccagccaagacatacacagttggttgtgaatcatccacaccagctttcaatgcagttagattcacagaacaattgctcagttccttccttcattttcacagtgtagacctggctcaagacccaagagtgaagcagcaagtgtgaagaagcagaaacattataaataacccagagaatccttttataacagcaactgcctactgattttgtggcctaacagctcgagcaaaaatgaatataaatacaacattgtgcaatgactaattactcaaaattttgtgcatcagcagaagtggaacctgtggttggtgctaatattatgaaatgcctttgctgtttaataatctggtagctctgtattatttagcatgcatttttcttggagaacaatgattttatttcaagtacctctcactgaaataaaaaagcagctgttagaagatgaacatttagcagaaaatattttagcgagtcttttgtaagatactaagtcctattggattaactgttttctgtctagaatagtggggtcacaaaaaaaaggggattgctgaccacaaaaggcaaaaggccaacctttagaactcagtgaatcactaacagacattttagttttaattgcgatttactcaccaatatatatacaaagctctcattaatattgcctgaagaatgggccctttttaattccatttttagctcgctctcaggattccacttctctttcattaacatggaattctttaaattatagaataaattaacccaccgcaaacattttgggcagaatggggttttcagcaattttcagcctccacaggccattcttctcagcagcttgccagccagcagagcggtgagggccatggctgggagcagcacctgcccctgaacttgaagagaggctagagcagcccaatgggctcctggcccaagcccactctcagggtgacagtgtccttcacatgttcctcaggctggccaaacaaggggtgtgccagtgcgtaagccacatcaccataaggctgctgggcacagccagtttcagccaaagaacattatggttgagctgcattaatgtgcccatattgactcagggacaatttttacattattataagcaaaacagaaaatgttctcttttaaattatcaagaaatgtgaaaaaacaaagagtttcattttatctccagttcccattcctggggtgaagtgggtgataggtaaagattaaaaatggaagagttttcagagatggctgaagattacctagagggtgaggctcaggcttgggccgagggtggaatgaggtatagaaaagggaaaggatcaggcatgtctgttctgtatattatttggcaatacaagacagtatatctacattttttacaaatgttatctcaaaacaccttcgtcaaaatgctccacttcagtcctggtctgaccagccagcccagagcccatcacaaactaacaaagctgagaatggaccctgagacacggtcaggccccagatggagccagccagtggcctctgtcaatatgaactaatggctgacttggactgggagccatttgtcaacaatagtggggccagatctgtccatggcaccaacctgtgaggtaggttgagcaccacaaccaagcacctcaacctgtgtgaagactgagatggctgagacacactgcatcaggcaggggatttcttttgtctttgactcaattttagatggaatccaagtgatgcagttactatgattatctgtactctttcttaaaaatggttactaaatacttgtagggtaccaataaaggaagaatctggcagttctgggatgaaagttaatagagtttttcttgttttatagtagttgaaatataatcaatgtattgaaattcagaagatcagtgtcattcgtaataccacttatggtcactttgggcagtgaagtgctgccctgagcatatcttagccccaccttactttgattttgcactcaaccgcttattgatccttctctgttctcacctatcttaatgaaagaaggctttagcctcataaacctcattccagatagaaatacataattcaagagaaacactgatgtcaaagaagagaaggcataccaatttgtgtcagcatttgctgtaaattagagaggagtacagggagagtttaatgtaatgtagaattggaattaaaatagaaccaatatttaggcagtcctccacctctttttttccctgctgtgacatgaaggattgactttctcccagcttaagtacctaatgtagttcattttttttcctttctgctgggattcccccccacaaaatactacatatttatttctggcatccaaaattaaatattttcaccttttccattccaatcacaaccaaaaactcagggtatgaagagttggagtttccccctcatcttccacacctttgcagcatagaaaggacctctggtggccgggcacagtacctcattcctggaatcccagtactttgtgaggccaagacaagaggatcgcttgagcccaggagttgctgggcaacaatagagagacctcatctctacaaaaaaattttttatagccaggcgtggtggcaaatgcctgtagtcccagctactcaggaggctgagttgggaggatcgtttgagtccggggaggtcaaagctgcagtgagccgtgattgcaccactgcactccagcctgggtgacagagcaagaccctgtctcaaaaaaagaaaaaaaagacctctgccatgccagtgtaatcagttcagctgttgtaaatcactattaatccctccttaatacagtactaatgtgggtgttacctccatggtttcttttttcctaagctgagaataaaaggttgatagtgaacatctcacaatgtaaatttgtgcaaggtgttcctgtacacttgtgagaattctttagcacacatgcaagagtgttcttccttttaaagtggtcacattgggaagcttcacattcagaccacatgttgttttcagaacctttttggagctctttatttgaatttctgccagagccgatcttgttctttacagttgcccattggttttggccaatggtggagttccctagcttgatccctcaccttaatcattagacttggctttaaacaattcactctttccagaaataaattccttaggatatggttctcaaaatatggccctaaagccagcagtatcggcatcacctgggaagtcatttgaaacacaaatcccaggccccaccttagatttaatggatcagaaactttggggatggagcccagcagtcggtgttttaacaaaccctccaggcgattccagtgcatgctcaagtttaagaatcactgactgagatgaaatgtgcctccattgaggatattcaaagatatgctacagattttgaaggtactgaaagagaagtttcaaaatatttttgagcaaagttagaatacatttatggcctccccagaggactgctttaatggggactgggatttaaccaaggtgttccagttctatcacctagccatttgaccttgagcaagttcttacacttggtttctcatccggaaaatcaaagacccaccctacctacctcacggcattgcaatgaaattcaaatttaatcacatctgcaaacatgccctgtaaaccagaaagtgctgtggaaaactgaaagtcatgtcacactctgcaggcagaattctggtagcctgaacattatgtcagggaaatgagtggggcaaaggcttatatttatcatttccctggccagatatacctttttgtctatataatggccttatggatgtgtctcagattctgccatttcagcctaccaattcatctggtattaagagaggaaaaccattgcctgactagtagctacaaaatgctagaaaaatattaatatatccattttcaggtcggtcctggtggctcacgcctttaatcccagcactttgggaggccgaggcgggcgaatcgtttgagcccagatgtttgagaccagcgtgggcaacgtggcaaaaccctgactctacaaaaaaataccaaaaaaattaaccacccacctgtagtcccagctacctgggaggctgagataggaggatcacttgagcccaggaggttgagcctacagtgagctgagatcatgccattgcactccagcctgggaaacagagtgaaaccctgtctcaaaaaaaaaagaaaagaaaaatatatccattttttggccgggcaaggtggctcatgcctgtaatcccagcactttgagaggccagtgtgggtggattacttgaggtcaggagtttgagactagcctgacctgtatggtgaaaccccgtctctactaaaaatacaaaaatttcccaggcatggtggtgcacgcttgtaatcccagctactcgggaggctgaggcaggagaatcgcttgaacccggaaggtagaggttgcagtgagctgagatcgcgccactgcactccagcctgggcgacagagtgagactcagtctcaaaaaaatgaaaataaaaaatacaaaagaaaaatatatcagttttcaaacttgctgtttcctacaaggacccgggaaagctgggaaatgagccatcagggccaactatgttgtgtggatactgaagctcttatgcctggaacatggcacacaccagcagtgcaagggtctgtcctaaaaatatcattttatgcctgtgcaggggtgtctggaccttcaaggaggaagctcagtgctcattgccacacattaatcactgcagagagaccgaaaagaaaagccctcaagaaaatcaggtctatggaaaccaagatttacagaccaaaccagttaatgcaagtttgtccaacacaaatttgtaaactttcttaaaacattatgagaatttttctgcgattttttaaacctcatcagctatcgttagtgtattttatggcccaagacaattcttccagtgtggcccagggaagccaaaagattagacacccctgaatgtatctgtgtttgagaagaatgtggatggatttttaccttagagattagcctttacaaacaacatcataggatttttttttttttttaagacaaggtctcactgtcacccaggctagagtgcacagctcactgcagcctcgacttcctgggcttcaacaatcctcccacctcaacctccagagtacctgggaccacaggtgtgcaccaccacacctggctaaagttttgcatttttttgtagagacgaggttttgccatcttcctgagctcaagcaatccgccggccttggcctcccaaagtgctgagtttacaggcttgagccaccgtgcctggccaggaattcttaaacagcaagctcctggtacatttataatttaatttgaaaactttacaaactctttaatgaacacttctggccaggaaggaagctaaacctgttgcctcagtgcttattgggaatgaagtttcaataacacagaaccacctggccaacaccaacttcacttttcgcacaaagtgccagctaaaatcgagattaggtgtgaatatattaataattggtttattatggttacattattggataattatggaacaataagctattgtttaattatagaattagaatatgaaatgattttgctcaaaaatgtggccccacttaacaaatctctagagacaaagcagataagtggttcctaggcctgtggatggttgggaggaatggggagtgactgttaatgagtatgaggtttctttcaagggagatgaagatttctaaaattagattgtggtgatggttgctcaactctgtaactatactgaagaacattggattgtacactttaaatgggtgtattatatgtatattaattatatctcaaagttgtttttttaaatccaatagctaatgaattgtagagccaagacaaaaaaattgtacctatttaaaagacagaagcaaaaataatatcaaaactttgctgcatgcagtttcagacttgattcatatgaaagtggtcatttgaaatacattaagccagaaaatatttgctcttttgagagtattgctctgtcgcccaggctgaagtgcagtggtgtgatctcagcttacaacaacctccacctcccgggttcaagtgcctcagcctcccaagtagctgggattacaggtgcgcaccaccatgcccagctaatttttgtactttttttatgtgtagatggggttttgccatgtcagtcaggctggtctcaaactcctgacctcaagtgatctgcccaccttggcttcccaaagtgctgggattacaggcgtgagtcaccgcacctggcccctgctctgtcttttaattgcagagtaattaaaaaatggattatctcagacttttttttttttttgagacagagtcttgctctgtcacccaggatggagtggcacaatccaacaggggcacaatcttgtctcactgtgacttccaccccctgactcaataaatcctcccacctctgcctcccaagcaggcgggactataagtacatgccaccaaacccagctaatttttgtattttctgtagacacagggtctcaccatgttgcccaggcttgtcttggcctcaactgatccttccgcctcagcctcccaaagcgctgggattacaggcatgagccaccacacctggctaataattgaaatttaaatgtcaaaaatcaaggtggctggtagtagaaggcaaagtcatggacatttgcgacataatggtttgtcatgttccctacagatttctttagaaaaaaagtcagcacttacacaataatgataagaaaactgaactctcactgtccatcatgatgctcataaactgacctggttagggaaggctgcaaggttgaggttcaggaaaggatgtgatctcatccttatgatagaaatatgcactgataagagaagttagaaaaattcagattttggccaggtacagtggcacgtgcttgtaatgccaacactctgggaggccaaggcaggaggatcacttgaggccaggagtttgagaccagcctgggcaacaaagagagactctgtctctataaaaatattttttaaagagaaaagaaagaaaaagaaaaattcagatttgagctgtggaactaggctcttgtgtaagcggcactgtgcctaatggcatgttcacaaacagaccgctcagtcctgtctgcataggggagaacctttccactttcccactttgggaaagataggccatgccacgcgggttctcatcttcttgttaaattcctcactccaggggttgagtgtccctaggactcactggtggccatggagactgtaaatggaggtaaacaggagaggaactggctgacagagctagggatttctggctcagtgaggaaagcagggaggtattagcgtgcattgaacttagagttgctgcgcagggcttcttaactcactagaagtccctgactgggccactggtagttctttgggacaagaggtcctgcttcattttttctcaaactttgtttttcatcatcatcccatgccaaggaaacttttttgagactttttttcctaatcaccctccctcttcccccgtgaaatttttataccacgtacacacatacacacacacacacacacacacacaaacatatgttccttgacctacaatgggattacattcagataaaccaaccgtaaactgaaaatataattaatagaaaatgcatttaatacagctaacctactgctatacttgagatgctgtccctgctaaatctcatgttgaattgtaatccccagtgttggagctggggtcttgtgggaggtgactggatcatgggggtggatttctcatgaatggtgtagcaccatccccttgccactctcctcaaaatagtgagtgagttctctcaagatctggttgtttaaaagtatggtggtggggcacagtggctcacacctataatcccaacactttgggaggcaaaggcaggtggattgcctgagttcaggagttcaagaccagcatgggcaacatagcaagactctctctctaaaaaaaaaaaaaaaaaaaaaaaaaaaatatatatatatatatatatatatatatattttttttttttttccccagctactcgggaaactgagacaggaggctggcttgtgctccagaggttggggctgcagtaagccatgggtgacagagtgagaccctgtgtcaaaaacaaaagtgcgtggcatcttccccgtcactctcttttgctcctgctctccccatgtgccatgcctgctcctgcttcgtcctccaccatgagtgaaagctccctgaggcctccccagaaaccacgcaggtgccagcaccatgcttgtacacctgcaaaaccatgagccagttaaatctcttttctttataaattagccagcctcaggtatttctttatagcaatgcaagaactgcctaacacacctaccaaacattatattacagtttgtactgaatatgtatcactttcacactgtcataaacttgaaaaattataagtcgaaccatcataagttgggaccgcttgtgtgtgtgtgtgtgtgtgtgtgtgtgtgtgtgtgtgtgtgtatactgtggccctttggagagcatttgtgtaatatctaagatttttttcacgcactgccaccaagaatggattttgacccctttcggggagatatagccccagttgggaatgcatgccctggatgaaatgaaggctgtaggcagggcccttctgttcactctgagtggcgaggttgatgacatggagtaagtaggtcaggtggccctatatccatcattaatcaggataggccctgacctcaggttccagcactgccctgctagagacgtcctccaaaatcacactgttcctgcaccatctgttcagcctgcctgccccgtcctccagcctctgctacatctcctctccatgggtggcagccctctgcccagtggccggctagctgtggtagacagtggaatgctccatcaagttggcattactgaggaagtgcaggctgtccctgccagcagtaaccctgttcccatcctgtcctgcagccttacccgccccagctctaggcctctgtccagacgcctctctcagtgttctccctctgcacgtcctccccaaatgaaagcatggggaatggatttcagagaccccagcacacaatgttgaccatggctggaactctctggagcctggcatccctcataaacaagggccacaggacactggccttcacctcttcctggctccaagtgcattcctggatgcctttatccttctactgtgagctggaaacataaagccagtcacagcataaaccccttgtctcacaatcctatggattgtgccctaggatggtgacctactttgtttcttagaagccttgtctggccccctctgacctaggtcatgggctttctctgccaaaaacttgagcaacttaaggggccactgagataataccatctttgtctgcctcacctttgttgaacacctgctctgtgccaagcactgtgctaagccttttcacatacattacttaattcagtcttcacaatggccctatgaggtaagttcccattgtacagataaataaacccacagaaaagctgagtgacttgccagaggtcacacagctagtaagtggtgaaattaggacttaaacccaggtctgtctgaaatccaaaccatttactgcattgtcccagttgaaaaaaacattttccagttgtatgaatagaaataaaaatgacacaagacctttattgccagtgaaaagacagtgaatttaccattcttaaaagatgacagagctggccaggagtggtggcttgcacctgtagtcccagctactcaggaggctgaagtgggaggattgcttgggcccaggaggttgaggctgcagtgagccgtgatcgcgccactgtaacccaacctgggtgacagagcaagagccgatctcaaaaaaaaaaaaaaaaaaaaagacacctaacaacaaggggcagaggcaggacttaaaaccaggtacatatgacacccatatctcctgcctgtcagtgattaacccttggaggacaaagaatgacttttacgttcccaggcccagtcagctagatactcacgcctcagcctcctgcaggcaagaacaaggcagaagccccatttttagaacttggaagagagcgcagagcaagcctggcccctgggccagcctaagtatgagccatctcagcagctggcgcagccctccttgaaacactctcccttgaagaaattctgacctaaacccagtgtagccagcaaggctgaccctgttggtggaatctggtggccccagtatggtggtgggaggtaacagagaccctggtggtttacatttgccctctctccctttcctgaacccctggcaatattcttttttaagaaataatgcattgacttatgatttagtcatgtttcatcccatttgcttttccctggcttctaaaaccacaagcatggctgaggaattcatgtccacagtgtaggctctgaatagctttgtgtagggagaggttttgaaaagagaagaaagtggcatctacttgtgagatggaatgcatgaagacatcggggaggaatgcacgcgctgtaactgttagggtccctcggcagtttgggtagtgactcattcagcgtgggtacggattcctaacaagtgaagcttggtagtgacgtcattcttgcaagattgtctggaatctgttagagctgcctgacaagatcttaccttggagactttcatcacttgggggtttttcccagctacacttcatacccatcatttcctccaacttgtccccttttctatcaactggaatttggcaaaccagaactttcatgcatctgttccattgtcatcctcctacagggcgttcctgggacagtgtgtgctcctcacctcatcgctcagcacccatcctcctgacagttcttggttcggtcagtgcctacctcagctatggtccaggccttgcactaggtctcaggacagggaggtgatgaagacaggcgtgctaccctcaaggggagggcagggggcagccagagggcctgagactggtggtttccgggacagcacagtgctttgaacatagtgctaggcaataaatatgtgatggccaagttaatacccaagctgagtctccaaaaatgagtataggagttagtctagggaaaagtccaagccgaggtgtctccatgtactgagacccgtaagtgaataggaagaagtaagttccttaagtgaataggaggaagtaagagatgaaactggaaaagtggtttagggaacctcgtgtgccatgttaagaagttgatgccacgggggccacgtggacagatttgcagtagtgtagaggatgggctggaagggtccagaccggaggcagggagactggcttggaagttaatgtgaccctgtgaggtgatgtgaacattactggggcagtgggggtaggagtggagacaagaggacagatttgagaaacatttaggatttaaactcgacaactggtgattgatgaagtatatgggaaggagatgcccaggagacccccaggttttcagtgtggaggtgccacaagctgaaaagataagaagaggtccatgttaaggcagagttttgagttcatttcggccgtgttgagttagagttgcctgcaagagacatgagccaggttaagcaggctcacgggtggttagatacacaaatccaaagacagaggagagtctgggctaaagatactgatttaggacccattatattcatagcagctgaaactgtatggctacataccccccaacttcctttcctgctccatgtctgtttatctaggacttgggcgcctacatgaccatttttctctctgtcccaatgctgtcatgatgtgggatgacttcagtgccatgaggatgaaccattaccaagtctcatagctcctagatgccctctattctggtgactcttcacctccactccactgcagcctcccactcccatgacaacctccaggacattgctagtacctccttggaaccacttcagttctccggtaaaacctcacatcctcctctctgagcagcccctggctttcaactcttctacgccgttcccagttgtcttagttccctgtactttctccttgcctgttgaccccctcctgacctctcttctttcctgatccaggtcagactctccgactgttcatctgaaatattctttcctgaaacctttgattcctttgtacccctgctcctctcccacacctgcccaggacaacgctagttcatgttctctgctcctgccacaagcacacagaggaaaatggaccccccatgcagtggagcctcactggagcttcatggccttccctcttccatccctgtatttcttcatcactatggaaaacataagccttcccatggggaaatgggaaaatgtgggcagtctctttcccccaaaatagcttctccatctgctctgctgctgaattcctgcacagatgaccttggtacaaatctcaactgccatttaccaccttttctttacactgggcaagagatttaacctccttgaatcccagtttcctcagcgtaaaataaagatggcccagggttgctgctggcgtctgtgacaccctgtgcaaattattatagaagaagctgcccctcttgctaggcacacagcttggtgagctggccgtggcccacagcccactctcagccctcagctgggcacccttgcgcaatgccactttgcctaatcgcacaccgcagccccaaataagcctacctcccctgggttctgatgaaaacaaaggccataacctggaaagcactcagcagagagcctgactctgagcagagcctcaaaacaaaagctatcgcagaccagcagactcagattaacatggaagtgtgctctgctggggatgtcacacatttatgccagctccacagcgtttattagagagcagagccttaagaagcagggacatgagtcaggtaccttcagtgaaggaactaacccatggccatagtcaagggcccaggcaggcaagggacaatgggagggagagaggagtgaggcagctatggacagacaggattgtctgaaacggaggggaagggaaataagaaaccagcctccctatggcaacattgcctcgagccctagcagcagaggctgcccacccagacccatacccagctccaggcgctgcctcaggggctcctgcctctcagattctccccttggggtcatctcgccagctgctcatgagtgtcatctctcaccagccctgctaaatcctcaaccctccccaccggcacccctcccacccccattagaaggctcaggtattccatggggccagttttcctgtccttgcgcttccctgattccccagcttcctcaatgggcaccactagaactcagaacccagaagtgtcaaggacctcaggaaggcaggggtttcagatgccacacccactctataagagcagctcttccttaagaggaaatcactgtgagaaggcaaagggtagtagccacatgggtattatattgaaggaagatgaattatgccatcaccccttttggcacaaaaataattttcagtaaaaggttaaaaccatcatgttgtatcaatgagaactatttcattattccaagaatgattgactggaaagtacttgacttacaggaaaatcacagtgatacaatacagctcctacttttaaagcactttccgtttaaaaaaaaaatcataccagtgtataaaaatagttataccgaagatgtgaatcaacagccaagtaatttattggcacttgaaagctttgtggtataaatagattcaacaatgagaatgtcaagtaactctgggccatggcaacctaaccttcattttcactaacacaaaagaaagtcacgtgtagttcagcaagggccatctggtcaccttagaagagatcatgggaagagaagaacatgatagaaccaggaccaataagtcaggtcaactcaaagcaagggacaaggcagcaggagaaacagaggggacagaaaagtagtccctgccctaaagagagttcagattgtcccagagcgaaggcttgtacagaaaacgttcagcacaatgaactcagagtcctaagagaaatacaaagggattacaggatgtcaaaagggagggagactcttttcagcttgatttccttcctttttccctccctctttgcctgcttgccccaaaccttcactgggtggtgaaacaggatgggagcggaatcactgggtctgggtacaaagtgcagctctgccatttaccagctctgtgactctggacaaatgactggatgtttctgagactcaattccctcaagtttcagtggcgggggagtgcagggtcagtgtgaagatgaaatgaggtcaatgttgtgtgtgtgtgtatataaatacccggctttgctgcctcttgatgaggagcaaacagtaaaagttcactctcttccttacccttccactcctctgtaaagagtacaaggccttttctgccccttttatgtttaaatttcaaagagtttttccactgttggatgtaatgtgacttttcagatcagccttcttgtctttgacccgaaggcccctgtcagccaggagcctccctgcttctttgtggtttggggctcagtagtccaactgctgccctctttgtgcagaaaaacacagaacccctgcatctcacatctggtgagaaggtggagactggggcaactgagagacggtccatcagcaagcattaattgaacacacaggacttttaagggattgtaaaactctaaggagtcagcagggaaagacatggacgagatttccgacctctcgtaagagtttaacacatggagattgcctctgtcatggttcttggttgaaaacagaagaaaccagtggtggtcttggcacagggcgctggataccatcacaacaggactgccactaacatcccagtcctcaattttttgtttttgggcaatcaatgtcacagctaaaaagtgttcctcctgggctgggcatagtggctcacacctgtaatcccagcactttgggaggccgaggcaggcggatcacccaaggtcaggagtttgagaccagcctggccaacatgttgaaaccctgtctctactaaaaatacaaaaattagccgggcgtggtgacacacgcttgtaatcccagctacttgggaggctgaggcaggagaattgcttgaacccgggaggcagaggttgcagtgagccgagatcgtgctattgcactccagcctgggcaacaagagcgaaaactccagctcaaaaaaaaaaaaaaagaaaaaaaaacgaaagtgttcctcccagtcctctcattgtttcatgggggtgtcattgtctagttcatggttacaacggaaactgcctcaatgaggtgggtattcccaagtgtgggaaagagcttcacttcagtctaccccgatttgtagcagatgtccacttaattaaaaagaaagagagaaatcattcaggggtagaaattggcccatttgcaaattcacaaagagtgactgatattgatttctttctcacacttgggatttttaaaatttctttattattattattattattattattattattattattattattttgtgggggggatggagtttcgctcttgttgcccaggctggagtgcagtggcacaatctcagctcaccacaacctccacctcccaggttcaagcgattctcctgcctcggcctcccaagtagctgttattacaggcatgcaccaccacgcccggctaattttgtatttggtagagatggggtttctccatgttagtcaggatggtcttgaactcccaacctcaggtgatccgccagccttggcctcccaaagtgctgggattacaggcatgagccaccgcgcccagcccccaaaacttctttaataaaattttttatttttaaaaagtaaaacttacagaaaatttgcagtagccccatatactcttcacctagtttccccaatattagcattttgccacatttgttttattgctttctctcaaaatacatcaatatcatccttttttctatttgagagtaagtcacagacatcatgattctacctcttaatacttcaggatatgtctcctgaaaaaaaggacataacaaaaatacaatataattatcaaattcaagaagttttacatggagataatcttatatgtacagtcctgtaatgtcccaatagtggttttttatcatttttggttcaggatccaatccaagactacgtgttactttagtctccttgaatatggaacaggttcttaaactatgttgtctttcatgacactgatattttttgaacagcacaagctcattgttttgtagaatgtatgtcaatttaggtctgtcttacgcatttgaggcaggaatactacatccgtgaccttgtgtccttctccaggccccacatcagggagcagtggtgtcagtttgtcttcttattggtgatgctactgttggtcacttggttaaggtggtgcctagcaggtttctcaagtgtacagttactctttttgcctctgtaattaatacataatctgtggggggattatttataacttgtaaatatcctaccctcatcctacctttacccagcagtgttaatgcctccattgatgattccttcctgaatcagacagcactatgattgttgcagaatagtgactttttaaaggtttttactagctggcattctactgtaaggaagaatttttctttctccagtatatttatttattttatatcagtatagacttgtggattcttaataacatttaatgtgactgttaacagtttatctattttcagaatcctttaagtaaattgcttttgcattttgtggatgagtcaacctaattgcagccagagctctttcctgatgtgggtttggccatttaatctatgctccactctatagcaaggccaacaggaaatagaatgctgaccttttataggaattgttgggttaagcacataggttgttgaagtgttttgagtaactctggcaaaatgaggtactctgggaagatatcataaaggagcagggccttaaagacagcaaagggttttgaatgaaggcccaaaaaggtaaagaagactggcaggatcaatggcttccaaactagacacagagaaagggggacttggcagggcaagaaggagtgggagaaggtcagagtgtgaaccagcagtgaagtgaacgtgcccagtctgcgtggagggtgtgcaaaagagcaagggaggtcaagggaggaagtggaaaaataaatgaagaaacgacatgtgttaagagttctgttcattgattttaggtaaaaagattgagcaccaagggatgatagattcagtggaagcaaagccatcaacttttaattagggaaaagactagaaatgcttttggtcagaaaggaaagaactaacagttgcttagcttttattttttaatttctctcttctattgaaagttgagctgttttttaatgttcacaaaatccttatgagagagatgttaataacttcattttatatataagaaaacaaagtcacagagaatttacattaatttccccaatgtcataaagctagtaagtggtgaggccaagattcacatacaggtctatcttactccaaagcccacgctgccagaagaaagaaatctttagactggaagagcagaggtggaattggagctctcaatataaggacaagtaacttcccatatgccaatcaaaacacttaagcatggcccacagtaaatctcagtaattatctcaaccacacgctttggagtaaatcaatagtaaacccaggaagtaactgtcaaggttttcaaacctgacattcctgtataactcaatacacatacccacccctctgccttcttaaaaaataagttgtattagatataatttttatacaataagattttacccattttcagtacatgattcaatgagttttgatgaatgtatacagtcatttaatcaccactataatcataacctagagtattttcatcaccccagaaagttgctgtgcagttcctttgcagtcagtactccccagcccctggcctgctttctgttgccacatttttaccttttctaggatttcatataaatgaattgatattagttggggttcaccagagaaatcagaccaagaagagagatgtatacgtatatgtatatgtatatgtatatgtatatgtatatgtatatgtatatgtatatttagtgtgtgtgtgtgtgtgtgtgtgtgtgtgtagatttattatgggaattgacacatgcagttatggaagccatgaaggcccacgatctgcaagatggagaactaggaaagccaggggtacaatttagtctgaggtcaaaggcctgagatcccagttagtgtgctgagggagaggggagaacatagatgtgctagctcaaggagagagagaaagaatttgcccttctgccttttagttccatccacgccctcaacagattagaagatgcctgcccacattggtgaggatcaatcttctttactcagtctacaaattaaaatgacagtctcttccagaaacactgtcacagacacagaaacattatttctattaaacagaaataatgtttaaccagctatgtgggcatcattcaacctagtcaagttaacacgtaaaattcaccatcacaaaactcatacaatatgatatgtagtcttttgtgcctggcttctcccacttagcataattcttttgagattcatccatgctgttttatcagcagttccttccattttattgctaagtagtattgccttgtctggatgtgccacagtttgtttatccattcttcagttctacaacatctggattgtttccaatttggagtgattataaataatgctgctgtaaacattcacatgtaggtctttatgtggacatatactttcatttcttttggataaatagctaggaatagaattgctgggttttataaatatatgtttaacattattaggaaactgccaaactattttccaaagtgtctgtatcattttgcattcccacaagcaatgaataagacttctcgtatctccacatttacaccaaccattggtactttcagctttaaacattttagtctttgtactaggtatataatgccatctcactgtgttttgaatttgcatttccctagtgtctgatgatattgagcatcttttcatatacttatttggcatatgcatgatgaagcttctttgatgaagcttctgttcaaatctcttgcccatttttattgtgttgttggtcttattggattgtattattgagttataacagtactttactagatacatgttttgcaaatattttatcccagtccatggcttatcttttgatattcttttgaagggcagaggctttaaatttggataaatttcagtttatcaggttttttaatctttgtgcttttggtgtcctaagaaatctgcctagcacaaggttacagcttttctcctgtcttcttctagaagtttgttgtttcaactcttacatttaggtttgtgacccattttgagttaattgttgtctatggtgtgaggtaagggtttgtgttcttacatatggatatccatttgtcccagaaccatttgtttaaaagactgccctttcctccattgaattactgggtacaggttgcgtttccctaatccaaaatctgcaatccaaaatgcttcaaaatcatgggccaggtgcagtgtcatccctgtaatcacacttgtaatctcagcacttcaagaggccaaggcaggtagatcccttgagcctaggagttcaagaccagcctgggcaacatggtgaaaccacatctctctctctctctctctctctctctctctacatatatatatacatatatatatatatatatatatacacatatacatatatatatatatacacacacaaacacacacacacacactctatacacacacacacacacacacacacacatcagctggccaggcatggtggttcacgcctgtaatcccagcactttgggagggcgtggcgggtggatcacgaggtcaggagctcgagatcaggctggccaatatggtgaaatctcatctctactaaaaatacaaaaattagccaggcgtggtggcagatgcctgtaatcccagctacttgggaggctaaggcaggagaattgcttgaacctaggaggcggaagttacagtgagtcaagacagcaccattgcactccaaactgggctacagagtgagactctgactcaaaaaaaattttttaaaaaggccaggtgtggtggcacacatctatactcccagctacttgggaggctgaagtgggaggattgcttgaacccaggaggcggaggttacagtgagccaagatcatgccaccacactccagcctgggcaacagagtgagacctatctcaaaaaaaaaaaaaaaaagcttcaaaatctgaaatttttttagtgccgacctgatcctcaaaagaaatgttcattggagtatattggatttcaaatttgtggataagagatattcaaccagtgagtataatgcaaatattccaaaaatccaaaaaaaaagatctgaaatccaaaacatctctggtcccatgtatttcagataagggatactcaacctatacctttgttggaaataagttgaccatatatttgtgggtctgtatctggactcttctatcaagttatcaagtgagctacgtgtctatccttatgtcagtatctctctgtctaattactgtagcttatggtaagcctggaaactttgttctttttcaaaactgttttggctattctaggtcatttccatttacatatacattttaaaatcagtttattaatttacaatagttggcagctgggatttttattggaattgcattaatctatagatcaatttggggagaatttatatcttaagaatattgagttttccagtccttgaaactctcaccatttgtttttctttaatttttcttttactttccatagcaagagtggatagatcttacacatattcagttaaatttagccttaaatacttcatttttaaaatgctgttgcaaatgttttgataactttgagttcttgttcattgctaacatatagaaatagaattggtttttttcgctctgttacccaggctggagtgcagtgatgcgatcttggctcactgcaagcttcacctcccaggttcacaccattcacctgcctcagcctcccgagtagctgggactacaggtgcctgccaccatgcccagctaatttttcttgtatttttagtagagacggggtttcaccatgttagccaggatggtctcgatctcctgaccttgttatccacccgtctcggcctccgaaagtgctgggattacaggcgtgagccaccgcgcctggctgcagttggttttttatagtgaccttgtgtcccgttaccttgctaaacctactatttctagtagctttttggctggacttcttaggattttctacgtaggtcattatgtcatctacaaagaaaaagtgttttacttcttccttttcaatctgtatgccttttctttcttttttttcccctgtccttttgcactggctaggcaatccagtacaatgttgagtagaagtagtgagaacagacatctttgattgttcccaatattagggaggaagcattcagtctttctggttgagtatgatgttagctgtagatttttcataaatgctctttatcaagaagatcaagttacaccttatttctaaatttgctgaacttttatcatgaatgaatgtagaattttgtcatatgctttttcagctcctgttgatataatcataaggtttttaatattactgaattacactgattttttaaaatgttaaaccaatcttgcattcctgggataaattctacttggtcatgatgcattatcagatattttatatatatatatacacacacatatatttatttaatttgctttaaaaagttaaggtttttacatctatattcacaaagggtattgatcttgttttcttgcaatgtcattgtctggttttggtatcatggtgacactagcattatagtgtttccttggctctgctattttcttaaagaatttgtgtagaattaggattacttctcacttaaatgtttgcaaggattatccagcgaagccatctagtctagagttttctttgttgggaaccccttatttttaatataggaaggacttatcttctattccctatcaacacagtgtgtaggccaggcacagtggctcgtacctgtaatcccagcactttgggaggccaaggcgggaggatcccttgagcccaggagtttgagaccatgggaagaccctggctatttatttgttttatttgtttgtttggacaggatctcactctttcgcccaggctggagtgcagtgacatgatcacggctcactgcgggcttgacatccctgggctcaggtgatcctcctgcctcagcctcccaggtagctaggactacaagcacacaccacagtgcccagctaatttttatgttttttgtagagacagggcttcacgacgttgcccaggctggtcttgctcccagtgtgctgggattacagacgtgagccgccgtgcctggccaacctcatctctacaaaatataaaaagattagctgggtgtggtggtgcacacctgtggtcccagctactcaggaggctgaggtggaaggattgcttgagtctgggagacaaaggcatcagtgagctatgattatactactgcgctccatcctgggtgacagagcaagaccgtatctcaaaagaaagaaagaaaaaagcaacacatgttgtagccctgagaatgaagggtaatcaagttgtgagaatcgttgctgcctaaataatgcttccagcacacacagttccaccaagccctgtgtttccctggccttggctgtagtggaagggaatttaagtgattttaagagtgttttcaggtgtgggtacaatattttttaaactttctttctttttttttttttttttgagacagtctcactctgtcgcccaggcgagagtgcagtggcacggtcttggctcactgcaacctccacctcccgggttcaagcagttctctgcctcagcctcccgagtagctgggattacaggcacccaccaccacgcccggctaattttttgtatttttcgtagagacggggtttcaccctcttggccaggctggtcttgaactcctgaactcatgatgtacctgcctcggcctcccaaagtgctggtattataggcatgagccaccgcgcccagccatatttttaaaactttctaaaaaaccttgtctgcagccaaaaaataccctgctagctaacagagggttaggtagacctgatttctatcggcaatgccagaatgtctcctttccaccttgtgcctccactctggtcagggtgcaaggtagggaggcacagaggcgtggctaacctattcatactcttattatctgaaacttttttggaaaaatattataagcttatagcaaatcaaacaatataaaagtatataaagaagaaaagaccactgtccctgtaccttgcacataagaaaaccaaatattcacaatttgatacatatccttcatttttctctatattctttaaaaaaatacacatatgctcatatagataggtatttgtctttctcattcttttatttcttttcccccaaatgggatcatggatgctgaaacctcattttttcacttaactaatggacatttctccaagtatgtgcttctgttgctagacttttctcattaatagctgcatacttttccataataagaatgtaccagtttattcatcctatttgatagacaatcagatggtttccagcgttttgcctttgaaaataatgcagcaataagcatctttgtacctatattcctatattacaggagcttttccttctgtaggagattcccaggagcaggattgaaattgttgaatcaaagagcgttacacattttctttctttcttttttttttttttgagatggagtctcgctctgtcacccaggctgaagtgcagtggtgtgatctcggctcactgcaacctccatctcccaggtttaagcagttctctgcctcagcctcccaagtggctgggattacaggcacctgccactacgcccggctagtttttgtatttttagtagagacagggtttcaccatcttggccaggctggtcttgaactcctgacctcgtgatccacctgcctcagcctcccaaagtgctgggattacaagcatgagccatcgcacccatccgagcgttacacattttctagtcattaccatcttttcgtgtgtttattacctaccatatacatttccttttctgaaattgcaggcctatatctttattcatttttatcctacatttgtctttttcctagcagtctgaagatattctttgaatactgaggatatgttacatgtattgcaaggattttcaccaaatctgtactttttcacttggctttatttatagtatctttggacatataatttttaaaatatgtttataaaattaaaaacctgttatttttttcatgtctttttgtgtttactgacttgcttatgttttccgtctggggttatacaaaaatattcatcaaaattttcatcttattattttactgttttgttttttacattcaagactttagctagaatttaattttgtatgtaatgtaaggaggagtcaagacttggcatctgggagtttgccgtaactcttcatatcttgtggcattttccatgttttcataataaccctccagtcagctcatagttcctcaggtttcaggcctttcccatgttggctgctgtgctgcaaactgagagtgggaaggaaccatgtctgtctctttctccattgcatccttcaggaaggaccagtaaatgttgcaaagcacctagcatagggcctaacacattttaggcactcagacaacattcatggggggaatgaaagttgcattcacaccgcattactatcaccccttggcaagtttaatattgatggctttgtctgtgtaaacaaggggaaatgtcattctccttaacgccactcatggtctcatgagctcactctggtccttcctccttctgtgtctttattctttgaggtctgccttctctttataaatctggctcattctataaggactcccttctggcagaggcaaggtggggggcgctttcttcaaaccccttcttaaaatctaacagtacttataaattctgcaatactatttagcatttaatccacaatggattttagtccttttctagcacccatcactgtgctgggcacatagcccattaaatacatcaactgtgactgaaacaatcttgcatgccaaggttctttaaaaagcctgaggtatagcctcaagatttgttatgaaagcccttaggtctaaggaacaacaaactgggaagaggtagaaaatgaccctgagaggccgggcgcggtggctcacgcctgtaatcccagcacttcgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaagaaaatgaccctgagagctgttgaatacaagaatggtttttctttttttttttttctttttttttttctgagacagagtctcgctctgtcgcccaggctggagtgcagtggcacaatctcagctcactgcaagctccacctcccgggttcaggccattctcctgcctcagcctcccaagtagctgggactacaggcgtccaccacctcgcccggctaattttttgtatttttagtagagacggggtttcaccgtgttagccgggatggtctcgatctcctgacctcgtgatccgcccgcctcggcctcccgaagtgctgggattacaggcgtgagccactgcgcccggcctaagaatggtttttcaagtgagactgtgtagtcacatttaaattgtcctgaacacaattgttagacaaacacgagcaggtattgctctgtccaaaggcacaggtccacagactttctcaggacgttttctgtttccatggccttcaccagcttggatctttggagcttcagagaaaatggaaagaaacttgatgtgtccctatatttggtttagaaataatatcaaatggctctcagctctttctgcgtgcatttttaatgaagaaacggctaattctagggctagggcagggactatacaagatgaccctggagcatcttgggggattttgtttgttttgtttttgtagaggcgaggttttgccatgttgcccagtctggtctcaaactcctgggctcaagccatctgcccacctcatcctcccaaagtgctgggattacaggtgtgagccaccacgcccggccccctggggcatcttgtaatgccagaaagtactcaaaaccaaaaggatgggcgtatgtcaaagggacacaggagccaactggaaaagctcccaatggccaaagctggaacaattcgaacaacaaaataatatagcattgaattatagcccaaagaataaaacaaccatgagttcatactgatataaatgactgaataaataaatggaagagaccaatctcccatgcagaagaactcccaataatttatgtagaaactccacccttaaggagatagagcatagaaaccccacccttaaggagatagagcataacttcagggaataattccccaacccttaagagtggaatacatgtaatgccttgctttccaacatgaaaaaaaaaattaaaattaaagaaacaaagagtacaacatgaaaaaagggagcaaagtaactttacagtggagaaacttggcaaagactaccttagccaggtgaccagggttaacaccatcagtaagaagtcatgttgatcatatgtgcccttaatatgatgtgatgaaaatgacatttcacctctgtggtcttccaaaaaccataaccacagcctgtaagaaaaacggacatatcccaattaaggtatgtgctacaaaatacataaccagttctcctcaaaactatcaaagtcatcaacaacagccaagtgcagtggctcacacctgtaatcccaccatttgggatgctgaggcaggaggattgcttgaggccagcagttcaagaccaggcaggccaacataatgagacccttttttttttaattaaaatttttaaaaattagctaagtgttgcacatgcctgtagtcctggctacttgggatgctgaagcaggaggattgcttgtgcccagccaggggttcactcaggagttgagcccaggctgcagtgagctatgattgtgccactgcacttcagcccaggcaacagagcgagaccatgtctctttaaaaaaaagaaaaaaaaaatcatcaaaaacaaagaatgtctaagaaactatcacagcctacaggagtctatggaaatatgacgattaaatgtaatatggtatgatggatgggatcctggaacagaaaaaggacattaagcaaaactagtaaactctgaaaaaagtatgaagttcacttaataatatattatttctttagtggtgataaatgtaccacagtaaggtgttaacagaactgggtctgagtacgtggaaactctgtattatccttgtaccttttctgtaaatctaaaactaaaattaagtttacttaaatatctttaaaatatgcagtttgggcaacagattgactacatgcttatcttcaaaactgtgctttcaattacagggtgctggtgacagctttgtgggagctctggccttctacctggcttactatccaaatctgtccttggaagacatgctcaacagatccaatttcattgcagcagtcagtgtccaggctgcaggaacacagtcatcttacccttacaaaaaagaccttccgcttactctgttttgattgctattagtcccaaaataaatatacctgggaataaaatgtacttgggggtggctgctcctggctaatgcttattagaaaatgtcctcgtcccctttctttgcaaatattagttcttttacgaagtcatcctcaagcttcaatttatttataacgatgattcttttgctttccatgcatttgcacaaaacaaccagaattaaagattccacaacc

SEQ ID NO: 38514 - DNA, 10882 bp, Homo sapiens
gctaatatgctccctctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctgtgagtatccagtcggggagaggggccggccccgccgcgcatgcgctcctcgccctgccctgccccgccccgccccggcggccccaggggaaaggacccgctgggggtcgggggtctgccgggcgcctcccggggcggaggaatggcggggccgccgggagccggcgtcctggggttgccatggttacccgctcgggcctgggcgccttggtaccccgggctgggctgggctggcgcttctgggaacattcccggagggaccagaaaccccagggcgggggggcggcgggggcgggggtggggcaccggcctggggcacgtgactgagccctccccccgctccccaggggcttttgtgagactttctcggtgatgctcacggggcgcatgcccacctggcccgtactaaagcgtcaactgttgacttgggcgtaggtgacggcagccacattgctaacctttgggcaaggattgtttgtaagggaggcgggtgcacggctggctagatttctggcaggaagccactgggcggaagtttgctgagggtcaggtggtgtcagggcacaggtggcccctggggccgcggggcagtgagctgagggcccggcctctccctgggtcctctgtccgctctcatatctcccccgttgctgctgccttagccgcctgtcaccggccttcctccccttctccgcacgcatcccagtcacagaccctgaccttaggctgccagggaagctaggctcttaagcacagccagaaaaggacaaagagggaggcaggtcagctccaggagtgaatggaagccgtacagctggccttccagggaaagacaagtctgtctgagtgataccctttcctttcctgtctgccctcaatcttgtggattactggagtgggcaaggtcttagagaatgtctgtcgaggatgtctgcaggttttaaacagtgcctgcctggcagagagggctagctctgggcctgggcagggcaggccccatcagcaatcctgccagaaggaccaccttttcagggtcaccttgggttccacagcctttccaggtgggtagagggtggagggaggttgaggcaggagggtgctgggctaggagtgtgctgccctcgctaggcatgcccttatccagaggcaacggatacggtagggcaggccctacccccaaatcacaaaaaggccccgagtttgtgtcactgctcttcagggcaagtacgcttttgactttgtaggagagactggtgggtttgaagttaggcattggatccagtcctgtcatgtctggttagctgttttccctgcagattagggtgggcagtgcagtggggtgacatggtcagtggtgagaaaggaaaggtcctgactatggcctgtaggccacacctccttccttcttggtcagtggccctgccgactcccagatttgctgtggagtcttactcagttctgtgcctctcaaagtgaggtacctctgcctttcctgggagttcctggggctctgttgggtctacagatgaagcttcaggagaaacttgtggcattgccctgagttgtcagttgcatctgcagatttttgggggcatggttatgtgaacatcaaaatgctgtattacagggtagaatgcaaaaatgcagggtgttttagagatgcggcaggagttcagacaagggttgtgtgccgggctggtccttgggtaaggttttcctcctccagggtgaggggatcagagagagtacctggagagggtctaccctgggtcctaagagcatctggaggtgataccttgggaggggacaggattgcatggtgacagccccctcacgtggaagatatcagcattgaggcccccaagtggacatcctccagccctttattgctaaaggattcctggctggagcctgctggtctggcttgacacctggtcctcccccaaggctggctgtgggttggacagctggggtagggttggagctggaggccaaatgctgactgcagcaggaagcacagccgagctgtcaggtgaggccaggcacagcagagaggcagggagccgtgtcaccctttgggcactctgctaggacaggcaggcccctgtgtacctgtggttctggaacaccttgctgtctgaaggcagatgtctaaggctgtgctgaggagcagtgcaacgcttgagtcctttgttttagaaggagaccctgggggcccatgaagcagtcccattgcagttcggctcactttatctggcttctttgcctgctgtctgcataaggttacctgggaaaatggaaaacagcagaattccagacccaggtggagggatcaggtgcagaggagctgctgcaagtttaatgagctgggtgctaattgctgcctccaaggcccccctcagtgatggcctgggcttgctccctgcccagcagccacctccttggacctgccttgaaggctcctggagttcctggtgaagccaggctgcaggctgtgggtggaggagggagttgggtgcaagagaccctgctggtgaggtgcagctgggaggcggggcgtcaaggctgcacatctgagcatcagagaagccacgttctggggtggaaaacgatgccccctccccttcctggccttatggcatttcagcggtgggtggctgggctgtgggacttgctcatgtgcaagaggagaaacgggtctaggaagatgaagatagcgtgccagtggcacagggctggtgaggaagttagagctggaactgctgctcagtcttacctggttcccatctctgttctgagagaggcaccccttgtcccaaccaaaatccaagccacattttctgagtcagaggacttcttgtgtggccggccctgtgaatggtggcaagtgacccttaccgaaggctgagtcttgggggagcactggcctgaatccttgagggacattcactctttaatccttctttaatcctaacctccctttgaggtggatattgatgtagctggggtcagagggccagctcctctgagccctgaaacggggagaggatgctgtgagatccacctgccaccttgctgccaccttgctgtggggcctggggcaagcaaggcactgcacctctctgcgtctcctcacctgtctcagacgatagagggcaggcttctgggtgctgtgagaactgtgtgctgagcatccgcagagactctcgtcctttccagtcatctcccaaggccgccttcccagcgggctccgcctgcctccctgctgactcctgcccgtgtctcttgtttcaagcttgcgcgatctctggcctcttcaactgcatcaccatccaccctctgaacattgcggccggcgtgtggatgatgtgagtaatgcatggccgtcccaccccgggggtcttgctggtcgggaatctgctgggcacctcccgggacagaggagtggcaggggccgtgggagtgggcatccttgtggttgccatggctactggctccagcctgggtgcctcgggcatgtgagtttctggccacagcatgcggcttcttccccttcatacccccaccatgtttagtttcctaatgagaggtcaaggcccagggaatgcccaccccggccttcatccggtgcaggggcaaggccatcagtgctccagacatttctggagcatccactgagactgcagatgccaagtccactatactggggccctcgccctctgggagctcccaggactggggtggggaaggctgttcattggggctggctgaggactgggttgaatggtctgctgggagagggcactcgagctcggagctgtgccaaagatagatgggagaggcgggtcggagttgtcacgggaacccgtggtcagaacaccctcatgtgcgttccatgcccacctcctgccagggtttcgccatcccatcggaagggaaggcggggtgagggcaggcccgtgtggcttggggcacgtgagaagtggcggtgcaccaggaattgatgagtgtcctcatggggcttggtgccttgaggggtacagagctagacgagattcaggtcccgtccccagtgacctatggccagtggagagcctcgggggcctgctgtggtggggtcctcagtgcttgtgctggccagtggtggatagggaagggggatggacagagaggcgcccagcccagcttcagggggtggagtcggagcctggccgagtttgaagtggaagggctggcccagcacagagtgagcccgtgcttggaggcctggtgtgtgggaggctcggggcgggtgcagtggttaagagttgtgaagagagtgcctgccccgggcttggggtggctcttaggtgtcctgagcctgcatttctgttacacaggcataatgatggcacttttctcccaggcctggggacagaagggcctggctcagtgtctgctaactgattgttatccatgcatagagaataccaagaccacagcagacaccttccgtcaccagtggcttagctgttcccaccccaaacatagggctggatgcaaggacttgctaaagttcttcctccccagcgtgggcttcccctgggtgtccccgggcctggggccggtggcatcaggtgtgtgggcagctctccgtgactgttttgggactgcgtggctccagctctctgcctccctggtggggcagccttcctggtgctggtgccactgacggcttttggtggccatggcgataatactaacagcagacagaggacacagctgccagtgctccatctgtggatgaacctgccgcagcgttgtagcagtgccatgatgtggggtcccctttcctccatgtcacacaggaggaggataaagggaagcagaagcccaggggcttccctctaggagtgttcagttcagctggggagatgggtgtgcaggagcagctggggagtgctggagtcttcagcagaggctctccgaggggtacgagcaggtgccctggagcagccgggcggcttcccagaggaggagggatgagggcaggagggtgagggaggtggcattccttatggcactggcactgggggccgccctcatcctcctgggattgtcagtcgctgctcttctcctgccctggtccctgcagcatgaatgccttcatcttgttgctgtgtgaggcgcccttctgctgccagttcatcgagtttgcaaacacagtggcggagaaggtggaccggctgcgctcctggcagaaggctgtcttctactgcgggtgaggggttgctgggcagggtcccgtgacacagttccccaaaaccccactgacaaaataggacccaaaagtcaggtgagggtgggcagtgtattcagttcctctctgtggaagtgtaaactgggattgcctttgtgcacagtgatttgctcatagctgccaaaacgtgccccagtggttctgcgcccaggaactcagctgtcgctgtgccgtagtcactggaaggttcagaggtatatgagcatgtgtggcagcatccgtgcagtggagagaaagtgggaagcgtctggaattttggtccgtccactgggagttgttaaccagatgatagtaggtctgtaggacatgtttctctgcagcctttccgaagagtgggttcatctagatgtcctgacgtgaagggggagaagcaggttgcagagcagaaaatgtggttgccctctaaatacacttgttaaaaattttcccatttctaacaatgaaatcaatatgtaatacttctcctctcagtcataagaaggaactaatttcaggataagcttaatacacggaaactcctagaataatgcctctagtgcataggaggctggtggcagctgtattcattattgtctaggttatctttagaaagaagtctagatgcaagcttgcttccccttcagagaggcccggtagttttgatggtaagagcacaagccacatgcttagttctggagccatcttgtgccatatctaaatcacgaagaacacaggatcacaaagctcttatctacacgcagtgtcatgtccttaggggttcaaaaaactgtattttaaaaatgctagacatcatagaaattcattcacaataatttggaatatagaacaatgttactcgaagcccgctgcctgctaatcttctgatgtgtgtgcttcctgtctgcaggcattttttaaaagcctgcttttaacacagttataaccattatgaataagtttgtatcctgccttttttcacttagagtaatgatataagcatttgaacatcaccacagactttataacattctttcaatacaggaatattcattcagctggatgtatcatgctgttcttaatttcttaactggtgtaaatcgaggtgtgataaacatgtgtctgctaaaactttttctgtgtttatgatgatttccttaatatctattttcaggtgtggaattactgggtcaaagattctgatcattaaaaatattttaagatgcgtggctacgttgctttccaaagaggtcccttgagtctctcccccgcccccaccccagcccagggctgcacaccacttcacattcgcatttatctatttgttatctaagagggaaaaatattttcccacgtgtttccattgcattttctgatatgaaaattttcgagtttactttttaacctgtgggaacctcagtgttctgcttagcaagttcagtgtgttttctgtattaaagatttcatgatccttggttgtatttcctgcaactatttttccaggctcttgtttgcctttaattttgtttttgtcagaaggttccccgccgtggtctttttctttgtaatttctattattattttatcattttgaaattttttaacgacagaaaaatctcacaaccacatgtctacaagaatggaaactgaggtagaatgcaattggccacgagtcttgtcctcctgcacaggcagcctcctctagggaggcgacaggacagagcgctggcctccaggctgcaggtatcctcctggcccagttagcccaggaattgctgctggcctggaaattccagccaggatggagaatcagccccggggacgcttaagccccagtggaccctgccaccaggtgacgccaaactgcagcaaggtctgggccgaccccgcagaccccgcagcctgcagccctcccatgatgagaccctgtgttccatgtggttgaattccagggaccttacttgtggcgatgtggctggtgttactctataactcagagcatttatttagtgcctgtggtggtcagcattgtgtaggtaacatgactgacctcggacaagctttgatcccctctccgcggtggagattccgagtaacttgcccgcgaagctagtaggtcctggatgggaagccagattctctgtcacaggctctttctggccagtttttctcacagtgagggcactggaccatctcgttactgtttagctctttttgggatcacagaccccttcaaaaatctgatgaaagctttggatcctattcccagaatggaacagttttacagacaagttcagggctgatgaaggactttctgaagctgtgtctcagttgatttttggggatccttcctgtgccctgggtgtctaggaaggatgctgggccgagtctgggaagcggggaaggatgtggtggctgtggggccggagtgcccccttgacctctgctttccccccaggatggcggtcgttcccatcgtcatcagcctgaccctgaccacgctgctgggcaacgccatcgcctttgctacgggggtgctgtacggactctctgctctgggcaaaaagtgcgtctgccaggcccagcccctgggcagggccttcctccctccgccccccgaagtccttcagtgaggaggatctgagagtggccccttttagctagtggagaccgaggcagaggtcccagtaactcattggtgcctccagggctcagctcgagtgggtgaagacagaggacttacaacacttctgcgtggcccagtcttgccccgtcacggcctgcagcaaggatagcaaaaacatggctggtgggagccccttcccctcccaggtctgcaccgggcattgtactcagttgccaccctctctcctgcagagcccagactgaggctggttccttcgcagcccagcatcccagggagcctgggccattctcagaggggacaagacaggcctttgccaccccagcagttgtctctggggaaatcagaatgcctgcaggtcacacctgggtcacagggcaggaaccgggcagtggtcaggagggctgtgggcatggggctggtgctccacgtgacgctgcctctctctctccccaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactac

SEQ ID NO: 38515 - DNA, 59246 bp, Homo sapiens
ggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagaggtacctgacatgggaggcggggaggtggtgagaggggcagctccatgtttcagaaccccagttcctagagttttccagcatttctctgaaaaactcacatgcctgtgccctcttatttctgattgattttaactgtggtctggggacaagtgtgccctattttctttctttgttttttttttttttgagacagagtcttgctctgtcgcccagggctggagtgcagtggtgcgatctcggttcccaggttcaagcgattctcctgcctcagcctcccaagtagctgggaccacaggcgcacgccaccatgcccagctaatttttgtatttttagtagagacgggatttcaccatgttggcataggtgatctcgatctcttgacttcatgatccgcccccgtcggcttcccaaagttctgggattacagttgtgagccaccgcgcctggacgtgtgcgctattttctaacgtagcttgtgatccagaaaggtcctggtgcctcattcttatcttccttttcccctccggccagctggccttcaggaaaagcatcccggaggaggaagaagaagtgttatatgtcctaaagtaaggtttcaggtgagttagctttttgttcattcaatgatttgtatttatacaacttaagactatttactttccttgggcccatttcttcccaaatagtcatttatcccactaattcctccccaagggatgtgacagggcggtgcaggtcattcctccgtgtatactccattgacctaccctcttctaaaatgtctaaaaattgtctaagaatctgatggtacagaagagattaattctaacactttatattacagtgtggtttggtaaggaagggatttatttttgggtggaaggaaacaccagatatctttggtcttttgtttattttttattattgtagttattttttaacatggttaattttttaaatttttatataattggcaaatgacaaattgtatttattgtgtatatgtttttatatatatgtatacattatgagatgattaaatcaggctgatgaacatatccatcacctcactaattattatttttgtcatgaggacatttaaactctactctcttagcaattttcaaatatactatattttttttttattttttttttcttttgcccttgtcccccaggctggagtgcaatggcatgatctcagctcactggaacctctgcgtcctgggttgcagcgattctcctgcctcagcctcccaagtagctggaattataggcacccaccaccatgcctggctaatttttgtatttttagtagagacggggtttcatcatgttggccaggctggtctcaaactcctgatttcaagttatctgcccgcctcagcctcccaaagtcctgggattacaggtgtgagccaccatgccctgcctttgtcccaatttttaatcaaatttttttttcacactcttgagttgtgtgagtttcttatatatcgtgaatattaactgcttgtcagatgtatggtttgcaaatatttccttctactccataggttctgtcttcactctgttgattgctctgctgtgcataagttttttaatgatgcaattcatttgtctgttagccaccatgcccagccttgatttctttttcaaatagttgttagtctatagggatactattttttttttatactttaagttctagggtacatgtgcacaatatgcaggtttaatccataggtatacatgtgccatgttgttttgctgcacccatcaactcgtcatttgcattaggtatttctcctaatgctatccctcccccagccccccaactccgacgggccctggtgtgtgatattcaccaccctgtgtccaattgatctcattgttcagttcccacctatgagtgagaacatgcggtgtttggttttctgtccttgtgatagtttgctcagaatgatggtttccagcttcttccatgtccctgcaaagggcatgaactcatccttttttatggctgcatagtaatccatggtgtatatgtgccacattttcttaatccagtctgtcattgatggacatttgggttggttccaagtctttgctattgtgaatagtgccacagtaaacatatgtgtgaatgtgtctttatagtaccatgatttataatcttttgggtatatacccagttatgggattgctgggtcaaatggtatttctagttctagattcttgaggaatcgccacactgtcttccacaatggttgaactaatttacactcccaccaacagtgtaaaagtgttcctgtttctccacatcctctctagcatctgttgtttcctgactttttaatgattgccattctaactggtgtgagatggtatctcattgtggttttgatttgcatttctctgatgaccagtgatgatgagcattttttcatgtgtctgttggctgcatagatgtcttcttttgagaagtgtctgttcatatccttggcccactttttgatggggttttttgtttttttcttgtaaatttgtttgagttctttgtagattctggatattagccctttgtgagataggtagattgcaaaaattttctcccattctgtaggttgtctgttccttctgatagtagtttcttttgctgttcagaagctctttagtttaattagatcccatttgtctattttggcttttggtgccattgcttttggtgttttagtcctgaagtccttgcccatgcctgtgtcctgaatggtattgcctaggttttcttctagggtttttatggttttaggtctaatatttaagtctttaatccatcttgaattaatttttatataagatgtaaggaagggatccagtttcagctttctacatatggctagccagttttcccagcaccatttattaaaaacggaatcctttccccatttcttgtttttgtcaggtttgtcaaagatcagatggttgtagatgtgtggtgttatttctgaggcctctgttctgttccattggtctatatctctgttttggtaccattaccatgctgttttggttactgtagccttgtagtatagtttgaagtcaggtagtgtgatgcctccagctttgttctttttgcctaggattgtcttagcaatgcgggctcttttttggttccatatgaactttaaagtagttttttccaattctgtgaagaaagtcattggtagcttgatggggatggcattgaatctataaattaccttgggcggtatggccattttcacgatattgattcttcctgtccatgatcatggaattccatttgtttcctcttttattttgttgagcagtggtttgtagttctccttgaagaggtccttcacatcccttgtaaattggattcctaggtattttattttctttgtagcaattgtgaatgggagttcactcatgatttggctctctgtttgtctgttattggtgtataggaatgcttgtgacttttgcacattgattttgtaagggatactattgattttttaatgttgacgttgcatactacaactttactgaattcatttattatttctagtcattttttgatggagcttttagggttttttatatgtataagatcatgtcatctgcaaacaggaacagtataacttcttcacttcctatttgattggcttttctttttgttgcctaattgctctgcctaaggcttctagtactacattgattagaagtggtaagagtgggaatcctcgtcttgttcctgatatttcaacttttcaccattgattatgatgttagctatgtgcttgtgttatatcacctatattatattgaggtacattcctcaatacctaatctgttgagagtttttgttaggaaagcctgttgaattttgtcagatgctttttctggatctattgtgatgatcatatggattttatccttcattctgttaatgtgctatatcagatttatagatttgtatatgttgaaccatccttgcattcctgggataaatcccgcttgatcatgttgaatgatcctttttatatgctactgagttcagtttgctagtatcttgctgaggatttttgcttttaggtttatcaaaggtactggccggtgatttttcttgtcttgcagtgtccttgttgggtttggtcatgctgttcttataaaatgggcttggagatagtcccttctcttggattttctggaagagtttgagaagcattgtattaggtcttcgaatgtttggtagaattcagcagtgagggcatcaggttctggtctttcatgggagatatttattgcttattcaacctccttacctgttgttagtgtgttcagattttgtatttcttcatgattcaatcttgatagattatatattactaggaatttattcatttcttctacattattcaattttttggcgtagaaattttttttttcttttttttttgagacggagtctcgccctgtcaccaggctggagtgcagtggtgcgatcttggctcactgcaagctccgcctcccaggttcacgccattctcctgcctcagcttcccgagtagctgggactacaggcgcctgtcactgtgcctggctagttgtttgtattattagtagagacggggtttcaccatattagccaggatggtctcgatctcctgacctcgtgatccgcccacctcggcctcccaaagtgctgggattacaggcgtgagccaccgcgcctggcccgggaactaattttttttataccaggcctgcattgattgcattataagaaatataacttgctgggcgcagtgcctcatgcttgtaatccagcactttaggaggccaaggcaggcggatcacgaggtcaggagtttgagaccagcctgaccaacatggtgaaaccccgtctctactaaaaatacaaaaattagccaggcatggtggcatgtgcctgtaatcccagctacccaggaggctgacacaggagaatcacttgaacccgggagttggaggttgcagtgagagccgagattgtgcctgggtgacagagcgagactccatcttaaaaaataaaaaaaaggaaatataacttaaggaagtcctgaatttaaaaaaatgattactcaaggtaaaaaaatcagagttatgaaggtgctggtaccttgtagttattaataaatgtttgaatggataggcttgtgggaagcataacaagtgtatctcaaaaatgtccacaccctaattcatgaatgcaggaatatgtgatgttgcacggcaagggaaatttcagttgtagatggactgaagttattaatcagctaaccttaagatagggagattatcctgaattgtgccagtgggcccaatgtaatcacagggtattagaagtagatgaggggtgccagaagaagagaaagaggtgaggatttactgttaactgtatttactgttaacattttgttaacaggtatgtgtcctgtctcccactcccccactaaacacgtgtgtatgtttgtttctggaacattaaatcctgctaattgatcatgtagatgagttaaagactcttcaaatcttagtttgtgaaagaaatccaacccagccatgggtcacattacatttgtgtacatgtggagaagagagaggcaggccagttatctttctcttgctttgaaaggcttcacgtttacaccttatagaattagagatacgccatttcaaactaatcccatgacagcagattatcaagaaagcctttcagaattagattttctatgattttaatgtttctttgacagagaatgataatcagtgatatctgatgccttccaaatatacacaagtaacatttccatgattatatgtacaagtaacaaatccaaggtatatgaaatccaaatatatgaaatgactaagatggcaacaatttgaaataattacacgaatctcccatatcacatagaacacatgattcagtctcttgctaatattcttgatttggtatctcttctcagattagattctttaaacttgatttctgatgcagaatcatgtctctatttccctagttgctggtaaagagggaacattttcttacgtgtcttagaatcgtttttgctaattctgctgattcaaataaattcatgcttaacatcaggcttggaaagttatttttagttagcattcatgatattgatagctgattgagaagcacatattttagcataagaaaacagcagcctcatgtttcttttctaaaaatggattaagggatatgtaatgtcagtgatctttaataaaaacagctaacttatgtaaagtaattgttatgtattactatgttttatgtagattatcttacttgataattgagatagccatatctcatggtatttatattccagtttcaccagtgaggaaaaagacactgcgaggttagtaactgtcagagttcagaatcacaccctgaaagttgtactgcagagcctgtgttcttaatttctccaaagtacctctgcccaaattacatgtacctttttaaatctactttcttcatttggtaatacatcataaatgctttctcaattatatggatcagtatcactagtaaatgtattttatgtcatgatatagcagatcataatttatttaatctgtcctctactgtcagatatttctttttttttttctgagacagagtctcgctctgttgcccaggctggagtgcagtggcgcaatcagagcccactgcagcctccgcctcccaggtttgagcgattctcctgcctcagcctcccgagtagctgggactacagctgcctgtccccacgcctggatgatttttttgtatttttagtagagacgaggtttcacaatgttggccaggctgctctcaaacaactgacctcaggtgatccgcccaccttggcctcccaaggtgctgggattacaggcatgagccaccgcacccaacctatttttttgatttttttaaaattattctctgaaggctgggcgtggtggctcacgcctataatcccagcgctttgggagctgaggcgggtggatcacgaggtcaggagatcgagaccatcctggctaacacggtgaaaccccgtctctactaaaaatacaaaaattagccgggcgtggtggtaggcgcatgtagtcgcagctactcaggaggctgaggcaggagaatggcgtgaacccgggaggtggagcttgcagtgagccgagatcatgccactgcactccagcctgggcgacagagcaagactctgtcttttaaaaaaaaaaaaaaaattattctctggagaagtggaataatatcaattgattgcatcaatgacagtgtcctagttgtggtattacactgtagttcaatcatcattggtataaatcaggtaaaaggtaaacaggatctctctcgctgtattgtttcttacaactgcatgtgaatctttatctccattctaaagaaaattcacagagaaaaaattccctgaatattcttgcacaaacaattgtgtatgactatagctgtgtccttcagataaattttgaaaaccagtattttgagtcaaaatcaagacttgttaagtgtctgcagtacgccaaactctgtgatattagcacgaagaatgagagaataactaaaaggacacagctgctacctgtatgttgtctataacccagcaaggaggggaaactgagtagaagcagctcagggcagcctgtgatcacggactgtggggaattccaggtgatgtaccttgagaggtgctaggaagggaacatcattctgacagcacccgctcgggtaggccattcttgcattgctatcaagaaatccctgagactgggtcatttataaagattatattggctcatgcttctgaaggctgaaaaggaagcatggtatcgacatctggcatccacttggcttctagggaggcctcaggagcttttactccactttacttggaaggtgaagtgggagcaggcacgtcacatggcaaaaggaggggtaaggttgggacacagcgctggcgggaggtgcgggggatgccatgtacttttaaatgaccagattttgcaagaactcactcaccatggccaagacatgagggatctgcctccataacccaaacacctcccaccaggccgcacctccagcactggggatgacagttcacctcccaccaggccccacctccagcactggggatgacagttcacctcccaccaggccccacctccagcactggggatgacagttcaactggagatttagacggggcaagtattcaagccataccgcccacggatgtcgatttataaccaaataattctgaattcacaggttccatgtgtaggtaaatacaatttgttttataacttgtatttttctaataatgtttgatgcaaagggaagaccaatagggtaaggcgaattaatgcttgtctgctgggccatcatggcttgaaggacaagttcagaggtaaaattcacactcccctcagacgtaaaaggaagcagcctcaaaacaactgtcggtatgtacagggcatcacttggcattttggccatttttccagtcagtgctccagcacatgtggaaatatgtgtctgtgtgtgcatgtacattggcatccgcaggggtaaccgggacctgatgtgtgagtagaagacgcacttgcgtgggcgtgtgtggggttgatgtgccagctctgtccccataattgtgacaggtgtgcgagtatcttgggggcaatgggacccatgcagggtgaccatccttacagagggaggtcagctacacagtctataaccccagttaatacaatgtagaccccaggaatctctgaaacactctgatcccagtgccctctgacttctgattgtcatagatatggcctgagggcagctgtgccttatgaggtattttctaatgtaggctgcgcacctagaaagaccctagcttctcagtcttatcctcctctttcccctaaaccaacattcttacgaaaaagcacgccttgagaggaggaatcatttacccatcttaaaatcaaggttcaagtgagttacgttttattcattaaatgattagcgtttataagacaggactatttactttccttgcccctaaatattctcactataacaacttatcccggtcatcctttccaaagaggtgttgggggttcatacagggatatccctcaatgtactccccattgaccaagtctctcttctgaatgttattcatgtgcctctttggcaaactgtgtagctttttctgtgtgctctgctcttctaagaatctgatgatatagaaaaatatacctcctggagcttaacattagtgcgtgatattagaatgtggtttgctaaggaaaagattcgtttttaagtggaatcaaacaccacctatctttagtcttttccctaagcctgattttcatatcacagccagaaagtagatcgtttgagtacgtgacaaggttgtcagctttgtgaggcttttaagagtggagtttgagcaaacttctgtgtcatcaaaggcataaatgttttccaagtaatcaataaattgaaattttttctgtttactagattttctttgaagctgacagcctcagagttgtttttttccacttgctttgtgtgcacagtgagaagcaatgtggtttgattttgagtatgagttctggatctaggacagagttggcaaatttttttctgtaaaacgttcagcagtaaagggatttatgggccacatatagttctgtatttttcttctttttatttatttattcggattattgttgttttgtttattaaaatgacatcctttattttttatttttatttgataaataacaaattatgtgcttattatgtacaacattatgttttgatatgtgtgtgcattatggagtgatgaaaccaaagtgaataacatacccttcaccttactagttatcatttttgtgattagaacatttaacatctctcagcaattttcaaatatacattgttattcattatagtcaccaggttataaaatagatacgcagaatttattcctcctctctagcctttgtagccattcatctccctattcccacccctgtcccagcctctggtaaccatcattccactctttgcttctatgagttcagctttttgacacttaaataggtgagataatgcaggtggacctttctatgcctggcttatttcacttaatatgatgtcctctaggttcacccatgttatcacaaatgactggattttcctggtttttaaggcgaatagtatttaattgtgatatatgccacattttctttacccattcctctacagattaacatgtaggttgatttttttttgtttccccctggggtattgtgaataatactgcagcaacttgggagcattccttcctctacaactttttggaagagtttcagaagaatattttgtgaatatttggtagaatacagcaatgaagccatcatcaagtcctgggctgttctttgatcagaaattctgtattatttgttcaatctttttactcattactgatgtgttcagatttttctgtttattcatgattccatcttggtaggttgtgtgtttctaggaattaatcttctaggttatccaacttttttggcatctaattgttcattgtagtctctcacgattctttgtatttctgtggtatgagttgtaatgtctccattttcatttctgattttattgatttttgagtcttcccttttttgtctttgaaagtctcatggtttttcaatgttgtttatcttttcaaaaaatcaactcttagtttcattaatcttcccatattgtttatttagtctccatttatttttattccgacttttattattcctttcattactatgagtgtcatttgttctttttcgagttccttgagaagtaatgtttgtttaaggtctttctcctttcttaatgtaggtgtttattgctataaacttccctcttagaactgcttttcctgcgtttctcaagatttggtatgttgtttccttttgcatttatttcaaaatatttttaaattaaacttttaacttcttccttgacctactggtacttatcatgttgtttaatttccacatatttgtgaatttacctaaattcctcctgttattgatttctagcttaataccactgtggttgaaaagatgcttgataggatttcagttgccttaaatttcttaagacctgttatttggcctaatatgttatctgtcctggagaatctttcatgtgtgctggagaagaatatgtattctgctgctgttgggagggatgctctgtatacatctgataagtccatttggtctaaagtaaaattcaattccagtgtttccttattgattttctgctgaataagttgtcctttgtcgaaagtaggatttgaagtccccttcaattattgtattgcagtctgtttgtcccttcagatcttataatgtgtgctttatatatttacacgatccaatgttgggtacatacatatgtacaattgatacatcttcttcatgaattgatccctttataattctataatgactttctttctcttcttatagtttttgacttaaattctattttgtctgatatacgtacagttgacccttgaacaacatggagctggggcgacaactcaccatgcagtcaaaactccacatttaacttttgactccctaaaaatgtaatagcctactgttgaatggaagccttattgattacataaagtagattaacacaaatatagaatggtatatgtgttatatgcaatactcctacaataaagtaagctagagaaaagaaaatgttattaggaaaatatgccaggcatggtggctcatgcctgtaatagcagctgttatagcagccaaaacggactaagacaactgtattgctgagacacagtgaaaggtcattcaagatcagggggtgacatcttaagtcctagaagtcaaaagtctaaagtgggtctcactgggctaaaaccaacatgttgaagactgtgttgctttttggaggctctaggaggcattctctttcatggcctttcccagcttctagaggctgcccagattagctcatgaccccatcctactttttttttttgatacagagtctcactctgttgcctgggctggagtgcagtggcaccatctcagctcactgcaaactccacctcccagattcaagcgattcttctgcctcagcatcctgagtagctgggattacaggcatgcaccaccacactcggctaatttttgtatttttttagtagatggggtttcaccagttggccaggctggtctcgaactcttgacctcaagtgatccgcccacctcggcctcccaaatgctgggattacaggtgtgagccactgcgtccagccctatcctacacctttaaacccagaaaagacaagtcaagttcttcttgtatcacctcattccccacctgtttctgtcatcacatgtttctcttcttcagaactccctcacctacttttaaggaactttgtaattgcaccaggcccacctagataattcagggtaatctccgtatctgaagggtggctggttagcaatttaagtccatctgcaaccttctttatcttgccttgtaacataacatattcccaggttccagatgtaggatgtggatatattctgccagtaacaggcctgtccatcaaactttcctgaatagctagaatgtacccactcccctataacaatggtctgttttccttactaatctttttttaaatttggggctccctataattatatactttataatgggattaatgaaagcctgtaaccaaaaaaaaaaaaaaaaaaaaattattcccctaagaagcacacaaagaggaaactaaaaattacccttatttatttatttatctatttatttattaagacagagtcttgcttttgttgcccaggctggagtgcaatggtacaagctcggctcactgcaacctctgcctcccgggttcaagagatctgcctcagcctcctgagtagctgggattacaggtgtctgccacacattcagctaatttttgtatttttagtagagatggggtttcgccatgttggccaaggctggtctcgaactcctggcctccagtgatccacctgccttggcctctcaaagtgctggggttacaggtgtaagccactgtccggccgtaattacccatatttataccatctaaagataattactgttaacacttagtatgtatgtttactgtcttcccctccacctctaagcatgtgtgtgttttgtttctggaacattgaatcctattaatcatgtaaatgaggcaaaaactctccaaatcatagtttgtaaaagaaatccagcccaaccacgggtcacattatgtctgtgtgcatgtggagagaagagagataccagtcatgtttccttgctttgaaaaattaatcattgatgaatatgaaaatagtcactggataccttacaaatatggactttggaaatattcccaaggttatatgtgcaagtaacgaatattgactgtaacatttcaaaggtatatgaaatagaatgagatagcactagtttaaaatgttcactttttttttttttttcttttttgagatgaagtcttactctgtcacccaggctggagtgcagtggcgcaatcttggctcactacaacctctgcctcccaggttcaagcgaatctcctgactcagcctcctgagaaactgagattacaatctcaccaccatgcccggctaatttttgtattttcagtagagacagggtttcaccatgttgcccaggttggtcttgaacttctgacctcaagtgatccgctcaccttggcttcccaaagtgctgggattacaggtgtgagccactgcacctagctgataagaatctttaaactagattttttaaggaactatcatgtctctgtctccctagttaaaaggaaatagcagacttgttacttttatgaaaatggattgagatatgttactgattttttagtaataacagctaccttatcttaattgttatatatgactgtgtgtttcatgtggatgatcctgttcaaacagtcatacattgtactatctttcttgtggttttaccagtgaggaaactttaccacactgtgaagttaataactatcagagctcagattaacaccctcaaatcagaccacagagcctgtgttaatttcaccaaaacatgtctgctcaaattatatgtaccattttaacctacccttttcccttgttgattcttcagaagttttcttaattaatgagtcagtattattaggaaatgtactctatgtcattgtataacagaccatggtttaatctgattttcctttatcctccactgcaagattttcatttttaaaaattattctcgactgggtgtggtggctcacgcctgtaattcctgcactttgtgaggccgaggcaggcggatcacctgaggtcgggagttcgagtccagcctgaccaacatagagaaaccccgtctcttctaaaaatacaaaaaaaattagccgggcgtggtagcgcatgcctgtcatcccagctactggggaggctgacgcaggagaaccccttgaacccaggaggcggaggttgcagtgagccgagatcgcaccattgcacttgagcctgggcaacaagagcgaaactccgtctcaaaacaaacaaacaaacaaacaaaaaattattctctggaaattctgggtaacgtcagtggattacatcaatgttaatcttctggttgtggtattatatactacaatcaccagctgaggtaaccaggtgaaaggtacacaagatctctcaattttatttcttgtaactacatatgaatctaaagtctatctaattaaaagagaaaaagattttcagaaaaaaagcattttgtgaacatacttcaacattgtgtacaactatagctacttccttggcataaataccaaaaagtgggattttgagtcaaaatgagactgtggttaagtacctgcaacatcctgtagaccctgtgacgttagtacttggaatgagagcgggactcacggggcataactgctacctgtacattgtttacaatgcagcaagcaagggacaccgaatagcagctccggcagcctgtgctagcggcctgcagagaattccaggtgacgctccagaggggctaggagaggatacccttctgaggacagccatggctcgcccggcatcaccccactcaagaggccagacggggtcccagctggggtgacacagctcctttcccagtcgggaaggggcgtctgcagggaccaggaagggcttagcttggggctgcccgctccggcaccgacctgggacgcgccctgaggcccctgcctgggaccgtcccggactacatttcccagagaccatccaggagtacgccgtgctgcatgctggaacacggggcttggggctctggtttcccccgacggccccgcgtcctcttctagcctcaccctctcccgaggccccagcgttgggggactaccgggtgcgtctgcggctttgggagagtgggaggagggaaagggatgggaggggtgcacgcacacgtgtcagtgtgtccgcgtgtcagcatctgtgcaggcgcacgtgtgtgtcgggctctgttgtgtctgcacatgcgtgtcggcatctgtgcgtgcgcacacgcccgtcagggtctgtgtgcccgcacaggcacgtcaacagctgagcacgctatgtatcgggggtctgtgtacgctcacatacgtgtcggggtctgggtacgtgcacatacgtgtaggggtctgtgtgcacatgcgtgtcgggctctgctgctgtctgcgcgctgcggccgctgggtgcgcgtgcgcatgcgcgctggcctccagggggtggcgggaccgagtgtgtgacgcacttgcgtgggagtacgaggctgacgcggcggccctgtccccgtaactgtgacacgggtgcacgcgagcgtcattgggggcgatgggggccgtgctgggtgcgcgtttgcaccagtgacgcagccgctgcatctccgccagtccgcgcaggtgagattggtgcgcgtggctccgaggggagacgggcacggggcttctgacggtgacgcacttgctggagagtgtggggtgacacagccgggctctccccataactggtgaccgggggtgctccagaggctttgggtcaacgcagcccgtgcctgtgaacctcggcggtgcgtccctgggactctgctccgtgaggtgcgctctgggggttgtgcgggggcagcggtcgggacgggtctccgtggcccacggatgcacctctgcaccgtgtggggtggtggggcccgtagcatggccgtgctgggcgttagtgggtatgaggggcgcagatgtgtctcaggacagagtgagctgtggtgaggctgagctgtgcagacttgtgctgggatgggtgatcgggccttctgggtgacgcaggtgtgtgtgacaacacaacctgtagcttcagcgtctctgtgctgggatggatgatcgggccttctgagtgatgcaggtgtgtgtgacagtgcaacttgtagctccagcgtctctgctgcttcccctgccttcacctcctaaccaagcggtacctgcctgagaacaagggccgcggagggacgtgagcgcctgagcctcgcctggaaattcaccagcaagaaggcagaaacagccatgaggtgacgctttcagagccagaagtgctgtgcatgcaggccacctgagtgacaggggacggtggcctcaggagtagaattcctcctgtagagggacaggtccctgatgtgggagacagggaggggggcagctccacgcgtcatcatctcaatcgccacagcgtgctcttcaggaatctcccagaaactccatctcggggcctcgtatttctcattggttttattaggtatggcaggtgttacccttccggttctgttttccccaggccagcatccttcagaaaaagcatccccgaggaggaagacgaatcgttaaacatctgaaagggtcaggtgagtatccttttttttttatattaaatgatatgtgtttataagacttaagaccaaacattaaaggtagatgaccaagatttgagtcctgtttctgcctcttagctttttgagccttctgaagataggcttgtgaggagggtgaaatgcattaacacgcataaaacccatagacgcgcacccctgagtgggagtgcacagtgagtgctgctgttttgtgctaagtctggatgtctgtacatcaggagcaacgtacatatgaaggtaactgggatgggtgtttgcaggttcacaaaatgaaccacagcctcaaatggcctagaactgttatccttaacctgagggcctgcctttaactccacttacaactttccaagggacattctgtgtatatttactgtatgtgattatcagtgttagtgtatctgtcccccaccaccaccaccctaaggagatactctgtaatttcatggcattaagaaggatggacatgccccaaagacatttagacccattggtctacaatcgaaggctgtgtaccttgaccacaattattgttcaggatggtggaaatggttaagtaattataccacgttcatttcatggaatactctgcagctacaaagaagtaagtttagttataaccgtaagaaagaaaaatgcacctgacataatattaaacactactaatagttattaacaatagtaaatgaaggaaatgcttcagttgcctacaaattccattgaataagatttttgtaaataccttatccaacatgacattttagtatattatttaggattattcatgaatccttcaaaagagaggagcctggccacatttattgagcgcatttttgtaccatactctattgtgttttgcacacactccttaatttattcttaccttagtctgtaacaaagtaccatagaccggtggctgaaaccacaaacatttattgctcacagttctggaggctggaagtctgagaagagggtaccagcatggtcaggttctgatgagggcccttttccaggttggagactgtcaccatcttgctgtgtcctctcacggaggacatgtgtgtgcttggaggctctttggcagagctctaggaggtgtgtgtgcttggaggctctaggagatagtctttttttttctgtaattgagatggaggcttgctctgttgcccatgctggagcgcagtggcacaatcttggctcactgcaacctccacctcccagattcaagtgattctcccgcctcagcctcccgagtagctgggattacaggcacatgtcaccatccgcagctaatttttgtatttttagtggaaacagggtttctccttgttgatcaggctggtctcgaactcctgacctcaggtgattaattagccggcctcagcctcccaaagtgcgggattacaggtgtgagccaccgagcctgccctgtgggaggtattttatgtccttgcttttgctggcttctagacactgccccacatgccttggtttgtgaccccttcttccatcatcaaagctgcaaagacaggccaagtcccttttccatcacgtcactctgaccctacttctttctgttcatctcaccctcttctcattttgaggaccctggtgattacattaggcccgctgaggtaactcaggataatcttccctattttagtgtcagcccattagcaattttagtccgcctgcaaccttaattcccctttgccatgtaaggtaatatcatcataggtgccagcattaccatattgacatgtttgagagaggcaacgagagaacaataatcatatttcttttcttttttttttttttgagacagagtttcgctcttgttgcccaggctggagtgcaatggcgtgatctcagctcgccgtaacctctgcctcctgggttcaagcaattcctgcctcagtctcctgagtagcttggattacaggcatgcgccaccacacccagctaattttgtatttttagtagagacggggtttctcttttgttggtcaggctggtctcgagctcccgacctcaggtgctctgcctgcctcggcctcccaaagtgctgggattacaggcgtgagccaccgtgcccggcctatatttcttcttttatgtgtttttgttttgttttgttttgttttttccttatagacaaggttgtgttctgttgcccatgctggagtgcagtgggttgataatagttcacagcagcctcaatctcctgggctaaagtggtcttcccacctcggcctctcaagtacctgggattacaggcaccagccactgtaccctgctcctatcttgttatatttcttataataggattaatgcaggcctgctgggggcaaagaaagaaacagtccctaaggagcccttaaagaagaatctccaaattacccataattgtaccatccagagataatcactgatgaacattttaaatggccagcactttgggaggccaaagcgggatgatcacttgaggccaggagtctgagaccagcctgggcaacagtgagactccatctctactaaaataaaaaattgaaaaagattagccaggcatggtgatgcatacctatagtttcagctactcagaaggctgctgtgggaggatcacttgggcttaggggttccaggctgcagtgagccattgcactctagcctgggcaacaaagggagacagtgtctcaaaaaaaaaaacaagaaaaaaacatctgaaatggtatttatgtttctaggcctcttctttgcctctaagcatgtgtgtgttttgtttttggagtattgaatcttgctaattcatcataaatgagtcagagactccaaatcttaatttataaaaggaatccaacccagccatgagtcgcattacacctgtgtgtgtgttgggaggggaagggctatgccagtgatctttgccttgttttgaaatatctcacatatttctaccttgtaggattagaaatccatcatctgaatctaacctatggtaacaaattttcaagaaagacagccttttagaattagattatagaatgttaatgttcctttcccaggacatcacaataatcacccatgaacactaatcactgggtgccttgcagatacggactttccatgtgacattagcaagattatttgtacaagtaacaaatatgggctgtataagtaacatttccaagatagaaaaagaattagatgacagtatctcatatgtatctcccttatcccgtggaacacaaaattcagcctcttgctaatgttctcaacttggcatcttctcagattagagtcattaaattagattttcttatgcagaacaatgtctctgtccccctagttgctgatggaaagggaacatttcctcgttatatttcttagaatctcttttgctaatgtattcattttgttaaacaaaatgaatttcattcttaacatcagactctgaatgttatttttggttaatattgattacgcagacagcgggttcaaggaaggcacttttgtttttcttgagacagagtttcgctctggttgcctaggctggagtgcaatggcgcaatcgcggctcaccgcaacctctgcctcccgggttcaagcgattctcctgcttcagcctcttaagtagctgagattacaggcaagtgccaccacgcccagctaattttgtatttttagtagagacagggtttttccatgttggtcaggctggtcttgaactcccgacctcaggtgatccacctgcctcagcctccgaaagtgctgggattacaggcatgagccaccgcgcccagtggcacattttaccattagaaaaaaaaggagggggccaggcatggtggctcacacctgtaatccaaagcactttggcaggctgtgaggcaggaggatcgcttgagcccacaagttcaagaccaacctgggcaacatggtgagaccctgtctctattatgaatttttttatttttttgagacggagtctcgccctgtctcccaggctggagtgtaatggtgcaatcttggttcactgaacctccaccttccagttcaagcaatcctcctgcctcaacctcctgagtagctgggattacaagcgcgcaccaccatgcccagctagttttttgtatctttagtagagacggggtttcaccacgttggccaggctggtctcaaactcctgacctcgtgatccgatccgcctgccttggcctcccaaagtgctgggattacaggcatgagccaccacgcccagccttattatgaattttttaaaaataaaaactataaaaagaaaaactttttttaaagaaaaaaagcaaggagattggccgacatgagttggtcttcaataataacaggtaacttctattacacaaatgtcacatattattgagtgttttacatagattatcatacttgccagttgtaacaatcataccatgtagtacttttattacattttatcagtgacgaaacagacactatgaggctaactgccagggttcagattcacatctctaaagtcagaccacacaacctgtattcttaatttcatcaaaacatctctgcccaaattatatacacctttttaatctaccttcttcacttggtaattcatcataaaaattttctcaagccagacgcggtggctcatggctgtaatcccagcactttgggaggtcgaggtgggcagatcacaaggtcaggagatcgagaccgtcctggccaccatggtgaaatcccatctctactaaaaatacaaaaattggctgggcgtggtggcatgcacctgtagtcccagctactcgggaggctgaggcaggagaatcgcttgaacccgggaggcggaggttgcagtgagttgagatcacgccactgcactccagcttggccagagcaagactccgtctcaaaaaaaaaaaaaaattctcaataagaatcgatattattaggccgggtgtggtggctcatgcctgtaatcccagcactttgggaggccaaggtgggcggatcacgaggtcaggagatggagaccatcctggctaacacggtgaaaccccatctctactaaaaatacaaaaaattagccgggcgaggtagtgggcacctgtagtcccagctactcgggaggctgaggcaggagaatggcgtgaacccaggagacagagcttgcagtgagccgagatcacgccactgcactccagcctgggcgacagagcaagactccgtctcaaaaaaaaaaaaaaagaatcaatattgttagtattccatgccatcatatagcagaccataatttaacccatcctctactgtgagatactgctatttttttcgttgttgaaactgtattctctggaaatcatagataagatcaaggagggaatctgtgtcactatcctggctgtgatactgtactgcagttttgtttttcttttttttgagacggagtctttctctgtcacccaggctggagtgcagtggcacaatctcagctcactgcaacctccaccttctgggttcaagcaattctcctgcctcagcctcctgagtagcggggattacaggctcccaccaccatagccagctaatttttgtatttttagtagagacggggtttcaccatgttggccaggctggtgtcgaatttgtgatctgcctgccttggcctccaaaagtgctgggattacaggcatgagccaccatgcccggcctgtactgtagttttataaggtatcactactggtgtaagtcaggttaagggtgcactggatctctctgtattattatttacaactacatgtgaatctacagttatctcagttttttagaaaaataacttacctagaaaaaaatttttcttgatcgctctttcacatacatttatgtacttctgttttcttgtctttctaactgtttcctcctcctggacccataaattccacatgtggaattttgagtcaaaattagatgtttgttaagggcccgcactatgccacaccctgtgacgttagtacttggaatgagagcgtgactaacggggcataactgctgcctgcacattgtttacaatccagcaagcaaggggcaccgaacagcagctcgggcagcctgtgctgtggcctgcagagaattccaggtgacgccccagagggcctaggagaggatacccttctgagaacagccgtggctcgcccggcatcaccccactcaagaggccagacggggtcccagctggggtgacacagcgccagtcacatccactcatggacactcagtaggccacactcccgatcacccagccacagtcctagatcagtcactgactcacagtctgccacttgtatttccattgtctctgggcttcctctgccttcaccttccaacagtgtggtacctgcctgagagcagcggcccccagtgggacatgagagccaggaccctgtcattaactgaaccaacacaaagggcacagccattgtcatagataagtgttcaagccggacgtgttctccgtaccggctcctgtgtcacagtaacgggaagcctcaggagtgggagtccttgtggagggagaggtgactaacttggtaggtgagtgtcgggagcatcacgtgttctagaatccagtaaatacacgttagtccccaagaactctgaaactcacaaatgccagtgtcctctccattcggattggtttcggctgtggcctggggacaggcgtgccctggagggtatttgctaatgcagcctgtgctccagaaagaccctaggttctcattcttcctttcccctaggctggcatccttcagaaaaagcatcctgagggggaaaaaaaaaaaaaaaaaaaaattattatttaggttggtgcaaaagtaattgcggtttttgccattatgtctaatgtcaattgcttttgcactgacctaatattatatatctgaaagtcggctctccacatgagttaccttttttgttcattaaatgatttgtgtttatatgacttaggactctttactctttatggccccaaatatcctccctaatagcaatttatcccagtaattcctccccaggggatgtggcaagggccaggcaggtatattcctctctgtaccccctggttgaccagccctctcctttgagtatccacaaacccatttgtcaaattgttgacatcctgctgtgtgctctggttttctaagatctgatggtatagaaaaatcccccctaaaaaaaaaaaaaacaactccctcctagaggttcatgttagcgcgctttattttacagtgtgcttgggtaaggaggggattcgtttttaggtggagtcaaacacagatatctttggtcttttccatgggactgatttttagagcacaagaaaagagaaagttagtttgtttagtctgtacctggcaaagttgtcagttttgtgaggcctttaagagcggagtttgagctaatttctgtgtcatcaaaggcagagatgtttttcaatatgcagtaaatcgaaatttgttctattcacttggacttctttgggcggacagcttctgtttttcttcagttccccgtttgtgtgaactgtgagaaaccatatggtttaatgttgagtatgagttctggatctagggcagaggttggcagctgtcttcaatggcaatttgtgtatgtttatggtctacagaggctttgatctgtgtttatactgcagattaaatcaagctgattaacatatccctccctcaactcactgataatcatatttgcaatgagaacatttaaatctagtctcttggcatattcaatattattcattatatttagtcaccatgctagacaataaatctccagaaattattcccactttatctcctttaatcttctcattccccatcaccctcccaggccctgacgaccacctctcttcttctgtgagttggattttttttacactccacatgtaatgacatcatgcaggatttgtctgtctagcttatttcacttagtacaatgtcctccagatttacccatgttgtcacaataacaggatttccttctttataaaggctggatggcattgcattgtgttatctctaccacactttctttattaattcctgatgagtatgtaggttgattccttatcttggctactgtgaataatgctactgcagtgaacacgggagcacaggtatcgccatgacatactaatttcattttctttggatatatacccagagtgggattgctgcgtcatctgatagttttagttttttcaggcatctccacggtgttttccatcatggctaatttacattctaaccaacagtgtataagggtcctcttttcctcacagccttgccaacatgttattttttttgtttgttttttaataaaagccattcttacatgtatgaggtgatatctcattgtggtttaactttttgttgccctgaataatagtagtgatcctgagcaatttttcacagacctatagcaatttgtatgtgttctatcaagaaatggctgttcaagttttctgcccatttattatcagggttgtttggttttttgctgttaagttgtttgagttctatgttttgtcatttttgtttgtttttttttgtttgttttctagacagggtcttgctctgtcatccaggctggagtgcagtggtgcaatgacagttcactgcatcctccacctcctggacccaagcaatcctcctacctcagcctcccaagtagctgggactacaggcacatgccatcatgcccggctaatttttcttttcttttcttttctttttttttgagatggagtctccctctgtcacccaggctggagtgcagtggcgtgatctcggctcactgcaacctccgcctcccgggttcaagcgattctcctgcctcagcctccgagtagctgggattacaggcgcgtgccaccacgcccggctaattttttttttgtatttttagtagagacagggtttcaccctgttagccaggatggtctcgatctcctgacctcatgatccacttgcctcagcctcccaaagtgctgggattacaggtgtgagccacggtgcccggccaatgcccgactaatttttcaattttttgtagatatggggtctcaccatgttgcccaggctgatcttaaactcctgggctcaagcagtcctcccatctcggccttccaaagttctgggattacaggtgtgagccaccatgccaagccctattttggatattaaccccttatcagatatatggtttgaaatagtctctcccaatccataggctaccttttcattttgtttcctttgctgtgtgggagatttttagtttgatgtagtcccatttgcttatttttgcttttgtaggatgatctggtgtgatagctaaaaactcattgccaagggcgatgtgaaggagaattttccctatgtattctcccagtagttttacagtttctggtcttactttttatgtctttaatccattttgacttcatttttctttttttctttttcttctttttttttttgagaccaagtctcactctgtcacccaggctggagtgcagtggcacgatctcggctcactgcaacctccacctcccaggttcaagtgatttctcctccctcagcctcctcagtagctgagattacaggctcctgccaccacacctggctaatttttgtatttttagtagagacggagtttccccatgttggccaggcaggtcttaaactcctgacctcaggtgagccaccgcacctggcctcatttttctctatgaagtaaaataagggtccagttgcattcttctgcatgcaaatatccagttttcccaacagcatttatttaagagatcgtcctttccccattgtgtgatgttggcacctttgtcaaagatcagttgaccatgagtttggatttgtttctgagctctgttcttccattgtgtgtgttttcatgccagtattataaccgtaataggtccgttgccccatgagcacagcatgtcaatacagcaggttgcagcaaagaaagacggtttactgtaaggctgcagaacaaggaggtaggatgaaaatgaaatccgtcctcccagggagtttggagctagggtttttaagggttttaaagtgtggaaatcactgcttaaagagtgcagtgtggagtcatgagacaggaagatgaagaaactattctcatgctgattctgttcctctgtggttgtcttcagactgcttggcatcagctatttcactggaatttgggacctgagaaacatcttgtgcaattcttaaaagcctcatgattctaacgttagaaatcctatgtatgggaacagtggggactctgtctcaaaaaaaaaaaaaaaatttttttttaaaaatcttttcatattgttttccagtctgtattttatttattttttgctctaatctttattatttccttccttcctatctttagactccatttgttcattttctggttccttgaaatgtttgtttgagatcttccttctttcgtgatataagtatttactgctataaacttccggcttagaactgcctctcttgccttctttaagatttgaggatgttgtgtttacatttacgtttgtctcaaaatatttttacagtttcttccctggcccattggttgtttagcatcatgtcgattaatatccacatattttttgatttacctaaatttctcccgttattgatttccagttttatgcccttgtggttggaaaaggtcattcatatgatgtcagtcattgtaaatttcttaagatttgtatcatgtcctaacatgatctatcctggagaatgtttcctgtgtacttgagaagaatgtacatgctgccgctattagagagatggtgcagaatacaactgttaggtccatttggtctaaagcgtaattcaggtccaatgtttacttgttgattttctgtccgaatgatctttcctttgttgaaagtaggatttgaagtcctcttctgtcattgtattaaaatctaaccctcccttgagatttcttaatgtttgctttatgtatttaagagctccaatgctggatgcatacatatctataattaatatatcatcttgactgatggactaattttattatataatgacattctttgcctctctttacagtttttgatttaaagtctattttgtctttttttttttttttttttttttttgagttagagtctcgctgtatcacccatgctggaatgcattggcccgatcttggctcactgcaacttccgcctcccaagttcaagcgattctcctgcctcagcctcccgagtacctgggattacaggctcctgccaccacgccaggctaatttttgtgtttttagtagagatggggttttgccatgttggccatactggtctcaaactcctgacctcaagtgacctgcccaccttggcctcccaaagtgctaagattacaggcgtgagccaccatgcctggccgttaatctttttttttttttttctttttttttgagacagagtcttgctctgtcacccagtctggagtgcaaggtgcaatctcggcccaacctccgcctcccgggttcaagctcttctcctacctcagcctcctgagtagtgtgcaccactatgcctagctaattattgtattttttagtagagatggggtttcaccatgttggtcaggctggtgtcgaactcctgacttcgtgatccacccaccttggcctcccaaagtgctgggattacaggcttgagccactgcgcctggccaatcattttttaaaattaggactcccttaactttcactccttataacgggattaatgcaggccaactgcaaaaaaattcagtcctctaaggagttcataaagaagaatctcaaaattaattacccataattccatctagagataattactgttaatcatatttggtatatatgtttatagtcctccacttcccctctaaacatgtatgtgcttttgtttctggaacattaaatccttctaattgataaagtaaatgaatcaaagactttccaaatggtagtttgtgaaaggcatccagcccagccacgggtcacgttatacctgtgagcatgtggggatgggaggggtgtgccagtgatctttgtcttgttttggaaaacctctcatatatttacaccttataggagtagagacacatcatctgaaactaatcccatggcaacaaattatcaaaaaatatagtgcacccttggaatgagttctgcatctgtggattcagccacagatcaaaaatatccttgggaaaaaaaataggaggtttgcatcctattttacagatgctaacatctgtattgaacatgtacagacttttcttctcattattctaaaccatacagtatgaaaattattagcatagcatataagataatttataaagaatctagaatctaaaatgtacaggaggatgtggataggttatatgcagatactataccactttgtataagagtctgaagcattcgaggattttgatattcaggggggttctggaacaaatctggatactgagggatggctctacagcctttcagaattaaattttctatgattttaatggttctttcaaagaccatgacagtaatcactgacgcctgttgccttacaaatctgcttgtacaagtaacatttccatgattatatgtacaagtaaaaaatacccactatacaaataacaaatccaagatcagtgaaattgagtacgatgacaattaaaatggtttgcataaatgtcctataacacatggaacacatgattcatcctcttgctaatgttcccagtttggcatcttctaagatcatattatttgagcacaatttttgatgcagaatcatctctctgttcccctactcgcttgtgagagggaacatttcctccttatgtgtcttagaatatttttacctaacatgcttaaacaaaacaaatttcattcttaacatcaggctctgaaagttccttttagttagcatttgctatattgacagctggtttgacaagtacatattttagcataagaaaaaaacagcaggccgggtgcagtggcccttgcttgtaatcccagcactttgggaggccaaggaggcagattgcttgagctcaggagatcaaggccagcctgggcagcatagcaagaccccgtctctaccaaaaaaaaaagaaaaaaaattacaaaaactagccagatgtggtggcgtgcacctgtagtcccagctcttgggaggctaaggtgggaggatgacttgagcctaggaggcagaggttgcagtgtggttgagattgcactactgctctccagcctgggtgacaaagcgagaccctgtttcaaaaaaattaaaaacagcagatgagtttcttttttaaaactggattcaggatcagtgtaatgttactgatcttcaatagtaaccacaaacttaaaaaatctttacatattgccgtatgtattagatattctgatatttaatagctgagacagtcataccttatagtattattatcccaattttactagtgaggaaacaagcagttaataactgttagagctcagattcacattctgaaagttatagaaattaagaacatagagcctatgttcttaatttcaccaaaatatctcctcccaaattatacataccctttcaaacctaccttcctctcttagtaattaatgataccgtctttcaatttacatgaatcagtatcactattagtaaatgtattttatgccattatataacagactaatttatttattctgtactctactgtgatattttcctctatcttctgcaagattttcatttttaaaaattactgtcttggctgggtgcagtggctcatgcctgtaatcctggcctaggcaacaagagtgaaactccatctcaaaaaaaaaaaaaaaaaattagtgtcttgaaatttgcataacatcaatggatgatgtcattgtgaatgtcctggcggtgatattatactgtatactataatcaccaattggtgtaaccaggtgaaagatacataggctttctcagtattatgtgtacaactacctaagaatctacggttgtatcaatttaaaagaaaaactttcccacacaagataatctccaaacatcttgggcatacatgtgtgtactactctagctatttccttgggataaattctaaaaagtgggattttgagtcaaaatgagactgtggttaagtagtacctgcaacatcctgtagaccctgtgacattagtacttggaatgagagcgggactaactgggcataactgctgcctgtacattgtttacaatccagcaagcaagggacaccgaatagcacctcgggcagcctgtgctggcggcctgcagagaattccaggtgatgctccagaggggctaggagaggatacccttctgatgacagccatggctcacccggcatcaccccactcagaggccagacgggctcccagctggggtgacacagcccctctcccagccgggaacgggcgtctgcagggagcaagatggactcagtgtggggctgcctgcctggaacgcgccctgaggcccctgcctgggaccggcccagactacgtttcccagaggccccccaggaacttaaggcgctgcatgctgggacacggggcttggggctctggtttccccagacatcgccctcctcaagcctctcaccccttcccgaagcccctgtgtgtttgggcctgagtagggcattcgcttcctaggaggaacccaggggtgcgcgccaagcatgggggtagggggaccgccgagtgcgcctgtggcttcgggagaggccaaagaaggaaggagtgggaagggcgcgcacgcgtgtcagtgtgtgcatgtgtcagcgtctgtgcacgcgcacatgtgtgtcggggtctggtcgcacatgcggatcaaggtctggccacacgcatgcgttgggggtctgtgtgcgcgtacacgtgcatgtcgcggtctgggtgtacatgcgtgtcaggatctgtgtgcacgcacatgcgtgtcgggctctgctgctgcctgcgcgctccggccgctgggtgcgggaggcccctcccgagtccggggtgcgcatgcgcgctggcctccatgggtggcgggaccgactgtgtgacgcacttgcgtgggagtgcgaggctgacgcggcggctctatctcccgtaactgtgacacgggtgcacgcaagcgtcattgggggtgatgggggccgtgctcggtgcgcttctgcaccggtgacgcaaccgctgtgtctccgccagtccgcgcaggtgagattggcgcccatggctccaaggggagacgggcacggagcttctagcggtgacgcacttgctggagagggtgtggggtgacgcagccgggctctccccataactagggctggggtgctcccgaggctttggggcgacggaacccgcacctgtgaacctcggcagtgcgtccccgggactctgttctgtgaggtgcgctctgggggatatgtgggggcggcgatcaggacgggtctccgtggcccacggatgtgcctttgcactgtgtggagtggcggggccggcagcgtggccgtgctgggcgttagtgggtatgaggggcgcagatgtgtctcaggccagtgtgtgctgtggtgaggctgagccatcagtgcaggcttgtgctgggatggttggtcgggccttctgggtgacgcaggtgtgtgtgacagcacaacctgtagctccagcgtctctgtgctgagatgggtgatcgggccttctgggtgacgcaggtgtgtgtgacaacacaacctgtagctccagcttctgtgtgctgggatgggtgatcgggccttctgggtgacgcaggtgtgtgtgacagcacaacctgtagttccagcgtctctgtgctgagatgggtgatcgggccttctgggtgacgcaggtgtgtgtgacaacacaacctgtagctccagcttctctgtgctgggatggatgatcgggccttctgggtgacgcaggtgtgtgtgacagcacaacctgtagctccagcgtctctgctgcttcccctgccttcacctcctaaccaagcggtacctgcctgagaacaagggccgcggaaggacgggagtgcctgagccctgccaggaaattcaccaacaagaaggcagaaacagccatgaggtgacgctttcagagctagaagtgctctccactcagggcgcctgagtgacaggagacggtggcctcaggagtagaattcctcctgtagagggacacgtccctgatgtgggagacagggagaggggcagctccacgcttcatcatctcagttaccacagcgtgctcttcaggaatctcccagaaactccatctcggggcctcgtatttctcattggttttattaggtatggcaggtgttacccttctggttctgttttccccaggccagcatccttcagaaaaagcatccccgaggaggaagacgaatcgttaaacatcttaggtcaggtgagtatcttttttttttttttaattaaatcatatgtgtttatgagacttagtcggcgggcgcagtggctcacgcctgtaatcccagcactttgggaggccgaggtgggcaaatcacaaggtctggagatcgagaccatcctggctaacacggtgaaaccccgtctctactaaaaatacaaaaattagccgggagtggtggtgggcgcctgtagtcccagctactcgggaggctgaggcaggagaatggcgggaacccgggaggcggagcttgcagtgagccgagatcgcaccgcttcactccagcctgggcaacacagcgagactccatctcaaaaaaaaaaaaaaaaaaaaggaaatcctattgaattagacgttttgtaaatatcctatccaagatgacgactgattattcagtgaaggaagagaggagcctggtcacatttattaagcacatattctctgtactaaactgtctcttgtctattttgcacacacctcttaattcttgtcttagttgattcagtctgtgataacaaagtaccatagactgtgtgactaaaagggcaaactttttttttttaattttttttttttttagagacagggtctcactatgttacccaggctggtcttgatctcatgagctcaagctttcctcccaccttggcctcaaaaagtgcttggattacagatgtgagccaccatgttgggccttttttattgtttttgttttgttttgtttttgagacagggtcttactctgtcatcaaggctggagtgcggtggtgtgatcatagctcactgcaacctcagccccctgggctcaagcaatcttcccaccccagcctcccaagtagctggggctactggtgtgtgccaccacatgtggctgtatatttttatttttattttgagacggggtctcgctttgtcatccaggttggagtgcagtggcacaatcttggctcacttcaacctctgctttctgggctcaagcaatcctcccacctcagccttctgagtagctgggactacaggtgtgagccaccacacctggctcttttttttttttttttttttttttttttggtagatacaatgtttcaccatgttgcccaggctggtcgtgaactcctgagctcaagcaatctgctgcctgcctcggcctcccaaagtgctgggattacaggcgtgaggcgccacacccagccaattttttaatattttatagagacagggtcttgccatgttgcccaggctggtatcaaactcctgagctcaagcaatcctcccatttccacctcccaaagtgctggggttacaggcatcacccaccgtgtccggccacagcaagcatttatttcttacagttctgggggctggaagcctgagaccagggtgccagtgcaagcagcttccggtgaggccttcttcaaggttgcaggcgaccaccctcgtgccatggccacacatggtgaaagggagctgagagctctctgggatcgtttttataagacactaatcctattcctgagcactcctccctcatgtcctaatcaccttccaaaggcctcacgtcttaataccatcacattggggaacagaatttcaatataggaatctggggaggaataaaatacttagttttgtcaggtatcttcagaggctatttaggtacagtattgtgctcagggtcagtgtgtacaaaaccaactcatttttcttctctcacaccacaacgataatcaacacagaaaactttgtgacttggccgggtgcggtggcccacacttgtaatcccaggactttaggaggccgaggcggatagatcactttgaggccaggagtttgaaaccagcctggccagcatggcgtaaccctgtctctactaaaaatacaaaaattagctgggtgtggtggcgcatgcctgtaatcccagctactcaggaggctgaggcaggagaatcgcttgaacctgggaggctgtgaacctgtgatgagctgagatcacgccaccacactccagcctaggtgacagagcgagactctgtctcagaaaaaaataagctttgtgactaaatgtgtggggagaagcaagctgtagtggacatcagccggatgtcctgcagttcagttctgacaccatctacctggagatggcatcagattccacaggttgtgagcaagactgtcccactctgccccactagccacaagaccaggcctctgggacatcttgccaaccctctacaggttggggttcttatactctttggcttctattagtgtatttgattgactcagaattcagggaaacacatataccagtttattacaaaggatattttaaaggatactaatgaacagccagatgaagagatatgtaggactagggttggaagagtcccaagcacaggagcttctgttcccgtggaattggggtgcgccaccttttcagagttcttttgtaccttcctagcagccacctcctgttcagctgtccagaagctctcctcaccctgtcttcttaggccttttatggagacttcattggataggtgtgactgaagcatgcacgaatgtgttgaaacgtgattggacaaataagagttgatttaatgctaattgattgagtggggaaactcaaggcccgtctgttcagattcttcttggcctctcagtgcagcattccttcctacaggtacagggcaggaccctctctggagtgagagtcctgctttgggcaggtgaaaggagggcaagagaagatgagagagagattctgcttcccgaggcctgcttctgaggctgaaagtgccctaatattaagattttaccaagggttatggaattatgagccaggaaccatggacaagaacatacagacacactcataccccatatatacacacatataggcacctacatatatacacaccatacacacatatacacacacataccccatatatacacacatatacacacctatacacacctacatatatacacacacatacacaccatacacacatatacacataccatatacacaccatacacacatatacacacacataccccatatatacacacatatacatacctacatatagagacacatatatacacaccatacatatacaaacacaccccgtatacacacatatacacacctacatatagagacacatatatacacaccatacatacacacacaccccatgtacacacacatatacacacctacatatatacacaccatacatatacaaacacaccccatgtacacacctacatatagagacacatatatacacaccatacatacacacaccccatgtacacacacatatacacaactacatatatacataccatacgtatacaaacacaccccatgtacacacctacatatagagacacacacatatacacaccatacacacatatacacacacaccccatatatacacatacacacctacatatatacacacatacacatcgtacacacacaccatatatacatatatacacacatatatacacaccatacacacatgcacacaccatatatatgcatatatacacacctacatatatacacacatatacacacacgccatatatacacacatatacacacctacatatatacacacatatatacacattcatacatgtacatacacaccccatatatacacacatatacacacacatcccatatatacacagctacatatatacacacatataaaaaccatacacacatatacacaccccatatatacacagatatacacacctacatatatacacatatacaccatacgcacatgcacacacatacccatatatacatatatatatacacacacgtatatacatatatacacaccataacacacgtatatacatatatacatatacacatatacataccatacacacacgagcatatacacacacatgccatacacacacatatgtacacatacatacccacaccatacacacatacatacacaccacacacacacatatacaccccgtacacatatatacacacaccatatatacacacacatatacgcacacacaccccatacacatgcatacctcatatatacatatacacacctacatatacataccatacacacacatatatacacacatatacccacaccatacacacacatatatacacacaccatatatatacacacatatatacacatccacaccatatatacacacaccatacacacacatatatacacacaccatatatatacacacatatatacacatccacaccatatatacacacaccatgcacccacatatatacacacaccatatatatgcacatatatatatacacccacaccatatacacacacatacacatatataaacaccatatatatacagacacatatacacacccacagatagacacacatatacacaaacatacacacaattatatcacaaggtctgattgtattactgagacacagtgaaaggatgttccataacaggaaggttatgcctgattcagtgacactactttttcaatattaggccttatatcagtttatttttgctgttttaacaaattactgtagattattggcgtcatacaacacaaatgtattatcttactgtcatagaggtcagaagtctgaagtgggtctcaccgggctaaaaccaggttgttggaggctgtaggagatattctgtgtccttgcttttgctggcttctagacgccgcccacactccttagttcgtgaccccttcttccatcagcaaagcctgaaaagacaagtcctttttccgtcacaccactctgaccctcctcctctaagtttaaggactctggtcattacattgcgcttgcttctataactcaagagaatcttccgtatgttagaggcagccgattagccattttaagtccatctgcagccttaattttcctttgccatacaaggtaacatatttgaaagtactggaattaccatagagacacatttgagaggtgggcaaagtggcaagatcccacctctacaaaaatacaaaagttagccaggcgtggtaatgtgcaactgtggtcccagctactagggacgctgaggtgggaggatcacttgaacccaggagatcgaagctgcagtaagctgggttcacaccactgtactccagtggcgacagagtgagaccctgtcgcaaaatatatgtgcacacatacacacatttgagaggcaggcctatccattcagagtttccttaatgactacagtgtgcctgctcccccataactatgtttgtgtttggcattttcttttaatttgggactatctcagtaaatttcttatattataatgggattaatgcaggcctgctggccaaaaaaaaaaaaaaaaaacaaattagtccctgaggagctcttagagaaaactctctaaattacccgtaattgtgcgatccacaggtcattactgtttctggtcctcgtttttgtaattaatgtttctagtcctcctctttgcccttaagcaggtatgtgttttctttctggagctggaattttgctaattaatcatgtgactactccagagactctttaaatctagttttaaatctaatctgtagcagcaaattatcaagaaagcctttaaaattaaagattctaaggtggaatgattgcttgaggccaggagtttgagaccaacctgagcaacatagtgagacctcatctctccaaaaatttaaaaaattagccaggcatggtggtgtgtgcctatggtcctagctacttaggaagctgaagtgggaggatcccttcagcccaagaggttaaggctgcaatgagccgtgatcccaccactgccctccagcctgggtgaaagagtgagaccatctcaaaaaaaaactagaaggccgggtgcaatggcttgtgcctgtcatcccagctctttgggaggctgaggcaggtagatcacctgaggtcaggagttcgaaaccagcctggccaacatggtgaaacgccgtctctacaaaaaatacaaaaattaggcaggcgtggtggcgcgcgcctgtaatcccaggtacttgggaggctgaggcaggagaattgcttgaacctgggaggtggaggttgcagtgagccgagattgtgccacagcattccagcctggatggtagaacaagactctgtctcaaaaaataagataaaatagctagagattctagaattgtaatgtttctttcccagaacatgacagtaatcactgataaattctaagtaatcatcaggtgccttacaaatatggactttctgggtaacattagcaaggttatagatacaagtaacaaagactgtgtaagtaacatttgcaagataaaataatgaggtgataagatggcaatagttaaaaatgttcacatgtatcttccatttcacatagaacacaagattcacgccgggtgcagtggcttatgcctgtcaccccagcactttgggaggccaaagcgggtggatcacctgaggtcaggagttcgagaccagcctggctaacatggtgaaaccccatctctactaaaaatacaaaaactagccaagcatggtggcaagcgcctataatcccagcttcttgggaggctgaggtaggagaatcacttgaacctgggaggttgaggttgcagtgagccaagatcgctccactgtactccagcctgggcaacaagagcaaaatcccatctcaaaaagaaaaaaaaaaactccgggcactgtggctcatgcctgtaatcccaacactttggaaggccgaggtgggcagatcacgaagtcaggagttcgagaccatactggccaacatggtgaaaccccatctctactaaaaatacaaaaaatagccgggcatggtgacgcatgcctgtaatcccagctactcaggagactgaggcaggagaatcgcttgaactcgggaggcagaggttgcagtgagtcgagattgcgccactgcactccagcctcagcaacagagtgagactgtctcttaaaaaaacaaaaaacaaaaaaccagattcaccctcttgctaatgtttgcaagttggcatcttctcgaaataggttctgtaagctggctggattccacacccccccaccccccgtccccgagaaggagtcttgctatgtcatccaggctggagtgcaagggcgtgatctcagctcactgcaatctccgcctcccgggttcaagcgattctcctgcctcagcctcccaagaagctggtattacaggcttgtaccaccacactcagctaatttttgtatttttagtagagatggggtttcaccatgttgggcaggctggtcttgaactcctgacctcgtaatccacccacctcagcctcccaaagtactgggattacaggtgtgagccaccgcacccagccaagctggattttttaatgcagaatcatgtctcttttctctacttactggtggagaggcaacatttccctaaatgtgtcttagaatctttattgctagttttgctaatgaacagaatttcattcttcacacattaagctctgaaaattgtttttagtttgcattcattatattggcaactggcttgagaaatatattttaatgtaagtaaaaaaaaaagcagacttgattattttataaaatttgagatgtgtaatgttgatcttcaataataacagctaatttacattaaataattgttgtgtattactgcatgttgtagatagattatcttagttaatagttcatgcagtcataccttgtggtatttttattccagctttaccagtgaggaaaccgacactgtgaggttagtaatcatcagagctcaggtttgcatcctgaaagaccacagagctgccaggtgcggtggcaaaacccatctctactaaaaatacaaaaattagccgggcgtgggcgcgcacctgtagtcccagctactcaggaggctgaggcaggagaatggcttgaacccgggagggagaggttgcagtgacccgagatcacaccgttgcactccagcctggcgacagagcgagacttcatctcaaaaaaaaaaaaaaaaaaaaaaaagagcacagagcctgcattctttttttttttttttttttttgagacagagtctcactctgttgcccaggctgcaatacagtggctattcacaggtaccatcccactactgatcagcacaggagttttgactgcctctatttctgacctgggccagttcatccaagcctgtgtccttaatttcagcaaaacatctctgtccagattatacgtacctttttattttattttattttattttttttgagatggagtcttcccctgttgccaagactggagtacagtagtgcgatctcggctcactgcagcctctgcctcccgggtcccagcgattctcccgcctcagcctcccaagaagctgggattacaggcatgtgccaccatgcccggctaatttttgtgtttttagtagagacagggttttgctatgttggccaggctggttttggaactcctgacctcaagtgatccacccgccttggcctcccaaagcgctgggattacaggcatgagccactgtgcccggactatacataattttttaaatctaccttcttcccttggtaattcatcagaaattttttctcaattaatctgcatcaatatcattagtaaatgtattccatatcattatataacattatttatatatgtgttctctactatgagatatttcagttgttttcatttttaaacattatctgctggaaaatctggataagatccatgggttgttattgtcctggttgtgatattttactgttattttgcaaggtgtcacagttggcataaatcaggtcaagggtacaaaagaccactgtctagtatttcttataactacatgtgtatctacatttatctcagtttaaaagacaatctttcctagaaaaaactgattttttgaacattcttaggcatgcattcatatactactatagctatttccttgtcataaattccagaatgtggaatttttagtcaaaattagacatttgttcagtgcctgcaatatgccagatgctgtggctattcgtacttggaatgagagtctgattcagtggactcagctgctgcctgtacagtgtttataatccagcaagggaaactaaatagaagaagctcaaggcagcctgtggtcaaggccggtggagaattccaggtcacacactcagagaggtgccaggaaggggacatcattctgtggacagccactgataattcatgaccaggtgattctgaatatactgactctttgttgggataaatggaatttattttctaggctttataccttaggtaatttttttcctttttaaattttttgtagagatggggtcttgctatgttgcccaggctggtctcagactcctggcttcaagcagtcctcccactgtggccccacaaagcgcagtgttggcattacaagtgtgaaccactatgtctggccttttttgtcctttatccttttttatttttatttttttttctttttgagacagagtctcagtctgtcacccaggctggagtgcagtggcacgatctgggctcactggaaactccacctcctgggttcaagcaattcttgtgcctcagcttcccgagtagctgggattacaggcacgcaccaccacacctagctaatatttgtatttttctagtagggacggggtttcaccatgttggccaggctggtctcaaactcctgacctcaggtgatccgcccgcctcagcctcccaaagtgctgggattacaggagtgagccaccatggctaggagtagactttttaagaaaaaaaaagaaaccttctttgtctttggagagtctaattgcctctgactacatttcaaatcagtacacatttatatttgataagggaatgcatgccttttgttgcaacaaataggtgcactgaaatgaagacactcaagatcacggggtgtgtcaggagctgtcaggaccaccaccaggttccttgtttctctagatggactcaacaggactcaccatctagacctactcgtgaccgatttattccagtgaagggatacaaagcaaaaccagctgagggagaggttgcataggacaggttagcagggcaccaggctccctcttcctcagtcctctcccaggggcatcacaccggatgtgcctggctcatccagcatcacattgtgacaacacctgttccatgttatcgaccagggaagctcaccagagtctgctggtgcaaggtttggtttggtttggtttggttttgggtcagagttttgctctttcgtccaggctggagtgaagtggcatgatctcggctcgctgcaacctctgccccctgggtgcaagtgattctcctgcctcagcctcccaagtagctgggtttacaggcacccgccaccaggcccagctaatttttgtatggtagtgcaaggttttgatcagggttcatgcacacactgcctcgcacaatctgaatcttctggactcccggaggaaaccaagggttccgtgtaaaccacattgtttatactgattattccagcgaagggatacaaagcaaaatcagaagagggagaggttgcataggacaggttagcagggaaccaggctcagtttaggcacagcgagccactcttacacgtgaaagaagagtgagaacactcgggtgtggttttcagacgccatgggccagtgttgcgagcagcctaagcatggcagtttccagttcagtgtgttaactgttttgcataaggggtcgtagaacttcccggattttttctttctgtttctctgtttttatatctctattttatttatttttctactgatatcttagggttggtttgtcagcgtgtatggttctgcattccctccttccctctctcctcctctccctctctctccatatatatacatgtgtatgtgtatgtgtatatatagacagatgcgtgtgtgtgtgtatttttatatatggaattttacaaatgttattgtgtcattctgttttggtaacctaactttactgagagtatgtctgaaatatctctcatgtctttaaatatctttctaacttaacattcagtaatcatttactattttactttgatattctgtgtgtaattatgctgtcagcttttctggactcaaaagtgctctcagatgtcacctctggtatacaaaaaaaacagttctgtatattacctgagcagtttcttgtccacctgccatgttgtgagtaacatcacccaatctagaggccagaagaggcccaagtttggataatacagcccctgttcaccctggaagcttgtctggaggggccagggtaggctcagaatgagactgaatactctgagcacccactgtctgatcctagatcacaatccccccatccagagttagctaatctatgaggctcatgggtatggtctgcatagaagaccaccctcacttctgacaccactgcaagcttggtggggattcctcaaaccgccctcaggttcaacagttcactagagccaggcatggtgactcatgcctataatcccagcaccttgggaagctaaggtgggaagctcacttgaggccaggagttcaagaccagcctgggaaatatagtgagacgcaatctctacaaaaaaaaaaattagccaagtgcagtggtgcaacctgtaatcccacctactcgggaggctgaggtgggaggattgctcgagcccaggaagtcaaggctgcagtgagctgagattgtaccactgcactccagcctggatgagagtgagaccctgtcttaaaaaaaaaaaacaaaaaactattcactaaaaggacccacagaattcactgagagatgttatgctcatggttacagtttattacaaggaaaggatacagattgtcatcacccaaggaaagaagtacgtggccaggtgtggtggctcatgcctgtaatcccaacgctttgggaggacaaggagggcagatcacgaggtcgggagtttgagaccagcctggccaacatggtgaaaccccatctctactaaaaatacaaaaattagctggacatggtggcatgtgcctatagtcccagctactcaggaggctgaggagaatcgcttgaacccgggaggcagaggttgtggtaggccgagatcgtgccactgcactccagcctgggcaacagagtgagactccgttcaaaaaaaaaaaaaaaaagtacgtaagttgaagtccaggagggttccagacacagagcttctggtgtcttctccctgtggagtcaggactcattactctgctgtctttgatgtgtgacaacaggcaccaactatcgccaactagagaagctcaccagagctctgatgttggaagtttttattggggcctcagcatgtagacatgattgactggttggtggattaactgtctacatggttaatcttagtgtccaggtcagctgatactgcgtgaccaaaagctcctaccccgaatcccttgattagtatttctggcatagcaagcccccatcagaaacaaagacattcctcttagaggtaatatagattacctttcagcaccagagggcaaaggccagactactttttaggcaagtacacattctttactacatcccacccatccgtccccgacagggagctggccagaaatggagccctcctgttaaattgtctgggcctgtctttgaggcgcaaaaaaaaaaaaaagtaaagcctcctctgctgtgtgcagctaggtttcctgaggtttcattgagagcttggtttaggtttgatccatgatactcttttttttttttttttttttttttgagacagaatcttgctctgtcaccagaggctggagtgcagtgacgcaatctcagctcactgcaacctccgcctcccgggttcaagcgattcccctgcctcaacctcccaagtagctgggactacaggcacgtgccaccacatccggctaattttttgtatttttagtagaggcagggtttcaccgtgttagccaagatggtctcgatctcctaaccttgtgatccacccacctcggcctcccaaagtgctgggattacaggcgtgagccaccgcacctggcctgatccatgatactcttcacctttcccagatatgtcacggttatgtgtttgtgttgggaagccaagacagaggagccaaaaggtcatattacatcactatggggaccccagatgcacctcgttttaatctctttttttccacccctagctctagcctctcggaatttgtcttcttcagtggaaaccccgagaagactgatcagttcttcagttctaaaacaatggcccaggtaagtgtatatttctctttccttcttgagctatgatatttgcgttctgtgcatctgcttgtgaattatctgaagccttttatctagtcaagctctttataattacctgtttcccagctctttctattccagtgaatgataatgccacgtagctccgtgtctgcctttttgggaaatcactgagcaggtgattaagtatctcctgtttgctcccttttttggcaagggtaattttggagcagtgaagtagcaaagtcctttgagggaaatatttaagtcaagtctgtggtttgatgagttagatatgttggtcccatctgaccacatgagaaacagatcctccactgatcatgttttctgcgtagataagagggaatgctcatattcgccggtctgtcttagtatgtgctcagatcccaagctttatgggacttttggaaagggatggggctgtgattaggacctttgaacagaggtcatgttcctgccgggaaactggaggataaattttattattgaatggatctctcagaccacaagatgattctaagtcatctgacatccttatcctctaaatcagaaacagggggccgggtgtggtggctcacacctgtaatcccagcactttgggaggcccaggtgggtggatcacttgtggtcaggagttcaaaaccaacctgaccaacatggtaaaacctcatctgtactaaaaataccaaaattagcaggctatggtggcatgtgtccataatcccagctacttggtaggctgaggcaggagaattgcttgaacccaggagatggaggttgcagtgagccaagatcatgccactgcactccagcctgggcaacagagcaagactctgtctcaaaaaaaaaaaaaaaaaaaaatcaggaacgggggaaaggcagggttatggatggtaataaatatgaagatcttccagtatggaagtaggagatgatcacataccccagaatcggagaaagccttaggtgttttgggcaacctaagtgaataactgtaataaacagtctgacttacctgtgtgggaattttttaaatgcttaaaaggaagactgcttaaaatgtagtttggcatgatgaactggaggcttgaaaacattcaaacatgcaaaccgtattttctttttttttttcttgggacggagtttcactcttgttgcccaggctggagtgcagtggtgccatcttggctcacctcaacctctgcctcgcgggttcaagtaattctcctgcctcagcctcctgagtagctgggattacagggatgcgccgccacacccagctaattttgtattttaagtagagacgaggtttctgcatgttggtcaacctggtctcgaacccccaacctcaggtgatccgcctgcctcagcctcccaaagtgctgggattacaggcatgagccaccacacccagcaaaccctatcttcttttcttttcttttcttttctttttttttttgagacagagtctcgctctgtcgcccaggctggagtgcagtgccacaatctccgctcactgcaagctctgaccaccccgggttcatgccattctcctgcctcagcctcccgagtagctgggactacaggcgcccaccatcacgcccggctaatttttttgtatttttagtagagatggggtttcaccatgtttgccaggatggtctcgatctcctgacctcgtgatccgcctgccttgttctcgtgatccgcctgccttggcctcccaaagtgttgggattacaggcgtgagccccccgcccagccccagcaaaccctattttctaaaataaaagttcttaaacagaaatcttgatttttcttccccccttaaaagaaaaaatgctgtaggaatccacacttgttgagaacttataaggcaggcacgtagcagacactgcttgtaagcaagaagaaaacttggattgttttatccacttcctggcaggtttgactaactgaggattctgcacagtaaagtcattttctctgcagcggtagagctcttcagtgacatgcaggcattctgcttccgtcacagttacagtgatgtccttaccgccccttgccgatgtcacgggtgttcagtctgctcacggtgttcaccctacccagagggtggcctcctgtctccttcatctggaagctgtttcctttcatttcatcatgcacgtgtgggtttctgtttcagggtttggtgacgttcgccgacgtagccatagacttttctcaggaggagtgggcctgtctgaactctgctcagagggacctgtactgggacgtgatgctggagaactacagtaacttggtctcactgggtgagttgcacgcctcagataacttagactgcctcctggaatatccgctctcccctgtgaatttcaggaccgcctttcaagaaactagttgaatttcttcttcctgtccccaaggaatgtattgagccttattgatgtggccgtgagcaccacaaccttcccctcccatccatcggttaccttcccacctttgtcgactcccccgtaatcatctcacttccttaatgtccgtggaatgagtgggaattctgggatatttatttcatgaccatcttcaaaggagccagtttgtcctgtgagagtatgtttatacccaaattgctattggtggtcggtgttactctagggacccacgtctagggaaaacatgtggacacagtgccctgaattgttctagtaaaccagcctatgtgtttgaagtacagtagatcagacaaacagaatttgtgtaaaaccaaagtgggcgtatttcatttcttacataccatacctgaagtgaggttgaaagttacaatccccgaactgtgagttaaacattgaatgacaatatcttgcaaacatccctggaaacttatttttcttctagcaaaaataacaacaatgatattaatggctaagctgtctgtggtgaccctgcctgtaatcccagctactcgggagactgaggcaggaggatcacttgagcccaggagttgaaggctatagttagctatgatcataccactgtactccaggctgggtaacagatcaagaccccatcgctaaaacaataaacaaataggaatatatatattttatatatatacacacacatatatattatatatacacacacatatatattatatatacacatatatattatatatacacatatatattatatatacacatatatacatatacaatatatacatatatagtatatattatatatataaactgcttactgtgtgccatgcactgtgctaagcactgtgtgtgtaagtacattgcatttcgttctcacaggcagatgagacaggcacaatcattgtctattttggagatgaggatactgaaacacagtgatgcagtcagacggagggagcaggagctagaatcagatttaacagttttggtccccagattccttgctgccagccaccatgttccacttgcctccaggcataatgcctacagaaatttaaaatatgaccttttctcggccaggcgcagtggctcacgcctgtaatcccagcactttgggaggctgaggtgggcggatcactggaggtcaggagttagagaccagcctggccaacatggtgaaaccctgtctctactaaaaatataaaaattagccgggcatggtggcgcacgcctgtgatctcagctactccggaggctggtgcaggagaatcatttgaacctgggaagcagaggttgcagtgagccaagatcacgctactgtgctgcagcctgggcaacaaagcgagactctgtctcaaaaataataaaaaataaggccgggtgcggtggctcactcctgtgatcacaagactggcaggccaaggcagacggatcacgaagataggagttcgagaccagcttggccaacagagtgaaaccccatctctcctgaaaatacaaaaatttgccgggtgtggtggcgcatgcctgtaattccagctacttgggaggctgaggcaggagaatcacttgaacccgggaggtagaggtatagcatttctttttttttttaagttgagatttttttctttttttcactctgttactcaggctggagtgcagtggcgcgatcacagctcacagcagcctcaacctcctgggctcaagcaatcttcctgcctcatctccctgagtagcagggaccacaggtgcacaccacgacacccggctaattgttgtgttttttcttagagatgggatttcgccatgttgtccaagctgatcttgaactcctgggctaaaggaatccacccacctcagccttccaaagaggctggattacaggcgtgagccactgcacctggctcaatagcattttgacttctggttgttataaatttgattaatactcaatcaaaaaaaatttaaggccaggcatggtggttcacgcctataatcccagcactttgggagtccaaggcgggcagatcacctgaagtcaggacttcaagaccagcctggccaacatggtgaaaacccgtctctactaaaaacacaaaaattagccggtgtgctggtgtgcgcctgtaatcccagctacccaggagactgagtgaggcaggagaattgctgggacctgggaggcagaggctgcagtgagtcaagatcatgccactgcactccagcctgggcaacagagcaagactccctctcaaaaaataaaaataatttttaaagaatttttgaagttttgagcttgaaatttttcctcaagttctatgtcctctagcatttcgtttttttaaaggagggcatataatttctaagccagaggtactgtcttatagaattaagggaaagagccttgatggttgtgagggaagagacaagacaacaatacggaggaaagtgggagccagtcagccacccgtacaaagagcatccccacagggcagggaacaggcacaccctgaggtgttggagagctttctccaagagctcaggcccaaagcctctaggaaagaaagatcttaccacgaacttgatcttcaccccatttccctgtcaccttgtttttcctgtcatatttaaccccattttatgtgctgctggtgctgctggtctgtgggccacgcctttagtagcgggtagaggtgacagggtcctctgccctttatcattcctgaaagtgggttagcctcgctttaagtgcccgttttctttttctcatatctaggtgttggcagtactgcttcccgggtgttgttaatgtgtcaccaccatgaagcacctggtgtctggttgtagctcctctttgccattggcagtcattggcactgcttacattcatcacactgggggctcaaatggtgcgcgcctatcactgccccttcatttatcagctgttataatttaaagagaaactttgtttcatctgctaattgctcatgcagtggcactgttcatattggataagaaggataaaaactttgttctttttctttgtcagtttttatgttgtatttttttcttttcttttttttttttttttttgaggcagggtcttactctgattcccaggctggagtgcagtagtgcagtctgggctcactgcagccttgacttccgggctcaagccatcctcccacctcagcctcccaagtagctgggactataggtgtacaccaccacacctggctaatttttgtattttttttgtagagacagggttttgctatgtttcccaggctggttttgaactcctgagctcaagtaatccacccacctcggtctcccaaagtgctgggattacaggcgtgagccactgcacctagccaattgccagtttttataataaaggtctggtttcctagcgtgttccagagctggccatttaacattttgtagtatcattatgaacttatagatttaaacgtttgctgtttctcagtcctttgcagttagcctccttattgatgctcaagttctaaacttttccttattgttcttctaaactttttcacattttttattaaatttagtctcgtaaattatcttttttgttgcttttgaatgttgtattcttttacccagttgcttttttttttttttttttttttgagacggagtcttattcagtcggctcactgcaacctccacctcccgggttcaagcgattctcctgcctcagcctcccaagtagctgggattataggctcacaccaccatgcctggctaatttttgcgtttttagtacagacagggtttgtttgtttttgttttttgttttttgtttttttgatatggagtctagctctgtcacccaggctggagtgcagtggcacaatctcggctcaccgcaacttctgcctcccgggttcaagcgattctcctgcctcagcctccggagtagctgggattacaggcacccaccaccatgcccagctaatgtttgtatttttagtagagacaggatttcaccgtgttggccaggctggtctcgaactcctgacttcatgatctgcccacctcggcctcccaaagtgctgggattacaagcgtgagccaccgtgcccagtctgtttttttgtttttgttttgagacagagtttcatgcttgttgcccaggctacagtgcaatggcatgatctcggctcactgcaacctctgcttcccaggttcaagcaatttccctgcctcagcctcccgagtagctgggattacagtcatgcgccaccatgtccggctaattttgtatttttagtagagacaaggtttctccatgttggtcaagctggtctcggactcccgacctcaggtgatctgcctgccttggcctcccaaagtgctgggattacaggcgtgatgagccaccactcccggccctttaccagttacttttaataatactactgacatatacgtgtatcagtttcagaatgctttacacacagccatccaactgcatattgttttgttacagtacttctatatttggttttccaagtatatcatcacatcatctacaaatacttgttttcatcttcaaaataggaaataataggactaattgtcgggacctttttcatgtctgactttaaaatagatgtctccaatgaattctcagttagtattgtaccagaagtagaatctacattttaacaagagccctgggtgattcacatttattctactggataatttttatttctattagacgagtttttggtttgtggttaggttcgtttgtacttgtgtccctctaaaggaaagaaaatatgttcttttttcccagatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcagg

SEQ ID NO: 38516 - DNA, 12456 bp, Homo sapiens
aaaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaaggtcagtggctttgctgacagatgttgcatcagggaatatttttttaaaaaagaggcttcctacagctgttctggtagcttgtgtagtagtgttagctatttccccaagttgtcttgtctcagttctctgatattctgagcccagataggatttttttttctaagaaaagaataatgaagtatctacagatggaatcctgagatctgacaatagagcactcagaagttgggtgacttgcccaagccacaaagaggaaaagaatcaaactcaagtttctcgactttcagttaatggctaattttaattgcataatattggagagtcagaaatgttcattttattgtggaagcgatccaaaacctcatgctataacctagattctagaaaaaggatgatcaagccctattagcgctgtaaaaataaggtaatcaagccctatcagtgctgtaaagaaagttttgcaaactaagttaaacttagaaaataaatagcaagaaataaatcagggaagcaaggtttccctgagactactgagtccatcatactggaagtcatccaaagttatcaacagcagattcattaactgggtacaaatgtacagctggaattcaaagtagactcggtgcccttctgtgtgccctgatggaagaaacatcgtgttctcattctgtggctgtgtactctctggggatcattggttttaccaagtttttacattgctttttcaaagacaataatgcctgtttcctgtatagtttatttaagtaaacaagaaggagacagcaaagttctgtctcctttacaaaacgagactttaaaaattttatctaaagaaagagagcaagagatctgttctctgcattgttccataagataagttcattagataaacagttctattttgaactcagttcagctgggcaaagtgttctgtttcctactacccacacacatcgtgaatatcaaagactttttaagaggataaaaatgctcccaaaagatttgttgagctagttctatcctcaattaatataacactacagaggttctgtgggaaggcaatggcatttttttttctggtgaagcaatcattttaaaacccaagagattatttgaaggcaagtttactccttatgagctacagaaagcatgccatcatttgaacacagaaacaatattccacagggattaggaagacatgctttggcatcaatcagactttggttctagtcctaggcaccattttccaaatgtaattgaataattactataattactattcatttataaattactatttatcattataatgataaggaataattaatgtacttagcactaaatatctgggtactttaaaataatccatttaaataattatctaagttttaaatttacatccgatttcaatgtagagtcattattttatttattcattgacttatttggcaatgactttctaagcatgcaaaattgttgataatgtccttgaggaactgacagatgatttcccaaccaacatgttcatggtaaacccctcaacataaaggcttgcttccattgcatgaggcccaaaacaggacattccaaaataaatctgtagtggatttggattgctatttttttaaagtattcactcatgggggcaacataaaattagttcttagtaaggcaaaagcgtttctccatatgtgaagtggcaagacaagaaccttctatatattccttcctcatgagtagtaccttagagtagtaaccactggagaaaatattttcattaccagaagatatctatgtagtgcttattttaaaataatgtctaacactgtaaaaaagaattgcatagttatgttcttattttcaagcaatttaaaattgaatgtatcatcaataaattctttgcatatggtcagtaaaaataaagtctcaaattggaatacttaaattttttttattctatgcaaaacattagcaatctcacagctggtgtgtatatattgtatgtgtgtcagcaaaattgtgtgtgtgtgcatatgcatatggaatgaagtgaattataaaattattcataattttactcgaaattttatttgtgagcctatgacagaattttttgacaattcacacaatgcatcataacttactagttaggcagtaatgccaaccttctctagcatttgcctctccaccggagaagtgaatagctacgctaacaaaattatcacatattcctcgccccacatctactccttgtcctgacctatttctgctcacagcaacctcaagctattaattacttagtttaaaaccttacaaactcctctcccttgataactttccccacttgaaattcattgctgagttttgctgattctaccattgcagtgatttcctacctgtccgcgtttgccaatatcaggtgcccattgcctcttacctggacaatcacagaggcatcccaactggtgtctcaacctgctttccctcttccccatattgactttccctaggacatgccaacactctataaagtcaggctactgtttataatgcacagagctcactgtgcaatcctgttcaaaaccacattgctctcaaaagaaagtccaaactcgccatcgaggcgataatccgaccataaactatttccggtcttattttgactgctctctgcctgccctgtgctctttaaaattctgccaaacaggctactcagtgctctttgtagaagacttgcacttttcaaagctatgcttgaatacaggctgtttcttccacctagaatcatgttctttccttttctatttataatgttaaatgcctgtgtgccatgaagattccaacctccaccaccccctaccccctacacacacacacccctgggcctgaattgatttcatcttccctgggccttccacagccgtttgttattccttcaagaaaaggattacccacgttggtgtccctgtgactttcctgttctggatggtaaactccatgaaagcagagaccatgctttgcccactgttttgcatctgctcagctagagcatttagcaagttcctggcacccaaaggagcacaggaactaaaatgcttctgaaggcagaggaatggcctgggtgacttttgaagtggcctgactgctatggcatcttccacggattccgcaggtaccaggcctatgtctgtcccggcctcaaacctacccaaatctgcttagtaatgcagctctattttaatgctcagatgtatacaaggcaaaatacatggcttaatcattctagaagcagtaggcaccccttttcagagcacttttcccaaactaaatctagttagaggatatcaccctgaacccaagaaaatgagacttaagctaaacttaggaaaatgtacataatataattttaaaaatgaattcctcacaacacaacatagaagaagaaagaggtacctagatttgaaacctggctctgccactttaaataaaatacaaatacctgagagatgactgtgttatgggtagtacatgttagatgcttgtgttaatgtgtccctttcctcttcaaactgagcacattgtgtgcgtcagttcagaaggaaggagcccaggttctggagttaaacccagaaacagggccagtctctgaacctccatttctttttttccctccccatttctttctcagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcggtaagtatattctgctctgtgactatggaatggggaaaagctaactgacccttacagagataccattgattatccgtttttaggacactttacatgttgcgaggtgatttccaatttccagtatcagattggtgtcaaagcctagaaattgtacagcgattaggagtcgactgggtgccacacaatgtttatgtacataattttatgaccaagacaagtgatatttggcacctgagactagggggagatttctcctgtaaacgagcaccaaagggctccatgctatcaggtatagggaggagtggcaaaggggtgaggtcattgtgatcccttcccttctcctccctgaaaaaaaaacaagtatggtgtgtttcctgcaagccccagaatatgtgagccttagctcactcactaagggaggctgaccctaggagtgtgcatttgtcttaggaaagaaagtgtcagcccattttgaggtaactctcgaacttcgggcttcctcatctttggcctccaaagaataacgtacataaacataaaatgcgatgcaaaatgtatggggttgtatcaggatggcaggagtttcggtgtatattctgattttgagacaagaaaatcaattcttctcatctgaggccagaatggtaattagttcttgttgaagtgagagattatttactcagctctatttttttatgtttatgtgacctttcatagttactcagaacaaaatggggtaagagaatggggattgtaatgtgaatctaaaagatgtatgtttccctttctatattcaaatggatcttatgagattcccatacctagaaattgaccaccaattagtaaaatacagatttatatctaaggcacattcattgttcctcttggtactatcagatctctctatttaatgtcctagacctcaaagaaaagtgttttggaggagaaaaaaagaaaaggaggaataataacatgacctgctatccaaaatgaacacagaagcacagatcactttccaaaatgtccatgatttcagaacataaatgcaggcacacccttaaaagaagcattagagaggagaaaacctggccagcttcccaaatctccctgcatccaattggactgggtgatgactgagatcaaaggcatgtggtgattggacagaaggccaagaggaactggcatcctcaaggctgctggaaattagccagctcaaacacaccaagcaaaagcaaattggaaataaagacaggcgagtaatcaaatgcacatgggggcatgcttcacaaaatgcgaacttcatgtgttcccagaggagaaattgccaggtcttcaacagcacaaactcaataggaaaatcaaaacatccccttttgcaaccttagagcctgaatctttggcttccactttagggaaatgggcaaaatgacctctttgtcatagtacacaccatgctccctgccctcctccactcccagacccctctcccctaagtaactttgtctttcattttgtttctaaagaaaaaaaaatgagatttttgcaatttggggcattctctctggaacagcaaatgttcccagctctgccgtttacaatgcctttggtggaaggtcacctcggaggtgtgatttttcagtataacataatttctatggtgccttgacatcctccaatgaagagcaccaataggaccactcctctgacattagggagagggtccactcaggcaccaaatgccattctcaccactaatcctaatcttccttgtactccttttattacctgcatgttattgggaaagaggatggtttatggtcccattcccctacatacacactttccaaccccatactcccttagaaatgtagagcaaagattacgaattcttttctgcaggttctgattcacagagggagagcatcagaatgggggctttggataggaaaaaccttgcaaattagtgcctgaataaagatataaaaagagaaaagtgaaggaagatattcttctcaaacttgatgccctttctctctgtctctgtctgtatacacacacacacacacacacacacacacacacacacacacacacacacatatatatgggttacattttcatggaggacaacagagtaaaatccagcagcatttaagggatttcctcttgccaaattgtctccggtcccttaattgtgtttaagccttgctgagtactttgtttacggtccctaatgtggtgatttgcatccccctgtctgggttgctcttggcagggcaggcagctgtctcagtctaactctggctgggaaaggtaaggatctttgctttgctttttgaaagatctgggaaggaaatgttgaatgtctatgggggttaggggcatagatataattcatgcattggaggctttgagaaaagttctccaaacttaaaggagtctcctaaagccatgtgctttagaaagaactagagagatttcctcttctttgtgaaaatagagggctcgcagaaataaggctggttgcattgtggatgaaattttgcatttgggggcaggtgtccccaaaggatgcccaggggtgtttaatactttgtagacacagagtggaaggaggaataaacattcagaaacaacaggcatagatcactaggaattctctttgaatttcaatttgaagaggtaaagtcagttaaagctgcatgtgtcagtggttaggatgacaggcttctattcttctgatacaatgtctgctttataccaaaactttctacctctttgaatttaaaatacaaatcattggttgtctactcagagtctagagatgtgtacctgtgtatcaaggcaggtgcacacaccctgtggaggagcattggtgtgaatgaggcacctgagcctgacaaggttgaagaaagctttggtattggaagtgatgacagatttgtgctcctaggacacagacacactcactgcgcctcattatagactcagtcaagggcttactatgaaaaaagctgccattgtcctctctctagacgttcaatgtttgcacctttagctttggtaacaggaaagcatgcttttcaacagaataaggtgatattcagagcttcagtgcagttattgggctatcttgcaggcaaagtggtactagaaaatagaggggaattgccctcaagggccagagtttgcaggtgagaagacagctctgttaaggagcttctcaagaacctccattgtacgtagccagcggcccccatcttaccatcttccgggggcaactttggcaagttctgaaatgccctggttctaagtattcctgaccctcaacaccaagtgacggtactcctcagatatgaaagctgtctctttaggtctgacatttttaaagtgtgaggatcatggtgaccaaggcctccaggtacttgccatgactcccccaacctcagggacttttcaactttattttttataaggacataaccctctctctggctttcattccagaataaacaacttctggtccctctctttttgtgacaagtcatcagggtattgctacaaggcaaggctggagagagtgtgctgtggtagaggagaggcgagatgtttgagaacatccaagccctttgccagctattagagaaatctaacaatttgagagaaagatggaaaacaaatctcttccaagagttaatttggatttgtggttcacagtattaattagaagaggttattaacacttgtgcagatgaaaaaatggaggatgtaaacttttaactacagagtgtaggatgagctcccagtattatcttttctcctcaaaaagacaatcttgggctttatatgtttcaaggttttaaaaatttcacagtttgtctgtaagaaagcataaacctataaagtcacttacaggtttatggggtgggaaatagatgtttaactttattgtttaagtatgatgtgtcaagttgtatatgtttgaatgtttaaaataccttgatccttaaagtgggccaaggaacagaggtctcaacataggtagggagcttgttacagacttactgaatcagaatctaaatttaacaatctccccaaatgatatatatatccattaaagattagggttcaaaccaagggtgtctctgttactgggtgatctttgttaaattacttaacctctctgagcctgtttcctcatttatgaactagtgagaattaacattaatatgtgacatttcttaatattgtgccatgtccacagtaggtgctctataaatggtagcaattatcatgatgatgataatcttggtgctgctaaagttacctccttgcaaaagcagtaaacaatcatgtttaaatcaatataactggctttcccccttaaccacaaacatttgtgcctcccaccctcattcctaaatgaattaacactcaacaagtggggttttaagcttcagatgactatcacgcacatataaagaataatggaaaacctaggaacatggatttttgctggcttagagactgaattcagctgcctgatgacttcacagctgtttctgccaccctagagtatctgtcccctcggctctgtcccctcagccgggtctgcaacgctgactctgggattttcttataaaaatgcctgatggacgggaggaagatctggaggtcggcgggggaaaaaatgagtcattcaaattcacaaagcagtccgcttagtaaatgctgcaagagaaaaagtaaaagctggctcctgtctctggggaatctgtagaaatgattcggactcatcatgtcactgagcaaagctgggggaagccaaaactcagaatctgctggcaaggaaaagaacgaaggaaaaaaaaaaatgttagggaggggcaaacccgagggggagggaataaaaagagagagggagggaaagacaagcgtcatttaggaacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgaggtgagtgtaagtaatttggggacagatcttgattttcaggttagctcaatctcagctttggggtgaagttatttttttcagacataatctcaaatatcttttaactggcctcaccagaagttagggtgtcattggacaacagtgattaattagtttggtgattaaaaatgacatgtgagtaggcagctctaagatttagtttcattgctcagggagtgatattttgactttccagagcagggaagaaccagtgaggtttgatttggagttgaatttgttttcagtggatgcttaatatatttaaagtatgaatctcattgaaatggtctcaagtatctttctttaaacttgttcggtaactacaactgctcaactgtgtagcagctagacagctttttgagaatggaagacagtgactcaaccatgtctgagcagcagacaagttttcactgatttctcatagacagcatttcaaccagatacttttgatcaaaagtctcaagctttgtcctgaaatgttcaggtacgaaatacttagaaagggtcattgcagcaagttttatacacaaaggcatggaggaaaatgaaggttgtgaaagtttcctgaaaacctagcatgcttatttgtttctgcatgttgtagtatacataatatcgaaattttgtgttgagcttaatagaaaatttgtgaattgacagctaattactcaaataattgattttattttgccaagagaaagcacaaaattatatcctatgaaggggttgaatttttttttcttattttttctcttttatagcagattggaagatattgttacacttcagaccacaaatccccacctcattttcaatgaattttttgctgaactgtccacctaaagtgggtaataaaaagatcccagggagcaggttgcactgtgtttaatagtaacacaataaagatttgttggctgtcattcaatggagaagaacatcatttgttgctggccacttgccttgacattgattttgtgggcagccaatgggtgatagtttgcaaagaatgcatgttatgcccagcaagattggcggagtctgagttgctgtaagttctgggattaatggtacgaaatattgtttgtaatgtattctcctcttgaatgagaccatctttggattaggattcaggcatttctgtgtattcagaggaaggagaagcaatagacaaagcagaaaagcttgtaaaacttttgtagaccgccagggtatattaaacactgtaagtgcttcctgctttttctgtcttcccttcatatgcatctgcttcatcttattttttgcctaaatgcaaagagaatgcaaccaattcaaaaaaagagtaaagttgcttttcacatggatctgtgcctcctagaaaggaggtgcctccccagcttttcatttctgcttacagggtgtacattctgatacatgtagctgacatctcctgttatcttcacagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtgg

SEQ ID NO: 38517 - DNA, 14637 bp, Homo sapiens
gaggtgggctgtgtgcagtaaactggaatgctctccctcgctcactcctcagtgtaggagtgatctgaagcaggacaagctcagcctgcagctgccgtgggctttgtgtggactggacgcagagcttgggagacgggggagggctattactccaattcactgtcaatggaattacagctatagcggcagtgtatataggattgctttttctcgtcttcctggtaagtgttttccatgttttttcttatgattgtcccagaaagtttgcttggttttactctctagaaagaaacgacttgatactatgagaaatccaaataggaacgtttgctctgtcaccacaacaagcaatatatgtgcgtgcaagccagcaatgaaaaatttcactatcatggctgaatgtaagaagtttcttagaaccttctttcatttataaaagatagtaagtggctattttctgtcttgagtaattgctatgtgaaaagagccttatggaaaacagcaagttggaaagttcaatgttaaatattaaagaatacaaggagattcttcacagataggaaagcaacttggtgtgtactgtacgtgtgggatgatcaccaattgctgtttttacaactgtgaaagaaaatcaataatccctcagcccatgagtacgcagtacatgaaaagcatacatcttgctcacagctagccgagctactcctggagacttatgtgcctctgtaaaggattaacagctacacctagattttaaagcttgcactgctatcgtgcctgagctgcttcaagcatttcaggcttgcaaatctcaactagtaaattgaactcagaggagggggagacactcttccaaaccatattccctcttcaatagaacaccaaaatccattgcttaggcaagtgaagtatgtgactagcatagtaaatggctaagtctactcagaaaaactaacaaagctcaccctggaagctatgcctgatgtatgcagtgagtttggggtagcaggaaagaaaaataaatgagtagagcccttatcaagtgggttttgcagaggatccattctttgcaacttataataggaaaatcttatattggaagaaatgcatttatactacaaagcttgaaaaagtagttaaatgtatcttctcaaaaaattttgttcactgaattaggtctgaaacaaaatggttgcatataggtaaagagtgcaacaggcccatccatgtcttctcaacatctggggggtttgtttttattattttatttagaatttaaaagaaaaaaaattgatttttttttcaatttttagtccaaaatctctaatggttttaataataaggctattttaaacattcttaataaatctgtctattaataaatctgtctaaaatgctcatctatgttattttattatccagaaacaacataaataaagccactagaaaagtccttcagctgtagcaatgcctttcatttatctctgactgcataaaaatatcctgaccagcctaaacataaagaataaatttgcttatattcagggagaatcacttatacctgacccaaagtgacagatgactaatattcatctcttccgaaatgagtaaagaaaaattaatcctttaaaagtgccacaatcaataatatcaacattaccaactactacaaatattaatgataatatgccaggttttaccatgggaaaattaaatcagagatatgccccttagtttggacacatatatatacacacagacaaacgcacatctatttattaccctgaaataaaaacagagttacaaaaacgcatagatttactaagaaaactaaaatttgattttttgaagagcacaaccaaaacacatcaagtccaaggatcagcaaaatattagtgaatgaataaacataatgaattcattaatattgcggttctgtaaaactgtctaccagttactaattgggtttttcatttcgctgcaccccaccctttaaaatcaattatgactgggttcaaaatgcacaattaaacacttcccaaacataacgtttgtgagatatataattggatagcaaataaagtttttacaaaaagaagaaaaacagtaagaaaatctgtcataactaaatgtggcagcaaaatagaaggtatgtttcttttgctttcaagtgttaattaaggagcctacaattctatcaaaactttttcagagctaaatgaagcagtgtgaaataaatttggttgaaatcttgtggctgtcagactttgttagcaagctattaattatctttaccccagtttcttctctagactatattgcccaatcaaatagaaactccaattatgctcagcatctcctgcctagggacacaagaccctaatgaacactcagtctctctagatgaaaaatacaataatcagctttaaacatgcaagtgcactgcagagagatttttctgtgcttttcttggccacacaccctaaggcttcctcctttttctggattattttgaacagttttaagccctacaaaaatcagtgcagggaattggccttgtcttaataatatattaatgtttcttctttcttgcttttcatttttgatatgccaatgttcataccaatattaaatctggtcaatgaaaaagtattggtttatagttgccatttcagtcatttcttaacttctatgcctctttttaaggtgggtgggctatataacaaagaatgtgattgattaatggcaaaatccagagctaacttaaaaattctgaatagatccccttatatattcttttattcaaacccatttatttaaaaaaaaaaagcattagaaataactgtttaaatcaaatgaagactaccataaataaagtcaacaatggaaataagattcagtaatttttcaaaggccataatttctcccctccgtctttcctccttcccccttccctcccaccccccaccttttgccccagaggccttcactgttcttctcaacgggaggctttgttgtaattaaaccagagaaaaactggccagcagcagccaacatctgacttgcggcttcagaaagcagtgttctggtagagtgtaccaccccccagtgggcaaaaactctacagtaaaaatctctcagcaatattaatcctcaaaactgcattttctcttcagagcataaaaagggatgtttctcagctccttctaacattccaccatttcaaaaatttactgaaagtcaacaaataaatttccaacaaagagttggtcttctgaaacagcattcttcctcttaagaaaataggtatacacatttcaaaaagtattttccagtttcaaaatacagatcgacatcactcaatttggttaaacatcacactaaaagacagttttcaaagctatgtttatgttgtgtaagaaagaactttgagttatctatttacgaaaaccccagagaaaacagattttaagtagaaagcaatagaatataatttaagcaaaagctaaaatttcatttgttttgcatatgcataatctctttcctaccctaaaatcaagtgtcagggatgtataaaaagctttctgcaggtattattctgtttaaatcaaaggagggagaaattgctctcactcgatgagacaatgacagcttttgttctttattctttcactttacatgtgcacaagttaccgaggcaactttgaagagaaaacccacagaccacatttggttaaaaaccatttttaaagtgtgccactggactgtggattgatcagtttatgtgttgttgattttcttcctcttcatctggtttaagtaataccctgcttggacatgaaaaacaatgtattttatgatttcaggtggtctcaccgaccagtatagtgcttgccacacagtagactaaaataaatgtatttgctgaactactgtatggaaacttaaatattagaaatttaaagcacatcaaccaagttgtacccacactgttaaaaaggaatttgaagtctgcaatggtaaaacgtggtttaacaaaagtaggcaaacttttaattgcatttgctcaaaagcacaaatttaaagcatgcccccaccccaaactctgcaccacttaccttcaccactctctaaattaatatcttactcgttcttacaactcttgttctctaattcatttactttgggtttaatatcataaaaggaagcagcattcactatgctgacggataatatcccagtttgcctttttgttttaaggatgcttgatttaactttacaagtcaaaataaatgaagcagaatttgattcatttgtcagaaacgtaccggggaaaataaccagtaacagaaaaagaaaaagtaaaaatacttagcattggaaattttatcctctattttccataaatgaaacaaggaccttgttcaggctagaaaatagtctggataaaaccaagtatgaaaaggcacacttgcttctctgcctctcagcaaacccttcagacttcatgactctcaagaggagagttagaggtccttctgcttgcctggcattgaacaaaagaattggaactttcctgaaatctgatgatcatggaaaatttaactaccagacaggctgcttagaaagcattttgctgtcactatcaactaacctgatgtactccagtttttcagtttaaccgtatatgtagtttatttgaaataccgtttgttgttgcaaaggcttagcattcacaggttgagcttttttggcagcaatttaagccttcataaataaattaccttcctaatactctaaattatgattgtataaattccagtttacctagaaatattcacaaagttggatacatttgtttaggcatgtgttttctttagtctcaaggttttacttaaaacaatgcaactaacttggattaaaagttctacatgccattagattttagattgaatatttttaaaagtccccagcattaagaaatcattctgtgagagaaatcattaaaaataaactataatctcaaaaccttatacttgaattaatatttttaaaaaatgactaatgatcaaacaggtcaaatcaaaatcaatttaaatctaaggcattaaataagaagttagcactactattatacagcttcatcttaatctaagtaatattctcaaaacataagaaataccttctcataacactcccacctccaaaatattgtagtagcagggaagaaatcacataaacatgtagattgccgcaagctcttgattttatttaaatactagttttctattcagatacaacttcttatattagtttccctaaaatagtatccttatctatttacatgttttattgggtgtatcatggaaataaattggaagctttcagacttgatgattacattataaatgcaaaaaaaccccacaatttttatttgtaaaaataaactgaatatgaatataaggatccctattaaaaatttgattcatcagtgaggtggttatgtttttcttctttttactacagttttaagtgttttatagttaaataatgattccattaaaaaatgtttttaaacattccattaagttaccagggcttcatttatgttttcctcccaagttaccccattaacagtatttttctaaaagatcgattcattttgttcagaagtaatggcctctttcaagcctaggcggacagaaaggctctgaagtcagtgttatggaaacctggccacagtgtccatgccagtgggggtcatttttcttttcatcatcgacatttgactacagtatttctaggtgcgcaaatatgtagatccagctcagaaaggggaaggtctaaggataggagaggatcgttcatttttgatgaagagatccttgcagcctttaatatgccaaaaccaaaacccaaaaatctgtttagcactatagtttcaaacataaatgggaaagagaagatataaaacgtagttaaacatgaactgttttgagcctaagggagcaggggcatatgagagtagctctgaacgtaatcttcatttccgaaagagtatccttctctcctaagaaacctgttttatgtttttgccttttattttaatacaatgtggggagaagagaatgacattttccaagaacttaatgagatttaaggctttctgttaatcccacattattaccactattgtatgaatggcaaatgtgagtttgcatatcaaacagaatagagaaagcagcttcacaaatgtaaaacaggtaaaataaacaaattaatcttccgtcttttcacaccaatttagaactctttcattctctgggttaaaaatgtgaaaatcaatacatattgttagagccttatttggtgaaatatatatatagtccagacacaagataaaagacatttattttatgtctggttatcattatgatcatcaccttggacacactgtggtctgacctgactcaggggacaatcagtttttaaatccccaatcagcggattcatcatctcaagtatatattgcctcaccatcatccctggaatatcagaaatgcttgactcttggtaacattttaagcaggttctcacttgttatttttataatggtttttaattagtttctaatgcaatttaacataagcaattgttttctaaacttaaattaaccacattattttatatgttgaataattttcaagtttaaaaaacttttacagaagatactttaaaaagtaactttgtaattataatttcagcagcttggttttccattttcacacactgagaaagcaacagttttcaagaaaagatactattggaatttgacaataatgagcaaagccctaaaggcatcacagtaaaacctcacattaaacaataaatcatttaaactttcctctgtgggcactttgcaatattcactagagactgtttgatccatctgctaactgctatttttgtttcaagttgcgtaaataataaattatatgtatctgtaattgttttcacttttcttccgttaatatagcctatgaccatgttggtatgtagttagcaaactaaaagaaactgaatttttggagagaaccagaaacacaaattgtggccttatttaacatactcgttcagcagagtatctgaattatggaacagatgctatacttgttggatgttagatagcaactgtgggagaagcaaattgctactactttagtccttactttgagggtcacatatttccaggatactcaaatgttccctacatatatacaaagtatcagagtggatgaccctgcataaccaattcgaatattactcacctcctctaaactctcaaaaaatcttcgtgcatatttgataatgggcaaagcagtcaacattaaattcaatgatctctttagtcaagccaaaagtcttcttttggaaatgaaaaatacacttattaaaaactggcaatattcatgtatgaacctagagagaaatgccccacctggttttgatgtgctttcctaatggtcactacaaggagattgaaataatagtgtcccttctatttcaaatacaatttttttttcaaactcagtatgctaaaagaaaattagaacagtattctccagaaaaactaaatatgacttgaacttctatgtcaccttttgggcaagaacacctgagtgcttagagtttcaagatcactaagtagtccttagatacacccctaaagagaaaggggatgatgtcaacattctgcagttgggagaattgagacctgcaggaggaatcaaacagggcactaagcaaatcaaaagaaaagcttttaaaatagtcttttcaactctaaattgtggattgtgtgactttgttaaatcatgttcagaaatgcctaaaaagttaccttggcatttctgtcaaaaatatttgttaatgtatttgctcacctctttgacatgtacttgttttcttctttttaaacattttatcattttatgcatatgatttaaaagtaaatttttaaagactggcttgaatttgaaagccatggtgtttaattcaaagtgacacaatcagataatagaaattatctgtttgatgacaatctcaactttggctcctactttatttgtataagaaaatgagaagtctaaaaacaaagaggtcaacctatcccttctgactaaccactatgatgaaagatgtgttattttaagacattgaaattaaatgtctaggaaatttctctagtatgttaaagttcattattaatagttcattaaaaccttttactttcacaggagatgctcagtcccagtatattttaaggaagagaaatataaaggaaatttagtatgcctccttttctttaaatgaagaatttagtttcctttacttcttaaaagagaatacctgttcttgtataacgtgactgcaccagacattctgaaaaatcagcaagaagcaaaagctggaaatagctatttcacagcaggtaatcatacctcaggatgtagctactgtacaaagtttatacttggataatcctggatgggaataaaggtagggggtaactgcctgaaaaacctattactatacaggccttagcatcatgaatgactttcttcatgaggatctgaagttactatctctgaccacattgcacagaagagccaataagaatttcaaagagggcaatttccactaagggaattaagctacacaaaaggaactttcacacagaaactctatcagaaagaaaaaaaaaatacataggaagccatgtgtcctacatagtaacaggaagcagaattgtttctgcccccactttaatgagcttgcccaccatgctgaactgcagctggaatgttcattgacaacagcaagcctgatctggaggtgtgtacgccataggattacttgaataaacggtgaagaacatttccaaggactaaacaaaagtttataagtcccagtccctcaccaggaaaataatatatgtgcattggatattcacccccgcaaaatttactcacatcgttcaataaggtaggaaaaacaaagtattttattttcatgcctaaaattacaaaggctaattaatacttaaaaggacagaagagactatattacacaatacatcagtataaatctatactttgccagccatagaaaaagttgatttatgttctaggttagaattcaaagaaatataaatgcactgtgacaacacgttatgaggtagaaaataatgaaaaatgtggacaaagtcattaaaacctgcagtatgaaacatataacaaaatgtgaacagaagaaagacagaatttaatatgaagtgaaattttccacttaggttagctggatgtattagctttgtaattctttcccaaaaataaatgaaggaatcattcttattttcttgcagaaatccatccatttaaaataatgcttaaaattaataaccaaagaaaatgaaatgacattaataatcaaagcaaactatgggtttgagattgaggatctcaagatgtgtgtaactattcctgagtatgaagagaataggtatttttatgacatttttctacacctgtatagtttttgcctaataaaaagtaaatataaaaatgtgtggttttttgataacagtaaaatgattacctttaaatataagaaataatattccaaggtgttacttattatgaatattaagtaagaaatggatattcaattagcttgatcagtgactgtctaaaggttgatataaagtataattaaaatactttggattattcaataaaacttcaattatatttaatatttcaaaatcaaatggatttaggacagatactttttaatttataaagaaattaagaaaccattaaggtaaagagattatatgacagtgtctattgttagctagcaataaaccctattatgccccctcccaaaacaaatgaaaatattaaaagtgattatggatattttagtttccacatttgtttttaaacattatattcagtatgctggccttattgttttctgtctttttttactcacttcattttagggttctgaagtaacggaagctaccttgtataaagacctcaacactgctgaccatgatcagcgcagcctggagcatcttcctcatcgggactaaaattgggctgttccttcaagtagcacctctatcagttatggctaaatcctgtccatctgtgtgtcgctgcgatgcgggtttcatttactgtaatgatcgctttctgacatccattccaacaggaataccagaggatgctacaactctctaccttcagaacaaccaaataaataatgctgggattccttcagatttgaaaaacttgctgaaagtagaaagaatatacctataccacaacagtttagatgaatttcctaccaacctcccaaagtatgtaaaagagttacatttgcaagaaaataacataaggactatcacttatgattcactttcaaaaattccctatctggaagaattacatttagatgacaactctgtctctgcagttagcatagaagagggagcattccgagacagcaactatctccgactgcttttcctgtcccgtaatcaccttagcacaattccctggggtttgcccaggactatagaagaactacgcttggatgataatcgcatatccactatttcatcaccatctcttcaaggtctcactagtctaaaacgcctggttctagatggaaacctgttgaacaatcatggtttaggtgacaaagttttcttcaacctagttaatttgacagagctgtccctggtgcggaattccctgactgctgcaccagtaaaccttccaggcacaaacctgaggaagctttatcttcaagataaccacatcaatcgggtgcccccaaatgctttttcttatctaaggcagctctatcgactggatatgtccaataataacctaagtaatttacctcagggtatctttgatgatttggacaatataacacaactgattcttcgcaacaatccctggtattgcgggtgcaagatgaaatgggtacgtgactggttacaatcactacctgtgaaggtcaacgtgcgtgggctcatgtgccaagccccagaaaaggttcgtgggatggctattaaggatctcaatgcagaactgtttgattgtaaggacagtgggattgtaagcaccattcagataaccactgcaatacccaacacagtgtatcctgcccaaggacagtggccagctccagtgaccaaacagccagatattaagaaccccaagctcactaaggatcaccaaaccacagggagtccctcaagaaaaacaattacaattactgtgaagtctgtcacctctgataccattcatatctcttggaaacttgctctacctatgactgctttgagactcagctggcttaaactgggccatagcccggcatttggatctataacagaaacaattgtaacaggggaacgcagtgagtacttggtcacagccctggagcctgattcaccctataaagtatgcatggttcccatggaaaccagcaacctctacctatttgatgaaactcctgtttgtattgagactgaaactgcaccccttcgaatgtacaaccctacaaccaccctcaatcgagagcaagagaaagaaccttacaaaaaccccaatttacctttggctgccatcattggtggggctgtggccctggttaccattgcccttcttgctttagtgtgttggtatgttcataggaatggatcgctcttctcaaggaactgtgcatatagcaaagggaggagaagaaaggatgactatgcagaagctggcactaagaaggacaactctatcctggaaatcagggaaacttcttttcagatgttaccaataagcaatgaacccatctcgaaggaggagtttgtaatacacaccatatttcctcctaatggaatgaatctgtacaaaaacaatcacagtgaaagcagtagtaaccgaagctacagagacagtggtattccagactcagatcactcacactcatgatgctgaaggactcacagcagacttgtgttttgggttttttaaacctaagggaggtgatggtaggaaccctgttctactgcaaaacactggaaaaagagactgaaaaaaagcaatgtactgtacatttgccatataatttatatttaagaactttttattaaaagtttcaaatttcaggttactgctgcgattgatgtagtggagatgcctgaacacaattctatattttagtattttttagtaatttgtactgtattttccttgcaaatattggagttataaaccatttactttgtgttctactgagtaagatgacttgttgactgtgaaagtgaattttcttgctgtgtcgaacaatcaggactgcattcatatgagatccttgtagtataagcacaggccatttttcactttggtattaataaaatgtaaaaaaaaaaaactggctgaatggctgaatgagataaaatttaattttaaaaaatggttatgaaataatgttccaattattaaatttgtattatcccagtggtattcaataaatcaaaatgtgtgaagtaatgggcaatatcaaacttcctgcatatctccatttttgctctaggcaaattaattatccttaaaaaagttaagcatatcttctgaactgaatacatcagctggcataaaaggagcatgaagtctgttaaagccattgtcagcaaagctttgaaaataaaggacttcacaaaaacggtaatgtaaatgtgcttccaagttggggggaaaatgtgtacttaggaaaacatggaaacttagacttgtatagtgtaatgaacacaaataccaaaactgcattttggttttgcctataccatcctgatttttgaaaagtgaattataaacacaaaattgttagtgtttatgatgtttttatcataaaggatgtcagagaaactttatgcatattaaaaatgtaatgtaattataagcgattcccctcaacaatccagagaaagtagttctttaaataagagataatttaaagaaaaataaatactagacatcaaatttagatctggtttatgtcaaaggttttaacactgtacataaatgttcaatttacttttacaaagatcaagaatactgcccattactgtcacaattttccagatattatataatgaactcgtaatgtaacatttccttctagcttcctactgaattgtgagctgttacttgttgaaaaaccatatcacttttctgttgccatgattttttttttttcaacaaaaaaccaaagtgcattgtacgccctttggccagtcttgtatgtgccttgatccaacgctacatgtattcagcttttaaaactccacaaatttttcatactccttaaatatgaaaaattatggtcttattgctgaataaaacttttaaaaagtacagaataattgtgcttgctttttcaggattgtgttactatcactaagtagcaaattgcccagcacattagtcctaaacgtcccatgtatttttctaggcataaaaataaaagttggctaaaaattttaaaaaatcaacatcttgaggttgtgtatcattttacttcaaagagttcagtgtttcatgtataaatgtatttcctcttacttatacactgtatagatggaaaatttaagaaatggtttcaaagcctttctctcttaggcgcactgctgccactgtcctgatactttttaaggtggtctttgaaaaactgtttttttaaaatagccttttagtagagtgagttggcatttgtgatactgtgaaatacacactttctctttgtccctgtttctggcatacaactcctaaaatccttgcaatcttcaaagtgatatattttcatatgctaatgagttcactgatagctggcaggccctaggtagcttcaagataaagtctgatcattgaaaagaccaagacatgattatagggttgggacttacaaccccaaaccctaacctccagagagggcgaagtggatgaagattaagttgatcaccagtgaccagtggtttaatcaagcatgcctatgtaatcaagcctccataaaaaaacaaaaggtcaagatttggagagcttccagattgctgaacatgtggtggttcctgcaggatggcatgcctggagagggcatggaagctctgtgcccacctagacctcaccttatgtttcctgccatctggatcctttgtaacatcctttataatacgtcagtaaatctgtttccttgcattttgtgagctgttgtagcaaattaatagaacacaaaaaggggatcctgggaaaccaaacttgaagctgactagtcttgcaactggtgtctgaagaggaggcagttttgtgggaataagccctcaacctgtgggatatgacacaatttccaggtagacagtgttgggattaaactgaattggaggacacccagctggtatctgctgaagaactgattgcttgcgtggtgtatggggcaaaacttgttaagacaagtcttctatgttgattattgttgaatgagagaattaaacacacatacacactt

SEQ ID NO: 38518 - DNA, 21428 bp, Homo sapiens
ctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccgggatcccagcagccgccacgccctggcctcagcctgcggggtaagtcggtgggcaatgctggggacgttggagggggccgggtctccaagcctgacagtgaatgatggggtggggaaggcctagtgggctcctggcttctacagcctggagccagggtctgtgtggggctccagcaccctctccctggacctccacaccccttcctctgctgccagggtgggtgagggtcccaggaggtggggtgggggctggacagacaactgttgctgctggggcttgggagtctagggctggaggaatgggccagggtttggttggggacacagatgggctaaacggtatgaaacggaaagagcacccttctgccccagtgtgtgtagaaagggtggtgggtcacatctgcaaactgaggcagccaggcagctccccacctcccatgtttccatgggaaaataccccacccgggtccccagggcctggtcccagcctaccctctccacttccctctgctggtgccgctcctctctgctctctgccccctgccccctgcccccttctccacccttctgtctccttaccactctttgactccttcttctttctgatcctgctcactgggcccatgagggttccccaaccctgaccgaggccccacccttgccaagtgatggaggctgtggtttcagttttcctgtgagggtgagattgtgctgtttgctgagcttcctaggccagcctagggcctgaggcagcgtggtggagagagcctgggccacaggctaggggcctccctcccttcgtgaagcccccagaggccctgaggcacacaaaggtagtattcgatgccttcagagctgaatcagactgaaaatatagacagaccctgaaaggctttgaaaacggaagaggaacgtcatggtagacgcatggtgtcagatccggctctgccaacaactggcgaccttgggaaagccactccccctttctaagccttagtagtcttggcagcaaaatgaagggtttgatagtctagtggttttcccagttatttcttcttagagctccccttctttggcgaggggttgagtgactggccccatcccagtcatcgcacttttatctgttggaatattggctgccaggcaagacgttgtgtaaagaaagggttgtgctgttaatgtaaatggtaacaggggttgtgacccctcagattccaggaagtcccagaggaaaagtcggggacagtcatggctcttcctgggggacaacatcaaaagggtggccctattggttccctgttcctcaccccacaggcctccctccctctcctcacccctgctgctcatccctcctggcccacttcccctgcattggggctgggctcccacacagtgggtggacctacttgcacttggcatttttgccattagaagtaatgagaagtaatggcaaaaaccgcaattttttttttttttttttttgagacagagtcttgctctgttgcccaggctggagtgcagtggtgccatcttagcttccgggtttaagcaattctcctgcctcaccctccctagtagctgggattacaggcacaagccaccatgcccagctaatttttgtattttttttagtggagatggggtttcaccatgttggtcaggctggtctctaacagctgaccagccagcctcagcctcccaaagtgctgggattacacccagccaccacgcccagccttttgcactaacctaatacctccttttgcaggctccagtcaggccaacaccgacgcgcagctgggaggaagacaggacccttgacatctccatctgcacagaggtcctggctggaccgagcagcctcctcctcctaggatgacctcaccctccagctctccagttttcaggttggagacattagatggaggccaagaagatggctctgaggcggacagaggaaagctggattttgggagcgggctgcctcccatggagtcacagttccagggcgaggaccggaaattcgcccctcagataagagtcaacctcaactaccgaaagggaacaggtgccaggtgagacagcaagtgggggcagggcaaagggggccccctgcccagctccagcagagcacccggagtgagactcattgactagtccagcaccagtgccccttcccacagcctgtggagtcctcagtctggccctggtggctcctgggcccgacaggctgcctctgctctgccatctggcattgctctttccagaggcttccccattcttggccttctgccttctgaggtcatgttcttcatgagatacattcttgagctctaagtcctcaactgaccctcaaatccccctgttcatgccaactcccacccctgtcatggtccctgttggggaaggcagcaggatccacactccatccagtgagaatcaaggacatctggaaatgtcccaggctctcctcagttctgcaagactgagcctgtcactcaggggacgtgaactgtgggattggggatgacaggcttctgcttggagtcatctgcactttgattttcctgtggtctttccaccaattcagactgtgtgagcaccacattcctgagagtcccacttccagtcctgctgcatttggcaccccctacttccctgcccgggggcggggcctgcccagtgaggctggagaatcctcatgggccaggctagactctgccacagaagccccttcttcccttctcatgcttgaggtacagccaccagctttggcctcgcaggctagagctgcttcctgtttgtgctggaggacagtggtcagattcagcaccagggtaggggaggatgcatgaggagattctgggagctgtggagcctgcccgacacaggcaggacgggcccttgatgctttcagtacctcaatctgtgccctcaatgggcttccctaccccaggaccatgatgccaccctggtgacagaaagttctttgtccaaatggccacttctgccagccagactgtccacagggctcctgtcagcagcagatagagccctcatggtcatgtgtggcttcctggtgctgacaaaggagggctggctgtaattacagtcatagctgttggcttaaaaagtctacccttgaaatccccacctgattcaaggaggcagaggttgcagtgagcagagattatgccaccatactccagcctgggtgtcagtgtgactctgtctccaaaaaaaaaaaaaaagtgacggatcccaacaatcaccttgtcaccaacctttacttggttgacccattccacaagagacattaagctgggacctgagggtctacaaatcatcaaatagcaccccctgttctttgtcttcgcatatctgctggtggtggtaccagaagccccagaggcaagttggcccctgtgattagtaacacagcccaggagggaatgactcatgcccttcccacttccagtcaccagacgctgctagattctagattctgacaagctaccagatcccttccggggtctgtgggagagatttctcattaggtgtgccttcttggtggtgtctgatatgtttcaacattgggcccagcgttgggcccaggtaatgctctgtttctgggaaatttcttgctgccaagcctagaatctctctggggattcagagtcagggtctaaagttaaacagccctgctgagattcccagtttggcgctgtgtgactttggcaagttacatgacctccttgtttatctaatggagaaatgagtagtttctgaccagcagggctgaagtgaagatgaaaggcacagaatattctgtagttaatagatggtttctaagaggagaagggagattttctgcatactttctttgaaggcagtgatgcatgcagccactgtgagtctgcggggacctcccacagccctatccagatccagccccaagctcaagagccaccacaagtggtgtgtgctgaaggggacccagtgggatatcgaggctgttgagagatggtacatcaaggcacctggcacatgacaagcacctgatgctgaaaagtgtctgtgatgactggcgtcatggggatgaagcagcttagtgcctggacaggccccttttcctcctcccggggtcccctaggatggctctaggaggatagaggccctcagaagggctctcactgggctcctgggcctgaggggtgtgcagtgtgtacaggactccctgaaagggctccctgggatggagggcttttgggggggcctgtggttcttctccagcatgagtcacaaaccacatcctccacagtcagccggatccaaaccgatttgaccgagatcggctcttcaatgcggtctcccggggtgtccccgaggatctggctggacttccagagtacctgagcaagaccagcaagtacctcaccgactcggaatacacaggtagaccctgccctgtggatccaaggctaggcatcctgtgagctgatagttaggtgggctgtgtgggcttgatccctggtcaggagctgaggagtgagtgttctcagcagccctcccactggaaggatggctggggggccctgtggacagagttaatcaaggatggcctcctgtcagtcttggctgtgcctcccacttccacccacccctcaggcctcctggctacctctgtcacccctagcccattgcagtggctgaatggaaacccaaagcaatctttttttatcttttttaataacagtgttgttgagatataatatataatgcacataccatatacttaacccatctcaaagcactctttgcccaaaatctaaatatctgtattgtttgggctgatcagaaaaataacatgagtactctagaagattcaaacagtaaggaaacatatagagccaagggtaaacacagtctctcatcctgggctccaattaattgtttgagaatgcatctgttcagactttctttctttcttcttttttatttttggagagatggggttttgccatgttgcccaggctggcctcaaactcctgggctccagtgatccttccaccttggccccccagagtgctgggattacaggtgtgagccaccgcgcagggcctatccagactttcttaatacatcagtatatatttacataaatggggtcttgacacatatactaatttgtaacgtgcttttcctccacttaatacatcttgtagcactttccatttcagtacatgtctaacttagtcactttgacaactgcagagtgagttttcccttgtgtccttatcatcatttagttaaccaattccttacttatcgatggccattttaggttgttcgtagtttttggcttcaactagctgtgtgccaggccctctgtgtgctatccactttgtttatattattcccctttttttttttggagacggagtcttgctctgttgcccagcctggagtacagtggtgcgatctcagttcactgcaaaactccacctcccgggctcatgccattctcctgcctcagcctcagcctcccgagcagctgggattacaggcaccagccaccacacctggctaattttttgtatttttttagtagagacagggtttcaccgttttagccaggatggtctcaatctcctgacttcgtgatccgcccgccttggcctaccaaaaatgctgggattacaggcgtgagccaccgcgcctggccattttttttttttttttttccgagacggagtcttgctctgtcacccaggctggagtgcagtggcgtgatctcagctcactgcaacctctgcctcccgggtccaagcaattctcctgcctcagcctcccgagtagctgggattacaggcgcccagcactgcgcctggctaatttttgtatttttagtaaagatgggatttcaccatgttggtcaggctggtctggaactcgacctcgtgatctgcccaccttggcctcccaaagtgttgggattacaggcgtgagccactgcgcctggccttatattattccctttgaaccttacaataatcctggaacattcccattttacagtaacgaaaactgagattaagagaggccacgtgacttgccagaggagatagagacattaagtggtggagtcatgtacaaatactgctctgaatgttctgctgtagacagcatttcacgaatgatgacttatgtcttagaaatttagtttctaagccgggcgcagtggctcacgcctgtaatcccagcactttgggaggccgaggtgggcagatcatgagatcaggagatcgagaccatcctggctaacacggtaaaacccgtctctgctgaaaacaaaaaacaaaacaaaacaacaaaaaaaattagccgggtgtggcggtgtgcgcctgtggtcccagctgctggggaggctgaggcaggaaaacggcgtgaacctgggaggcagagcttgcagtgagccaagattgcgccactgcactccagcctgggtgacagagcaagactctgtctcaaaaaaaaaaaaaaaagaaaagaaaagaaaagaaaaagaaaaaaaaagaaatttcgtttctagggcagaaattgtagtcatgtctgttggtatttcttatctgttacttggagccttaatagcctataacatggttgtgctcccaccagttatgtgtagcatctcttttaatcctcccaaggggtactttgagctgggcttataagagctatcgggcagcccagccactccaggtctcagcaccactgtgccccttcccctcccttcttcccacagagggctccacaggtaagacgtgcctgatgaaggctgtgctgaaccttaaggacggagtcaatgcctgcattctgccactgctgcagatcgacagggactctggcaatcctcagcccctggtaaatgcccagtgcacagatgactattaccgaggccacagcgctctgcacatcgccattgagaagaggagtctgcagtgtgtgaagctcctggtggagaatggggccaatgtgcatgcccgggcctgcggccgcttcttccagaagggccaagggacttgcttttatttcggtgagtgagcctttcttggataaatcgaggcaaagagagagtaaggcctggttcaaggtcacatggttagtgtatgacagagctggcagttaaacctaggtttttctgaccccgatgccctgcttctaaccactaggctgcctgcaaaagcagtttgtcttttgtccaggccagcctcaaactcctgggttctaacaatcctcctgccttagcttctcgagctggggctacaagtgtgtgccaccacatccagcattaatttgtcataagagatgtttcatcctcgtctggccagaagacgggcatgcacccagacccagacccagggaaagaaataggggctgctagcactggcatgtgacttggccaggcagagcctgaataaagaggcagcatgcctgggctctggcaaagaagacagcaaaaggcagcaggttggctggcccctgttctgctcccttcagtggtaaagaagcctgacctgtttcaaggagggctggccttttgtccaaggagcatgaggagtaggcagatggaaagcaggaggcctggggcccaagctgctctcttggcctgcaggtgagctacccctctctttggccgcttgcaccaagcagtgggatgtggtaagctacctcctggagaacccacaccagcccgccagcctgcaggccactgactcccagggcaacacagtcctgcatgccctagtgatgatctcggacaactcagctgagaacattgcactggtgaccagcatgtatgatgggctcctccaagctggggcccgcctctgccctaccgtgcagcttgaggacatccgcaacctgcaggatctcacgcctctgaagctggccgccaaggagggcaagatcgaggtgagcggctgtccccttcccacttcccctctccaggaagcagtaggtctcatcccaaaatttctgcagaaagaacccagggggtggtgaagagcagtggcttctctgcttttcaatggaacactcctgttagtaagaaaattttcagtatgtacctctgatatatttctgtttatttataaattgcatatgaactactgaatatattacattataaaacattgagattttttttttttgagacggtgtttcgctcttgttgcccaggctggagtgcaatggtgcgacctcggctcaccgcaacctctgcttcccaggttcaagcgattctcctgcctcagcctcccaagtagctgggattacaggcatgtgccaccacacccagctaattttgttttttttttttttgagacggaccctcgctctgtcacccaggctggagtgcagtgacatgatctcggctcactgcaacctctgcctcccaggttcaagcaattctcctgcctcagccccctgagtagctgggattacaggcacccaccaccatgcctggctaattttttttttgtattttcagtaaagaggggtttcaccatgttggtcaggctggtcttgaactcctgacctcgtgatccacccgcttcggcctcccaaagtgctgggattacaggcacgcgccactgcacccagctaattttttgtatttttagtagagatggggtttcaccatgttggccaggctggtcttgaactcctgacctcaggtgatctgcccacctcggcctcccaaagtgctgggattacaggtgtgagccatggcacccggccaaacattgggaatttttaaaagtcgtttgtgtttctttattaagagatagcctttttatatcttttgcctattttgctattctgtttctgcatatttattgataactttataatgaatttagtattttgtctaccatagcacttgtaaaatttctcctagttcatcatttgtcttttgaattttatgttttttttgctatacaggatttaaaaatttttataatctgcaagtgtgactatcttttcctttaaggttccatggttttgctattgtctaattcctgctacaagattttatatatataatacatattatatgtacataatatatgttataactattatacattatattatacattataattatatatagtatatatataatcttcatacccatattttcttccaaacttttgcagctgcatttttttttttttttttttgagatggagtttcgctcttgttgcccaggctggagtacaatggcgcgatctcggctaactgcaacctccgcctccggagttcaagcgattctcttgcctcagcctcccgagtagctgggattacaggcatgtgccaccacgcccggctaattttgtatttttagtagagacggggtttctccatgttggtcaggctggtctcaaactcccgacctctggtgatccacctgcctcagcctcccaaagtgctgagattacaggcatgagccgaaacgcccagcctgcagctgcatttttaatgcctagagctttgactagctggaagttattctggtaggaagagtaaacatgaggcagcccccactttgttccagatagcttaccaatggcctgttccaaatagcttttgccaatagctcaccagggctggcctcatgggcttacagtggagatttttgaaagattaaggaaacgataaacataaatagaagttttaaccctttttcgctgccctcccaagttttttggagtgctccctggggtgtgtgaacctcactttcttgtctagaggcactgctgtgtggcctatgaaagcagtgtcctgatctgttcctcctttcccattcctcacgcgtgaaaccagactgcttcctaacctgtttggattagggaccactttctagtctgttgaaaattctagattctgaccgcgaaagtgcacacacagatacagctagtagactctgatctcaggggcctcaaggaccccagggctagggatcaatctgccatttgaggagttcaaggaaggccacagggcaggggaggggaaggaagagccaggctggctggcaggctggggcagatgtggctgggtgcgtgtgtgtgtttaagagtttagacaaacaaggacctgcgtgtatgggggtacgtgcacgtgtcagctgcagctctgcagaccgtgggcagctgctgagtcctgggtgtttcccagccttggcccaggatcagtgccaggaagggaccatgaatgcaagctcatatggccaccctgcagattttcaggcacatcctgcagcgggagttttcaggactgagccacctttcccgaaagttcaccgagtggtgctatgggcctgtccgggtgtcgctgtatgacctggcttctgtggacagctgtgaggagaactcagtgctggagatcattgcctttcattgcaagagcccggtgagcccacaggagcatgggtgcacgcagaggacccagcagagtttccagcaaggtccacaaattggggctgcctgctggaccatatctgccccattcctgtgccagtgggggtgtggctgcatgtcccagcaggcacgaccctgaccatggccaccgggcccatactcaatccatactctagtcccatccaagacggggatcatgccaagggcctcgtggcaaccatccgggtcctctctgttaaccagcatctcatttggagggcaagccccttagtcacactgtagctgggagggttggcgtgaggtcctttggggctcctggggtgtggaagcctgctccctgtcctctctcctcatttcctgggcccttgctttgatcttgacatggagtgggcagcctatttgcacttgttgagtgtacccatggctctcccctccccaccccagcaccgacaccgaatggtcgttttggagcccctgaacaaactgctgcaggcgaaatgggatctgctcatccccaagttcttcttaaacttcctgtgtaatctgatctacatgttcatcttcaccgctgttgcctaccatcagcctaccctgaagaaggcaagggcgtgaggtttgggggggcacatcttgggggaggcctgcttgaaacaaccctgggggaagatggggcagtaatagtgctgaggcatgggctgctggagtgacattcccaagcttatgggagccagcactgcagtactaacggtgatacagtgaagatttgctgagtgctcactgtatgtgaaaaaggattctaggtgatggacatgtgttgactaattaatgtgccccaaaacccttgagatggtgaattataatcacccccagtttatagtagagggaagggaggcacagagaggttaagtaacttgcccagggtcacacagaatggaagtggtgtggagagggaatctgaatccagggagtctggcttcagaccctacactgaaatgctacacaatgtgcctctcaggatccaggggtccttccctggagcccatgttcccatgccgttctgaggagcctctccacagctcaggctcagagtaggccctcagcttcagctctgaagggtgagctgttcgagagaggacccaaggccctaggtctcatctgagtgtgtcttcagcaggccgcccctcacctgaaagcggaggttggaaactccatgctgctgacgggccacatccttatcctgctaggggggatctacctcctcgtgggccaggtgagtgcccctccccttctcctaccaagaagcaaacctagaattctgcttcagggggcttagagaaagttagctgcatcccctcactgacaatacccagtcccacccagagcaaccagcctcactgaagctgagggccagaggttctggccttgccttctgagtccccaggaacccctctgctgtgcttttggggttccttggggtagcagatagcttctctgattccttggcagtacagactctgctcccccaggaatggagctggaagcgcctgcccctagccaggcccctcggctgggaagctcccctcttggggagcacagagaccagaggtaggtggggttcaggctatttcccccagtagggcctcttcagtgggaaatgctgtaagcctgcaggacacaggctggacaccaagacattgggacctccgcagagtgggcagaacttgggcaccaaacgcaggttggctggggtatgggtgctccctgtgaggccagggagaagggaagggaaaggtgctcttccccttcctgcatgcagtgcacaggctcttcacctgcaccccccggccttgcctaggtggctgctctttctggaaagaaagtcccaagctatctcagctatcagaagtattcatgagtcccccaaaaccaaagctgctgacttagctctagcctgggtggcaggctcccactcagccaggccagcagggggcatgcgggagagcaggtttcacagccctctgtcctcccttcctccgcagctgtggtacttctggcggcgccacgtgttcatctggatctcgttcatagacagctactttgaaatcctcttgtacgtgggttctcactcctccttctctcaactgtctctgaggtctggaaggggcagttgtggcagaaggcaccaggttggctttagaggcgaggacacggggcccaggaagtcgggatctgtgtacaggccagtcccaggagtctgggctgccgtccagcctggggccccttgtgctcccatcactgtagatggtgatagtgacatttactaggcctcggcacatacctgtttcacttagtccttgaaaacactctatgagtcaggcatcattattattatgcccattttacagtgggagggaactgaggcccacagaggttaaatgtcttgcctaagatggaggtcaggaccttggtcagcataggccagtgggggctcagggagccaagtggcccgcaagcccacctggattctgctcccacacagcctgttccaggccctgctcacagtggtgtcccaggtgctgtgtttcctggccatcgagtggtacctgcccctgcttgtgtctgcgctggtgctgggctggctgaacctgctttactatacacgtggcttccagcacacaggcatctacagtgtcatgatccagaaggtgagagaagggggtggcccaccgggactcttttggcctcatcaggcaagaagagccttcctccacagctatcctaggcagaggagggcatgtgtacatctgcctgtgcgccagcactcagatgcttgctggatggaagcttaagtacaggcctgcacatacctctctcagggctctgcatgcacacgcaaacaaacgtacatatgtgtgtttgcaggtgtccacacgggagcatgtgcatccttccacaagcaaggagcaaagaatatgtgcataagctcatctgcatgtctgtgtcctgcgatgtgtgggcgcgggcatgtaactgcattcatttatgtattcagcgcatgtttagggagtgcctactgtgggccgggccctgttctaggtgttgggaatatagcagagaacagaacaagtccttgctcccctgaagctgatgttctggtgggaggaaatgaaaaccttaagaaaacaactgagaacattccacactgctaaattctatgaaggaaaaaaaagcacaggacaatgtgatgcagaatggctgggaccaagtaccctttagatgggatggtctgggaagcctctctaaagaggggatgtttaagttgagacctgaaagaatgattcagccacagcagggtgaagaggagatattctcagcagagggcacagcagtggctgccacgagccagaaggagcttggggtgcttgggacagggtgaggaggctaggtggctggggagatggcaggagggtggaggtgaggaggttgggaggaagggaagggccaggggccccttccacggggagggatttggaggtccccagaggcttttttttttttaattgtagtaaaatacacctaacatggaacttttttttttttctttgagatggagtctcactcttgttacctaggctagagtgcaatggcaccatctcagctcactgcaaacccctactcctgggttcaagcgattctcctgcctcagcctcccgtatggctggggttgcaggcacccaccaccatgcccggctaatttttgtatttttagtagagacaggttttcaccacgttggccaggctggtctcaaactcctgacctcaggtgatccgcctgccttggcctcccaaagtgctgggattacaggcatgagctactgcgcctggcccattttaaccttttttttttaaagtatacagctaagtgtcattaagtacattcacactgttgtataaccatcaccaccatccaactccagaactttcttgtcatcccaaactgaaactcaacacccattaaacaactccccattcccttcccccagtccctggaagccaccattctaatttctgtttctacgaatttgatgaccatagctacatcgtagaagtggaatcatacagtatttgtcctttaatgtctggcttattttactcagtataatgtcctcaaggatcagccatgttgtagcatgtgtcagaaatgccttccttttttttttttttttgagatggagtcttgctctgttgcccaggctggagtgcagtgatgcaatcttggctcactgcaacctccgccacccaggttcaagcgattctcctgcctcagcctcccgagtagctgggactacaggcatgtgtcaccacatccggcaaattttttttatttttagtagagacggagttttgccacgttggccaggatggtcttgaactcctgacctcaggtgatccacccaccttggcttcccaaagtgctgggattgcaggctgagccatcacgcccagccaattccttcctttgtaaggctgaataatatcccattgtgtagatacaccacattttgtgcgtccattcatctgtcgatccagtcacctgttgcttccaccttttgaccattgtgaataatgctgctacgaacaagggtgtaaaagtatctgttagagtccctgctttcaattcttttgggcatatacatacccagaagtggaattgctgggtcatacagtagttctatattttattttgtgaccctggaaggttttttttttttgttttttgttttttgttttttgagatgggactcattcagtcacccaggctggagtgcggtgacacgatcatagctcattgccgccttgacattctgggctcaagcaatcctcctgtctcagcctcctgagtagctggcactgtaggcttgtgccaccatgcccagctactggaaagttttaagcaggaaaacaatgtgatctgagacatatatatatatatatatatatatatatatacatattttttttttttttttttttgagacgaagtctcactctgtagcccaggctggagtgcagtggtgtgatctcggctcaccacaacctctgcctcctgggttcaagtgattctcctgcctcagcctcctgagtagctgggattacaagcacaggcacaccactgcacctggctaattttttgtatttttagtagaaacgcggtttcaccatgttggccaggctggtcttgaactcccaacctcaggtaatctgcccgcctcagcctcccaaagtgctaggattataggcatgagccaccgcacccagccagatctgagatatatttttaaaagactcctctgctcggtgtggctccacaggcccacatatgcatatgtatgtgtgcgtatgtgcagtgtacacgggaaccatgctgctgtgggtgaggcagggttctggggtcgtgactggtggcccagctacccaccctggcccctgggcacatgtgttccaggtcatcctgcgggacctgctgcgcttccttctgatctacttagtcttccttttcggcttcgctgtaggtaaaggctccctccggccccctcccccttccccacgttccttgtccaccctgtacactcccaaggctgcccaccggtctcctgggctaaggacccctctcccttcatcccatagccctggtgagcctgagccaggaggcttggcgccccgaagctcctacaggccccaatgccacagagtcagtgcagcccatggagggacaggaggacgagggcaacggggcccagtacaggggtatcctggaagcctccttggagctcttcaaattcaccatcggcatgggcgagctggccttccaggagcagctgcacttccgcggcatggtgctgctgctgctgctggcctacgtgctgctcacctacatcctgctgctcaacatgctcatcgccctcatgagcgagaccgtcaacagtgtcgccactgacagctggagcatctggaagctgcaggtgccaccagagaggctccctgcccccaccccaccccacactcaggcggtggggagtgctccggaccctgcggagctgggccttccctagccaggagatgccgggttgggcagctctaccttgtcagtcttcctcttccttttttttttttttttctggagacaaggtcttgctctgtcacccaggctggagtgcagtggcacgatcacagctcaatgcagcctcggcctcctgagctcaagtgatcctccttcctcagcctcctgagtagctggggttacaggcacctgccaccacacttggctaatatttttattttttgtagagaagaaggtctcactatgttgccccggcctcaggtgatcctcccacctttgcctcccaaagtgctgagattactcccacctcctttaagctcatagatgtacttaggacagtgcccagcaccaagcaggtgctcaatgtgctaccagctactcttatcatcattgctgtccagtgtttcttttttttttttttttgagtcaagagttttgctcttgttgcccgggctggagtgcaatggtgcaatcttggctcactgccacctttgtctcctgggttcaagcgattctcctgcctcagcctcccaagtacctaggattacaggcatgtgccaccacaccccactaattttttgtatttagtagagataaggtttcaccatgttggtcaagctggtcttgaactcctgacctcaggtgatacacctgcctcggcctcccaaagtgctggcattacaggcatgagccaccatgccccaccctgctgccaattcattgttgatcttggggaagccccttatctcctctgagccttggtgccctcctctgcaaggttctgtgccccacctgactcactggtgtgcctctgggcaggcacatgtgtggggtgagcaaatgaagttctgttcctggtggtgtggcaatctggagcctggaacgatgtaagagcaagtagctgtccagtactcataaggtacagacttcccatcagctgtctgaggcactttgtcctcagtctacaaatggggaaactgagatgcagagaggctgagggcccaaccccacacaggtaaccggatgttggagccagattcgaatccgcgtgtttagttgacttcgcgttatactgtgaagtgctgcgcggcacttccctgctccgcttgccttgtgtgcctttgcccccaggcagggtcccaggacgttctgtctgatgcatcctttgtccccagaaagccatctctgtcctggagatggagaatggctattggtggtgcaggaagaagcagcgggcaggtgtgatgctgaccgttggcactaagccagatggcagccccgatgagcgctggtgcttcaggtgagtgagtggtgggagggtctcctgggggccttgctgtccagcaatccctggggcccccctgcagtgcagggcacagctgccaggagccaggtctggtgggaagggcaggcccaaagagcaccagggactgagcctgagcaggtgaggtcaggggtctggatctcacaagccatggctgccacatgactggccatctgcctgtcccagtggcttaaactgaaggtcccctcctggtgatctcagactcctccttgtagcctgaaatgtgttacggtaaggaggccaagaagtcagagggacccttgggttgctagcactctagcattgccctggctgctctgtgtccccccacccccaattctgccagcctgatctctgagctacaaccccttccatggagaacatgcccttctgtgtccaggaaaggctgggacactgggagagggaacctagtgacaaacacacagctaaaaacagacactgtcggccgggtgcagtggctcatgcctgtaatcccagcactttgggaggccgaggcgggcaaatcacgaggtcaggagatcgagaccatcctggctaacacagtgaaaccccatctctactaaaaatacaaaaaagtagccgggcgtggtggcgggcgcctgtagtcccagctactcaggaggccgacgcaggagaatggcatgaacctgggaggcggagcttgcagtgagctgagatcgcaccactgcactccagcctgggcgacagagcgagactccatctcaaaaaaaaaaaaaaaaagaaaacaacagcaacaaaaaaaacagacactgtcgtgaggcagcagatgagcagagagacggagtcttgggcatgaggagcagccatgataggccccagaacccggaagcacagatacacctgatctgaattcctcttctctggttgttctgggcaacccaggctgctgtgaacagccagaagcgatggatgctgattcctgcaagtgagcacctgcctcacaggacagggctccaagtgggtggcccagaaccctgcagagaaaaagcctgtcctcctcagggcctctgtgtccaccagagcatctctgcatagtctcccaatttggggggccacgcccctctccggggtgggaggggaggcggtcaaagcaggcaaacctcagagctgctctgttgccctcagggtggaggaggtgaactgggcttcatgggagcagacgctgcctacgctgtgtgaggacccgtcaggggcaggtgtccctcgtgagtagcctggtgactagagcctctgccctggggtgtgtgtctctgctgcttggccacaaagccttggagagtctggggcaggacccagagacctcctcatagtccctttgcagatccccacatgccagctcctcttagagggattgcctccttaaaacagtggttccctcctttcctttccacccacaccttgctttcaggcaggaaccaggggaaacctctgaggctgttagcgcttccaccagcccagcctctggctgccctctctctgatgccagtcagtcacaccctttgcccattcaattggttatcgagggtctgtccccagccaggcctgggctgagcctggggactcagcaggggaataagttaggaagggctgtgtcacagcgcagcctacaacagaggcagcatctccctggaccctcagaggaactgccctgcataggcccttagtcccttcacaccccaagtcccccacctctgagaaaccacttcccatgcttcctccatgtccgtggcctgtgtcctctccgttccagtgtagtgatggcccctcctgtccccaccctgctgcctccaccaagactggttccttcctcccaccctcagaggcctgttctgaggattagctgtccccactgcataccctttctttctagaaccttcaatagctcccaccttccactggttcacctcctctcctttctccatctctttcctgacaaatttcacttgcttgtgcctgttgccccccacaatagcctcctgagtctcccatggcccctgttgtagggaggctcctctggcctcttctgccccacagcctgctggtttcccaggctcctgggccgtgaccactgcctcacatacagataggtttcccttcaccttctctttgcatctccctctcttcactacaatgccaggaaagtcacctctgaaagtcaccttgtccctccctcatcttgccccaagcactccacaccccactgcctgctggggcctccaatgtgacattcccaacaggaacagcctcggggctgccccagcaggtcacatgtatgtcaccccaccccctcctcacccaggtggaaggccttgagagtctcagcctattccccccgctataccagctctcccacctggagctgagtgtccttgacccctcaggcggccactcatccctctgccctgccctgcctcttacttctgcaccactgcaggggggcccagcctgcactcttacccattgcagtcctgctaatgtggacaaaaaccacatgcagcccacgctacacaatgcctcccactacctggaaggccgcactgctcagaatggaggtcagggcccaaagctgtctaactcactccccacacctccatccacatgtctgcagtactccttgttctttgctttccttggttcatctctggattcgtctctgtcggaagtgctcttcctcccctctggatgtccaaatctgccaccgcccctgcaggacaggtcccctctctcctctgagctcccccagcatgtctcaggtgttctgatctctgacacacaagtctgtcacctccaggcactttaagctcctgggggtggcaggggcagggggaagcccctgatatggcaggggattgggaaatgcttgtggagtgagggaagcagggagaaggattgctggcctccaggatcgctgaggctgtccccacggcatgacgtgttttcatgactgtggccccgtttccctggtgcctgcttcctggggacacactcaagggttaagctacagtgcttgccatctgtttacaggaactctcgagaaccctgtcctggcttcccctcccaaggaggatgaggatggtgcctctgaggaaaactatgtgcccgtccagctcctccagtccaactgatggcccagatgcagcaggaggccagaggacagagcagaggatctttccaaccacatctgctggctctggggtcccagtgaattctggtggcaaatatatattttcactaact

SEQ ID NO: 38519 - DNA, 4351 bp, Homo sapiens
cgcgggcgggcaaacggacggctccgcccagccgccggctcctttaccccgccccactacccccgccttcgcggcgctcgtttcctggcgctccccacctttagcgagaccaacgagagaacaccgcctgcagctagaacagcctggtcaggagcgtaacggagtggtgcgccaacgtgagaggaaacccgtgcgcggctgcgctttcctgtccccaagccgttctagacgcgggtgagtggcggggcctcgacccccaccccaagcgcaccctgactcccctccctctcttgggggaggcctgggccccagccctctcccagcatgctccacgcgggatgcttgggcaggtgcagcgggaggattgtcagcacaggagaccgagagtcttcttcctgggggcgctctcttggtccctcagagggatatcgaggttaccatgtcctccctctcacttctcttccctatttcgtcttcgttttccgtacttcaccccaactaccttcacccaaaaaggttcatctaaaaaccattggggtagtttctgtttcatttgtgctcgtgtgcagttttgtttccttctgcacaaagtatcctatcatatgcatccctagtgttatattttttgcctctgtgatggggaaaaaatctccttagaataatttttgcaaattattttatttaaaatgtgtagacttactgagttttgatcactatttttgcagccaggagtaggatcaccatcaggaagaattctgacacatatgccataattgagcaaagaaacatgtgaattatgtattggccagaaataatgaaaactgcgtgacatgaaatacaaaaatcctatataaattaatcttagagtgcacctgacaattctttttcttttttctttctttctttcttttttttttttgaaacagagtctcgctcttgttgcccaggccggagtgctgtggtgcgatcttggctcactgcctgcaacctccgcctcccgggttcaagcaattctcctgcctcagcctcctgagtagctgggattacagtcatatgccaccatgcccggctaatttttgtatttttagtcgagacagggtctcaccatgttggccaggctggtcttgaactccctacctcaggtgatccacctgcctcggcctcccaaagtgctgggattacaggcgtgagccaccgcacacagccgacaattctaatattatgccgagcttgttttctgtcacttctcttcttggaactgtgtttattgaccaagttctgtgagtgacacaggaaagtcttcctgcctcttgccccacccaccgctcagaaattacatctgccaagctattccacaccttgtctttctggtagaagtcaaaattccatttcctctagcagaaaaccacaggagtggtttccttgtagcaatatggtgctgttgggtgcaaaatatcagttatggtcaacagatcccacttttttcccatttgtatgaaaacaaggatattcagtaacccatttattaaactctaatgtggtagaagcactatggcaattattcttctgtaatggaaaaaaaccattaaactgatattgagaaatgtggtttctagtccacttataccactgtctaactgtgtgactgagtcagttatttaacctctgtggacttccatttcctctctgtaaaatgagagaagtgactgacattgggtagttttctaaggctcctttcaaccataagagaaaactgggaagtctaagtagctcaatagattgcttttttctgaagatggagggaagattggaaaattcagcctttactagaataaatggttaacatacaatttttttcaacaagtttatttaatgtcagcttttaatttcttttatttatttattttttctgagacagagtctcactctgatgccctggctggagtgccgtggtgagatcacagctcactacagcctccgcttcccaagttcaagagactcttgtgcctcagcctcccgagtagctgggattacaggcacccaccaccacgtctggctaattttttggattttgggtagagacaaggtttcaccatgttgcccaggctggtctcgaactcctgaactcaagggatccacccacctcagcctcccaaagtgctgagataacagccatgagccactgcacctgcctcttaatttctaattgaaataaaagtgtaaatttttccatttttacttccccaaagaagaagaaaattccttttgaggaaatgaaaatgtttattaatgggccccagatatatctatcaatattcctttttgatccaaaagatgtaactttttattatgggcttctattacatcaatagttgggatactgtattggaaaccatttagttttaggaacaaaagggtaaatattaacctatatggtgttattctcaagaaacttggtttagatttactcaaaacacttaaggacagcagccatcagttaaagaaagcactatgttgagaacagaaatgtcagcacaataccattggtgatttgccatttataggtggttttatctgttcaacccaaggttttggtgtaaaagttcactatatttttagaggtatttaaataatgcaagcttgtgatgtgaaattctttaaagagaatggtggatggataacctctgtaacactggtttcaagggtttattaaatccccatagatgaagtgcaaaacaaacttctccatagaggagttgttgcaaagttccagtttataccaaacagtaatcagattccattggaagctaaagattttgagagccttttgtactatatgcaactaacttgatttcaagcttgggaaccttttaaaaaaaacattaaaagcaaaatgtaagtatataaggaataccaaatcaaatttatagactaatctttttctattaagtattttaagagtctttttcttctttataggaaaaatgctttctgaaagcagctcctttttgaagggtgtgatgcttggaagcattttctgtgctttgatcactatgctaggacacattaggattggtcatggaaatagaatgcaccaccatgagcatcatcacctacaagctcctaacaaagaagatatcttgaaaatttcagaggatgagcgcatggagctcagtaagagctttcgagtatactgtattatccttgtaaaacccaaagatgtgagtctttgggctgcagtaaaggagacttggaccaaacactgtgacaaagcagagttcttcagttctgaaaatgttaaagtgtttgagtcaattaatatggacacaaatgacatgtggttaatgatgagaaaagcttacaaatacgcctttgataagtatagagaccaatacaactggttcttccttgcacgccccactacgtttgctatcattgaaaacctaaagtattttttgttaaaaaaggatccatcacagcctttctatctaggccacactataaaatctggagaccttgaatatgtgggtatggaaggaggaattgtcttaagtgtagaatcaatgaaaagacttaacagccttctcaatatcccagaaaagtgtcctgaacagggagggatgatttggaagatatctgaagataaacagctagcagtttgcctgaaatatgctggagtatttgcagaaaatgcagaagatgctgatggaaaagatgtatttaataccaaatctgttgggctttctattaaagaggcaatgacttatcaccccaaccaggtagtagaaggctgttgttcagatatggctgttacttttaatggactgactccaaatcagatgcatgtgatgatgtatggggtataccgccttagggcatttgggcatattttcaatgatgcattggttttcttacctccaaatggttctgacaatgactgagaagtggtagaaaagcgtgaatatgatctttgtataggacgtgtgttgtcattatttgtagtagtaactacatatccaatacagctgtatgtttctttttcttttctaatttggtggcactggtataaccacacattaaagtcagtagtacatttttaaatgagggtggtttttttctttaaaacacatgaacattgtaaatgtgttggaaagaagtgttttaagaataataattttgcaaataaactattaataaatattatatgtgataaattctaaattatgaacattagaaatctgtggggcacatatttttgctgattggttaaaaaattttaacaggtctttagcgttctaagatatgcaaatgatatctctagttgtgaatttgtgattaaagtaaaactttt

SEQ ID NO: 38520 - DNA, 71330 bp, Homo sapiens
aaacgggatattcagcagtggcctgtggctgccagagcagctcctcaggggaaactaagcgtcgagtcagacggcaccataatcgcctttaaaagtgcctccgccctgccggccgcgtatcccccggctacctgggccgccccgcggcggtgcgcgcgtgagagggagcgcgcgggcagccgagcgccggtgtgagccagcgctgctgccagtgtgagcggcggtgtgagcgcggtgggtgcggaggggcgtgtgtgccggcgcgcgcgccgtggggtgcaaaccccgagcgtctacgctgccatgaggggcgcgaacgcctgggcgccactctgcctgctgctggctgccgccacccagctctcgcggcagcagtccccagagaggtaacgcgacccctgcccgggctccctttctctcctttcccttcctccacccctgcagcctcgcctgctgctttactcaacccgcttcggcgcgcctgggtgacccagcgctcgaccctgcgctcccgcgcggtgcaggcgtccgccaccctcgggtaggctaagcccgggacttcgggacccatccttgctcgcggggctccctcctgggtccccagcccggcctgccggatggccctgcagctggcttggccaccacgtggcggggcttaatctgacttgtgtctcccctctcctcgtgtctatggggccagagggaagcactggggcccaaatatgtggattttggtttaccgctgttttttttccttccccgagaggctttgcccagagacgtaaactagggaacaaccctagcggcgcggcgcctagggagccgctccggaaagttaactcttcgccaacctctggaaggccccaggagctgggctgtgggacctgcccggtggccaactttggcatcacctcttcagcctccatcaacatcagcctccctttcgatgggaagctctgccaatggcgagtgattttcagaaagggggaggagaactgggcatctctccaaatatgggaacgacaaactttttttatattaaccaattgcttgcctgtctttctttaaaaccatgcttctcattcagcctggctcttaccttctctcccactcccccagttaaattgatgtatttaccattttcctacaagactttgccacaatgccgaggacttgattatacatatatataatcttgtgttattatgatggagacagatggcgctggactgaatgctttgtcaggctataatttaaatattctaggagctagcaaattttcagatcccttatatggtgcaagcattgattaatcaacattaacttttatttatattaataggctacacctttctgaaggtaacatcagattgttagaccatgtttcaaattacattatcttttcttcttttatgttcccagacctgttttcacatgtggtggcattcttactggagagtctggatttattggcagtgaaggttttcctggagtgtaccctccaaatagcaaatgtacttggaaaatcacagtaagcattttttaaaaaggtattctcctggaagtgggtgttggcaacagtgtgaggctgctgcctttttcctctggtgttaggatttgagtaagaggcaaatgcctgaaatagtgaaatgttggatttaccccaactattgggaagatttttattaatataatagatctagtcgtgtcctgcattagtgattacaaagggcacaagataatgcttgaaggaataaattctcagagcagatgtgtttctgaaagcccagtgtgactcagttgagttttatagattcataattaaagctgttttcagtcaaaggcctgttgtaatgaccttcataagttttttgttgctcgtgccttcataaattcccagtgggaaatggaagatcaaagatagtgctttgactactctatgctcattaggaaaggaaaaagaaaaaaaataaaaaaagcccacttaatgttcctgggttgaaaccacctctaaaggcagtctaagaatagagaatgggggggtgggaatctaaatagcagccaagggccaataaaaagtccatgctgattagtaataacatagattatgctgagtcaagataagctggatttagagacagccatatattttttaactgatttagagtcaactagagtgagtcatctttccagtcagcatagcattgactgttaccttcttcactttttcgttgttgggaagttgtttagtaattgaatacgttggttcactgagagcttctttcagtcagattgtgccactggaggacttagattttttaaaaagtagcccccactgaatgtgtaaactagcagttactgtgtgccaggcatttaccatgccaagtagttagcaagtataatcacccagaatcctcaaaacaactgtatgagaaagtatctattatcatccctattttatagatggggaagctgaggcctgaaacaattatagaaattgacttgatcagacagtcgggaagcccaactttatgtaaaagtaaaacctactttgcaataaggtattcccactgaggtcattttgcaggcagatatgagaggtccccttccataatataaaactcagctcttacatgccttgacggcctcttgtaaaatgccaaccatgtcacaaactggtacagatttcattatgttattatagcacatgtggccaggaaagaagtcatagaaaataagtttgaaatactattaacataaatgtcaaataagtctctgaaacaaaaataaaagcagcttgattttcatgtcgtgattgtgttttaaatgtaattaaatggccataagttttaaacgaccctagaaaatcaatggctcagaggcgtcatgtgcccaagtagaaattcatggttggccatgtgttctgagtattgcggacaggttgatgtgactttacactttgactggggttggggggcacgtccagtgaaagctttccttgataaaggaacggtttgcctcaggagaggcatgatttcctgtgtgggagtggggaagttaaatggatgctccatctggatgtcctgtgaagggaaagcctgtgagctcagcagtcacttccctggattcaaattccagtttcaccgccataaactgtgtgtccaggatctacctcctttaaaccttaggattactgtgaagacaaaatgagatagtgtaaaatgcttcaactcagtgcctgagtgggaagaagcttgatttgtctgaagaacaaattaaggaggttggagtggctggaatggaatgagcaaggggacagtgggaagagaagcgaagaaggtaaacaggactctgtaggccacggtggagagtttgaattttgttttgagtaggagtcactggaagatcttaagcagaggaatgagcttatctggtgtctgcgtggaagatgaactgtagggagttaagagtagaggcagagagaccaattaggaagctgttgtggtatccaggagagggaagatggtggagtagacaaggtggtagcagagaagatgaagaaatgcggagtcttctgcccacagtgttttctcagcagctctgcctgcggttaggatatagtggcaccagctagaaggatacatgcaccaggctctgtctccctgcttagccattccagacaggactgtgctctactatggccttgtccaaggccatctattaaaggtttttcccacgctggttggtccagcccatttttctgttcctgcagtcagtaaaccaagaatagtgttcccattgagtgattcagtatcacttttattaaaatatcacagaggccgctggagatgggaaagcctcagagtggtccttaaactgtagttcctgtagctggggggaaatatcttgctttcactcactggcctcccattctgttcgtccaaactggagatgtgtcccagcatggtagctttcaccgctaaatggttttcattaaactctatcatatcaatgcaagaatgggaaatgtctgattttaacttttgctttaagaaaggtgaatcctagttgttaccaccaaacttccagtccttcgtgttggactttctgatgcgaaagtacagcctgcagattggaaatttagatgtgtccttacattatagtactttaaaatttttatagcaatttcttagacagctgcattgttccaacacactgtattggctatttaaatgtaaattaagttaaacatttagtttcttagtcatactagccacattcaagtgctcaatagccacatgtggatagtggctgccttactggacaatatgtaatatagtatttctgtcatcacaatttttcttgtggacagtgctgtgctattaatagaaaaattttatgcttaattttactcacgtaaaatgttgaggacagaggtgctctgtgctgcttagttgtacttctgctttgcaaatagggaagctgctactggttctttgtagttgttggagctgtaactggaactcaagactcttgactcagctttatcaccaagagttgatggccttaacaggtcttaggttttttacttttactgtatgtgttctcaaaaatgtatgcttagagactaaattagagaatttgggtgttaagaaatagttgaatattttgtaatccatgatggggttgagagtttcttagtttactgtaggagttgattctggggactataacctaaaaggcatctgcataaaatcccctaattctcaaatacggggacgtgggtatgagttaaatgtgatttgacagctaaggtatatataatcctttggaaagtagtgactggtcttctaagcaggcttggaagaacaatagggttggggtgaggcataagtcaccctaatttatttaagaaccagaaccaataactcccacctgtattaagccctgcagcaagaaatgaaactccaaaagttgacatcccaccacctggacccctctattacagtggttcttctgcagtttgagattgtatgcaggagacaacagtaaaaaatctctgagatccataaaagaagtaggggagagtggaccactgtgaacaaaaacacagctggtgtgatgtatttcactgcaacataggcaggacacatttagaagagcccatgaagcatggtgctgggtgcaggagacacataggcgaatttagaggtgataaacacatggggagctacctgctaggatgtgttcccaaggccctgagtgggaagtgagacaaagcccaccaggcatcttacgttctgtgctccacaggcacccctggcataaagatcaccattccgttaatagcttcattataaattcattgcaaactcggcaaatcatcaatacctctgttccttgatattttcattcataacttgttcattttataattcccataatggaattagagatacatattgatgattcgacacaaatatgtgttttttttttttttaaagaaaagtagacatacgttgggaggctgaggcaggtggatcacctgaggtaaggagttcaagaccagcctggccaacgtggtgaaaccctgtctctactaaaaacacaaaaattagctgggtgtggtggtgggcgcctgtaatcccagctactcggaggctgaggcagaggaatcacttgagcctgggaggcagaggttgcagtgagccgagatcatgccattgcactccagcctgggcaacaagagcgagactccatttcaaaaaaaaagaaaaagacattaatagcaaaaataagaccttgtgaaagcaactctatttagagtttgactttggctgcatatggtatgggtggctgagtgaaaccagctgaagctttgtttatagtaactgcaaaccagaggaaacttaaagcctagaatcttctgggaactctccttgaacaggtatataggaatttttgtttaaaattggtttcctttttttttttttttttttttgagacggagtctcgctctgttgcctaggctggagtgcagtggcgcaatctcgctcactgcaagctccgcctcccaggttcatgccattctcctgcctcagcctcccaagtagctgggactacaggcgcccaccactatgcccagctaattttttgtatttttagtagagatggggtttcaccatcttagccaggatggtctcgatctcctgacctcgtgatccacccgcctcggcctcccaaagtgctgggattacaggcgtgagctactgcgccctgcctaaaattggtttccaaacttaaaaccaaatatcacatctgaatgtctaatgcaactgctgttatgttatctaactgaaacagcaattgttatgcagagatcgctggaattgattctgttcttagatttaaaactgggcataatttacaaatctgtttttaaaaggcgatgatctggccaggtgcagtggctcatgcctgtaatcccagcactttggaaggcagaggcagaaggatcgcttgagcctaggagttcaaggctcctggagtgagctgtgattacaccgttgcactccaggctgggcgacagagtgagacctcttctctaaagtataataataatgataaacaaacataaaatgaggcaatccatgtatgtggtcctattgttaaaaatcattaggtttttattatttataatttaaaagtactgaaattagccaattatttaaggtttcagttattctcagcataaatctagcctgagaaaaatcagcaaacatagagcaaaaatttagtcttggggtccacctagaatacaactttttatccctttatgaagaaaatatgggagaggccaggcctggtggctcacacctgtaatcccaatactttgggaggccgaggaggaagatcgcttgcagcaaggtgttcaagatcagagttcaagatcagcctgaacaacgtaaagagaccctgtctctgcaatttttttttttttaaattagccaggagtggttgtatgcatctgtagtcctcgctacttgggtggctgagatgagaggatctcttgagcccaggagtcagagggtgcagtgagctatgattgtgccactgcactccagcctgggtgacagagcaagaccctgtctgatgatgatgatgatgacgacgatgatgatgatgtgggagggccagagagtcacagacctttgacagaaatgggaggagaatgtggcaatgggtagaggcagtcccattaaagtgaaaagtatgtggcaaaatttttcttatttagctactccatgaagaaaaaagcgtaagttgtcttacatagaaagatcttcagattctccaggtaactcaagtattaccatctttataattacatctgtttttctgttcagctagagtgaaatacagtcacatatcccgtaacaatatttcagtcaatgactaccacatatatgacagtggtgccataagattatattaccatatttttattgtaccttttctgtgtttagatacacaaatatttaccattgttttacatttgcctacagtgttcagtacaggaacatgctgtacagtgtcgtagcctaggagcaataggctatactatatagcctaggtgtgtggtggattatacaatctaggtttgtataaatgcactctgtgatatttgcacaacagtcacctaatgatgcatttttcagaatatatctccatcattaaacaatgcatgactgtatacttgtgatagaaatcatggaactaaaaataataatagtatatatagtttttggtataccttcaaatatattgaattattttatttgcatctgattctctggggttggggtgacagaccttagtatgaccatttcataaatggggaaattgaagtctaaagaacttgtgtcttaactaatgtcatacttgtaaatggtatacaaagggtagcacacaactttctgactcagggataccattatactctcatgcacttatttatcaaatattcaccaagagtttttgagcacttcctgtgtagtaggcattgcactggactgtgggggtagaaagacaaggcataatttctgtcctcagggagtttataatcttgtggggagcagttagacaagagaattggtaacagttatgtgtgtaaattattataatgcccactgtaagcagttttaagtgttgataatttggagtaaagcttattttcacttttaaaaattattgaagatcttaagattagttaagataaaaataattattgcttcgtgcaaagagtatgacccgttttacttgtgtgctactctaagactggataagttgttactgtatcctttgtaaggatttgtttgacttcccagggttattttacatgtgccttgatatttccaaagatgcctaataaacaattacgtgaagccattcctgtaacattgccttgagggcaattttataacttacatatgttaaagtcatcatacttaatccatcctccagatgcctgatcaattttaaatggcattcctatttagttgaaggaactagtagattaaaaatgtgattgggatttatgtcttcccgataacttttatatggcttcatgagaagaaagtcagcagtggtgagcaaagggtttgtgaaaattgagacatagtgatagtctagtaagatcagtgctgggtgtataatttgagaaaacaaatagtgaatttaggcaggaactcaactttgaagtcacttaattatacctaagggtatggcaaggggttctaaaattactgtaactattatttgcctggtataaccacagcaggacagataggggaatggaattttgactttaaacacatatttcttggctttaaactgcacgtaggatttagaattatatagagacttaaatttcaatcttaactgtgggctttttttttttttaatgtatatgtatacattggttgcactaggctcattatttcagttgcctgaatagtaatttaacccaatgcttgagttagtattatttttatgtaagaatagtaaaaatgagtataactaacagaaaatgtttgcatatccaaggctatatgaatgggataagagcaccatagcttggttttttttgggggggtggggttgtttattttttaatccagaaagtataatttggaaactttacaattcctttttttttttttttttttttgagatggagtctcgctctgtcgcccaggctggagtgcagtggcatgatctcggctcactgcaagctctgcctcctgggttcacactattctcttgcctcagcctccccagtagctgggactacaggcgcccccccaccacgcctgcctaattttttgtattttttagtagaggcggggtttcaccgtgttagccaggatggtctcgatctcctgacctcgtgatccgccctcctcggcctcccaaagtgccgggattataggcgtgagccaccgtgcccggccaaaactttacaattcttatggcacataagctgttcaattagatgtcagttattaagatagcagaaaaattaaaaagttttcattattgccttaaatttttctgggaagcagggcaaatataaatcctaaataaataagcaagcactgtaggtgacattttcccactggggcctcagtccagtttttctaaatttgtttagctttctgcctgcttttgaaggcttctgttgcttgtttttgttttctttttctttgctctttcacacggaaatcaagtgtttttattgattgaaaactttatgttttataaatatacttatttgtactgcttgtatttttagtgctgtgttcaagcagatgtcttagaagaggtttaatgagtagaaaagaaaatgagcaaacatgaaaatgaagtcttcatgtattttttttttctgaaagggattctctttaataacatattcataccaaacaaaaatcattctttcctgaaacatcactataaaaatagaacataaagataacactttttttaaagtagtgtaaatcaagaaggcatttagtataattaaaacactcagaaaggatttttaagattatttaaaagacagattaaattacttttatatcccttgaccacctccagagttaaatttatgatgtgaaattatggcaaataagaattgtaccataaatttgaaaatgccttaaaatctctcaggttttgacagtaaaaaagggaacagtctcatttattggttgcttaatgctgaagaccagagaaacatttaaagggctcctaattctaagaagttctttcgggttttttttttttgagacaaagtctcacttttcacccagtctggagtgcagtggcgtgatctcagctcactgcagcctccgcttcctggattcaagagattctcctgcctcagccacccagtagctgggactagaggcacccaccatcacgcctggataatttttgtatttttagtagagatagggttttgtcatgttgactgatctcaaactcctgacctcaagtcagtcggcccgccttggtctcccaaagtgggatttcttttcccacattgctctgcttagagtcaggagagtgcttttgtgtgctgtcgctttcccatgtttcttgtacgtagaaatgttagtgtatggattgttcttcaatcttacgaaaactgtaatccccactctcaacttagacagttgcaccttatgagttaacagctttatcaacggtggcaatagcactttgagggactcttgagtttcttagtctaggaactttggagaaaataagtgtttttctcagatacattatttggtcgatcacgagagtcagtatggcaagtctttaagaaacaaatataaacatcccgaaataaatggaacacccacagagaagtggggagttggaattataactgcccaaagcacaagccctgccactaaatatcacctctcttttaccacctcacccccaagctgctcctgagtactgcatataataaaatagtgttttcaaaaatgtgaagggagggagagaccatttaatcaaagatgggctgttacatggaccagactgtcaagaagaaaagcacagggaacccaggggcaattttactcctgctaaatgctcctggaaatgaatgataagggtttgattgctagacacagaccttctgaaatccctgggctacagttgagctcctccaaataaattgtcattcattcattcattaaaactgtaaagtacctaccagagatcaggtgctggattgggcacagaaacagcaataattgaaaaatcacattcctgaatggggctgggcgaggtaaggaggctcttactcattggggagatgtcccagaaacaatgaacagtggcacagggtgacagggaccatggttcagggtagtacgtgtgatactgctcagttactagaagaatgggcattggagagtcagactgacatagttcaaatccctgttcagccatttaatttactaggtatgtgattaagtttctgggactttctaaagttagtatcctggatataatggtcaaacatgccttgtaaggttaatctgaagactgaaggaggcagtagatgaaagtcccttagcacagtgcttggcacaagcaggcactcaataaatggtagtgttgctttatttatttattttttaacctcccttccaggtctgtaataaggaatagaagtgtggtgtttgtgcagaacttgtctacaagccaacttgtttcaagctggttggtaatccatttggagcatggggagttcccattggaaatacccattcctactcactatgtcctttcttcatttaaaatatgatctttcataagatcatggactttgtccacagaattgcttccaaaccctccctacttcaaccagccactgcctaccccatcatcaaccaagggcattccataaccgttaagacttttcaaagtagagaaaagattgtcagttaaaaattgcaaataattttctctgtttatagatggagactttaatttacctttggagtcccaaatcatcagaataggccccactaattacataaattaagtaaagactgtattcatttattcctaatagagacacaacatgatatggtggttaagagtgtattttctaagagtgtaatttctggagccagacagcctggttcaaatgctagttccactgttgtgctggtgagtctccaaagatgacctccccaatcaccacacctcctggtattcatgcctttttctggcatcccccagcattgaatctgggcttgcttttggaacaaattggatggagcagaggtgacattgcatgacttctggggcaagaacataagaagctgccatataaggcccaccatgctgtgaggatgcccaacatagccatgtagagaggctttgtggagagagagaggcccagaaagctcctagtagttccagtcttctcagctgaggtgccaaccatgtgagtgaagtcatgttgaagggctagcccagtgagccttcagatgactcaagcccaagctcctaactggtagtaaatgcatgagagaattcaagctagaaccatccagctgagaccagtgacccacagaaccataacaaataagagtacattattattttaagccactaaatttgggggtggtttgttgtgcagcaggagattactgtaacaattacgagctgtatgactttgggcttgctacttaacctccctgtgcctcagtttcctcatctataaaatgtggataatgatactccctacctcataggattgctttgggactgaaattactgtgtgtacagcattaagaacagtgcctagcaaatggtaaatactcaaaaaatattatttcttcatgaaatattatacttattgaacacttatgtgccatggcctgtttcacatcctgggcacacagtgagaaggtccctgcactaatggtgcttacattctagaagcaggagagaaaccacaaaataggatggtgatgtaagaatgacactgatgaggtgacatttgagtggaaacctagatgatgcaaagagtctacccactgatggttcttggagaaactgaggtcaccactcctttgggtgcaatgatttattatgtggcagcagacagtatctctgaggcttcttgcccatcataagtaaagcacaaaatgtctcctggatgtttatgaatggaaaggccttgctcatggattaaggttagttcctgtggtgagggtggtaggtttggtttgcttctttatgtttggtttctttggtttttgacttttgagagatgctttggggatgtgaagcggggaggagggagctgaagggtctgtttttatgagtaatgttgccttgggttctgggtgccagaactctgcactgtggtgcagagttgggaggaaactgttttcatcatctccattcacaactctctgcaacctttgttgtggggaatcttaagaacatcaagaaggagcacccttggaatagacagagatttcctcttcatcggtctgttcagagtacttccatcagcaaggacatttcatttatacattcatctgttgattgacacttgggtgtgcttctaccttttggctattttgagtattttgaaccatgcagtgctttcacttcctttgcattttgtagtcaggagtggaactgctggatcatgtgataatttaggttttgaggaatcgccaaactgttttccagaagtaaaagagaaaaaacctggtgaacactgttaccaggaagccagactgctttctaggccaatgtagatgtcgcctggagttgctcccaaacaactggcattttgaagaggatgctggcacagtcatcagctgctgggagcttgagccattgcgctttagtggttacaacttacgccttgtttaaagatacgtgtatttgtggttaaaatattttttaaacaaggggatcattaggagccaggcagctactccaggagatgcccaatatgcttgtttttgttatgatattataattttaatgaacttattttatgccccataaatcttagatatatgaaaatttgttcctataaatcttagcaatgcatatatcattttattattccctatcaatctcaactacatacatctgcaaataaaactgtatttcttagaagtaacagaattatgaagtcagaagggaattatcagacagtcttcctaactacctctgtgtaccctagtacacacctgatgtccacttcctctgtgttcccatagcattcggggacatctttattatagcacttatcaccctgtattataatcatgtttattaatctgccttccctactaaactataaatctcttaaggccaaggcctttttcctggtagctaacatagtggttgacacatacagtagtaggtgagtgaaagaatgaattgattaatcaattcatagctccatccacctgcttctgggcagaacagcatagaaatgataaatctccgaagaaaagtatcaacttgtttccaaagatttctggtaaaaggagatgtattagttcattttcacactgctataaaaaactacctgagactgggtaatttataaagaaaagagttttaattgactcacggtttttcatggctgggaaggtgtcaggaaacttacaatcatggtggaaggtgaaggggaaacaaggcacgtcttacatcgtgcagagagtgaggggggtgtgccacatttaaaaccatcagctcggccaggtgcggtggctcacgcctttaatcccaacactttgggaggccaaggcaggcggatcacaaagtcggaagatcaagaccatcctggctaacatggtgaaaccccatctctactaaaaatacaaaaattagctgggtgtggtggcgtgtgcctgtagtcccaactactcaagaggctgaggcaggagaattgcttgaacccgggaggtggaggttgcagtgagccaagattgcgccactgcactccagcctggcaacagagtgagactctgtctcaaataaaataaaataaaaccaaactatcagctctcatgagaactcattcactttcatgagaacagcatgggggaaccgcccccatgatccagtcacctcccaccaggctcctcctgcaacatgtaaggattacaatttgagatgagatttgggtggggacccagagccagaccatattaggagacttctaagtttttgtactctgtagaattctacatttgaaaaagatgttctcttcctgtgtcctcccctgctatgtctctagttgcgttccaccccccgagtgtgtcattatctctcaccatatgattctcttgagtgactatcagtcagtcagtgtaccaacatcggtgacatgaacaaagcagcaggctgtttgggtttattgttggtttctgaatactcactttccagtataggtgaacattccagatacatcattaactgaagctcctatgtgctttctctgtttacattccgctagtcagttgaaatataaatatgtattatgcttcttgtagatgaaagagtataatgctgcaattttagtgttaactttgttaattatatgtgtaaaatcattttgggttgaacttgcaaatcatcaaataaggaaatagattaacagttaatgtgaattaagagagtatattatataggtagttaactttaaaaaatttttttcttttttttttttttttgagatggagtttcactctagttgcccgggctggagtgcaatggtgcgatcttgtctcactgcaacctctgcctcccgggttcaagtgattttcctgcctcagcctcctgaatagctgggattacaggcacctgccaccacacttggctaattttttatttttagtagagacggggtttcaccatgttggccgagctggtcttgaactcctgacctcagggtgatcccgctgcctcagcctcccaaagtgcttggataacaggtgtgagccactgcgcccagccaacattttcttttagagtcaacatgtgcttatgaaaatgtaagtaatataaggttgaatgatagagatgagattatatcataattctaacatttatagaattgaatattgaactaacatttataacattaaataaaatcacctttggtatgtatttaagttttcagtatttctttccgtttagaccataaatcttttgggggaaaataaaagcactttttttggggaaattctttatatattctgaggatgaattaatagtaaatcttatccttttgatgatgatacttggctctggctaaattgtgattttcacacttgcccaagatatgtattcagtcaccctggagtaaatatgagggaaacgggcattgtcactttgtgatgtggagccatgtaacaggaggcaagattttttttcccttaggggttatttggtgagctatatgaggacagaaggtggaacacctgttatggatgcaacaaggaaggatgttggaatggggatcaatgagattattttattcgatttatacaacaaatatttacttatcatggactgttctaggcacgtgggatattatcagtgagccaaacagagactcttgcccttgagaagctttacatgcctgggatgttctaggagcagcaaagaggcctatgggatgaacaagcaggaggttgtagaagctgaggttgttgaggaggaagtggggtagatcctgaagagcccagtgggccattgtgagtgaaatggaaagcctatcagtaagggcccccgtagaaaatagcgcagtcaaaatacagtgattcaaggggggttatttacaaagggactatccaggaagagtaggcaagctacaaaggatagtacagtaacacagagaaagtggcagacaggctgtcactgcttctagtccccaaaggaggtgtggagggtgttggtactagaagccaggagtcagcacaaggtgacctcacagagaaagagacaggaaagtaaatgccctgactggactctcctccctgttttcagtatcctgtaggggcttcccgtggccaaaagcaactggaagacaattgttgatgcattcatttaggtcaaccacccaagaagagtagggtgaagatgggaggagagtggatctggaggggcaaatggacaatgtttggcacagggaggctgtatcagggttctccagaagtagaaccaataggagatgtagatatataaatgtttatgtatatgtatataaaaatatgtatgtatatattaatacaagtacatatgtgtattgaatatctatacacacagctatatacacatataaagagctttatttcaaggaattcgtttatgtgattgtgggattagggagcagccagtctgaaatttgtagtgcaagtcagcaggctgaaaacttccagtgagaagataccgctgtagtcttgagacagaatttcttcttcctcagggaaacctcagttttgttcttaaggccttccaactgattggatgagggccacccacattatcgaggataatctcttaaggtgaactgattgtacatgttaaccacatctacaaaacaccttcacagcaacacctagattactgttgattgaataagcacttcctatagtctagccaagttgacccataaaatgaaaccatctaagagccacagccactcaaacacactgcaggattttaagcagaggagtgccataaggtgtctgtgatttaaaaggatcaccctgaatactgtgctgagaacagatcatagggtgcaagaatggaagaagggagagcagctgggagccttttgttgtaattcagatgagagataatgagggcttgggccagcatgggaaccatggaggtggtaagggaatgggccgttttctggatatattttaaaatagagccaataaaaattattaatggacaagacgaggggtgtaagagaaaaaagaggagtcaagaatgacctcagagcaaactggaaggatgaagatgcaatcaactgtacagggaagacagaggtggagcggctttggcagcggaggccaggggtctgtctttgacatgttaagctcagctatacattagaccccaggtgatgatgtcacagcagattgctgttccaaatatgactttaccatcagggagaacagggagcaggtaacagtttgcttcttggaccagtactttaggatgtaacaaaaattggaaacatcaaatggcagctggtgtgagtccatgtctttaaagcatgcagttcaaggagctgggtagctgtatccaactatgtgtaggtgtgctcgctgctgaagataaagctgctcatgacttaggttttgagaagaagaacagtatatagtaaaaaaaaaaaaaaaaaaaattgcctcattcactgataatggcaataaagacacttactctgtttcaaatggcttgctctggtgtatcacaggaataaatcctgtttctttcctagcctgagcctattattccgaaccaaaatgccacaattttacattgaaaataaggcgtcagaatctgttgaggttgaactgtggtcaaagggcttggttgctgagagtttggagtcttcctaacgcttgatgtttttcttcactcttcagagaaatcagtaatttattattgcacaaaaccctacccagatgctgcagcaaaacatgaaaaatactttctagagctaagtgctgtccgagatagaatcagggacacgttcattgcttttgcccaaatttaaacagtccactttttagatctcgagtgtgatctatccgtcaacctaacattttacataatagtggagtttgtaatgaagaatcactctgttgcttctgggtcctaatttgatttgactatccagaaccatctgatgaagctagcaagcacttgctgccaccgttgacagcctgttattttgagttaggatcttctaacttatagagacagagaacgaaaaagtgactgcctttgtgataattacctaacagattgacatatgttaaaattatccctcattcatgtgaaagtagtattaattttaagatagcatggtaaattttaattttttaaaaacaggcctactattgatggtgttgacaaaaagagtaaatctctgtaaaatatttgaagagatttattctgaaccaaataggactatgacccatgccacaggcccaggaggccctgagaacatgtgccccagttggttgggccacagcttggttttatgcattttagggagacataaggcatcaatcattacatgtaaggtgtacattggttcggtccagaaaggcgggaaaacttgaagtgtgggggcttctaggccatatgtggattcaaagatttttctgtttggcagttggctgaaagagttaaattagtatctaaagacctggaatcaatagaaagaagtgtctgattaagataaagggttgtggagaccaaggtttttattatgcagttgaagtctccagataacaggcttcagagaggatagactgtgttttttatcagatttcaaaaggtgccagactcttaattctctcctggatcagggagaagatctggaaagggaaggagattttctacagaatgtagattttcccccaacagacagctttgcaaggccatttcaaaatatatgaaagaaatatattttggggtaaaatactttgatttctttccggacctgttatctgtcatgttgatatcttattgctacaaagagtctgttttgtcagtcttaaggtctctgttttttttggtttttttttttgagacagagtctcactctgtcgcccaggctggagcgtagtggcgcgatctcggctcactgcaagctccacctcccgggttcacaccgttctcctgcctcagcctcccgagtagctgggactacaggcgcccgccaccacgcccggctaattttttgtatttttagtagagatggggtttcaccgtgttagccagtatggtctcgatctcctgacctcgtgatccacctgcctcagcctcccaaagtgctgggattacaggcgtgagccaccgcacccggccaaggtctctgttttaatattaatgctggtcacctgtgcctggattccaaagggaggagggtataatgaggcatgtctgacccccattatatataaagttttggtgccgcaaaagaaatagcattcgaatataaaattttcatttaattctcagcaaggcaagttacttctattgaatagtgcgcccttacagatggagcaatggtgagcacacacttgacaagggaggggaaggggttcttatccctgacgcacgtggcccctgctgctgtgtcgttcgttcccttgttggctagggttagaccgcacaggctaaactaattctgatctgctaatttaaagagagtgacggtgtgagtgctttggcaggggaaaaaaatggttatgcaaggtggagaatgagtcagggcggagcaggtagcaggtaatctgaatgagttagggtgaagcaggtgatcagaatgagtcagggtggagcaggtgatcagaatgagtcagggtggagcaggtaatcccaaaaggttgctttacgaggaagttaagtttaaaagtagaaggtaaagaattgaacatactgatatattgattctttgaagagaaatttagaatttatatctaacaccccttgccatcatggctgaactagtttttcaggttagctttggaatgcccttggccaagacgaggggtccattcagttggttggggggcttagaattttgtttttggtttacaatggactgtgtatattactattaagtggtccttggaggccaaaagtttgagaaacactgtcctagacagtgctctccttgagagcagaagccacagttacctttatcctttccttagagccctgcacgtcgtgacctgacacatagtaggtatttaacaaatatttgattattttaaaaattgaatggcctttatgggagaaacaaaagaattatcattgtttcctcctgttccttgccttatcctcaagtaacatgtttatttgggaagagtttataaccatttcatttctgagttttacattctgcttcagttttctcagacatctcagatacttttctgagctgaaaccaagacgaagtcacagtcctccacaattctgccctagctcctttggaaagctaccaaactaatcactgatatttctaatttatttatatatataggtatctgctttactatatgagaaactgccagaccagtttccaaaggggttaaccattttgcactcccattggcagtggttagaagttctgtttgccccaccttctgatatttggtatcatcagtctttctagttttagctgttctggtgggcaaaattctagtcatatcacgttgtgattttagttgtcatttccctgatggctaataagattgaactcttttttcatgtgcatattggtctttgtgaagtgtacattaagtcttatgtccatgttttttattggattgtcttttatcatgaagttgtaattctttattccgaatacaaggttgtcaggtacatgtattgcaaattttttttccatctgtggtttatctactcattaacagttacttttgatgagcagaaattaaaacacttgaaatccaatttagtagtttttaactcttgcagttactactttcttgctacccaagattgcaaagatattcttctgatatggctgtcttgtctggggaaacacccagggtcctttatctcgcaccaagaaaattagcaacatggacacactcgtggagtggattaaggagcagagagtttaataggcaagaaagaagagaacagctccctctacagagggaggtctaactgccacatatggtggaaaacagtcagttatactgggaggctcgaggaggcggtgtctgatttgcatagggcccaggggattggtttgaccaggcgtgtcattcacatagcccttgaaaaaactggccctcccaccctaaccttttattatgcaaatgtggcttctacctggctggttgccatgatacctgtacacatggcttctacctgtctggccacaatgttacctgcacacgcggcaacaaagaaaagggagtgggaactgccctgttgcgtggacctggttcttagctgcctgcatttacatatgcaagcctgcttgcttgtcaatgcttgcaggtctggtttttcaggccattttctgttagaaaagaaatgttttgggggctgcttttttattaaaagaaaaagccttactgaagactcttttacccattctagctgcctaaaataatttcttaataactcctgtaatatatctgtgttttttgtagaagcttataattttagcttttacatttatgtctgtgattcatctcaagttaatttatgtatggtgtgagatggggttatgattcatatttttcaacattttttgttgaaaagactgttcttgtacccattatattagtcaagatactccagagaaacagtcaaaatattttatttatttattattgattgattgattatgggaattggctcatgcaattatagaggctgagaagtcccaccatctgctttctgcaagctggtgaaccaggaaaactggtggtgtaaatcagtccaagttcagagacctgagaaccaggagggcctctgcgtaagtcctggagtcctaaggcctgagagccaggagttctgatatccgagggcaggagaaaatggatgtcccagctcaaggaagaagagagagagaatttgcccttcctccacctttttgttctacttgggccctcaacagattggaggacgtgcacccacactgttgagaatggatctgctttactcagtctactgattcaaatgctagtctcttccaggcaaaccctcatacacactcccagaaatcatgttttatcagctaccttgacattccttagcccagtaagttgacacatacaaatcaaccatcacacttattgaagagcattgacacctttgccaaagattatatgtgtgggtctatttctggactctcttctgttccattgatctgtttgcctatccggactatttttctcttgcttacagggagtcttttagacatcgttattatggtgatacttaacaacatattaagtgaactacttttttaaaaagagaaaaataagccttagattaaaagactatatccacatttccttgcttcctatccagtcacacaaattattccaagttctccatacattgattttgttgacatatttatataatgagcctgctgactacataatatctgtatttgtagttatttctaaaacttcttgtgttttaatttttactcttttatattatcctctaaaaagcagtgagaggccctccatccttcacaggatgttgtttctttttatattctgtagaaattatggctgatccagaaattaaagtgagaaaccagtgttcctagccaatgcattcttcaagagatgttgttgtcaactcacttattttgtatggggtaacttcattaaacaagcttgtaaggggttccttgcctctcactcttggcgtaaaatggatgtatgaaaccagattttgcagtgtgactcagatgttcatctttattacaagttaagttttgatgcttttctgtttgtattttaaaagtactttagggttgacaatttaaaaaaaaaacaggcaaaagatttgaatagacatttcactagagaagatgtataaatggtcaataagcacatgaagagatgctcaacatcattggtcattagagaaatgcaatcaaaaccacaataagctactacttcatacccattaggatgactttaacaaaaaaaaaaaacacagagaatagcaagtgttgttgaggatgtaaagaagttgaaactctcatacactgctggtaggaatgtaaaatggtacagccactttggaaaacagtttcttttaaagttaaacatttaccatatgaccaagcagttgtacttttagatgcaggagaaatgaaaatacatccacataaagacttgtacaaagatgtttatggaagcattgttaataatagccaaaagtagatacatttcaaatacccatcaacagggtaaatggataaatatgtggcatattcatacaatggaatattattcagccataaaaggtatgcagtactaattcatgctacatggacctcagagacactatgctaagtgaaagaagccagatgcaatagaccacatactgtttgattccattcatatgaatgtccagaaaaggcaagtctatagagacaggaagtagatcagtgcttgcttgaggctgtgggtgggaatgagcagtgactgcagatgggcatgagaaatctttttggagtgatggaaatattctgaaattggattgtagtgatggttgcacaactccatacattttctaagaatcgttgaaatgtacactttaaaatgagtgggttattatggtttgtaaatcataccttgataagttgtgttgttttgtttttttaaggaaaaaagtgttttatgattgaaaaactctgacctgaactgggtctgaaatatcaaggaactaccaggaccctggcctgaaacttgtggccaagtgagaaatgataaaagcagaactgctctatatggcattcgaagactctcaattttaagaatcagcttctccttgaattgaaaaaccacagcataagtgcttctcatcaacatcagccatctcttcagacagctgagggctttgaggaaaaggtgcttggtgaaacttgggtattctcattttatgaataaccctaagctttgcagtataccaggtcgccatgcaggaagtaccaggcatgtttgaacgtaattacccccaccctgctataactttcaagccatctgtgccagtttcacgcagtctggactagtaagttctttctgagacgctccccagtcttcttttccttgtctactagtgtcttgtttttatgattttttttttcttaaatgtgtcgtcgtcacagaacatttaatttaaatgccacaccatctgagcaaaatgattcactgtcttttcttctgctgactaaactcttctccaggaatcatgaggtttttcttaaatagcatgctagtttatccacttttgttttgtttttaatttaatttacattttttaaaaagctttgtgtttggtggagtctaagtggaaaagaatttagtttgaaaagaatttataagcaaagttagctaggttgttgggaggcttgggcacacggtgtggaaataatgaaagtgcctcctctgttgatgcacctaaccaccatcccaaggatgtgccctcgggttgttgcttctggcacctctgagcccttcccacaccctcttcctctcttacgcgctatttgaggctacacatttgtgagccatctggctagagtaagacagtcgtctgtggcctcagacgttgttttctcttgtaaaagtttttccatgtcccatctatctgatcaaatgtcctctttcctgagagaactggaccttttgaaatgtttttcccctgaaaccatcattctaactgccttatgatattgcaacattcagctcaaatatcttaacctgacatgttcaaaagcaaacttatgacaccctctgtccctctgccctacttctttctaaagcaaaacaacatcaaacctttctctccttactgcctttgtattgtggatggtacctgcagggcttgaaaccctgaagctatcttcaatgttttttgtttttttgttttttacctgctgtcagacatctggcctctgccacattaagtgaaccaagctttcccatgcaaatgcctgctgtgaaattaaaacaacaatggtgtctttttttttttttttttttttttgcctgccagactgataagtattgataggcatccagcgtaggagaaggtgtgaaaaatgggaactaatacaacttttcttggggtatattctgtaatcatctaaaatgcccaactccttgatttagcaggtccatttctaggaatttgtcctataaaaatattcccttaagcacaagaatatttttataattatgtttataatagcattatttatattaatgaaaatttggaaacatgctaaatttagaaaaatttgagatttcttgtataaatgatggtgcaagtgtacattagaatagtataaagccattacagatggtagtatagctgtctttcagtcctttggagttctctggatatttgataggtgcttaacagatctgggttccattttaaaaatatactcttatacattattttataatgttatacatgacattgtcttctagataacctacaaatacagcatctatcattcttattatgtcctaataaagatcacctcagtggcttctcgtgaaacctgatgaattaagcatttatttatgtatttaagcatttatttcagtatttctcttcccaccaaaattacagtaagggaattgaaaagtttaaactcacaggaaaaatggaattggaacagaattaatagtacatgagagataccaacaagattttggaagataagaaagcagatggtcagtggtgactgaattaacagaagagagagaacgaacactcccctgccagaggagaagggaggtgtcagtaggaaacaagccgatttgtgccacagaattctagaaaggctctggagctggaggcacctggtttcttggaaggcaggagggcagatgaggttagaagttggagttctgtttgaaggcctctgtaagagcggttaaccctacaggttccctcctccacctccagcagcaagggtgctgtctctcttctacctccccaccttctccctccagcctggcagggagtatgctctgggaaccacaggggttctgggcttcagaactgcaagcctagcagaagaggtcaggcccaggtgtggcactgaaaacagggtaattacagtctgtgtactagaatggtgagaccccggccccacctctttccctgctcctccgatgaaagctgcagcaaggtctttacacctcaggcgaggcatggaacaatcttagagaaaatgaacagcccttgagaaaggacctctatccagatactgacatttgggaggcccaaggcaaaagccagctcgtccccatcacactggtgacaagccctgccacagagcttccagtcagcctcacctcagttctgaatgtgaacagccagttggggattactagacatttgaggaaagcctcttacatgaaaaggcagagcccaaaccgagggaaacaaaaactccaaggcaacagaaacagtgcagagcagaagaaaatgtcaaaataataatcattatcgtcctcagggagatgtgaaaagacactgtgcacataaaatcaaagcaggatactaaaaacaaaggaaacaacaagaaaaacactgttggaaatttaaaacttgataatagagataaaaaaattagtatcagggctaaacttgacactcagcaggtagaacaaaataagaggtagagtattgaagagaaaagataagaaaattagagaatcctgtcagggaagtccaagtctgactaacgagagttctaaaaagaaagaacagggaatttggagaggagggagttatcaaagaaataacactcagcacaaatgaatgaagaaagataaacaccaaggtgcatctttgttaaatttactcacaaaaatcctacaactctctgcagaggaggacagtcacatagaaggggaaagaacagcatcagcctattgctggaagctagaaggcagtggagcaaagcctttagcgttctgagaaaaccatttaaagctacaattctgtaccttgccaaactggcagacaagtgttgagtacagaataataaagacattttcagaggtgtactatctgaaacttttaatctctgtacacctttggtaagaaaactaaaggaggatgatctccagaaaaatgagggaataaaacaagcaaggaaaatgacctagaagccctgggaatgggggttcctgaattggtgaagaagtgaagtcccagcccacagctgtgctgcaggccttgagagtgaccagtccagactggatagagggtgggcaggaggaaggagagctccagaatgggtgtttccaagaagagaatggagcttgatagaatactggtgcctggccggtattgagaggggttttagtgataggcacatagaaaactaagctaacttaaagaacaaggcatgggccgggagtggtggctcacacctataatcctagcactttgggaggccgagacaggcggatcagttgaggtcaggagtttgagaccagcctgaccaacatggtgaaaccttgtctctagtaaaagtacaaaattagctgggcgtggtggtgggcgcctgtaatcccagctacttggggggctgaggcaggagaatagcttgagcttgggaggcagaggttgcagtgagccgagatcgcgacattgcaatcaaacaaaacaacaacaacaacaacaacaacaaaaaggcaattattagctttaggaaaaatgaaaaaaaatattagcccagcagtgaaaaatttaatattcatgtggctgtagtcatgaaaatcttgaatatggatttaaccagaatttttgacagaggaatagggggaataacaggaagcaaagaggtgaagtttaaaagggctaagtcaagaagtagcagcataagcatataatatattaagcaacaaggaaataaatttcacgcaaactgtctgaaagaattacactggttgcttctgaggagtggctgtcaggggcaggaagagggcaaggacttatttcccattgctgttaaaaactatggacatacttttatattgtaaactatgcacatactttttaatataataattggatttaaaaacaatttgttctcttttgtagcaatttaatgctaccatgtaaagcctgtcttttactcatttaagagaacattggatgctcacatatacatctgttctgttttaaatgtgctttcttctttactctgatttctcttatcccagaagggaagggctttttgtttcattcctaataaaatatcagtatagctgggcgcagtggctcatgcctgtaatcccagcactttgggaggccaagacaggtggatcagagcaccctggccaacatggtgaaaccctgtttctactaaaaatacaaaaaattagccaggtgtggtggcgtgtgcctgtagtcccagctactcaggaggctgaggcaggggaatcgcttgaacctgggaggcagaggttgcagtgagccgatatcacgccactgtactccacactccagcctgaatgacacagagagacttcgtctcaaaaaaaaaaaacaagaaagaaaagaaaaaattagtgtaattttgtgttcctgacccataaaagacttatcagatgaaattccagattatggagatattttcttgaaaatatttcagatttgtttcttagattattgcatagaagtcagttctgtcctataaatgtttttgaaaatatatatatatattcatgtgtcattgagaagaaaacatgggccaggtgtgctggctcatgcctgtaatctcagcactttgtgaagctgaggtgggtggatcacctgaggtcaggagttcgagaccagcctgaccaatatggtgaaaccccgtctccactaaaaatacaaaaattagctggtcatgatagtgggcacctgtagtcccacctacttgggaggctgaggcaggagaatcatttgaacccaggaggaggaggttgcaatgagctgagatcatgccactgcactctagcctgggcgacagagtcagactctgtctctaaaaaaaaaaaaagaagaaaacatgggtgttgtatgacaaaaaggctcctagctataatgggaaaggtctccctcagcttttatctctgttacctttaagaatatctgccagacaatatgtactagtggtttagcctggggatgctttttctccaggaatctccacctatcatgtctatcttctggattaatttatgttgacaacttccggagaattgaaagaatgccctaaaatgacttaagtactttgtttcagttttcaaaggtgtaaagaaattggctgggtgacagggcaagaccctatctctcgctctgtctctctcttacacacacacacacacacatacacacacacacaaaatcctgtatacatggactgagggaatataacaaagcagactgcttgggacgggcatatgaacaaactgttggtgccatctctcacatgtcttagtgggacccccccacttaccccagggaggcactgccagcttctgggtcacatgaacccttggagtttatgttttatcctagtttgatatacacacgcacacacacgcacgcacatatatgtgtgcgcatgtgtgtgtgtatgttgctgtgccagcagctggtagttgattaatacttgttgatttgcaaaacaaataaatagcaaagaaaatcccgaaactattcacagatctgagaccaaaatatatgaagataggaaactttttttccatctccatcttcacctgcattgtgctttttggatgcctggctgccaggtgcatgtgggttcaattactcagacaaagatgactagaacactcctgtctgtgcaaggttcacagtcagctgcaaggccaggtgcacactgcagacacctgtgagacctgtggatgccgaggaggcaccaaaggggagagggaacagtgggctctggctctgggaggtgaaagagggaagataacatccccccaggtctaggaattggatgggagaggatgagttcctcgagaaggtgtatttggccccaactttgaaattggagtggaagtcaatagtctgggaagggaagaaagaatattccaggcagggaatttacatacgacctcacagaggtgggaaaggaaaggggccaggtgtgtttgaggatggacagaatgatacccaagacacaaatggctggggggtagatgaggccagaatgttagcctggggtgggcccagtaccctatgattctgaggagtttggacttcattctgcaggtaataggaagctcctctgttattctttcattcttttattccttcaacagctgttcattcattcaacctgtggttgttgggattcagcaaggcagcttcaaacattagaggagaggcctagatgttctaaggccagggtggccctgtgtccacatttgtcctggacagttctgatgtgtacctgtcatccagggcatcacatatgatttacagtttgtcatggattttttcattgttttaaaagaaatattaccttttttcccttttttatagtcattttaaggactttagaaatattactcttaatagttgctttaaaataatctaggatgggcttggtagagcttcacttagtacttccatcttttgccgtggtcttgtctagaagtgtatcatgcatgtatgcagtgcccggagttctccttgaacacatggctaaatgtgaaagacaaccagtgataacctgtctctcctttccaaaccctttcctgacacaactaacagctttcaaggacagcaggcaggacacacactgatcacatgaaacagcttgggcttcagccactaggtgctatttactccttccagtctccaagcatttgctgctgctgctcctcgcagccacaggaggtgccagtgctgtggttgatgccagacctggtaaggcacccgaagcaccaggctcgcaccagctggttcagtaggaagcatgggaaagtacaggttcattgcacacatacgatagattgggaaatggagactcttacttactatagagtatatagaatatcctggatgctcttgcctagagtgtttctgaaatttattgctccgtgtgtatccacagctctttatcttattatttggtaatgctttttaaaaatttttgctgtaaaccctttcaggagcaaatggctaaaaaaaaaaaaaaaagctcctgtttagagaaaaactgagtagtgaatttccagttttctcaagaacatggatgaggaatgtataacttgctcagaagatttgccaccacttatgtccacagtaggatctcagggtatcactggccaaaggaaaactgcaagacaaatgtctgtgaaaaggaatactcttcgttttcaacgttatctctttccccagccaaaacctaatgcgacagctcttggcacgattgcctgtctcctcatcctgctgcatctaccttagccttcctgcttctgtgggttcggctttgttgtcccttcacgtttttcccatttgcctttccacttggcagacttcagtctgaacaccctcccaatgccgaagggcctgttcgcagctgggatctttcgaacatcttcatgcttaggcagcatttgcacaagaggcataacctgaagtcctgtcttgttcgttttgtagccaagtcttcattcagcttaagaagtactagtggctgctggttgcctctcaccccaactgaccagccacaggtaaaggactcagcggtgataactcagaggtgataacaggggctcgagggcctagttacacttttgcagaggccatggaaattacagtatgtgcctcgatgattctgaattttctcccctttgtggttgctccaaatcatctacgtctactcgaaagtgaggtgctttgacctgaattcagcccatggtactccaagcagtatacagttaggcaaagctgatgtctcccttactattcacacagcctgtgttggcttgcttggtggccacgtcacactgttgattcctagagagcctgtaggaaccccaaacaacaaaggtgtctatacagttacctgccacagaggtgctgggtaaggacacctggtgaatgtcactatccatttgttaatcagggtaattaacacaaagtgcaaaactgctctaacaaacaacttccccagtctcagtggcctaacccaataaatggctgtttcttgttcccttcaccgtccagtgcagtgggagggctgttctgggcagctctctcttctcctgtgtggctctgctgtcttccaacacctccacttttcttctactgaatcccctccttagagcaaaaagagaactccaaaaggattgcactgggtgtcttatggctaggcctggaggtaatgggtgcatcactttcatctacattccattgaccaggacccagactcatggccccaacttaactgcaagagaggctgggaaatgtcgactccatgtgtgacctgagaagaaacaaggtttgggagcatctcctcagcctctgccacagtcaggtcatggaaaaacacagcaaggtggaagtctggtgacctgagttctgccattgtctttctgggtggccttaggcaagtcatcataaccgctgtcagccatttcttcctccccgtaaggatcttaataatacttgccctgtacttgtgagtttacatttttatataaaagtatgtgctagtaataggagtcatggcctgcactattattttaagattataaggatcgcagtcatttattcaatgaatattttctgagtactcatagtagccaaagcattggacaaactgtagacccacagaccaactgttctctgtagcttacattctgatagtgagacagatgataaataatctgtgaagaaataagagggctgtgtgatctaagtgaccaggggtgctcaggataggcttctctgaaacagtgactcttgagctgacctagatgatgaggtggagtgagacccgtgtatatcagggagaaggctgtgccaggcagaggaccaggctgtgcaaaggcccttaggtgggaaccagctcggagggctccttgaacagaaaagtggcatgacagccaagttgttgcttgaaggagaaagatgagagataaggggatatatcatgcagtgtcttaacctctctgtgcctcagtttcttcatctgtaaactataaagttgggccaataataatatcaacttcatagggttgctgtaagggattaaatgaaatgatacgtatatagtgcatagaaaaatacctggcacctgatgttcactaagtgtgtgaactataattaaggtgaagattttattctaagtgcagtgggaaagttttgggtggttttcgggggttatctccactggtgtcttcaggctgggcccaaggtggatgggagtttccacgccccttctagacatccaggggtaaagtttttttagtgaaatccccaaaaacaaaagaaaatgttcaaaacatctcgttatttctacaatcaaaatatgttttattttttaaacatgtataagatttacctttacaagagtagtattgaaatatacccagaatatagatgaataagatcttgtaagcttctgatttatccccctctagaaagactgccaaatatttttacataatttgtctatagatctttctggactacctttggaggtccatgggagaggtgacactgagtggtcacctcgagctttacgtagatcaactgtgcctcgagctttacgtagatcaactgtggtctgcattttagaatgcacgttcccaaaggtttgtttgtggaagagggaaatcgtagaagattagaatgatggcttaaaaaaaaatcacgtgctgcaaaaacagttctttttgatcaaagtagtaaatgatgtgtttagggaggaaaagctgcagacacaaaggagcattcccatttctgcagaaatgcactcctccacacagaagaagctggcctcctgtttgcattttgctcatagtatcctaaaaatgcaaaccatcagcttaaaatgcagttcctctgtcctctggcaggagccccggcatcgagagctttggcacgtttgcttgtgacagtgaggacatcccaggagctgtggggtgagttgaggtcactgtggaagctctacgctttggcccacacgggactttgctgttgataggaaaaaacacaaacgtcgaattgtttttctgcaggcagataatgaatccccaaatcaatataatctcacaaaacagtagcttcatctatttgccaccaaaaaagcaccttgagtttctgcattaagtgttagcatttacaggagatttgaaatataaagtttccaaaaagatatgcatctgctttttgcaaagaatggcttagaaaagagagtggccttttggagctctgctgccaggcaaggtaggaaatattagaatgaaaaaggtggagccagcagtaggtatattgtctgtgatttgtgcaaggaggccggtgattcattgagtacctaatggattattcatttaacaaatatttttgatgttaagctttaacttggggccatgccagatcctggggatgcaacagtgaacaaggcaggaaggatccttgccccctcgaggttgagctttataacatgcagtgagtgggctgagccatcccatgctcacagacctgaggggagcactgctaattggacagagcccaccttcgggtttgggggtgtttaggcatgtctccaggagggagtgaccttgaaactgagaccctaagcatgagtgagagaagggcagaagtgggaacatgttccaggtagaaggaatagcttgtgaaggtcctatgtatttttatttttccttcttctcttcttcctcagccagaaaattcaaggatgcccaggttgtggagtgatatgtaaacattatcccattttcccttttttttttttttttaaacagggtctctctctattctccaggctagagtacagtgtgatcatggctcattggagctttgatgtcccaggctcaagtaatcctcacacgtcagcctcctaagtagctgggactacaggcatgcaccaccacatccagctaatttttaaaattttttgtagagacacgatctccctatgttgcccaggctggtctttaactcctggactcaagcaatcctcctgcctcggcctcccaaagtattaagattacaagcatgagcctggcaccatttttgttaatttttaaaacaacacaaaaagtcactgtgcattttgcatggttacatatatataatatatattaaaatatatattatatacacatatacataaatacttatgtgtgtatatgtatatacacacatacataaatatatataaatacacacacacacacacacacacacacattttgatcagcatggaaggaaacccactaaatttgtaacagtggttgcttctgaggaaggaggaggaaatggggcctgggatgaagacaaaggaaatctcatttttatctgaaatgttttatttacttcattaaaggagactttaaaaatctattaacaaaatgttaacaaaagtcaatttcgtggttggtatccaggtgttatattattctgtgtatctttctgtattttttatttttttattttttttctattcttaacaaagaaaattcaaggatacagactagattctccaagtggaaaggccatcttcggagaatatgctctctaaagtcctttataatgacaatcaggagctcttatcaaagcttgcatcagagggcatcagacaatcttgatcactcatataaaaaatgaagaacggatgttgtgtcatactgaaaaggctcacagcagtatgcttctcatttgcaatagaatttctctctggccttcagtgcaagatgacatttgtctctggttataggagacttacactggtacagatcacctctgcatccttctttcaaaagaagctttgtcggggttgttcgggtcagcatgtgttcaaaattgcaatgatgtaacccagtttctattgctgatcatatttgtgtctcattctcaaattttcattgccatgggaacaggtacaaaacttttgggaacaaatgatttattttattgggaatgagcatccaagtcctgtagttaatttcaacacctctctacaggagagagtcaacagaattgtctacgtagtgtcagagaaccaagaacctgccaatgaaacatgattatacctccctattcctctccttgatgaaataatctaaaagcctcctggacagtcttcctcgcttcttgcaaattttaactcctggttcactgtcactgtcttcaacactcttccttgtcctaatcaactgtaatttcaatatctatatgggtgatcttctcaggtctttaacctcttctccgccaaataacttatcctccatagttcctcagcctcccacttccactgttattttgtccttactccaccacagtcttggttgttactgtcctcaccccacagcgtcctgatttccatcctaacccagtttggattccacagcacatcatcatggtcactcccttgcctatgtcttcaactctcttgtccttctctcctgccatatcctcccttggcaaacctcaccactctcccctactgcttatatccaactctccacctgccctgtacctttgcccacggagctgaatgtggctggggaagaagaccacgaacaaacaaaaacaaatatcgccaccatgcagagaggtcttaattttaattcatttacttcaagtggaccccagcagtcctggtactcctgctgcatttcattaatccatttcctcactttctcttctgttatcagattcccagtagtgcctctctcttccacatttgctgctgatgaccttgttttctattttactaagaaaagcaatccagaaaaaaaattctatatatgctttcaccacctcatttactgacctacctacatctgtcttcccttctgtcattgggcaaaactgtccctgctcctactaaggccaactccaccagctgttccttctgtagatcagatccccctttgcctgctcaaggacatctgttaagcaatcctccctctctcttgcttcatcagttttgccctctctacagaatccttcccatcagcatgcaaacatgccttaggaaacacccattgcaaaaactctgcttagaccccatatccccttccttacccccatattattctgttcatcttcacagcaaaactccttgaaaagcttgtttatatttattgtcaccatttcctctcaccccattttctcatgatccttttatccagttttctccccatggtgccaccagaacagctttgtcagcattaccagtgacttctggttgctaaacttctgtgttgctaaatccactggtctttctcagcagcagcacttaactcagttgcccattcattcctccttgacatactctcttcgcctggcttccagacgccacacactttggttgcctcctacttgttgactcagtctctattgtggtttgacctcttcacagacttgatgacattggagtgttccaggcctctatacttagacctcttcctttttctatccacattcactctgggagtgacttcatcaagtttcgtagctttgaattaccctctatacatttatacaaatagtcactattcatgcaggaaaaaaacaaattagtttgagattcttttcatggctaggactttttcggtgattcatagagagcctgcttatatttaagattacagatgtggcatcatattttgataactttctgattattgtacaaatagaggttgtgtgcaaaacaaaaaacaaagcaaaagacaggaagttttacaacagacatcttggtgataatgtttaaaatttaaattgttctttctgttattagcttcttaagctgttctaagttctttggaactctgatattcacaccactgagacaagcttctaggaattagaatgcaacgatggcaaatccaaacatgtcccttttgggaactacgccattataatttctacgatgaagtgtagatgtgtttgacacaaaaagcaaatagcactgaaaacacttcatcttaccataggaaaataaaacgtatggcactgtacttaccaacatggggaagccgtattaatgtcaaagcatctattgacccttgagtctgaaatagttaattaagatgaatataaaccaaccacttttgattgtgtgtgtttgatttttttaatcactgagttttgttatatgtaagtttttacagaatggaattctccactattcagtggagacctcatctgattaaaggagtaaaacaattatgatcaagactttatgactgaacaacttgaatgaagaaattaaaaggtggtatgaactgggaaagaaatggggctttggtaacctgagaatcctaccaaatgcttttatagccattttttctacctactcagggaataaggaaggaaccatcattaagaattttatggggaaattatgatgaataaaatattatgataaaatgaaagcttatctttttcttcattagcgcattgtgtctcaaggcttcctgacatataaagtcttcacctggaaaacaaatgagcaaaaaacttagtgacattcagaagagatgattcagcaattactcagttcatttagtcagtatcggtagttcatctggatgtttcaggacccaaaatgaattatctgtaaattaactacacaattgccaaataaatcctctattttgaacttcatagaaacattctatacacaggcattgaatgcgtcctactgtattatttgtaagaaatgatttttttttttttgaggtggagtctcgctctgtcacccaggctggagtgcagtggcgcgatctcggctcactgcaagctccgcctcccgggttcacgccattctcctgcctcagcctcccgagtagctgggactacaggcgccccccaccacacccggctaatcttttgtatttttagtagagacggggtttcactgtgttagccaggatggtctcgatctcctgaccttgtgatccgcccacctcggcctcccaaagtgctgggattacagatgtgagccactgtgcctggccaagaaatgatatttttaaatgtttctttgctaagcaatatctctaggtattagaatatgcaaatatatgctaaggtccaatcaggactggtattcattctaagcaatgactcatctattaataatactgacctaatattttgcagctttgttgaggtaagttcttaaggaataagattgtgaatcctggagaattgcagaatttgtcaaaagaaaataagtacttaaattttttaggaatgcaatatgctagaaaacttcccttgggttagttcagatatgagagaggaaaaagcattatcttggatattatactttacacacttaagtaagtgactagatgtcaaagcctcagatattgttttcatgacagttttctaattggcgcttttcttggcaggttcccgaaggaaaagtagtcgttctcaatttccgattcatagacctcgagagtgacaacctgtgccgctatgactttgtggatgtgtacaatggccatgccaatggccagcgcattggccgcttctgtggcactttccggcctggagcccttgtgtccagtggcaacaagatgatggtgcagatgatttctgatgccaacacagctggcaatggcttcatggccatgttctccgctgctgaaccaaacgaaagaggtactgtttccacataatggcaataacaacagtaatgttggttcactgttcttggcacttgatgtttatttactcctttaaagcttaagagtggttctcaaagagctagtgaatgccatcaaaccatgatgagaccaatacaaaaaatcagccttttaatttaagtccacatgcattcttgtaaatcaagtatagaaattcatagagtaaaaatgtggagcttacatacataagcacacatgcaaatatgcaaacacaccccttcaccactccatagtccattctccagaaatagccatggccagtggttcccatacctttctatgtgtgcttgcttttatttgagtacttatacaatagcttttaaaaaataaaagtggagcccaggcatggtggctcatgcctgtaatcccaacactgggggaccaagggcaggtggatctcttgagctcagaaattcaagaccagcctgggcaaaatggtgaaaccccatctctacaaaaaatacaaaaattatctgggtgtggtggcacacacctgttgtcccagctacttgggaggctgaggtaggagaatcacctgagcccagggaggtcactgctgcagtgaccgtgatcatgccactgtgctgcagcctgggtgttgttgagaccctgtctcaaacaacaacaaatatatatatacacacacacagatatatgagatatagtgagctcccaagcgtagaaatctctacttttgaaagatcactgcagtgggcaatatttgtatgttttcagccttttacccaagagcagtccataatctgcttttggattggactgtagtgcaacatttttacttgaaaggtcagaggacagaatctggggctgaaagagcagccagaatgttggggaggaaatccaggcagggagttacagaattgaggcacaaaatattcgtataaaatctactgaaatctttgtctgacagctaaactctacatatgtggaggagagcccagttggcctggcacaaaagcatcagctgaaaaatgaaagaactgaaaagagattacagctgctgcctgctgccagggaaacagactttaagtttgagtctagccaagttaaatgcctgctagaacaaaattatttttatcagaacacaacagaatctagagtataatgtatcatgcataatgtccagtctgtagttatgtaatgaaacaggaaaagtgtgtccctattcaaggacaaaagcagtcaataagaactgatctcaaggtaactcacatgttgcaattagcaaacaagtactttaaagctgctattacatgtttgtttcaggatttataaagggaaatatgtgcataataaataaacaaattgagaatctcagaagagaaacaggaactattaaaaaataaattaataattctagagataaaagaaacaggatctgaaattttaaaatttacctattgtactcacaggtagatgggagatggcagaaaaaaagagtcagtgaacttaaatagaaattactcaatctgaagaaaaaggaggaaaaagattgaagaaaaagagctcgagaaaccagtgagacaatatcaagtggtctaacatctgtaatttttgtcccagaaagtgataataaagtgaaaaaatatttaaagatattatgacttgactctgctcaaatacagtgaaaaatatcaactcacagagtcaagaggggctgagcgtagtggctcatgcctgtaatcccagcactttgggaggccaaggcaggcagatcacctgagatcaggagttcaagaccagcctggccaacatggtgacaccccgtctctgctaaaaatacaaaaaaattagccaggcatggtggtgcactcatgtaatcccagctactcgggaggccgaggcaggagaatcgcttgaacctgcaggcagaggttgcagggagccgagattgcgccactgccctccaacctgggcaacagagcgagattccatctaaaaaataaataatgaaaataagaaaaatagagtcaagagggtcaacaaactccacaggacaaataaaaatgaagcacccccatgcacattataattaaattacagaaatttaaagacagagaaaatcttgaaatcaatcagatgaaactaaattccatacagaagaagagtgataagaatgatggcttccatttcctcagaaacactggaagccagaaggcagtgtcatagtattttttttgagactgagtttcactcttgttgaccaggctggagtgcagtggtgctatctcggcccactgcaacctccacctcccaggttcaagcgatttttgtgcctcaacctctcaagcagctgggattacaggcatgcgccaccatgcctggctaatttttctatttttagtagagacggtgtttcaccatgttggccaggctggtttcgaactcctgacctcaggttgatctgcccacctcggcctcccaaagtgttaggattacaggtgtgagccaccgcccctggcctgtcacagtatttttaaagcgctggaataaaactgtcaacctctattctatagccagccttcaagaatgtaagtaaaatgaagacattttcagataaacactaaaaatctctgaaaggcatttttatacttacactggtagaaatattgaagagaattcctcaggttgaggtaaatgaccttgtaaaatgaaagtaacagaaggaatgaaggtcattggaaatagtaaatataaaagggtatatgttattttcttttcttctcttaatttctttacatgtatctgttcaaaacaaaaaaaccttagcactgtgttgtggaatatatagtgtatgatgtaatatgtttgacaaccaaaggatggacacataaatgtaattacactgttgcacatacatatacaacacgtgaagtacaatattaactctaagtaaattttgataacttaaacatgcatattataatccctagagaacccattaaaaatgcaggagttatcactaaaagccaaaagattaaaatagaatactaaaattatccaactaacccaaagaaggctataaggaaaaacagatggaataaaagaaaggtaaagcaaatagaaaaaagtagtaaatggcacattaaatccaagaagatcaataaatatattaaatgtaaattattaaatactctgattagaagacagttattgttagaatggattgaaaagccagacccaactatatgttgtctacaagaaagcacttgaaatacaaagaccaagttggttgaaagtaaaaggaaaaatacaaaacttcattaaaattaaaactaatacttataaaaagacatggttacaaatacaaatagcctacagaaggggagaaaatattcacaaaaatgtctggtgaagaacttgtattcagaatatacaaagaactcatacaactcaacgataaaaaggtaaagattccagtaagtataaaaattggcaaaacacttggacacttcacagaggaaaatatgaatggccaataagtgcatgaaaaactactcagtatctctcattagtcatcagggaaatgcaaattaaaattacagtgagatgccattacttacccaccatgttggctagaaaaactgacaccaccaagtggtagcaaagatgtaaagcaaccgaagtgttcatactcgagagaggtgtaaaaccacttggagaaaagttccagtagttttttatgaagttaaatatttacatcgactcttggcccagcagttgcagtcctgggtatttatataagagaaatgaagatacatgtacaaacaaatgtgtacaaaactgttcatagcagcttcattcacaatagtccagactagaaaccacccatcagcaggagaatgggtaaacaaatttatatggagctctaaaattaaactcatctaatgggaagtttttcagaaaagtagtgtagagaactggcaggatgggaagagatgcacaaatttagtgggaaatggattctatatcatcataggagtgtggtttacacaggtatatccatttttcagatttgtacagctaagatttgtgcatttcagagtatgtgaatttctctccccaaaacctgtaaaataataataataaaaacaatgaagcaggtcgtggggattgggtggcaatatagatagaataatagaatgatgactattattgtaactgggtaatggatatgtaggaggtcattatattattctacttactttgtatatacttgaaatttttcattaaatggagatttagaaattattccaacctccatttttataatacattatcttaaatttagaagtttgatttaagaatggttggatatattctgtgtcaaagaaatattccattgaagtataattattttagtttcagttcagtttttatttgttatttacattcaagtaaaattaaatttagaacttcgtattaaaataattcttacattatttctgccaacctacaggtacatatgcaacttatgagtacagatgcctgaaatgatatttgtcacctattaattttgatgagtttttggtggctaaaactggggatttgggggtatatttttgcttccttccttgtgcctttctgtattgctgaaaatttgtaaatattatttttacaaacaaaatttattcttaaaacatatatatattatatacatattatatatatatcatgggaagttttctagtaatgagagctgtctatatcaactaattcaaattttgtccctgggtgtttactaaataccaatgccttgaggagccttaacatctctatgattttttgagcctgcaagctttctgagtgagtgcatattcaaatgttttgtcttccttgtctaaggaaaaaaaaagaaaagaggccctgagtccacttctcccctctctcgtgttgctatgctatgtcaggtaacaaagatcattcattgtgtgtgttggggggttatgtatgtaaccatatgtttaagagaaaatgtaagcgcttctgctgttgcctttatttactgtactctcaccaaagatcccacattcctaatctccacatggttgtattgctgtaacctacataaacttgtgggcttttttccttgtttaatacttgaaggggatcagtattgtggaggactccttgacagaccttccggctcttttaaaacccccaactggccagaccgggattaccctgcaggagtcacttgtgtgtggcacattgtagccccaaagaatcaggtgagattccctggaagtgtgaagaaagcatgcatgtgtgaattgcccagtgtggggggcccaccaactctcaagagcctcctgttgtgggggctattcgagagctaagggatacaagaagaggaaggttcctggacacaggtatttcttcatgcgaagaccccagatatttttttttttttttgagacagagtttcgctcttgtcgccctgtctggagtgcaatggtgcgatctcagctcaccgcaacctccacctcctgggttcaagcgattctcctgcctcagcctcacgagtagctgagattacaggcacgcgccaccacgcccggctaattttgtatttttttagtagagacagagtttctccatgttggtcaggctggtctcaaactcccggcctcaggagatccgtctgccttagcctcccaaaatgctgggattacagatgtgagccaccgtgcccggcctagcctttgcatttttttgagttgcaaattcatggatttaatttcctgctatataatgacaattttcaaaacagttttaaaaatacaaatggtaagcagatctcacataggattgtttaaccctgcagtggatgttataagcagcagcgactaactgtgggaggataaaaatccccaggtccatggacatttcaggttaccatttgctcccatcacaaacccatcatgtcctgataatagttattctagtgactaaataaaaaagtgtggatgctttgcctcaacaaagccaacaaaagcaagccacattatctcttcaaagaacaagctggtctgctttagggtgtttttggttgtcatttaaaataaaatatgtgcaggttccccacaaaaagcttcattcattgttctgaaataatcaacagagaaggtcgacttttccagtatttattaatttgtggttacatatacaactttttaccctttctgggaaccagtttcacatattaattgcaggaaagaacttagcatagaaacacatgaaatctactttgtggacctttaaagataactttataaaaattattactattagaaacactatagactttaacccaaacactatgaggtaaacattatgatactgtttttaaaaaaacttttctaaattaacctttcatatagcttgaacagataccatttgtcatgtatttctttttttatagaaaattatttaagctaatataccatgcaagttagtgatttgaacatatacacatatatacagacataaacagtgatcataattccaaaacttggttttatttttaagaagaaatatatggccatttatttaataatggaagattttataagtctgttgaatgttttataaagtaattttaaaaattgtgtttctgaaacatttaaaccattatgtaattcttgaaattatattgatcattttctctgtgacatttgtaaatatatttgaccaaataattccaacttaattatacttgcagattacagttaagcatctcttttccattgttcttccctttgatcatttaaatgttaagtttgatttttatttgattttaatgtgatttttggcttctgtcaattgagttcttaatcactgtgtttgaaatcactggcagtttctcaaaggagaaaaatataatgggaaaattaagtcctaaatagtttctatgcaagggaattattgtattgaaggaatttcattggaattttcttctattaaagaattaccttaccatcatttgttaccacagttcttttcctttatcttcttctttactttttttaatcttctctgcaaaagtttttgtgactaatttcttttttttttttttttgagacggagtcttgctctgtcacctaggctggagtgcagtggtgcgatttcggctcactgcaacttccacctcccgggttcggtccattctcctgcctcagcctcctgagtagttgggactacaggaacccgccaccatgcctggctaattttttgtatttttagtggagatggggtttcaccgtgttggccagaatggtctcgatctcctgacctcatgatctgcctgcctcggcctcccaaagtgctgggattacaggcgtgagccaccacgcccagcctttgtgactaatttctaagtagaaaaagttcgccaatttttttaataacctggaaagcattttattagtaagtggtaagaagtcactggacccaaagaggaaatattttaatacaatttaaagccatcttaagtatgaataagcattattcacctatcactggcactgactttttaaaaggtagttcagtccaaagatgtgtggaaattatggtcaaagccaaaattacctttgtgtccatctgtgatgctgttgctattatcatcttcacctggattactgtgtttgagtcttctctagctaataggaattaatgtcctttatcttccctgaagtagcaaggagggttcttgcccacttgctgctcggcaagattgggtaccagctgtcataggtaataataaatccagtgaggtttcctttgattcacatgttggaaatgttcttttaaacatttgcttgtatggggaatgattgattgcctatttaatcaaaattttctattcacgtgaataatttaggacactattattggtactagtgcaaaaaattgagaaatactaaaaacctaacactgactttgtagatcagtgcttctgtgcaacctcttcaaaaataaccacaccctgattaggccgtgcacggtatcacacatttcaaacatacttcaagaagacactgccatcaattccacttccctgaataactggtcctgaaaatttgacttctttacatctgatagaaatgtcagtctccttccctcaaaaggggaacaactctatccactcagctcaccctcctacacatatattcacacacactactactccctgacatacagtagtataaggagcatcttagataatactttttatttctattagcttctattaaggtatgtagccccttttcccactataacacacatccagttatccaattacaatcttgtttttctctttctttttctttttctctgcagctttattgaggtatagttgacaagtgaaaattatatttatatgtgcaacatatatatttatcatgtgcaacattatattttgatatatgtatacattgtgaaatgattaccacaatcaaagtaattaacatatccacctcacatagttattattttgtttgtgtgtggaatgtggtgttaacatttaggatttactctcggctgggcatggtggctcatgcctgtaatcccagcactttgggaggccaaggcaggtggattacttgaggtcaggagtttgagagcagactggccaacatggtgaaatcccgtctgtactaaaaatacaaaaattagctgagtgtggtggcgggcacctgaaactccagctactcaggaggctgaggcaggataattgcttgaacccgggaggcagaggttgcagtgagctgacattgcaccactgcactccagcctgggcaacaagagtgaaactctgtctcaaaaaaaaaaaaaatttactctcagcaattttgaagtttattatatgttattattaactatagttaccatgctgtacaatagatctccaaaaccaattatagtcttaaagtaggttgctagtgttacataatgttcccatacttttgtagctgtaagtgaacagagttcttaagttgaatatcctaactagagttgatctgagtttgagatgatcttttggaaagattacaattaaaagcaaaagaataccacagttttttttttaactaaataagaaatatgcaacaaaaagcacttaatgcatactttttttacaaaggaaaatcgtagtatcctccaaatctggggagaggaagaattccatttgaggttattcaacaatgctattaatatttgacacttctattgtgctttctctaaagcttatagaattaaagtttgagaagtttgatgtggagcgagataactactgccgatatgattatgtggctgtgtttaatggcggggaagtcaacgatgctagaagaattggaaagtattgtggtgatagtccacctgcgtaagtagcacctatttatgtctttaatagttttatggctctaaacttgtttcttgttcagtttcccaatcacatttgttttctggaagattttatgttgttgttgttttgttaaattattgggtcctctattagttctcgcactgctgtaaagaaatacctgagactgggtaatttatttaaaaaaagaggtttaattggctcagggttctgcatgttgtacaggaagcatgaggcttctgcttctggggaggactcaggaaatgtacaatcatggtggaaaggaaagagggagcacacacatcacatggccagagtagaagcaaggtcgaggggaggtgccacatgcttttaaatgaccagagagcagagagctcactgtcgccaaggtggatggtgtttaaaccatgagaaaccgccctgatgatccagtcatctcccaccacgcttctcctcaacattggggattatattacatttgggcagggacacagatccaaaccactacaagtcccataaccatggagtcagcaccaccaaaaaagaatagccaacccaggccctgaggcaacattaacaggagtgtcaatagccaaacagaaacaagtagagctggtgataccccagggtcagatgcagagccgggtacctggatacatcactgccctgtaagaatgagatcaagcatcagagtggaatgggaaaattctgaaaacaaaacaaaacaaaaacaaccagggggcttaatactggggatccagacaaggagacccagaagtttacgacaaacccaaatgattttaccttatcagagatctgtcctggactgtttgaggccttatgcctccccctcacattgctatccaaatttttgctaagtggaccttgaaggcaccatgtatttattcaacaaacatttatggagccaagagttctgccacttaataactgtgtgacattgagcaagttacttaactctgctgcaatatataactgtatttctggtgtaattatgtaactgcatttatataactgcaatatataactatttctggtgtaattctggtgcaatatataactgtattttggtgcaagatatttcataacttcacttacaatattagtaaaagcaacagctgaaattactgcagcttgccttcaagtcaccattatgccaatttaaatacccttttctactctgttgcttaaacgtaattagattatatgcatcacttgattttatatgcattattatggtttttcattgacatatttgagttaaaggagggtattttctattacatttacattgataagaatgttttaatacatacaagatagtagttataatttaagcataaccatacccaaatttggtttacagatgaatatattggagaagggcctatttctaagttcctagataattcttttcccattgctgctgtaacaaattgccacacgtgcagcgacttaaaacagcacaaatgtattctcttacagttctggaagccagacactggactaaagtcaaggtgtcggcagggctgtttccttctgaaagctctgaaagggaatctgtttccttggcttttcctgcttctagagtctgcctgcatgccttggcttgtagccctcttccttcatcggcaaagtgtgtcacttcagtcgctgcttctgtctcctcttcttagtcaaatctccctcttataagggcacttgtggttacatttagggcctacctaggtaataaaggacactctcctcttctgaagagtcttactcacatctgcaaagcccctttgccttataaagaaacatacttacagtgtccagggattaggatgtggacattgttggggactacacaccctattgaaagccaacacattaatctatgtcttcctttggacctcctccttttttcccttgaaactttcctccatttattaaccctcctctttttcttcatgtttatcctctacctccctttttattccttccccatagcctataaacctaagttctcccaaattaaaaaaaaaagttttaaactctattgactctgtcctggtctaacttttcttccatgtctctcctcttcatatccaaatacctttaaaaagtaatttcaagcttcattttctagcaatatgcaagataagatatccttgaaaactttatagaataaacactaaacaacattcctaaagattaagaaaaaattttgaaagcatcgctgagttgtcaaaaaataagagaagtcatcagaggtcaaaagtagtaagaagcccaaagccagagagagaagcacatgctgaagatggcagctcccccggggcatgtgccagttcctggaagcctagcacttcattctaacagactgtgcttgcagacaagagacaaagctcagggtccaggccaggggggtttggagcaaagaccacagcatgtatagaaaagggacccagagaagctgacaccaatataagtaagctaactttctcccttccctaagggagatagtaaggaaaactggctggttttgccttggcttttggtgaaggaacggatagtctccgatgagaatttctgaccaaaaaccagccaacatttggggttagaatttacactacctgactgtccccaaaaaaacaggtcaagaatttagtttaaagcttccaagttgataatgcctgcattagaaacagtagaaatacagtttttaacttgcaaaacagtggaaggaaacatgaagtgacaaaaaattcagtgcaaaagaaagtaagaaaagaaaaaatgagaaatattttcaaaagcatgacaaagcaggtgtgatggctcaagcctataatcccagcactctgagaacctgaggttggaggatcagttgagcccaggaatttgacaccagcctgggcaacatggtaagataccatctgtaaaatttttttaaaaaaattaactgggaatggtggcatgcacctgtagtcccagctactcaggaggctgaggcggaggatcacttgagcccaggagatcgatgccacactgagctataatcgtgccactgcactccagcctgggtgacagagcaagaccctgtctcaaaagacaaacaaaaagtacaagataagatggtagaaatgtatctatcatctagatatatataggtatatctataaatataactgtaatcaatataaatacaaatggaccaaataattaatagaaaagtgttatactaaataattaaacaaaatccagttatatgttgtttacaagacacatccccccaaaataaaaacagagtttgaaaataaaaggatataaaaatgattagaagcaaacactaattgaaggaaaattggcatagcttcattgatattaggaaaaaatcaattttaggcagaaagcattaccagaaatagttgctatataaatgataaatgatgcaatttatcaggcagatgtaataattgtaaaattttaaacttgtaaacttgtacataagattatttgaagcaaaaaaattaaaaaattaagaaaggcagatctacaaagttcattattgtagtagagatttttaacacatctctttcaataattaacagattaactaactgttaatgagagaaagatgggaaattaggaggtagaagatttgaaaaacaatgaacaggcttggtctaatagacaaatagagaacactacatccagcaactggagaaactctatttttttcaagcaaaaatggacacaggagaaagaaaaagccatatttgccaaatgatcactaaagaaatttaatcagtaattaaaggttttcctgtcaaggaaggaaaagttctgacagatatttgaggtacagacatttctaatactgcacagaatcttccagagaaaaatagggattgttccacaactaattttataaagctagtatgaacctgacacaaaaacaaggtaaggacagtacaagaaaataatattagagaccaatctcatttatcagtatgataaaaaagaaacgctgaaacaaaaaacttggcaagccaaatttagcaatgtataaaaaaaattctatgaccaggaatccaaggttggtttgaatttagaaactttattaatttaaccttatacctcaccagattaaagtgtgacttgtggacttatgttatttaatggaaaaatcattttattcacaaatgtcttttcttagatagtttgaacttaaaagtttacattttgaaaaaaatttattttaaaagcaataaaaatcctgctcaggaataagtataaaaatgtgcttaatagggaaaattataaaaccttgctaaaatatattttaaaagagctaaataaatggagctatatacaatgctcatgaataggaagactcaatatcatttaaaaatattaaaactggttttccattaagcctagcagtctaattctaaaatgtgcatgggattgcaaggggataggaagaagggggcaaaagtaagacagttctgaaggagaagaacctggcaggaagacttgctttaccatgtatggaaccttatcagaaagctgttgtaattaagacagtgtggttttaaaagagtgatgggtagatggctaattaaacaacaaggagaggccagaaacatatccacatgtatctgcagattgggcccgtcacagagaaccatcagtcagcaggaaaaggatggcctcattgaaaaatggggcctagactatttttattcatatggaaaaatgaaattatattcatagctaatatcacacaaaaaatcaatgacagatggattagaaacttaaatgagaaacttagatgagaatttctgttcatcagaatataccctgaaagagagggaaaagaaaagccacaaatggaaacatatttataacatatatttgacaaaggcttaggttccagaacgtattaagaaatcctaaaaattaacaaggaacagataaccacccagtaggaaaaaaaagggggtaaaagacatgaaaaggcattcccaaaagaagaaagctgcatagtgaataaacctttgaaaggtgtgtgaattggtacgaccacttttgcactgcaagacatatacaagaatgttctcagcaatatggtttgtaatgagggtgggagagagtaaatagcccaatgtttatcaacaagagaattcttaaattgtgttatagtgcacactataaagcaatgaaaacagtggatgaatctcatagttataatgttgagggtttaaaaaaaaaaaaaaaaaggctgagcgtggtggctcatgcctgtaatcccagcactttgggagcccaaggcaggtggatcatttgagttcaggagttcgagaccagcctgggcaatgtggaaatcctatctctaaaaatacaaaacaattaatgtcgcctggtagtgcatgtaatccccgctacttgggaggctgaggtgggaggttcccttgaacccagaagatggaagttgcagtgagccaagaccatgccactgcactccagcctgggcgacagagtgagaccttgtctcaaaaacacaaaacaaaaaagaaaaaaaaaatgcacactgtaccctttcatttatgacgtttaaaaacatgtagacctacacaatatatcgcatagtgatgcatatgtgtgtgataaacctatagctaaaaacaagaaaatgataagcacaaaattcagggtagtggctgcctccatgagggtggaggaggggcagccctggcggcggctattgagcatcactcatttaccaggggtttgactggaagagcttggctgccagctcaccaactaacacttttatccagaggaatagttttcatagtcagaatacgtctgggttagagcagtgcagaaaatgagaaaacctgtttggggagcttttccctgttaaaaaatgaacaggaggagcactggggataggtagacagcaccccatcatacttggtttgattcagtgtagatcaatgccattgaattctgttcagaaacattgattcctccccggctgtgtgctgggcacctggaatacaaagataaattaaaactgcaaagaaaagtactgggagggaacagaataaggcagataagtaaattggctaatgaatgtcctgggtgggtttttgagttctttggcccagtctggacaagtgatcagggaaagcttttgaaaggagattgtgcctctcgaagatgagtcttgaaggaagagttggagttagagacagcagggaggacaagctcatcccaagcagaggtaactccattaataaagatacgcgggagagatgtgtgttatttctgcagccaaaaccttgagttggggcctctatacagatgaggcaggagggttgagttggcttccgtgtgctgcagagatggtaacgctcaactgaatttaggccaggcgtgacaggaccagaggctctagaacccccgtcctagagaaggtgagcagggagcctagttcagagactgttgcaatggtccaggtaaagtcgaggaggtggagaagggtggtagaaatgaagaggagggtgtggatcaagaaatacttaggaggcaaaaatggcaggacatggtgtttggttggctgtagtgactgaaggacaggaagactatggaatgataactagagacagctaacagtaactggctctataccacatgaaacagcatctcagtccgttcttgggatttgccaatgcagagtggatctaagtgaaatttcctcttgtctgcctagtgatttataacaatttgcagatgtaacatggcccccagtacatttgtggcactgtgattctgtcacatttatcctaaagctcagttgcagcagaacaaaaatatgtctttgttcctaaaatactcttccttgagaaaattcagtttccaatatactacccccaaggttaattcatagaaaaggcagtgaatgatcatataattataacatcatgtctagaaggctgacctgattgagtctttcctttcctttgctgcttataagtgctttttttgtaattttatcatttaaacaaaattaacatgttttatttgtaattgtaggttagaattgtgtgtagtgcattgtttttatttatttaatgggagtgtttttcaaaagcatgatagaatattttcgtgaaaggctcgaatctcagaagcattatttaaataacttcatcacttttgtggctggaagtgtcttagtccgttttgtgttgcctataacagaatacctgaaactgagtaatttataaagaaaaagaatttcttatagttacggaggctgaaaagtccaaggtcaagggaccacatctggggagagccttcttgctggtggggactctctgcaaagtccccacgcagcacagggcatcacatggcaaggggggcagagcatgctaactcaggtctctcgtcttataaagccatcagtcccactcccgtgattgcccattaatccattaacccacttatccattaatctgtgaatggatgaatccattcctgagggcagagccctcatgacccaatcacctcttaaaggttccatttctcaatactgccccactgggcattaaatttcaacatgagttttggaggggataaatattcaacccatagtaaactgtaaatgtagatcacaaagctcactttttgattcatctcatcccctggctcagaaggttatattcaggacggaaaagatcacgcagtttttctaactggttgggtcaggtagatctaccctctctgccacccaaccccactcagcacagctgacagtagggggaaaaaaatgctgcttcattatttggtgtccatgatgtgtaagaagtgattggctgagaagatgtctcaaaaaggtgttcagtcagaccactggttaattcatttaaataacttgttaaattttttctacttctgaattagtttttaaacagaattaatcagacagcatttttttaaccattgtgtaaataacaatagcaaaacttaaatgaaactatcttgtgtaatatagtaatcccctaagattttagagagcttttgagcctcacttaccatctccactaaatctttagtgccagctaaccaggaagctcctaaaattagagctcttaatcaatgatgccattcatgaacaccaaaacagattcatcactttcttttttttcctttacagcattttgctaatggagattataatagaaatgtttccatttcagacataccgaagaactgccattgaaaatgaaatggaagtcctttgcatggctttcttagcccggagtggatagaaaagataatcagtccactgagataatccctctggctgcatctttacagggcgtgggaatttgttcaccagatttgtccattttatgctctgtagccaacatggcaaacccaggccagcttgaacgcaagtcttagttcagagaatctgccttttcccaatcaggcaaatcatgaggtgctttttgaaaaccagccatgtcccaacgtctgccacagtctctagagttatctggtcctgggttcaagttctgactctcccaacatactagctatagggccttgagtaaatcacttgaactctctgaacttcaattgccttttccataaaaaaagagataaaaatagggttgttgtgaaggtggaatgtgacaattcacataaagcacagtgcctagctgagcaaacactcggtaaatgttagctattagaattggtatttttaaacgttttaacttttaagtttaaacaactggtaatctattgtcggaagttaatggaaaactagaaaattttacattttcagagaggcaccacttttaagtatttataaaaaaacacatttttctttttttaggccaattgtgtctgagagaaatgaacttcttattcagtttttatcagacttaagtttaactgcagatgggtttattggtcactacatattcaggccaaaaaaactgcctacaactacagaacagcctgtcaccaccacattccctgtaaccacgggtaagttttcctgtttggaagtttgtgcaaaaactttaggagtataagaagaattcttttaaagtagaaaaaaaataagaggaagatacttgaaattaaagttaaataggatgaaagctttggtaagagaataatatgactgcattaatgaaagaaaggtatggggtgtaagaatgcttgtaagctaatagtttttaaatatcaggtaagaaaattatgaccattgaacaatgactaggaagcctattagaagcacagatcattctaagactaagtttctgtttctggaactgacaaacttgtcgtttgctttttattacatagaattgtgatattttaggttgaagttctagggccttgctatctgtgttttcatattctgccaatgtttgtttttggtttttttttttgcttctcagcgaaatgtcatataaaatgttatttatttatttatttatttattttcaaatcggagtaaattaaacaacaatattcaacgaagtacagaggctggttgggaaactggcctggggggctgaggcatgtatgtagggagtggagaggcagggtctctgtaggtagtacctggcctatcagctccaccccctgggatttcaggcctcagatctaaaaatccaaacccagggaggagggggaaaagcgggaaggaaagactgaaggttaagatgtaaaataggctgaaataagcccagctttattgcccacattttccatgtacacctaggctggggctgagtacaggcaggcgcctctgggtctaacgtttccttgcactctgcaagtgcgccactgtgtggtgtggacgtgtactgcctcatgtaactgctgtatttctccagctcagctcagtaagccttggtgtccatgttctttccagtgaattatctggtcacacccattgagctagtggttcccttgcttttatctccatcctcaactttctctgaaatcgcaagcatggatttgtaattctttcctggacacaatgtgactgtagctatttaaatgaaagcatatacaaacttgtttttatcacactattttctgcctcagacctacttctccacctattttcccaagcacgtccacagcatcggtagccgcactcatagggtcatctttgatatcctctatcttttctcctgacctcatgccctaccccgctcccaccacaccgagtagactgtgttgttctcccattaaatttatagtctacagctatgctatccaatatggcagccactgtgagcacttaaaatgtggctaatgatattgaggaactgaacttttaatttaatgttaatgaatttaaaattgaaaagcttcatgtgactagtgactaccagattggaccacatgggagcccaaaccccttcccgtggtgtgtcagacccttcacactttgtccccagcctctctttctagtttcgtcttcaggccttgcaaactctctcctatgctctaagtatttttgtgtttatcctatgtgtgggggaagctgttgatgggtttaagcaaagttcaggattagtttcacattttacaaagatcactgtggccactgtcaggtgaatgaattgtagaaatccagggggtcaccagagtctcgtgctggtccaggcgaactgtgctatggcacaaattcagagagagtcaagagatgagagggaaacagtgacaggccttggtgattcattggactagggaggtcagggaggtaggtgtcaggaatgcctcccaggtcccgggcttgcacagctagggggatactgccactgttcacagaggtagagaactggattcggaggtggatttataaattaggctgtcgccttgttgggtttgaggtgtccgtgagattttccagtggatatgccatgcgtaggggtacacgggtccccagactaaaagatttaagccagatttaaatttaagagtcacccatcatccacaactcgggtcacagcgcgcccctccccaaggtggtcttccgcgacccgtactggtttaagaagcggacggagcttttcattgctgccgagggcattcacacgggccagtttgtgtattgcggcaagaaggcccagctcaacattggcagtgtgctccctgtgggcaccatgcctgagggtatgatcgtgtgctgcctggaggagaagcctggaggccgtagcaagctgtcctgggcatcagggaactatgccactgctatctcccacaaccctgagaccaagaagacccgtgtgaagctgccctctggctccaagaaggttgtctcctcagccaacagagctgtggttggtgtggtggctggaggtggccgaactgacaaacccatcttgaaggcttgccaagcctaccacaaatataaggcaaagaggaactggtggccacgagtatgggatgtggccatgaaccctatggagcatccttttggaggtggcaaccaccagcacatcggcatcccctccgccatctcagagatgaccctgctggctgcaaaatgggtctcattgctgcccgccagactggacgtctctggggaaccaagactgtgcaggagaaagagaactagtgctaaggggctcaataaagtttgtctttatgccaaaaaaaagtaagagtcatcaatatatagatagttgaaacaatgatcaagaacgagatgacctaggcagagattgagggcaggaggaggagaggcgcggagattaaccctctagaaacttccgtctttttgaagagaaggttacactggcaaaggtgactgaaaagcagtggcgagggaggagggaggagaactgggaggatgtgtggtgaaagccgtggaagggaatgttacaaaagggagtggtaagtgagtcaagcgttgatgagacttccaataagggaggactacagtgtttccgtttggtttcatgacatggagtctactggagacgccagcacaatctatgtaagtggctttgtgccgccagcagaacccggacagtgtgtgctgaggggagtgtggagcatggcaaattgagataataagttcagtagctcattccccaagtttggccttaaagaagaaggagaggctttgagagtcttgaacctgcttatgttgatgggagtaactagcaaagaagaaggcaatggcagacagaaggaataaactgagaaggaaagtttctataaaggtgagaggggctggctccagaggactcacagaaggcatgacttcaggtcggaggggggtgacccctctctcagaggaggaaaagaagagagatggtataaagatgacttggaggtttggtggggatcttgagaacattttctgctatgcttctcttcttcctagaaaataggcagggtcggctaggtgcggtggcttacacctgtaatcccagaactttgggaggccgaggcgggtggatcatgaggtcaggagatcgagaccatcttggctaacacggtgaaaccccgcctctactaaaaaaatacaaaaaaattagccgggcgtggtggtgggcacctgtagtcccagctactcgggaggctgaggcaggagaatggcgtggacccaggatgcggagtttgcagtgagccgacatcgcgccactgcactccagcctgggcgacagagtgagactctgtctcaaaaagaaaaaaaaaaaggcaaggtcacctctgagagggagaagggagtggcagcacgggaggttaggagaatgagaaagaatttgaaaaacagctgtagaaattggagagtaggctgaactccagcctgtcactctgctgaaggcccatttgtgtactcagttgtctgagggcaggcacaggaaaaacagatttctctgaagattcatacagggctgaagggcagaggggaagggaccttaaggcattgtgtagaaaatgattgaaataatggaccatggaaatgaaatagaattgctaaggaagtaaagacaggccagggctgacgggttgggaaaaatgagagcagccaatatattgaaccatcaaagatggaagaaaacatagtcatagagtgattaaataaataagcttggaggggagaacgctgtcctggttgccagcaggtctaaatttgatagactggcaatgaacagccatagcatgaagacatccgagcctggaactgagtgtctaggaaagtccctggtgaagatgaggccacggggactgcgggatcagacatgggagggtggacccatagaaacgatcgcgggaacacagccagggagggctgagaaccgggaccagctttgtgagtgaagggcaaggagacagatgacagttaagatgaggaggggaaggagagagccagtgacttgcaggccagacagcaggccccaccaaagcaggagaagggcatgttggacacccaccccacttccagactgaccttcggaggctgagaagcagccggttcccaatgggcccgggaaagggcgctcaccatcagacacaccacaactttttgactcagttaactgagtaaatttaattccataaatttacagctgaagtgaggttcccaacttctggaacaatggtatgtctctcccttccaaacatcttctgagctctttctctcccttttttaaaaatgcatatttaagctattatatgtattttaacattaaattacatatgttttaatattgccatctgcttcagattctttctggagttaactagggggtacagattaagagtatataaataggctgggcgcggtggcttacacctgtaatcccagcactttcagaggccgagacaggcaaatcacctgaggtcaggagtttgagaccagcctggccaacatggcgaaatgaaatctctactaaaaatacaaaaattggccaggcatctgtagtcccagctactcaggaggctgaggcaggagaattgcttgaacccgggaggtggagcttgcagtgagccaagatcacaccattgtactccagcctgggcgacagagcgagagactccatgtcaaaaataaataaatagataaataataaattaacagaggagttggtggggcctgttggaagagcaatattacaactgtggatattcacccaacaagggcaattctgttaccgtggttctgtttagttcttcctagcatattgtcacacagaaacaaataattagcaagtatttctgaaacattcttaagatgattatgaggatgaactattttcacgttgttaacccggggtttctctacctcagcactatttatattttgggccagatccttctgtgttgcggggactgtccttttttctgtgggatgtcagcagcgtctcggcatctacccactagatgctagcaataccctctagttgtgataaccagaaatgtttctagatattgccaaatgcctgctgggggcaacgtcacccgtacttaagaactgctgtgttttgtctatttggtatacttttaaatttgtctacttcttagttcttaagattcttatagccagtgccaggctcaaaataaatatttagtgatgggttgcatctaattacagatgtaacacactttacacatgaacagtatttctaaaaacctatgctactcatgtttaggcaattgcatattttaaggatgtcctcaggggaacaccctatgattccttttgtaaagtgagggattaacctacattctgtgagttccaatttgttgttctgggtttttctaaacagggcacacactcagagtacgcctgtattttcttatagtgtttgttttatataaaggaagaagagaacagggctacatttgtgctatctttgaactcaggtttaaaattcaatagagggtattgagttgtcctggtgaaattagagcagtagttggtagcatggagaatttattttgcgtggttttaaattttttctttgtagtgatagattggtggctcagggaaataaatgataattttaaatgggtagattcagaactaaagaccaattatgcttgaattcatttttcgtgaaacttatgtcttctttgaattaaggtttaaaacccaccgtggccttgtgtcaacaaaagtgtagacggacggggactctggagggcaattattgttcaagtgactttggtaagaaataaaagccagtctttttctctttaaccagaaacttgaggctgcatgcttaatctcaaaggaattcctatgaatttatggtgaagggtcaataacgctgctcatttatccaagaaaatacttgcctatacaccagaatggtcaaattgttagatttcaccactgagaaaaatatggatttagaaaatatacttttttcatataagcttaataatttgactcttggtacatgatactgccacattgtgtgttctggctgactattcctgcaaaaaacctatgtacttttttccttatatatttttcatatacagagtattttttcacacatctataactcaacttaagtaaattagaaacatacccgagcttatattcagaagctggtctctctcagaagaaattcaagtatttcccctgtactgcctttctgaggtactgaagtaaaagttggaaatctggagtccatttggaaactctcacaaactggaacctgaggaggtgttctttaatgatttagaatttttaagagctttttccagtggaaagattgcaccatctatgatagctacttaagagcaaaagatacaacattttatcttggttattttttcagtggctttaaaggaacatttaagacaaatctgatcaggaagagcaagttgctatggcctaaatacatttccccaaacaaaacttccccagagaggctctgcttgctttttctgtgccttgaagtgacttctgtagtccagacgagctgtatcatagtgaaggtgtgaagacactgaagactctgggaccctaaaccttactagagttcacatgctgaaattcaaataactggcataaatgtgaaaacaacgccacatgtaattgctaccacatccagtttactcttctgtaggaggtgcttcaggaagtctccctccctgtgtcttgggagccactgatttcacttgactatagactgaattttggagtgaacacttatcacgcaggatcaaagtaaagcatcataggaattctgattttatgaacattgcacactgcctaagcagtgagtgttcactttattctgaaggagtcagattaaccaagtccaaaacttgatttattccattaatgtgaccgcttacatggcaaaatgaccaaaactatcatcagtcactggttctcaaccagggctgataatgctcccctggggagtggtagagatgttagattactgcatttttttggttgtcacaataactaggaactgctactgatttttctaggaaggacaaggctggtaaaaaatgtattcaggccaggttcagtggctcacacctgtaatcccagtactttggaggccgaggcaggtggatcacctgaggttgggagttcgagaccagcctgacaaacatggagaaaccccatctctactaaaaatacaaaattagctgggtgtggtggtgcatgcctgtaatcccagctacttgggaggctgaggcaggagaattgcttgaacctgggaggtggaggttgcagtgagctgagattgtgccactgcagtccagcctgggcaacaagagcgaaactccatctcatgaaaaaacaacaacaacaaaaaaaaactgtattcagtgcaagtcctacaccacaaggaactgtccttgctcaagcccccagaatgccaggcgcacccccgtgagaaagacaacatctttccttctgtggcttcaaagagagactcttttctcggagtgtcatgatggaaaaaacaggggtttacataatgaaaaaatcaactgaattttactagaggtttttttttaagaaaaaaaaaagtttaagttaatacctcagttctatacttcagcttgttaaatgaaataaacggagtggataagaaagagaatatgaaagaccgtagaagacagagctttcctgataattagacagaggtgaggacccagggaatgaacaaaagttcaggaagaaaggacagctacagagaagggtgaggagagacacagaaaggtggctacacacccacaccgacacaaagactcacatcttagtggcccaaacccccatcgcgcaatcttttagcgtggtactgcctctaaagatacaagatctttttgagtattcacaggtagagcctcataagccagactatcccctatgtgacaatcaagccacaagttggataaaacgttttaaagagtttcaaccttggcaatggaccgcagtgtggcaagtatttaggcttctcttctagttatcaatccccaacaaccagcgtaacatcacagctccaacctgaattttggtgacaaatgtacagaagcaaatgtgaaacctctatgagggccttttctttaacattaaaatgtttcgtatctgaaacttagaagaatgtaaacttgtttttcagttctgcttgcatttgccttcactgtcacatcacttcaaaatgttttcttctgcagtattagccggcactgttatcacaaccatcactcgcgatgggagtttgcacgccacagtctcgatcatcaacatctacaaagagggaaatttggcgattcagcaggcgggcaagaacatgagtgccaggctgactgtcgtctgcaagcagtgccctctcctcagaagaggtgagtagggagaaaactgggtgtctctgagcaagccatggattttccatgccatggttggtctagggaagtaaaatcagggctaatatgttgcccacttcttgcagagcaggaaggcctttggagtcaggcagaattgggctctcatccaagtccttgtaacttgtggcagaagaaggggtagtggacatgatgaacaagtgaaagaagcgtttgaagttgagtcaataggcaacagacacacagagcagtgcagggtggagagattttagactattgcacttaagatgccagtactgtctaggtttaaagaaaaatatccagcagccaacaggaaatgcagacccgaagttcagaagagggaggtatatccgggctagaatcaagatctgggaatcatttgcagagataggactattaagtccatggatgggagtgagtttattgaaagaaattacgaaaaacggaaagttactccagagctagaggcacatgactttttaagaatatgtatttaacaacttataaaagtaacatatgtttcatggtttttaaaaagttgaaataagtaggtaagagtatgtttaaaagtgaaacccttttcctttccttagaagtactctaaaaagttccttccagccagacacagtagctcatgcctgtaatcccagcactttgggaggccgaggtgggaggattgcttgagcccagaagttcgagatcaggctgggtgatgtagtgagaccctatttctataaaaaaaaaaaaaatttaagttccttccagaaagtttctatccacataaagcatgggcatatacacttatggaatcatatcacacacaagttctgcaatttttcccctacataagctctaacatctttccacacatacacacagagagagagagagagaaagagagagaaagatacagaatatccacttcaagaaagctttactgtcccagcactttaggaggctgagatgggaggattgcttcagcctgagttcgagaccagcctgggcaacatagtgagacctctgctctactaaaaataaaaaaatttagccgggtgtggtggtgcgcacctgtggtcccagctactcgtgaggctgaagcaagaggatgccttgaacctaagaggtcgagtctgcagtgagtcatgatcacactgctgcactccagcctgggtggcagagcaagactgtctaaaaaaagaaaaaaatttaaaaataaagcaagctttactgtgaattcagattgttcagaaaagtcaggaggctagtagcctcatgttgagtctctggagagaatcacaaaggctctgtaaaagagaaacatttctttccagaactgccaggagcagcagatactgcacctcaagattctataaggtctcataatgctgctagcacttcagccttgaggcagcattacctgcccagactctcaggctctcacagaccactgtgatgacaaggtccacccacacaggaaaatgcaagagaaaaaggacacattttctctatgacacaccaggggaaaggggaactaaaggaggaattaacccatacctttttttctgatttatttctgaggtaatataaatattcagagttacccaacacctcaggccccagtctaggcctaacttagccagtcacaccaatgtataaaaacatagtataaccaatataagtactcttgacaccgatgttttgcaagaaactgtacaaatgcaagtagtatatgatccatctatgccctcaagaagcttgcgtagcatacatgtttgagatgttgattaaagttcaagacaacagcaacataagagagtggatcattggttgccaaatgccaggaaaatccagacacatgatgggactgagaagccatctgaggatggcccatcatggagccctggaggcccctcgaggaaggagagtctttcacgttaacgcggtgcattcttcatagcaggcatttgaaaccacaacagacctacagcactgcagagcgggacatggctgatctaaccactcagtccagcttcctggtgttagcgtagctgaaataccttactagttgaatttggctttttgccgatgagagtcttaaaacagattttatcatccaggcacaatggcgtgtgcctgtagtcccagctactttggagtctgaggcaggagaatcgcttaagttcagtagtttaagaccagcctggggaacatggcaagacccccatctctaaaaagcaaaaacaagaaacccagattttatcgtggatggaatacatgtataatcttaccatttgcagaagagaacatttatctagaggtaacttacagtctaagttgtttcacacatgatacatagagaaaaagattaatttctgtattctctttctttaggtctaaattacattattatgggccaagtaggtgaagatgggcgaggcaaaatcatgccaaacagctttatcatgatgttcaagaccaagaatcagaagctcctggatgccttaaaaaataagcaatgttaacagtgaactgtgtccatttaagctgtattctgccattgcctttgaaagatctatgttctctcagtagaaaaaaaaatacttataaaattacatattctgaaagaggattccgaaagatgggactggttgactcttcacatgatggaggtatgaggcctccgagatagctgagggaagttctttgcctgctgtcagaggagcagctatctgattggaaacctgccgacttagtgcggtgataggaagctaaaagtgtcaagcgttgacagcttggaagcgtttatttatacatctctgtaaaaggatattttagaattgagttgtgtgaagatgtcaaaaaaagattttagaagtgcaatatttatagtgttatttgtttcaccttcaagcctttgccctgaggtgttacaatcttgtcttgcgttttctaaatcaatgcttaataaaatatttttaaaggattac

SEQ ID NO: 38521 - DNA, 34320 bp, Homo sapiens
cggtccgttgttcatttgccattcgacctccgccagggcctggtcggacggaaacgctccgccggctttattgtcgcttcgttatgtggcggagccgagcagtttagcgtgcctctcaccctcagcgcctgcgaagccggcggcggcgtcgggactcctcggcgcgcggaggaaggatatctgtgtggaggatcggtgtgtgcgcgcgcggctttaaagagggggcagcggagggtctccccgcactccgctgctcaacttcgaaggcctcgctcgctgcaggctcgctcctcacctctccgccgcccgcccccttctccgcgcgggacgctgcccggagcgcggcggggcgggggtggaggacgagagagcggtcggaggcgtcggcccggcagcggcagcggcagcggacgcgtgcagcagacccgggagcgagcgcgagccgggctgccgggcgagagggcgaggccgagccccgcgagaccggaacgccgggggcgggggcgagacagagggggagccgcggggagcgcgcgggacgcggcccgaggccgtgcgcgagccggggcaccgggcggcggcggcggcggcgcgcgccatgtcgttcagtgaaatgaaccgcaggacgctggcgttccgaggaggcgggttggtcaccgctagcggcggcggctccacgaacaataacgctggcggggaggcctcagcttggcctccgcagccccagccgagacagcccccgccgccagcgccgcccgcgcttcagccgcctaatgggcggggggccgacgaggaagtggaattggagggcctggagccccaagacctggaggcctccgccgggccggccgccggcgccgccgaggaagccaaggagttgctgctcccccaagacgcgggcggccccacctcgcttggcggtggcgcggggggccccctgctagcggaaaggaaccgtcggactctggccttccgaggcggcggcggcgggggtctcggcaacaatggcagtagccgcggccgccccgagacctcggtgtggcccttgaggcatttcaatgggcgagggccggcgactgtggatctggagctggacgcgctggaggggaaggagttgatgcaggacggcgcgtccctgagcgacagcaccgaggacgaggaggagggggcgagcctgggcgacggcagcggggcggaaggcggcagctgcagcagcagcaggcggtcgggcggcgatggcggggacgaagtggagggcagcggtgtgggagctggcgaaggagagactgtccagcacttcccgctcgcgcggcccaagtctctaatgcagaagctccaatgctccttccagacctcctggctcaaggactttccctggctgcgctattccaaggatactggtcttatgtcttgcggctggtgccaaaagacccctgcagatgggggaagcgtggaccttcccccagtggggcatgatgagctttcgcgagggacccgcaactacaagaaaaccctcctcctgaggcaccacgtctctaccgagcacaaactccacgaagccaacgcccaggtacagtatatcctgctcctacttttttgagatcttttagggaaaggtttatcagcactcccttcacccccacccacccccgaaaaaaaacctcaaaaccattttcctgggtgaagacatcgttccagttgagaggtgcgggaagcttaggcgtgggggtttagaaagcctgggaacaagttttataaaagttctgtatgtgttgtggggggaaggggatggaatgacaattgtcgtggcgctggattttcttttttatgactcatttcttatcagattgaatcaaaaagaaagtgaggttgaaggttttaacctaaaaggctgactttgcggtaaaaaaattttattagctgtgattttagagaagctggtctatgctcacagacgtttagtgtgctggtcgaagtcaaatcgggcaactctttgaagaatggattaaacagtttacctttaaggctacccctttcaggaaaacgtccagccgaaaaaattctttatatgaaatcaaaataatgtcaagtatgagagcagtatgtaaatgtagagaatgctatttggaattccttgctcttgtgaataattttactaaattaatctctgttgaactttcttactacggcttggttttggtaaattattgtagtttttacttgtttacttttactcagatttttgtgctgagatttctttttgtactgttccttttcagaaagatttttaaatgcagtttccaataagtactttaagcttagcattagaaatgtttaatgtgtagttatttgtatcaagtagtggatttggattggtagggaatttatttaccaaacaccgtgaaagtgcttacaaaacaagtaagctgtattttagttcttagtccttgttttaacatttccagtctaaagatagtaagccttactattttgataatctgtgttcaagccaaacagatgttgatcagtcctcctttttgactttaaggcaacctgtggtggtggatggaattcattctttcgtattggttagccagtcgttgattttataaagttagctcttagtattctgtttattggaatgattctgccgttcagcacacttaccctggggttaattaggcgcaccagtaaccccacagacacagcacccatgtttctcagaagttagggctttaactttaaagcacagggtgatcccccgcccccgccccagtggacaatgtagtagggtttttgttgttgttttgcacacattttagttgcctaagccctagaaggaaggtcatttaaagatacaaggccgagaaaggttaagtaaatagtcctaagagtctggggtgacccaactgagactagagcctgtaaggaatgtcgtaatggaaaaagaatggatttggagtaaatctgggttcagatctcagctttctgcaattaactagctttgtgagcttgggcaatagagtgaaatggaactaacagctcctggttttccgtgtgccaaacacatttattctgcaaagtatttattttttgttcccattttacagaagaggaatctaaagccttaaagggttaagtaacattcctgaagttatgtagtaagatgatggagttgcaagggacttgtgaaaatgaaagtttaattttccaaatagggctatgttggttacttagaaaattttaaatgggatgaattttcttaatcggctgtggaccaattcctctttatcagcatagtctctccctgtaggcaaatctgaatgggaatgcaaattataattagctcctttagtgaacctgaaatcagaagaaggggcattaattggataaccttaaggtagcctcagcttgagtgtattcttctcctctgggtatgtatctgcgtcttggaattcctaggaaaaacctttctaaacttgacccgaactacgactctcttcctcatcactcctttaaattcccccatcaatgtaatctgcaggccatctcctttctttgggacattctatacaatatacatatattaagggctacagttttagtaagtcctgtgtgtcctaaggttatatattggtctccttgattggattttgggtgttttcactttgaattgatcttaatcatttattactttcattataactaatcttgaggggatatcttgttatcaaccccccaggtaccacctatataaatacctgtttgtcttaacatgagtaacatgagtaacaggttcctgatctcttttgggcagagtgcaatcattttgtttttcgtttttcttcagtctccaattacctataggaggcagtataacacaacacgtaatgtaagcgcctacttgggcttaaggtcagaggactttgctcttaaatctctactttttaggcaggcaaattagttaacttctagtttcgttatgtatgcaaagtatatgtgccagcataaaaccacttagtgccgttatttattatcattattacctttttgttttgtttttttgagacagtgactctattgcccaggctggagtgcagtggtgagataaaggctcactgcagcctcctgggctcaggcatcctcccgagtagctagaactacaggtgcgcgccaccattcctggctaatttttaagttttttgttgaaacgggagtctcgctatgttgcccaggctggtctcaaccttttgggctcaagcaattctcccaccttgacctccccaaaatgctgggattacaggtgtgagccactgagcctggccgttattactcattttgatcaccaatcagttctcctttttataccttcagagactttgtggccatcaggttctttgaacattctgagcctatttctcatacatgcagtttttctcagcttcacaaagacactcttaatatcttgtcttaaaaacatggaaatgagagttttagaattctttaggcaagaaatcactttgagtctaggagtactaaactcctattttcccaattatttctcaaagagtcccgtttctgagaggaatttggccacatcttaacacagtcatgtactgcatgacgttctcaaggatggactgcatttatgataatggtcccataagattatagcggagctgaaaaattactatcgcctggtgatagcgtaaagttgtagcgtactttgttttgtaatcccagcactttgcggggccgaggtgggtgaatcacttgaggtcaggagttcgagaccagcctgaccaacatggtgagaccctgtctgtacttagtgtagcctaagtgtacggtgctcataaaatctacagcagtgtatggtaatgtcctaggcctttcattcagtcaccactcactgactcacccagagcagcttccaggtatgccagctctgttcatggtgagtgccctataaggtgtgccatatttttactgtacctttttcatgtttagatagattagatacacaaatactattgtgttacagttgcctaaagtattccttacagtaacatagtgtacagatttgtagtctgggagcaataggcccaaccatatagcctaggtgtgtagtaggttataccatctaggtttgtgtacgctaaggcacagtgacaaaatcgatgcatctctcagatcatatccctctcgttaagtgatgcataactgtatgtcatgaaaggttactttcctctaagtaagaaaagtatctttttgttaatcccttggtagttaccaaaaagttaatccttctgttaattggaccttggttattgtggactgttcatgggaaagtcttttaaaacatgctttctgagtctgtgttttgagccttctatttccgaggtgtccctgtatttataaggatgtgagggacaattaatagtttaattttgagtaacaattgactacatcgtcagagtcaggtttaatgattagctcattcagtatctgaccatttggcccagaagactttaaaattccttaataacagtgattaccagttattcttggtttagaccactttctacctaattgtgaaattttcatagcctaaatcacacatcctgtcaactcttcctgggagaaacatgcatccaaatgtattattgttgtaaatttagttaacctttacagaaactaagtaatgaattcagaccagtgatctgattgaaatttccagttggaatatattgatgtcagtagctgagcaaacaaaagaatgtaaggcagatctatcagcctaatttgtttatggcagaaataagggcggaaggttggttggttggttacttggttggtttttaacactttaggaagaaagtctgaaagacctttcactgaggaaaaatcgattagagttgagcctgtagcccattaaattccgttgtttcttatttatatattttacattatttataatttattctttgtgttttattcagtaacagctagttcatagcccttgtgcttttcaaacttgttagcagtgtctgactgtataccttattgtgtacctaggattagcttccttctccatcttaaatttagctgtattaggttggcaaagcactggagataaaaatctgtatgttttgttaacattcattctctctgccctcaaggaacttgtagtttagtaaggagagacagacatgaccgaaaaaagacacagataacatggtagcagtatataatcagggtacattgaagaatttttttttttttgagatggggtctcacttgtcacccaggctggagtgcagtggtgtgatctgggctcactgcaacctccgcctcctgggttcaagtgattcttctgcctcaacctcctgattagctgggactacaggcacatgccaccatgctaggctaatttttgtatttctagtagagacggggtttcagtatgttggccaggatagtctctatctcctgatctcgtgatctgcccacctcggcctccgagagtgctgggattacaggcgtgagtcacgcacccggcctgaagattcttaagggagtgatcagttctacctgcaaaggttggaagaagcttgtacaactgattcttgaattttaattgcatttaattaataggtgttgaccaggatggggagggcatttaggcagtgcaattagaaacagcctaaggaggagccaggcgcagtgagtggttcatgcctgtaatcccagcactttgggaggccgaggtgggtggatcacttgaggtcaggacttcgagaccagcctggccaacatggtgaaaccccgtctctactgaaaatacaaaaataagccaggcgtggtggcaggtgcctgtaatcccagctacttgggaggctgaggcaggagaatcacttgaacctagcaggcaccccactgcactccaactggggcgacaagcaagactgtgcctcaaaacgcgcgcgcgcgcgcacacacacacacacacacacacacacacacacacacagcctgaggaaagtgaagaatggtatcttagagaagggagagtttggttgctgtgcaggatgaaaaatcaagtttgaatagatagactggaggtcatggaggatctcttgtcatgctgaaaacattaaattttattgtcttaacaaatgggcaacaatagcagttttaagcaggggagaatcattatcaaatgtgtatgtgtttcaatctagaggcacctgcgtagtgtgtatgtgggtttagagtttgaggagagaactggttggcaggatgttataataacctgaataggccgggcgcggtggctcaggcctgtaatcccagcacttcgggaggccgagggggatggatcatctgaggtcgggagttcgagaccaacctgaccaacatggagaaaccccgtctctaatttaaaaacaaaacaaaaaaaaaaaaccgagccgggcgtggtggcgcatgcctgtaatcccagctactcgggaggctgaggcaggagaatcgcttcaacgcagaaggcagaggttgtggtgagccgagatcgcgcccttgtgcttggacaacaagagcgaaacttcgtctcaaaaataaaaaataaaaaataacctgaataaccatcgtctgtctgctccctaacactcacaggattagaatttctggggatagtacttaagctaccaaagaggatgccatcactcagagatatagaggtgatcagaaaactgcaaaagagaccttcttgtctttttctctaccaactgttatgatttgtcattgccactagcatgtatttggcaaaacttgctatggccttgtttgtcttccttctataaaatgaatttgttctaaaatttggaaatagaaattactgtttttgttctttcagtatattccagtgggttgctgcagagtaatatttttatgttttcaatgcttttagtttacacttaaatgtttgtgttggaaatgtcttttctgctaattcagttattggaaaagggctgtaattgagtagggtagtaaatactaattgcttgtttctttaactgaataacattttcctattgttaacggattgactacaggtgtgctgtttgactttctattacttgtaactgaagttagcctctcttcctctacccccgcaaaagtgtaggagactgggtgatggtcttgtattctctacaagttggtggcgttgtttaggccccaagctggaatgctgatgaccctatgattctctccctccaccctttacatctgttttatcatgcaagttctgatgatttttagactatttttctaggctctgcttcacacctcattgacacctatcttccctaattaaggtcttttttttctggcatgtatgttgccctattaacagtagctttccagagggtacatggctcacacctgtaaacttagcactctgggaggccaaagcaggaggattgcttgagcccaggagtttgagacaagcctgggcaacacagggagactcttatctctacaaaaatttaaaaaaataaaataactgggcgtggtggcacacatcttatagtcccagctacttgggagactgagacaggaggatcccttgaacccaggaggttgagggtacaataagccatgatctaaccactgcactccagcctgggtgacagagtgacactgtctcaaaaaaaaaaaaaaaaaaaggaaaaatagctttccaactgatcacagtatctgcagtcttcattccctgataataaatctccaccttgctgccataggcatctctcctctttgctatttcgattatatcactgcttctgaaaactctgtaaggtgcctatagcaatggttctaatatttgggagggagaaggggattcaaatctctctctctctttttttttttttttaaggagatagggtttctctatgttgactgggctggtcttgaactcctggctaccagccatcctgtcgccttccaaagtgctgagattacatggcgctcttgtcaaaatggatggacatttacctctgaaatgtgcccaagtgcatatttgcattccgtagggctttttagaaaatcacattgaagttcttttacaaatcttaacttttgaggatgctatagaccatcttatgtttttttaaaatgctgggtttttgttttgttgttttttttttttttaaatgccgtcgcatttacttgaagtgctcatccacccatcccactcttggatcctttaaagctctgctcaggtcttgtttcttcgaaaaagcatccccacactttaaaaacaaaaaactggattagatacacatgctttctgctcttataacaccttaagagtcttacccactaacagtaacttcaaattagcaactgaatcattttgcttcctagtgtagaccctggccaaagtaggtattcatttaatgtttattaaataaatatgtaaagttaggacttttcaagcattttcctttgagtaaaatatttactattttgtagcctatgttctggaaatattgaacatctagataataggttataaggattttaactaactggacacttacctatattttctaaattttggaagacttgatattgaggtctcatccagactaaagttttactaaatggcatctttacaaataaaaaaattcaagatttcatatttagctctgaatgtctgtttctttaaaatctccttgtttagccagtttagactaatgtctgagctaattgtgttttcctttttgggagagaggttagaaaaggtcactacatttgaaaagaccagttgtggaaatagtaattttttttaacttatcagtgatatctgatgttatcagtatactaaaagtggacatagaacgttaaagaaggaaccaaagaggcaaagatacctggagttattagggacctattttgagattttgtctctggcactaagaatttattaatttattgagtttagcaaatgatattggcagtttattttagtgctttgtgcttatttagctctttaacccaaatcctctaataatgatctccttagagagtacacatactcttggaaatgattcattttttttgaaggtcatatttatttatgtggtttcttttttttttttttttgaagggcatatttaatagctgctgcaaacatatggaatagtgctttaatcagtggtgaacaagaaattgctgttgttggttataaaaacaagggacattaatgttcttgttcttgtaccatagtaatgagaaaaaaaaatagtggttgaatggtgtttaatttgtacagtttgtgtcaaagtagaatgggcagatattttggtggataggcttttgtcttagttataaaaattaggacatttggtatgataaaggcagagaatcttaacaattggcactggcccagaaaattcagggtgcagtgaccatagcgtgttatgactgctacagtaggcatagccacctcctgaagtgttttcaactgcttgatatacggactttaggcagttcttgacttgtacatgctaattcactgcttccacaaacagttcatagatatatgctgccagatatttagtgttgaaaacttttgcttcttccaaatattcatacaatattcatgcttttactataatatatagtagattgaacactgaaccaaatgagcttgggttcaggtacagcttgtgtaacaaagcttttagtgttgggcctgtatcaaagcaagattcttcccccttatttgtaatttctatagagagcataggcaaattaataaaatttactcagtctcaaaagggaaaccaagtaaacagaatgatgcttttgtggaaagttacactgtccaagtaattgttacaggtgtttttagtatcattctttacattttcacacaagtcctaaattgttcattcctctttgctacatgatacgaaatttcacaacatactggttttttttttcttttaaccaaatatttgcagtaatccaatacaacatactggtttaatacaagagcttaggttaaataagtctcattattaccttatttcctttctccagttccccaaaaacaaaaataagggtattactcatgaatggacttgttttgattcctctatccgtgacttaacagtttttgcagaattggatcttttggtaggaggagaaaatagctaatttagagcatggaacattattatatggtgggggggggcatgggtgggagttttttggtataagggctttatgcacttggcacaagaagggtatgggaaggttgccaaggatcagtcaaaaatgaggaaatttctctactttgtgtgcttcattctgtagtgatcatatactccagattcgtagagtttttcatactattccattttcacagtgaaacagttgaagtgtgtcctggaatctttttttttttttttttttttttgagacaggtctcagtctgttgcccagactggagtgcagtggcatgatcttggctcaccacaacctctgcctcagcctcccaagtagctgacattacaggcgtgccccactactgcccagctaatgtttgtatttttagtagagacggggtttcaccacattggccaggctggtcttgaactcctgacctcaaatgatctacccacctcagcctttcagtgctgggattacaggcgtgagccaccatgcctggccatgtcctggaatattatttgggttctttcagttgacttctcatacctgggagcagcactataatttttagatggactgggttagtttcagagaattgagatgacagcgtctgtggcctcctgtgacatgcacccaagtaaagctaaaatttttatgatttagccatgcacatgattgcattaagtcatgtttcgtgattgtttagggatccaccatttaggatattgtttgtgagactacttttgcagtctcgtcatctctacaccactaactctcttctaagcatgtcagtactttgagcctgtttacactctagtgtttatttctccatgtttttctccatgctcgtaaaatcatagatccatacatatgtgtatatattttattattttatagaaatggtctatgtttaacttaatattttgtgccaaagaattgacacttgaataaggtcagtattttcagttatcttttctactagaaatggtctaagcaatttttctcttgggaaagagatgattacttcatttgtttagcaaagtgtggcaggcactaatcaaagtgctggagggatattcagctctgccttgagggagcttacccacctagtcactgtatgaggaaagtcataaagttttaactaacatttgtaatactgacttatcgtttaaggaaaaggctcagggatagtgactttccaaggacacgcagttaatggctgatacagacagcattctgaattctggatcatacttttattcttacgattatatcacataattttaattgtgacgccaagtagaactataatgaatacctgtatgataagaagcaaaatttataaacatttagaattttgaattcaggaattttaatttaccttacagtttatagtacttatgaccctaaagagataaagcgttttgaaagttgataggaaattatataactagatattcctatagttgaagcaaattttccccttagggtcttacctttatctctagttagatttaattaacttcattgacctaaactgtttgattttaatgtttgccaagacttaaaatttacctttttattaatggtagatagggtgatatgcctagcataaaatataacttggatattttaagttcaatcgggggagactgttgcttttctatagagataaagcaaacatttaattcctataagagaaagtttcttttcttaagaaaataattgctctttttaattttaattttaagaaattctcaattcatgttcttagcttatatttgaaacatataacatgatgaatgttatttttaaaatgaaaccctgctgatcttcagtcagatgtgtttgatttttttcttttttaataatagcagtgggttgcaccaccactgttcactccatttcttgattactcacaaattaatatatttgattatcgctttttaaaaacttgataattgttttccttggtttgggagtttttaaaaaagtcaataaagtttaatattaatgttttttatccaattacaggagtcagaaataccatcagaggaggggtactgtgactttaatagtaggccaaatgagaactcttattgctatcaacttctgcgacaactaaatgaacagagaaagaaaggtattctttgtgatgtcagcattgtggtaagcggaaaaatcttcaaagctcataagaacatcctggttgcaggcagccgtttctttaagactttatattgcttttcaaacaaagaaagccctaaccaaaacaatactacccacttagatattgctgcagttcaaggtttttcagtcatcttggacttcttgtattctggtaacctggtgctcacaagccaaaatgccattgaagttatgaccgtggccagctatcttcaaatgagtgaagttgttcaaacttgccgaaatttcattaaagatgccttaaatataagcattaaatcagaagctccagagtctgtagttgtggactataataatagaaaaccagttaatagagatggtctgtcttcatcacgggatcaaaaaattgccagtttttgggcaacacggaatcttaccaatttggcaagtaatgtaaagattgaaaatgatggttgtaatgtcgacgagggccaaatagaaaactaccaaatgaatgacagtagttgggtccaggatggatctcctgaaatggctgaaaatgaatctgaaggtcaaacaaaagtgtttatttggaataatatgggctcccagggaattcaagagactggcaaaacaaggaggaaaaaccaaactacaaaaagatttatttataatattccacctaataatgaaacgaatttagaagattgctcagtaatgcagccacctgttgcctatccagaagaaaatacactactcatcaaggaagaaccaggtaaatattatctatacaaggatacttccttgttcatcctaattctagttggatataatcttgaagtatatttttaattgaattattttagttataaagtaatactaaagttgtttacaaaagaagggggaacgtcattcaaatgcataacatatttggtatattttctttgtcttttttcaacacatatatatgtgggtttatcaaaagatgtattaatagccaggtattgcatatattgtcaaggaacgtggactctgctgcatgtacgggtctttgactttcctcatttttagcctctgtgctcactattttatacccagtgttgggaaagatagaatctttagttgtaatatataatcactgtcgtttcagagacccccttaaccttttttattttatttttggctgttaaaacatatttaagtgtttcaaagaattttgccaattatgagattatggtattctagtttgtttagggctactgttcttctgttattttttgtttatttatttttttgagtcggagtctcactctatagcccaggctggagtctcactgcaaactccgcctcccaggttcaaacgattctcctgcctcagcctcctgagtagctgggactgcaggtgcgtgccaccacacccagctaattttgtatttttagtagagatggggtttcaccatgttgtccaggctggtatggaacccctgacctcaggtgatctgcttgcctcggcctcccaaagtgctgggattacagacatgagccaccacacctggcctagagcaggtactgttctgttctcaccatagaagctattttgtttgtccactgtcacctgattttcattcacctttgcattcattgcaaagcctctgaggcctttctcttcaatatatttctctccaaaagttccgtaggaatcttagagaatcacatttacagtgggaatttttttaaaacgagaagaccattgttaagtctttagtttaatctggctgtgcatatctttatttgaagaagctcagtgggtttgaggtttcctatgcatgcctgaggcttgtccaccactgtcatacattatttaatgcttgtttttttcacttcaaagcactgtaactgttcagtgtctgatttatacgatggtggtcatctgaggatggagtattttctgttaaaggaatcactgtttttagttgccagagggcaaaatgccatagtaatcctgtgaaatgttcctctggctttttagatttgggttagctttcagtgataggaattttgtgtatgtatgtgtgtgtgtgtgtgtgaaatttttactgtgtgaaaaatcaagtgtgtatatataacgaatactatatatctttttccttgtactttatatcaagttttaacaataaaatccctgagacaatttagttaaatgaagtattaagggtagatagactccttagctagcactttgttttgtcttaatgtagaagaccttgacagatttctcattagagctacgttgtctttgtgctgtatggattatttctgtttaacagtatggtgggaaccctgtagtgtttttaaatacacacacttttccttaaaggaataaataacatcttttgggtgtagcggttgtttgatggtaactagtcagcagtaacctcatttaaaaaattaatgccacatataattggagtgatttaaagaaaagcattaataatgaaccacaatgcatactttcaaagatgacattactagcaatttttatcaagtatctcctagccatggttgtgttaatggactagttctattataaattaattggtggtctaatatgctttatctcttacatctgttttgtttgtttgtttttaaacggagtctcactctgttgcccaggctggagtgcagtggcacagtcttggttcactgcaaccactgcctcctgggttcaagcgattctcctacctcagcctcccaagtagctgggattacaggcacatgccaccacacctggctaatttttttattattactagagacgggggtctcaccatgttggccaagctggtctcgaactcgtgacctcaagtccacccaccttggcctcccaacatgttgggattacatgggtgagccaccgtgcccagccgtctcttaaaaaggattattttcatttcattgataccagtttggtatccgaaccttgcttaactcacaaatttggttctatccatgccaccagtgttatttggtggaaaaaataaatgggtctcaaaagagcattatggttagggtatataatatgatatagaaccaaggactggtaaatttttactgtaaagggctaaaacagtaaaaaaaaaaaagactttcacctttgttggtcataaaagtcagctcatcaactctgccacttgtgacatgaaagcagtcatttgtactatgtaaacaaatgaaggtaggtgtgttccagtaaaacttgccaacccttcgtatatagcagtggttcttaatcatgggtatgcacgttggtatcacttgggagcattacatgccgtaaagggtctctcttctgtggattccaatttaattggtatggaatgtggtttggatgtggaattttttttaaagttctacaggtaattttatgagttaaggctgagatcagcaaatattactatattggaaagagcctaaattgagtcaaacataatgaatttaaaatttaaaaataagctgtgccacctaccccctgtagtccatgatcaaattaagctcttgtcctcagtttcctcattaaaatattgtgttgattttatagaattattatgaaaatgaagtgacaaatatgaaataactcttggtcatggcaatcctccttaaacttggaaaagactattgaggttattcatatcagttttccggtgctgtgtactttctaccaaatgccagatagatggtcttagcctcagcttgattttttgactgcttgtaaagacttccctaagcagcttccagtgtaggatgactgattattaggtagtcattttaaatgtagccaaaatttgcttctctataacttcctaattctgtcgttgggaatagtgtaatttattatttatttatttatttatttatttatgttttttgagagacagagtctccctgtgtcaccaaggctggagtgcagttgcatgattttggctcactgaaacctccgcctcccagattcaagcgttctcctgcctcagcttcccaggtagctgggactactggcgtgcaccactgcacccagctaatttttgtattttgtatttttagtagagggtttcactatatgttggccaggctggtctcaaaaactcctgaccacaagtgatctgcccactttggcctcccaaagtgctgggaatacaggcgtgagccactgcgctctgcctggaatagtataatttaaacctaacctaattcctctaatctacctgataacccttcaaatgttagacgtttaaagagtcctgtttttgtaggctatgtgctcttctgcccatcttgtgatgaatacacacaatttactctttccaggcaagttctgaccaatatagaacatagcctgtgtttaccaacgttaaggccttcccaaggtcattcagctagtaagagtagaaagaggcaggttgcatatttaggactatgctgcatgaaaaccttgaaattaactactaaagtagtagattcctatcttttttaaaaaattagttccttttaactttaaaatatttttatgatccccttcatcattagttatgctttaatttccatttattgagaaaacagttgtccatgaaataaatgcttttaaataaatttgaagttctatagcaaacatctgaaaagtcttagtgaattgttcaatctgcaaacaatgcttggcatgtttggatttggcgggggtctcttctagttactgtgtcttccctcaggtcttcagcacagagtttgtaagatacagttctaataacgctgtcttgtataatgttgaagcttttgtttgggtgccttttaaagattgagataagaaggtgtacccatagctgcagggtttttattcagatggtatttttttatcttgaaattaacatatttgttgtttgactcactacagagtcatatttgttgtttgacttcacttcagatcatttcttttacacaagaatactttgaaggtagaactcagaaaagttagaaatttctgtcctaagagaatatgcacatactgggattatggaataattaaaactgtcagcaaaaactaaaatctgggtaatcaaataagggtaaaaatgatgtcgtgagtgaattgctctgataatgtaaaaatttcaaaatccttgtcttgctgatttgcaaccaggaaacattaaattttagccaaataaagtagataacctgagattagaaattgaattacagaagtacagataactagtgcctaaatttgttttacaacgtgtattcacacatgttgtgtcccgtttaactagaacaagtcaggtgttaatctgattttttaaaatcactttattttgcgggctcatggaacatggttttctgagcctagatttttaaatttatacctgtcatactagcaacttctacctattataaataattttactctgtatgtacgttgcatgcatacataccttattttgaaatgacaaaagaaacaaattagcaaaataaagtaaaattggcaaagaagttaagagtgctcatcatggatataaatgtggttgccctaattaagcttttaattggctctaagatacaaaacagccttactcaaaagagaaaaacataccagttctaccaggatgacaaacttcctggtactgacttctgaaaggaatttctccagtgggatttttttatgtagttgacaccaagtaatataatggacagtttccttagatgttttctagtaaatgcagcagtcgattattatatttttaatctttgccacaagctgatgtagttctatgtaaatgattttttttccttatgccatacgaatactcaaatgtaaggtaattttagttgattaaaagataaagtttagaattcttttaaataacctggaagtttctttcacctagacttatgatggaaaaatagttttgcagcatttttaggtttgcgttaatccttacaagtagagttgaaatcaggtttaagctttgcacttatttgtgtaattgcttttttggtaaaaaagcatacaatttggtactttgaaaactattttgagaaaagaatatccaaactagatagatataagaaatcgtaataaggcatatatttgaggcagagtcttgctctgtcacccaggcggagtgcagtgtcatgatcatggcttacagaaacctcaacctcctgggctcatgtgattctcccgcctcactctcccgcaatcagccacacagagtacttggaactacaggtgggcgtgcaccactatgcctggctaattttttttttttttttttttttttaagtaaaggtgaagtctcgctttgttgccaaggagactggtctcaggctcaagggatcctccagcctcacttcccaaagtgctgggattacagccttgagccactgtgtccagtctaaaatatgtttcaaaaccatgggacatggctttggtgaaggagacttgggctttagattcagttttgccacaatgctagccttgagtgtatcccagacagcctccctaatgggaaagaagtaaaatttctaccttaaaattctgaaatcttaatagttctgaggacccaaagctttttcttaatcattttggcaacaaatcagctatttatatttttttacttccttaaatgtgaatattcatgggttttttttctttttttcttttttctttttttgagatagagtttcactcttgttgcccaggctggagtgcagtggcgtgatcttggctcactgcaacctcacctccagggctcaagcaattctcctgcctcagcctcccgagtagctgggattacaggcatgtgccaccatgtctggccaattttgtatttttagtagagacgagacgggtttttttcatgttggtgaggctggtcttgaactcctgacctcaggtgatccaccccccccccaacccccgcctcagcctcccaaagcgctgggattgcaggcgtgagccagcacgccctgcaaatattcatgttttattgtataaatattagtgttttgtataaatattcatgttttcattatagggtgctactccagaccccacatggggtgttacagtcatagctataaaatctgaaaaattctgcattctaaatcttaccccaagggtctcacgtaacagatttatggatctgaattagtttttattctcttaggagattccgagtgttttgctaaacctcttaggcatcctatggagtatgctatgaaggatgagatgcaagtcagaatttaatttcatttttcattagcaacttgggggggttctaataattagggggagggtgctgaaggccagatgcttacttatgtatttatttattttattttattaagagacaagatctccctctgaggccgggtgcagtggctcgcgcctgtaatcccagcactttgggaggccgaggcaggtggatcacgagggcaagagatcgagatcatcctggccaacatggtgaaaccccatctctactaaaaatacaaaaattagctgggtgtggtggcgcgcgcctgtaatcccagctactcgggaggctgaggcaggagaatcactttaacccgggaggcagaggttgcagtgagccaagaccatgccactgcactccagctgggtgacagagcgagactcagtctcaaaagaagaaaagaaaaaaaaaacagctgggcacggtggctcacgcctgtaatcccagcactttgggaggccgaggcgggtggttcacaaggtcaggagatcgagaccatcctggctaacacagtgaaaccccgtctctactaaaaatacaaaaaaaaattagccaggcatggtggcgggcacatgtagtcccagctacttggggggctgaggcaggagaatggcttgaacccgggagcagaggttgcagtgagctgagatcgcgccactgcactccagcctggggcacagagccagactccatctcaaaaaaaaaatctccctctgtcacccaggctggagtgcagtgatcatagctcactgcagcctcaaatccctgggctcaagtgatcctcctgcctcagcctcctgagtacctgggcacacctacaggcatgggccaccactcttggctaattttttttagatttttaaaatagagacagggtctcgttatgttgcccacactggtgtccagctcttgggctcaactctcctcctgcctcagcctcccagagtgctggggttgcaggcatgagccactgtacccagccctgatgcttatttttaaaaataaataatagttaatgagttatatgatatactaatgcataagaatcttcagtatttaattttaaaagatggtagtaggcaaccatatggtaggtgaaatagtagtctgccactgtttccccttttgctgtgcttactgttgctttccttccctgtatcatacttgacccaagaagtggctacactgttgattattacctgtaagttagaaactctttaagtggtcagaataaagctgaagagctgaagaagtcttatgtgggtcagttaaggcatttttgtgacttcttcctgctgaaggtgttaagttgtctaaaccatataaatgccagtccctgaaagttttttatagaactgaatttttggtttctgatacagacttaatatatagtagggtgaccagatagtgtaaattttcattcaaagctttactcttcagaaatgttataactttctgggaactccaaaatagctttccacatataataggaaatttggaaacgtttttatttaaaatctaaagacactgagcaataggccacataatgtcaagattgaggagtcccttatgcggaacttattcacaatagggtgactgtggggtagaaacatactcagtgccatgtgataaatgttaaaattagattatttaagatgcatgacggggtgcagtggaacagtcctaactgcccagaggagttgggaaagcttcatagagaaggcagtgtgagtggatcttttgttatgtaggagtttgctaggaggggaagaagagcattcgttgacttgcaagatgggaagaaattggaataagtgggtcgaagaatagaaaaggggtagtgttgtggggacatctccaatttcctactaccttgtctataggtataactagttatttttgtattgtaataaattctgacttgttttacagactctgaagtagtgagtggtttttttaactagagatttgatctgtttatattgcatttaagactaaaaagtttaagagcatttttcatggattggaggtggggcatgtactggggggacctgttagggagaaataacagcactttggaataatgcaaggaagaaacagttgagcctagtctaagtaagatggggcagtcacttgtcaatgagtttgcgagtgaaagggaagctattttgagtttaaaaggctgctacaggaactgtaaagggtggtttatataatacatttgcaactgaatttactctccactgaaaggagaaaactgaagagaaaaaatctatacctgtttatgggggggaaaagcaccaaacacatttacttttagttctgaaactgtcaccgtaagagaaacttgtgctaatatgtgtttatatgaaaatgaaagttgagtagatctgagtctgagtttttatacaacttgtttagctgtttcttaaaacttctttcccagggtcttgtctcatatcttttcaagaatatttgtgttctgagaaaatctggattagtctgcacttgcctaatggttggaatattgagaaccacaagcaaatagtcagggaaacctttccaactcagtcttgtttaatttagcattcacaggcaggtgctgtactactcacttcgcacgtgatttggaagggttgctagcccaccgtgatctaaaattcctgtcatgaccaaggcaccaagattagtcttgtctttaatgataccttgttttgtcttgtactttgctcaatattttcatttactaatatcattggtcatgggcacatttttgggaggtagagactgagatttagaccagtcttttaatcccatctcattctttttccactgttaccagattttcaaaaatctatggtaatattttcatttttttttaggagatagggtcttggtctttcacccatggagggagtgcagtggcatgatcatagcttgctgcagccttgaacttgtgggctcaagcgatcctcctaccttggcttcctcccaaagtgctgggattacagacatgagccattgtacccgtccttccatgaatagtacctctcatgaagatattatttaaaatgcaatacatggttaattagagaagtatataaatgtgaattctaaggaggagattgctttaaagtagacaaaaagtattactgtaaagagcaatgatagctagtaccttggtatccttaagattttggagaatatattgttaaataaagggaaggtaataaagtggatgctggtttaacacagagtggaattaatgtttatttttgttcatttcacaaaaagagcatatcaagtatcagtagcaaagtacgtgtgaatatacttctgcactcgtgttcccagcattgcaaattgtagttttttgattgcctgcttatgtgccaggccctgaggcttggtgcttgtgataaactgtcaggaagcaatgtaatacagttactaaatagtgcagacctctgccactagcttgttatttaacctccctcagccttagtttactcattgataaaaagttgaaagattttactgccggatgcatacaatccatttttgttataggggttgctactatctgttcactgagaaaagacatttttttaaaataggagaaatcctacatggcttgtcatttagctctggtcatttgaatattacataccactcatgtacctgccaccagtcagaaaaatagccgtcattttgtgaaaccagtgtgtgtgtgtgtgtgtgtgtgtgtgtgtgtgtgtgtgttttagacaagtgcagtagtgagaagaggggaaaggaaactaatgtttgaattagtcttcagaaaggatttctgctgtttgcaaagaaatcttagccctttttttgctacctttaaatgaagcataagattcccataggaagatgctggatatcacaaaagcaggtgtattagagtttattttgtaatcttgtaattttagagaaaaagatgatgaccaagagttgctatcatgcttcctaatgaagcaaaattcattcgtgtcaattaagtggttggttgtttggtttctattccattcacatcaacatctctaataatgagttgctaggtggtttggctggttttgaataaggtaagcagtgacgtaatatattggttcctgaaagttaagcacactattgtcaaaagattgtcaacttggaagaactcacctgtttttgagatttgtttttgatatcaagaaccacgtagttggtgcctttcaaaagagacacaagacaaatatacttgatatttattttgtaaggttttggctgaggaggtctatacttgttgtccatgtagaattagaaatcacaaattctaatataatactttagggctagggtaggagataggaaatgcctcttaagagttgaggaaagccttcaacaattcactgtagaattttgcataaatagaaacctgtatttggaaacccacttggcagaattgtaagacatgtccttgaacagactgcatttcagaataatgacttttttaaaaaaagattgagaaatctagtgaaattgaataattgtattttttatttttatttcaattttgttgagacagggtctcactcttgcccaggctgtagtatagtggtgtgattgtagctcactggagccttggactcctgggctcaagccattctcccgcctcagcctcctcagtggctaggactagcacatgcctggccaattttattttttgattattgaaatacatttaactttaagaaaacaaaaccactaaatttcaattaaatattttcagttcatgataggttttagtttaattgtagaccaaaaaaccaaattattcttcagataccatgaattaaaactaaactttgtttagtgatataagttgcaaagggcaagactattcaagccagcatttaactctaatacatatatatcccaaagtgctgggattacaggcttgaagccccaccatgcatggcaaacgatatttttaaaagccttttatttatcatgcattatgataaatactaggaaaatacctaaatagtatcctatctagctattatcctagatacctgaacagtatccccgttcttaaggattgggcaaaggagttctgtatctatttactgttatttaatgtggtaccacattaaataacatttaccacatttaatgtggtaccacattaaatacttgttcattgttctgacttccaacccatttactctaagcaataatgctacattctactaatttcaccttacagagaaaagagaagccaacagcctggtggaatatccttaagttctggctttagctctctctatgtacactgcttgtctctgctgtctctcttaagtacccagacccgtgctcctgtatcacaagactccttaggaatcttacacaatggataattccttctcttcgcagcaatatctttagtattctccctttagtgactccttcctgtcagtattcacatatgtaattttcggccgggtgctgtggttcatgcctgtaatcccagcactttgggaggccaaggcaggaggattgcttgagcccaggcattcaaggccagcctgggcaacatagtgagaccctgtctctacaaaaaattacaaaaattatccaggtgtggtggtgtgcacctgtagtcccagctatctgagaggctgaagtaggagaatcggttgaacctgggaggcagaggttgcagtgagctgagatcgtgccactgcactccagcctgggtgacagagggagaccctgtctccaaaaaaaagtaactttcagtttcttaaaaaagaaaaaaatcagtcgttaccctatttctcacacttcccttttatagctaaatttctcaaaaagattgtcagtattttttcttaattgatcatcatctcttcagaacacagaccactcttattttttctgcttgccccacctactcaccagtatcgctcagtaagattaccagtgacatcctaggtgcttattgaatgaaagtgatgtccatttttagccctcatcttgaattctagggagcattggcaaagtggactacttttcccctaaaagtcttttatatattttttgtaactcattaaatgttaggattattcagtatacttaatcttttctcactgtctcatctgtttcactcccatggttttatttgccatctatattctgtattctgacaaaaactgttttttcttttgagttggggtctcactctgtcaccccaggctggagtgcagtggtgtgatttcagctcactgtagcctctgcctcccggactcaggcggatcctcccacctcagcctcccaagtagctgggactacaggtgtgtgccaccacacttggttaatttttgtattttttgtagaggtgtggtttttccatgttgaccaggctgatctcaaactcctggcctcaagtgatctgcccacctcagcttcctaaagtgctgggattataggcctgagcccccacttccagctaagcagtctagctttaattggtctccacttctgaaccaatgtggatgcaccagcaatgttttatacatctagtacttactagttagtactagcagtattgtttgagcgtcaagtaccataattgtaacacttggcttgttatattatccaattagattcctagatcacatctacgatataggtggatgtaaattagggagaaactaaggcatatggtcacatagcctgtaacagaaacaggagtggcacctaatttaccctggttctacagcccattcctaaccagtacactgtactcactgtacatgtcttaggcttctgtgagccttgtagtattgaacacagtagataattcattacttacagatggtactttttatttaagaaacagttccaagaaagagtggtgttttgggtggtggctatggtgtggtttgtagataaatttttctatgtttccttttcagatttagatggtgctctactctcggggccagatggtgataggaatgtgaatgcaaatttattggctgaagctggcactagtcaagatggaggtgatgctggtaggtacagtaagattttagcaacagtacatttaagattgggaagtgttacatcttacctgcagcctagtgtaatttctcttccataagggggttctattgtatataactactttcaatctatggtagctatgtttatgatgactggaaaattggtaaatgcaaattgatgtttccggttttgtatgtttgacggagtcatttgtttagttttaaaaactcctacatataaaaagtaattgagttaatatggcttatggcttcctgctggtatatagatacggaacggaaatggtaattacgataatggttgaatttattttaattagtttttatgcaaaatgatggtgtagttaatggctatagaaaatgttgattagttctgtgtgatgtcagcagtgcattggaggaagcttgatgaatataaaaacaaagaatccatgagtatgttatgaataaaatagagtaaaagaaagtcattctttacagaagaatgccaagctgatagaagaatgatagaattggaaaaatagctattttgcaatccccacaggaaataattcaaagtcatcagtggatgttaagccaccgttaatgggcttgtccccctatgattgggtgaaagattgttggggaatatcatattcacatggtctcaaattattcccatggattcccatagatgatttccacttgcaaaggggaaaaggtaaatttacaataaggagatctgagaaagattgtcataactaagtgattaaacttagtgccattaaaaagagcacaaaccaaaattaagggctggctgatttgatgtgccacctggcatacaacatttcctatgcagtattcttgagaaactgtttagcttgtatctaatgacaaaggaaaacccagacattgatgtatacgacaggtagtccaaactctaaaatgttaatgttacgacagacaagtggggaaaccactagattgaaggagaccaaggaagtaaactaaagtgcagcatggatcttgattagatcatgggaacaaaaaatggctaaagaggacattttggggccaactggaaattagaatatgtagtgtgtgttaagtgatattcagttaattttaaatttcttatacggtggttatctaggagcatgttctagaagatgcatttaggcttgaagttatgagcatgcatgtttctaaatagtgcatagaaagcatgtatgtgtgtacataaaaacttgacaaaactagtatttgttgaagatagatatggatgtttattgattgtttcaattttattagctttggaattcttttcaaagttggtgagaacagagacagtgaggtacttgttactaagagtagtcgtgggctctgaattcagtatgtactgaccaaaataaaaccacatttctaaagaaactgccttaaggtggtttcccctgactgtttaaaagaatttacaaaacaagttttgaaattagcagtttgtacgtcagatgtcttgaattttaaagatttttttgctcgtacagaaagttgctaaccgcgcaagaagatgttactgcacttgctttctcagttttgaaatctagtccaagaatgggtttaattagggatatttgaattcatatgtaaaattttaaatttgtaaacctttgatatagggttattcctcttaaaggggacatttcgattcattagtatttttgcatctgagatcagcctttgcttgatgattttgatgtcaaaaacttacattgctttttccttagttttctattgtggaataatgtacccagaaggatattattgatcagtaagcaccattttgaagagatctataatgaccttaatgatccttaagtgtattgaattacaatgacagtacctttatttaggccactcttgtaattcctacaagtattctctgttataagaattaggagagatgaaagaaatttggggcaaggtttacttaatttgaattaccattttgtattccagatagagtattcattccttgttatcatggatgttgaatcttggattttcagtttacaaatggttttagggatattcttctgtctcctttttcttttgagatggggtctcactctgtcacccaggctggcctgaatctcatgggctcaagcgatcctcccacagcctctcaaattactgggatgacaggcacgagccactgtgcctggcctatttccttattcttacatgttgtgaataatatttaattgtagatactagaacatctaatgtgtcttttggtactagttttccaagtattttgagcaagtcagaagtatgtattggcatttgctagataacatttattctacaagtaattgtagggcatgtgtcttaaacaatagaaaaaccaaggcaagtaagataggcgcaggagtttgtactgatttagacaagaaatatggatcataaagctcaaactttgtttagagatgtgaaactaacagtaggttgacctccacaggctaccacttccgttccattctttatccctcacacagaaatgcttcactttaggattcttacaacttactcccaaacactaattaggtgcagctataatgagttatagttgaatttatgtagctatgggttcagggggctttctttacatcaaaaaccggtgacggtattccaagtacagcacagtttacagtaatagtaatgatgtgcagttttaaaatattttagagacatttttactttgttgggtattaagactttcaccaaaaaggaatcttaagttatcttaatttttaagagggacagcatgtctgagaacatatatgggaagtgattcttaggaaatccatttgggtaaacattctttacttttaaaaccgtgatgcccatgggaggaaaatgtattattgctgcttgagtgaactgtatcttggcaaggagtgttttaggcagaggaaagcttaagcactttgaattgggagcatgcttattatggacgaggaacagaacagaggtcagtatagttggaatagagtgactgaaaggaaagggtggttggaagccagggctccaccgggtaaagctttggaggatattgaaagtctctagcttttactgtgagggtgggtagtctttgcagccttgtaagctgagtggtgacctgacttaaggtagtgttttaaagaatctgtgatttctctgctgagaacagactctaggaaggcaacagtggaagtagggagacaagtttttggtggctactgaagacagtccaggggctagagctcatgattgattggatcagggtggcaatagttgtggaagattctggatatatattcctattgccaaaaggttcctggtccaaggaattacattaaagatggaattaaatccagtggatataattcctgtccttgctaatctgaagatccttaggcacatgtattattctattttgattctatcttctgcacgttattttatttaaggatggagttagaaagaaatttcagggaaccctgagagcattcagttaccttgccctaatatgtctgaaacaaggatctagtaatagaactttacatttttaattatcctatatatattctttattcttagtctatttttctgtaccaattaatcttaaaattatgtgcctgtcctggattcgtaataaggagaatatcccatttgatagctgggctttagggtgataaaatcttaagtgatagagtagttagaaaaagcaactattaggagttctggtttgaatatacccatcctttaaaagggtaatttcttgtggcgtctgcacaattaaatgatattcatgtttttttctcccgcccgccacctttttttttttttttttttttttttgagacatgatcccactgtgtcgccctggctggagtgcagtggcgcaatcttgaatcactgcaactcccgggctcaaatgatcttccccagtagctgggactgcaggcacacaccaccatgcccagctaatttttaaaatttttttgtagagatggagatggagtttctccatgttgcccaggctggttgcaaactcctgggctcaagtgatccttctgcctcagcctcgcaaagtgctgggattatatgcatgagccactgtgcctggcccatgattaatttttttaactgaatttcttctactatagttgaatggtattttgtttaattgtgataataaagtaggaagacatctcaattttagactaaaatacagttttatttaactcatactatgaaattctatcataatgcctgtaggatataaatataatttctgttttctgactctgatgagagacagatctttattaccattattaattcagaatttttacttgtactaggtacttcacatgatttcaagtatggtttgatgcctggtccttcaaatgatttcaagtatggattgataccaggtacttcaaatgatttcaagtatggattgataccaggtgcttcaaatgatttcaagtatggattattgccagaatcttggccaaaacaagaaacctgggaaaatggcaagtattagtcaactaaacaaatacagaattaattaaataattgttaacaattaaaagctttcatgttctgcattttttaaaaaccaagtagcagtagctccacataattgctgttctcagagatagagataagaagttttgatagcaagttttctgtttaatgtgtaataagcactttctctttttttaattctcataggtgaatcatctctaatcatgaacaagttaaaatgccctcattgtagctatgtagccaaatacagacgaacactaaaaaggcacttgctcattcacacaggagtgagatcatttagctgtgatatttgtggaaaactgtttactcgaagagaacatgtaaaaagacattccctggtaagtaactttaaatacagctgatctttgagataaactatatttatgtcagtgaagtttaaagggatttaaacagttaattgtgaatttaaggaagattgtctcctaaattgctttaaacagtttgactttatgaactgatagtgagctttttacagagaaactggtgtattcactcactattaaatgtgtggtttaatttgagtggttcaaatgcattctattatatataatatccttatattggattttttccccctccaattaggtgcataaaaaggataaaaaatacaaatgtatggtgtgtaagaagatcttcatgttagcagccagtgttggaataagacatggatctcgacgttatggtgtttgtgtagactgtgcagataaatcacagccaggagggcaagaaggtgtagatcagggacaggatacagaattccctcgggatgaagaatacgaggagaatgaagtaggagaagctgatgaagagctagttgatgatggagaagatcagaatgatccctctcgatgggatgaatcaggagaagtttgtatgtctctagatgattaactgacctactatactcctcaaggatgctgcatttggacctaatatgaatcgacaatttggattgttgaacttgaaggcttgcaaaatatggtacatgctggatagtagttatgttgctgtgaaaactgtagggtcaaagccttatagcaaaaaaaatttttttttatatttgcacaggactatacagcaaacaaccatgtggttggattacatggagtccccacatactcagtcagttatcaaagtaaaatattttttatttataggatatacagtaactatttgggtcctatgaaaatagtccttaaagagcttacattcatgtgctactttaacatgaatggagaaaatccgtttatggaagtacagtgacaattgacccaatcactctgtccatcaaaccactcaggctagtttgtactagtagagttttgtttctatttttatttttattaattttattttttttaatacagattttcagtgaggggctttttcaaccccattggttctattttcttgtatttttccatttaatttgcttcataacttaaaccaagtctcttctagtcttaggtattatttctcgattttgtgctgatgggcatgtttataagaactggagaggtaatttattggaatgaactaactgacttcctccattcccctcttcctttttgacatgaattttactacttcacaaatgaagaatgatgttatgaagttaccgtggcgaagttgacaaataccactaaaatgattatgatttagaagtaactttcttctgctgctctaatctgataaatggttactatatgatattttctgacatggtatttggttttgggtatctgttactttggcactattcttgtttgcctctttatttttgccagtgtactatacctcagtcctatttgaaagacctaattgaaagaaaaatcatagaaataagtaaaatgatttgttttataatttatccaccatgtccagtttggttagct

SEQ ID NO: 38522 - DNA, 27040 bp, Homo sapiens
tttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgggccgagggtgaggctgaggaagagagtgacttcgacgtgttccccagttctccccgctgcccgcagctgccaggcggcggcgcccaggtgagaaggggcctgcgttctgcggagggatggagtggtgctgtcgccaaacccctggaatgccgcgtctcccagaccctcttctacgcctttttctacgcccacctcactgccaggggccggggacctgggacctgacgcctgatgccatcccaccccttttatggcatcttcggagggcagacggggtggccatatattaccaacctccacctccacgcacatgttttctttcgccttggctgattcctgttcactcttggaataccttcctccatctccccttcctgacagcactcagatttggggcggctcatgctgtaacattgaccctttgtcctcttgtgagaggttttccccaagcactttattctgttaaaggctctagcatacttgtgcacagttgctaggaacagtgaatgattgtagttcagcatcacactgagtcctgacaaagatttcacatgcgattttcaccgatgttgacaactgagtaaattctttaaatctcgcttttgacgctggcgtacacctctcccattcgcgtgaccatctttgccttactgttttgttttttagttttgcttcacgtcattctccagtgaaaatatatacgcatatacttgtgttttccttcagacttctcttaggttcctggtattgtgttttcaatccagcattcctgccttcctgcgactgaaacgtatccaaatgtgatatactattaaggatttttcagggacctatcttaggggatacttacatactcgcatcaccttgtcctgtttttttctccgaatccgtgtgtgttttggaagtatatttcagaatcacagactaaacactaatatattcaatggatcataagtgtctgccgccttcttgcaaaatggggttcccaagagtgtaacagatttaatagtagttttcctctcaacttattttgctagatgttaatgagaatgagttaaattgcttaccagtaagcgtgacattatcaatcttatgtccagctaacagggttagttggcttcacacagagaaaaatgctgtttcataaccactgtctgtactttggccagctaagtcactggggaactacaagacattttttaggaggacagaatgagagttgatgggtccatcattagtcacccactaattttggatcactagtgtcatctttatatacaaaatgtattataagcacatgatgtgctagggaggaaagaagaatgaacagcagatgccattgtcaattttgaaggcatatgaagagaaaaaagggtgtcaagaatttcagtgcattgtggttgaattacagaagtaatctagagaaatatctgtatgttaatttcttacttgtgcacttctaaatttgtttagctggaagagattttagaagtgagtaagcttatctctctcattaaaagtgttttccctgaggccatgtaactagttagtggccaggttaaaactagaacccacttatgactcctagtccagtatattttcccacctactgcactgcccaccagagttcgagaccagcctgaccaacatggagaaaccctgtctctaccaaaaatacaaaatcagcctggtgtggtggcgcatgcctgtgatcccagctactcgggaggctgaggcaggagaattgttggaggcaaaggttacagtgagccgagatcacaccattgcattccagcctgggcaacaagagcgaaactcttgtctcaaaaaaaaaaattttttttgcaaactgattattaattctgagttcatgtgtttattacaaacctacttattggtcttactggctttaagacttaaatttttggattggaatatttggaaaaaataaaatgtttaattgattaacattttataatcctaaaaaaagctttggcttaattttatcaaataagggggatctagacttcttaatgtagtatgtgatatgtagttcttagatccaattaatgtaaaggcagatcatgtttaatgtccctctaaaacttctgtatggtcatggattagaatgtgacctaatattttatttaatatctgaatacatgttggatagtttgcccaaatggccaaatgttgtctgggtagtttgtggagaaataagacatacattatttttagaatttttcgatttgagaaaagaatatttgctcccaaataatttgaaaatgcaagataatttctatttatccatattaccatattacttttcttgatatattatcctttctctttttttttttttttttttgaggcagtgtcttgctgtgttgcccaggctggagtgcaatggcacgatattggctcaccacagcctccgcctcccaggctcatgtgattctcctgcctcagcctcctgagtagctgggattacaggtgcccaccactgtgcccagctaatttttttttttttttgagatggagtctcgctgtgtcacccaggctggagtgcagtggtgcaatctcggctcactgcaacctctgccattctgggttcatgccattctcctgccttagcctcccaagtagctgggactacaggcacccgccaccatgcccggctaattttttgtatttttagtagagatgaggtttcaccacgttagccaggatggtctcgagctcctcctcgtgatccgcccgcctcggcctcctgaagtgctgggattacaggtgtaagccaccactcccggccatgcccagctaagttttaaaatatttttagtagaaacggggtttcgccatgttggccaagctggtttcgaactcctgacctcaggtaatccgcccgcctcagcctcccaaagtgctgggattacaggcgtgagccactgagcccagccaaaagaagttttatatacaaaagttcttacatcttttcttacaaaataagttatatagcttaatttttctccttttcctggctctgttttaagcatagctagtctacagttattcttgatcctattctaagataactattcttgatcctattctaagataacaaaaagtaaaaataaatattttattttaaaatattatattttatattaaaatattttatattaaaatataatatatatattaaatatatattatatttatatataaaatatattttaaaatatattttaaaatatactttatatattttatatatatattttatttttatatataaaatatattttatatatattttataatatatgaatatatattataaaatatacttagggacatggtttatagtaccttggctccaaacctgctgaatgagtaaataaaacatctgaatagcaagtgtccacatttgtcccagtacaaacgtgagtttgcctgaagactcagctaagaggtagggtccttggttactacttgcctcagaattgtttaccaccaccagtcagtaaacaaataagcatgatattgtatgacaaacaccacaacagaaatatgcataacttgggtcgggagacactgggtcagaaaaagtttagggcatgccagaatctggatgaagataggagtttctgtaggagttacctcgaagaaagaggattgccaaattgaagtgagggacaagggtgggaaagggaagaataagcaaacaagtagaagagcaatgggaactgagtctaaagaggtaatgggaaataacatcacgaagggctttgccacagagtatgtactttatcccaaagctaagaatgaaaaaaaagatcagattcattttttggaaagatcactccagtctagtggagtggagaacggcttgggataagagtctgcatttgtataattcacatgtgaaattataagggcttgaatagtgatgcagatatgggaacagattggagagaaattattctgaagttgatgtacatttgacgaagaactcataaagaatgtgccttcagcttttgttttatagagccaaggaatatagggtattgaatgtctatcacagtactttacatgtagtaattaagtaaataaaagtaattactactgcttcggagtagtacggtcagcagggtagaccattgtcacttttaagaaatgtaactttgtggccaggcgcagtggctcatgcctgtaatcccagcactttgggaggccaaggtgtgtagatcacgaggtcaagagatcaagaccatcttggccaacatggtgaaaccctgtctctactaaaaatacaaaaattagctgggcatggtggcacatgcctgtagtcccaggtacttgggaggctgaggcaggaaaatcacgtaaaccccagaggcagaggttgcagtgaactgagatcgcacctttgcactctagcctggtgacagagcaagactccatcacaaaatatatatatatataatttgcctattttgattaggaataaattaaaggatatctgtctgatataatcagttataaatggaaatatccaataagaacttctcaaatcaccaaggattggaaaaatacagatagaaaatagaaaccaagaaacgattacttctagataaaaggaggtttttttgtagtgaagaatttggagaacaaaattataaaggcctggttgtcagcatgttgagtattgaggtgatgaactagatttaagctttgttctcattattctgcttgttcaggattatgaagactattaattaaacgtttgttaagcactagctttatgcaagacactgtgatagttgccaggctttttgttgctgttagttgtcaggggataggcctaaattaacaaagaagtttagaagttagttgatgaaacaaggactaagatataaaaacatgactgcagacctagaacacaggatatactatataccaaaatattgtacagaaatcctttgaattaagaaaaattgaactgtgctgcacaaacatccattgctttcttcatttcttacaaatattgtttttatccagatgtatagccatggaattgaattggcttgccaaaagcagaaagagtttgtgaagagctctgtggcgtgcaaatggaatcttgctgaagctcaacagaaacttggtagcttagcactgcataattctgagtccttggatcaggagcatgccaaagcacaaacagcagtatcagaactgaggcaacgggaagaagagtggcgacagaaagaagaagctctagtacaaagagagaagatgtgtctgtggagcacggatgccattagcaaggatgtttttaataaggtatgagcttttactgggccataatgaaagaagaaaaactgaagtgtttgtacaaaccagttgtgcgtatttggtagcaaagcagcagaatcccataaacagtgttcaattttgacagtttatgaaaggtgcttgaaaagtttatgaaagtcaaaaagtctcaaagctcttgctgtagagctgcagactccaggcagttaagtgaccagactgaaatacatatttatataaatgtactgctgaacaaatattacatatattaaaaaacattcacaagaatttgatataaggatgggaaaatatatcagttatgaaatattttcctccacatatattttgtaccccctacactgattatcactactttagagttcctttaatgcaactaccttctttttataaatgaagaaactaagtggaaaaataagtagagtgacttgataacttagtggtgggttaaatgtgagaaattcctgactctgggattgagagataagataaagagaagtgttgaatatcctttattaagtgcctttaagaatgaaggcttagacttttaaaatctcatgtttttcaaacttcagggttttatacctcagttttccatttgaaaactagagtttttagcgattgattttcaaatgcatgaaaaggggagaaaaggcaaaacttcatgaactagtattttaaatgtggaataaaatgatatttattgaaaaataggccaggcttagttgtccacacctgtaatcccagcgctttgggaggccaaggcaggcagatcacttaagtccaggagttcaaaaccagtttggttgacatgatgaaaccctgtctctataaaaaatacgaaaattagctgagtatgatggcatgtgcctgtattgccttagtcccagctacttcggaggctgaggcttgaggattacttgaacccaggaggtagaggttgcagtgaaccgagatcgtgccactacactccagcctgggcaacagtgaaacacatctcaaacttcttaattgtcctcttggcatctgctttcacccactctcatgaacttttttaattgcctttccctggaccagctctagttctgctacagcagtcagtaacacacacagataagtgtacatcgccactagccctatcagtactttaacagtgagtcatatctttctcgactttctctgtgcctgtactaatttatatatactttttctccccctccacaatgggatcattctttatctgagtcatttgctatatctgtatatattgttttaaggggtgcatcttgtgttattttctgttctgcatttatatcccaaaactattgaaaataattttttttcttccagaaggaatgttcaaagtaatatttcttgttttgtaaagttaatgtctcttctttaacacagtggtcacaaagaaaatattttcattttgtctctgcttttaattatttctttaaacttaggttctaaggttctaagacagcctacatttatctcacaaattaattaggactatctttatgttccagtcatttgctcaaaatcctacactggttttgtctgggagcttgagacttgagaggactggtctagatctgcactatccaacttgatagccactagccacatgtgctattgagtgcttgaaatgtggctagtccgaattgagatgtgctgtaagtgtaaaatacacaccagattccaatgatgtagtgccaaaaaaagtaaaatattaataattgttttgtattgcttacatgttgaaatgataataggctggatatgttaagataaataaaataatttattaatgtcatctgtttctttttgctttttaacgtggctaatagaaaactttaaattacatttgtgacttggattgtatttctattggacagtgctggtctagatgtcagactgcatgaagaaaaaatcttttattttgaaatatgtaaacttttgagtgcttcctgattataaactggcagtgatctagtttgcaatttttatttttggcagtgatgataacggggtataaatatgatcacagaatgttctaagaaacttctgccagtttttctagctagatacaaactttattcttggtatattttatgacttatttaactgaaaataagtacttccttaatagaaatttgtacttgactttaaaaatcaaactgtttggtctcttctaagaagtttattagaaatgcaacaaagggccaggcacagtggctcatgcctataatcccagcacgttggaaggccaaggtgaagggattgcttgaacccacgagttcaagaccagcctgggcaacatagcaagaccacgtctctacaaaaaatttaaaaattagctgggtatggtggctcacacctgtagtcccagctactctggaggctaaggtgggaggatcacttgaccccaagaggttgaggctgcagtgagctatgattgtgccactgtactccagcctgggtgacagagcaagaccccatctcaaaaaaaaaaaaaaaaaaaaaaagacacgcaacaacaacagtctatttcttgtttatgtcttaataaagaatttacggtaaatatcatttattctctatgtgctttgaatttctgagtttatttccagcaagaactcgaaagattaggcaagagttgcaaatatttataggaattaaataatgcacaagtaaactatgcatataaaatataaaggatgtttctatacctgcttttaattgggaaattcagcttaccaaaaaggttaattcagttgtttttctgtatgatttctaagatgaacctatatccacacatatatcgtatgtatttttttgtgagatggagtcttgttctgtcgcctgggctggagtgcagtggcatgatctcagctcactacaacctctgcctcctgggttcacgcaagattctcctgcctcagcctcccgagtagccgggattacaggcatccaccaccatgcccagctattttttgtatttttagtagagacggggtttcactatgttggccaggctggtcttgaactcctgacctcgtgatccacccgcctcggcctcccaaagtgctgggattacaggcgtgagccaccacacccggcctcatacatcattttaaacaaaattaataagactcccatacaagaaaattttaatttttaaaaatagtttaccagatgaatttaatcatgtaatatcagtatgatactataccacatatattgtctataggaagaattgctagatattcagtatctgagaaagaagattcaattagaatttaaaatctgatttaaatttctaaaattttttcttagagttttattaatcaagataaaagaaaagacacagaagatgaagataaatcagaatcatttatgcaaaaatatgagcaaaaaatcagacattttggtaagtctactacttggatttccttctttgtaatgtttggtatcatatgtacatgtgcaaaaaatggatttataaaaagagagccaaaaagaaaagtggcaaactccaattttgtagcttctggcacagctgtatagatcttgttttagaattttttttttttttggttataaataaaattaattgacagagcaaaccaaatggtaaagagaagcaaaagtattattatatagtgtactacctttaagacaactttatgtattccatagcctctttccatttcctaagtagtctttgcttttttctttttcctctttgcttccttggaatctgattatcttatgttttaaagattattcattttttttcaggttttggatatgatgctttataattcaggcagatccttgaactgttactcagataaatatagtaatagaaatgtatatataaagaactgaaaaataggttttttctattggggaaaaagggtaagaggggggttgatacaagtgaaggcttcccagaggagccagcatctgagcttgatttcaaggaacagataggagtttttcatgtataagggaggcaagccaacagcaacagcatgagacgggcagttaggaaacagcatggtgtgttctgagaattataggcagcatgataccgctggcatgaaaatgctgctgggaagtgttaggagttaaggtttaaaactttttttttttttaattccaagtagtatgttaatttagtaaacatggtttttatttgtaatatgttcatgaactttttacatggcattttgaaatctttttcctgttggtgtttatttacccaacgttttttgaatttcgtttatgcttcagttatgtcaatataataaatattactttaaattttttcccttccttttatgtaatttattcgtaaaatattcactttgctcatacttttcattttaaagaaagaaaaaagactgtgtttaactaaaaaatagtacccaaggaaataaagacaaagtttttctacatataatcaatgtggtattatttataatggaaaaaaaatgaatacacaggcctcccttggacagatagtaaaatcttaaaatgagcagagccttgagtcataaggatagaaagcaaaaaatttgcacatgaatcttagttgtgatatgtgaattgccactcccgcctacagtccttgctttctaggcccatgttttgctgctgaaggaaaaatagtaccatatactgattgctctttcagagcatgtactgcatctggtgaaacaacattcctcaaggtgttttcacccagctggcactctgaaagttggttgctttgaagccatgagaaacctagtaaatgagaagcagttctttcacttttgctgtaagctgagtgccttgttcagaagcaattttgtgtaggaaaatatccaaatatcacaaagtgttgtaacccatctggcactatgtatcttcagcattttataaaacctgcttctgggtagtgatgttcgtgatgagaacagtgaatttcatgaaccctacagtcttcatttcttttgctgtaaaatgagtttctgggtcaaaaaatagtgtggtatggtgaataattcatttagtaagactacagatgtattactgattagaagcatggcaaggagggagggcacttccacatctagagtgggctcgttcaagtgaggaattaccagtccctctgagatgaagtgggaccagggtagtcaacctgctacttgatggctggctgatctctgcagtgcattgtgccgtattgagattttggtgtttttcgctactagtaaattaggtgttcagtggctaaactggattaggatactagaacatccttgaggggagagtctacactgtcgaatctatgcataatcacaaacctatgccaccacgacccctgaatttatgaaactattgtgcaaataatgagatagttgaggaaaaaaactgacttaacatccacaggtgattaataagcaatcattttgctgttacgtgttgtgaacttccaatatactatcttgtaataaatatcagagccttgctgttttcacacccagccagaccaatagccattcccagagtcacaatgtgcctgtttcttactgaaaatgcatgttgtctttaacttcaaaggagatatattacttgccacagcacactggatccccaggaatgttacaaaggtagtaggctctcaaaatgttcatgtgttttatttcccactctggaatagatatatcttaacaagagacctggaatacctgcaatttctgctttaccaagttccatcagtggagagtggaccaacttgtagtcatggggaatgatgagataataatccctgtggactgaattatggcacagagttgatagaggtgtgacacaagacagtgaaaatttgtggctatgcctgcttgatggaagatttctgttgtatgcttattgtgatgaaagaagaaagcttaccaaaatgatgactatattggtatactcctttattttgtttttttgttgttgtttaacttttgttttaaattcaggggtacatgtgcaggatgtgcaggtttgttacataggtaagcgtgtgtcttggggatttgttgtacagattattacatcacccaggtattaagcctagtattcattagttatttttcctgatcctcccaccctccgcccttcggtaaactccagtgtgtgttgttcccctttatgtgtgcatgtattctcatcatttagctcccgcttataggtgagaatatgcggtatttggttttctgttcctttgttagtttgcttaggataatggcttctggtatactcttctaaacacatctgcaataggagatgtaattaaagcttccagttggaggctttctggacttggattgcattctggactcttggttgacacgggcctggtgtgtgtgggggctgtatagggctataggggctttacacccatgtttctctgtggtcttatttgtacttatattcttcagagtttttcctaacttttcccttatacaatttgttgactgcctttcttgtgctgcttttacccttacaattaggtggaatttaccacctagtggtaaatggtacaatatatcatggactattataaagcattgaaatctgactttttcctctacatttgtatttagtttattaatttagttaattcacgttttataaatataaaatattaatttaaaaacaaaggcttttatctcttaaatttcacaaccgttatattcacagttatatgcatgtttgacatcactggctttatggtcatcagagctgctttttgagtcatctaattttcagagcacatcatcttcactttcagccaaagttagctgtgattcagctttttttaatctgtgtaggatgttgtcactggaaattttaccaagagctataaaagtttgctcaaatactatgatagaagttttttcgtttgttctgactatgaatatttacaacctcttcaatgtaattgttcattgcttttaaaaaacatatcaatatcttatttttgaaaaacatttaatataaagcactcttacatatgaagtgaaatgaatagaaaatgtatatgattttaatgttttttttttttttgagacgaaatctcgctcttgtcccccaggctggagtacagtggtgtgatctcagctcactgcaacctccgcctcccgggttcaagcgttcctgctgcctcagcctcccgagtagctgggattacaggcgcctgctaccacgcctggctaatttttgtatttttagtagagatggggtttcaccatgttggccaggctggccttgaactcctgacctcaaatgatccgcccgcctcggcctctcaaagtgctgggattacaggcgtgagccaccactctgagccttaattttggttttttaaaaagtcattcaaaaatatgcctggaaggaaatacatcaaaatgttaacagtaatctcttgtggtagaattacagctaacttttattttccggattttaaaaattcttcataataaataaactttatttttataatctgaaaaaaatttttcaaagcgtttatcctaagaatcaaaatggcttaacattagaaaactcattaatgtgattcactgtattaactgatcatagtagtataaccacaggacttggtggtcaatttgatgtgggagaaatggaaatgtcagaggaatttctagaatgcttgatttggtaacatggagcctaggaaacattgtaggatggcagagagacaagtatgggtttggtttcaagtaagatgggtttacgtgcaggcatatcagtagaaatgcatatggtggtagacgattggaaatagaggagatctggagtttaggaatatgggaaatgatcatacaactttcctcaagtaattcacaaactacctgggagatttttagtacacagagaaattaaaatgaattagtgtagtttgttaaaatatatcattctaagcctggcatagtggttctgcctgtaatcccagcactttgagaaactgaggctggaggatcacttgagcccagggattcaagaccagcctgggcaacacagtgaaacctcatctctacaaaaaaaaaaaaaaattcgtcaggtgtggaggcttatacctgtagtcccagctactgcagaggctgaggtgggaggatctcttgagcccaggaggttgaggctgcaatgagttgtgattgcaccagtgtactctagcctagacaacagaggaataacctgtctctcaagataaagaaataaattaattaataataataataattctataagtgtaatgaaagaggaaagggaaatcagtaataaggaaggacgtgtatttcaggaccattttaggaatcaggtggcatattgaaggttgatgatggattgagatttagacgttcactagggaaatatataggttaaagcatatgattaaaatatctaaacttgtcaaagtgaggttttccaagcattcagagaaattgtttggctagtttaaatgactgtattatccttaaccaaaggattagctaaataaacattttgaatgggtgcttatcatttatcgagtatttactatgtctcaggccctgttctaagtgctttatatgaattaatagcatttaattgtcatgaaaatcctgagttaggtactatttttagccctattttacagaggaggaaatggaggcatataaagggaactgcagtagtaaaatggtgaagccagtatttgaacctgggccatttagctctagtctgtcttctcagccgctgtcttaaattgttactctccatttgtatacaagtttgtttacaaattccaaaataatatcagtaatttgaggtatatgctgttccactgagttgttgattctccttatgtgttttatttttgaaacagagtcattttctgtcacccaggctggattacagtcacaagatcatagcaactgcagcctcaatttcctaagctcaagcaatcctcttgccccagccttccaagtagctgggactacaagtgtactccgccatgcctggctaattatctcattttgtgtggagacacggtctcattttgttgcctagactgacctaaaactcctgtgctcaggtgattctcctgccttggcctcccaaaatgctgggattacaggtgtgagctactgcgccccacctgtctttattttgttcataaaattccacactctttccacaaaggtctgtatcgactacctgtaactgaacttctcaatttcatactaattcaatgtgcatttttgaaatcaagtgatagtatttctcagatttaaaaaaaaaatgtattttcaatgtcaagtgttaattcgtctcaggtattaaataggtagttaaaaaatattaacatttggcagggagtggtggctcacacctgcaatcccagcactttgggaggccgaggcaggtggatcatgaggttaggagttcgagaccagcctgatcaacatggtgaaaccttgtctctactaaaaatacaaaaattaactgggcgtggtgacacacgcctgtaatcccagcttccaggaggctgaggcaggagaattacttgaacccaggaggtggaggttgcagtgagctgagatcgtgttgctgtactccagcctgggcaacagagtgagactccatctcaacaaaaagaaaaaaaaaattaacatttaatgatacccttccccatggccccaagtgtcaggaaccctttcatgttatccttcctgcaaaataaaccagaatggataaggcttttggtatttcagtaagtcacaatgctgccatgaagaagtaaacaagaggagcaatgctttatcgtggatggtagatagagttgaaaatattacctctccagaagtgtaagaaagctaaggcaaaactgcttcataggatttactttgtgggttcaagtataagaaataaggattgtgctttctttaaatctgagtcccaggaatcattaggcttttttaagagatatggtcttgctctgtcacccaggctgaagtgcagtggtgaggtcatagctcactgcagcctccaccatctgggctcaaggtgtgctctcacctcagcctcccaaatagtggggattacaccacgcctagcaatattcttatactttaagaagtagttttaagtaacttccataatcattctgtttctcagaacttcaaatgacctaatcattatgtccaaagcgttggggaaataactttataaagcttagaatactctatgagaaaatgctacagtctttatccttttttttaatccttttaagagatgaggtctcgctgtattgcccaagctggagcacagtggttccatcataccttctgcagcctctagctcctaggctcccaagtgatcctgccccctcagactcccaagtagctgggactacaggtgcacactaccatgcccagctaatttttaagctttttctgtagagacagggtcttactatgttgctgaggttggcctgcaactcctggactccaccattcctctggcctcagcctccaaaagtgctgagattacaagcatgtgccaccatgcccagcttatctcctttgagacagagtctctcgctctgtcgcccaggctggagtgctgtggtgcaatctcggctcgctgcaacctccgcctcctgggttcaagtgattcttgtgcctcagccttccaagtagctgggatttacctgccaccatgcccaactaatttttatatttttagtagagacagggttttaccatgttggccaggctggtctcgaactcctgacctcaggtgatccgcctgccttggcctcccaaagtgctgggattgcaggcatgagccaccgtggctggccccaccccctttttttaagtgaggagaaaatgaatcatttatttttgattgactcacattgttgctgtgtattctcagtaggacatttgtcttcagttttgttctttcttgtgtactgatgtggaattaaatatataggagttcattttgcacctacaggaaaagtttactgctaaactcttgagtcagctctacaaaatttccatgaatatccagacttctttgcatgagtctaaggaatctaaacctaacattgctatattgaatttattcagttagccaggcacagtggctcatgcccataatcccagcactttgggaggcctagccaggagaatatcttgaggccaggagttcaagaccagcctgagcaacataataagcctctcatctttatggagaaaaaaaagaagagaaaaaaagaaaagaaaaaaatctattcagttatgactgactggacaacattaaaaagtcaacactttgctggttccgtgatttcttggtggtattgactttgaccaaatttcctgctaatttagataaaggtgtagatataacttaaatagtatttggatttctttgacaccttgaaacaaaatgacaaccattttcaaatatgcttaactaatttttaaaagactttgtttataacagacatcatgagtaaatggcttacataactaactctcaatttgcccaagactgcgggcattcatggatgtaggactttttaatattgaactggccactctggcctgattaattatctgaaataaaacttcctgtgaattttaggagctatttccagtctactgagtattgctttaaagagtactgtccctcacttgctcttttaccataatctgttgctctggtaatatgaattgtctttaaagagaatcatttaaaaataccattgagagattaatgaattaagaatggttggtatttcttcccttatgggaagaaagaaaatatttgacacttatggttcaattcttttttttacaggtatgttgagtcgatgggatgatagccagagatttttgtctgaccatccataccttgtatgtgaagaaactgctaaatatcttattttatggtgttttcacctggaagctgagaaggtattattatgtgaaccttgagtttctgggaaccttagtggaaatctgatttcatactttattgatgttttgttttgttttctacattaagtcctttaaaagaaagcaggaaggtcattagatggaattaccattttttgcttccagatctacttgagtttaatgtgggattttgttgttgttgttgtttcagttagcatacagaaacttttccactatgctttctctgccactccacctccatctctcttgttttcatattactataatccttttcaaactaatttgaaagtcgtattttaaaaatccagacggtaatcatggtattaaatcaagttcagagcatggtcttcctttagttattctggtccacatacaaataataaaaaaaaaactaagatatactctttatatgtttgtaaagtatttgacttataacttaagagagtaaaatcaaaagtattttaaaaattcaaaatttgaatcagtatgccaattaaatatatttatatatttgtttcttatatcatttaaatctttttcagaaaggggctttaatggaacaaatagcacatcaagctgttgtaatgcagtttattatggaaatggccaaaaactgtaatgtggatccaagagggtgttttcgtttatttttccagaaagccaaagtaagtagttatttgatattgataaatgggaagatttggtcccagctgagacctctttgttctgttcatatcaatagaaggcatccaagcaggatgccacaggctaaattctgtagattttcttgtgaaaagaaaatttatattgctaatttcttgctaatttaaacttaaaagagctatataagaggctgtactacagcatgtatatgaaattgagacccatttaaatgaatgtgtgtattcaggaaacttacgttccatcattaattcattcagtaaatactgagtgcctaatgcaaagcacagctgtttcagatgctcaggatgcattattgagcaaaatagatacaggattcttcatgtgtagaactcagcagtttaatgagaaatcagacttttataaagaaaaaataggaagcaacctaaaaattcagcaattaagggaatagttaaaaatacccatggtacatagaatatcatgcaccctttaaaattatatttatggaacttttgtaatgagctgaagaaatgcttacgctatgaattcacaggaagcagtacatactagatgatgttggctatgttgaagaaaaatagatgtctagaaagattaagtacctttcacactcacaagatttgcagtaatttaaaagctgcccaagaagtagggcaataagaatttgcgttcactgctagtggaagtataaattggaacaaccactttaaaaaatttcctagtaaagttgaacaagtgcctgccttaacacccagaaattctcctaggtgtatgcatcctagagagtagattctcaaggtggggtccaggaacccggaggggcttcaagaccttttcaggaggttctctgtcgaaactattttcataataataccaagatgttatttttaattttcattttcattcctcagtagtgtacaatagagattaatgcggaagtacaaatatgagaatctagccatcttctgtaaagtcagacattagatttagaaaaattaaaggaaaaagcagctctcttctcactaaatttttttgttttggaaaactttttttttaaataaaaatgttattaatggtagtgtaatgagtttgtcattgttatttttagttaatgttttaaaaattcctcagttttcatttctaacagtaaatactgacagatacaactcacataaacagaagctctttagggtcctcaataattttgaagactgtaaagagaactgctgcgctagagaaactcttacacatatgtactagattgccgtaatgttcatagtagattgtaatagctaaaagcctggaaacaataaataaattgtggtgtaggttgagtattcctaatccaaaatccaaaacgctccaaaatccaaaactgtttgagcatcgacatgacactcaagggaaatactcacagattttgtgttttcaatttagagatcttcactggtaagtataatgcaaatattcccagatctgaaaaaactgacaatctgaaaaacttctggtgccaagcatttcagatattcaacctgtatattcattctgtaaaatactagccaacatcagcatggatggaaaaacaagagagtgaatcaaacaaaccacagagtgatgtatctgtttagatagatgctaaatggatatatctagtatcaatgttcgtattttgtatttttttataaagtatttttttagtgacaggcagaactaaataatatattgttgaaggatacatatataagcagtaaaactaaaaagcaaaggaataattaagaagacaaaagttacaataatgataacctcagggagggagggggaatgctcttgggaactggtttctaggatcctagtaatgatccatatcctaatttctatgggtaaatagtgggggttttgctgaataaactgtgcgcatatcttttacatgctcttctgcacataggatatatttgaacatatacaattagaagttaaaaggaagtataccaaaagtttaactttggttatacttgtgtggtgaaattataaataatttccgttttctttttcatgtactacaatgaacatttcctattataaacataaaattatatttttatattaaaaaaaaactctcaatgtggcagtagtcctaacttaaataccctaaactcttctgaaatgcaaccaaaatatgaaattttcctgaaacagttgaactttaatagcaaatgcttgacttgatattttagctaggctgcttctggtgactagtctaaacttttgtttgtttttagagataaggtcctgctctgtcactcaggctagagtgcagtggtgcaatcattgctcactgcagccttgaacttctgggctcaagcaatcctcctgcctcagattcccaggtagctgggactataggcacatgccaccatccccagctaattttttgtagagacacggtctcactgtgttgcccaggctggtctcgaacttctgggctcaagctgtcctcctgccttaaccttccaaaatactgggattacagacatgagccaccacacccggtctcttctaaatttttacttgacacttaagagtagtaaaaaacatactttcctttttatcttacattaatggatgtgtttaaactggtgtttaataaaataatggaatgtggccaaatcatatatattgtttgacatttactttaccaaagtaaaacggaaaggcactggtcttcaatcttaacattgtatgcttaataatacttttttttaaattatgaaataatcactttcatggtatgcttactttgttccagggactattctaagcactttacatgtattaactcattaaattcatataacattttatgaggattactgttgctatcttatgggtgaagaaattggcataaagaaattaagtaagtggcccacaaattacttaataatacaaaatctgtcatcactctatatctaaatccctaaaccttaagcatgcaatgaggacagcaattgtgcctcttaattttcagaaagaatccttatggatattacatactctgtgtccacacaagttcttataaagtgaggtgctaaaatgtaattaaggaaattcttcctaaatttacaagaagataggatggcagcacagaacactctctgcattatttcaatagaagctgatggtagtaactaatccacaggttttaacctgttacgcaacctaaaatccatttgacaagatctcttccactacttgaacttaaagcctgcattctattggtaggataaatctctgtatcatttctctatattcagaggaaacataaacagaggcagctgccaatagggagttgcctaagagttccactccctcgacctaagttatcatactttttctttccataatattgaaaagaaggtacttgcttaactagagcaagatggttccataatgacgttgactattgaattctatttggttttcgtagctcttttaagtagggaatatacagttagaaaattactaggaacaggtaatagtgccccctcattaattgttggagaattaaaaggttttaagaatatcccttgattgtttggtagtaggaagaagatagaatgaattggacagattaaatgactattttggatcctgttaaggatctagataagtcaaggaaaatacagagaaagccttcttttcttttagttgtgtgcatatgcatagggaggggttgttttttattagcttattttgctgaagcagaaggaaatggagcaaaccaattattaatgttcctataaatcaggtagttttcacaaatgtgacagggatcgtggtggtttctatatttagactattcaccttgtcattacttcctccacttcaaacctgttatatgctttctggaatttactatgtctagaaatcttgaagaacacagtctttgtttttttttttgttttttctaggcagaggaagaaggttattttgaagcattcaaaaatgaacttgaagctttcaagtcaagagtaagactttattctcaatcacaaagttttcaacctatgacagttcagaatcatgttccccattctggtgttggatctataggtttattagaatccttaccacaggtaagttggaaaagtaaatatttgttttataagcctattaattcacataatttttgttattttgccccactcttttttttttttaatatgtgctactattttaaatattcctgcctcagaagataactgttgaatcttacttcatgccatgttttggtgctgaatctcacctcttaagtatttagagataccagatttcctctccttttaatgtagtagtgattagttatacctaaccattcttaagaacaaatcttagctattgatcatctcaatcataaactcttcaagatggctccctcaggagcttccttaaaacatctcatcctgagttaaaactatgccattttgaattttttaggatgattagcttcaaagtggacatgcacatggaaccagtgtgatctgttgcttaagtttatttagtattttcttgttaaatgttgggtctaccagatataacatttttagaacacattaatgtagctgataatattgtatctggtaatactggccaactgtttgagcctctttgaagtcttcagtggtttgatcaagataaaaccatgtcggctgggcgcagtggctcgcgcctgtaatcccagcactttggaaggccgagacaggcagatcacgaggtcaggagatcgagaccatcctggctaacaaggtgaaaccccgtctcttctaaaaaaaaaaaatacaaaaaaattagccgggcgtggtggcaggcacctgcagtcccagctactcgggaggctgaggcaggagaatggcgtgaacccgggaggcagagcttgcagtgagccgagatcgagccactgcactccagcctgggcgacagagcaagactccgtctcaaaaaaaaaaaaaaaaaaaaaaaaatcatgtcatataggcagcatgaaaaaatttacatcaaaaaggagacatgatcagaccactggtctgcctgatgctagttaggattacaagtttaagttattattagataattcctacccatttgattttactagtagcactttaatagagcccagtcatctctcatttccaggctccaagattttaagaccagctttagccagtttaatctgttgtctacattgtgagaaggaaagtcttattcaaaagacaatgtgaggagagtcctatatttagttttaaacctcataaagtgctaaaaattgggattttcagtggcttgaccttatctcactgtaatttcaccattccaattacatgtatgtcctttaaggaaagtgattgatcatatttaccccagtcaaaaatattattatcaggagtctctgagcctactctggctgaaaaaaaaaaaaaaaagtctcaaggatggaaataattaatgtttgatttttaaataattagtaatgttcccccttagttagacatgtaaagaatattccctctacaaattcctacagattatctcttaattttatttaaattcagtgatgatttttctcttcagttcctaagaaatagcccatagggaagtagtttttccaggggaattctgtgaccaagtcactgtgaaatccaatatataaacctcctgcaattaaaatgtcacataatgcatgggaaggagaaaagagactttggaaggatgtaactgattctaaatataagagggaaagatacacattatagtatcttaagcctatattatcaagaagttgcctctggtttgagagaagtaagtccttgttgttattagatagcaactatatattagatagcaactgatatcaggtgctaggcatcccttatagtcatggggggactagaattatacaattctgacacttctgtattgctgatattatcagggttattcagatttaattaagctgggctaatctcctcatggtgggagaccaattccttatggtaagtaatttgagcatcctgatgtggtccttctgaaggatacaagggctggagaaaatttcagttagatgcttgctacatgtgcggaaaggattatcgactagttgagggaagtaaaatgagaggccacctgaaagaccaaatcatcagtttagaggtttggaagaaaaatcttaccataataataacatcccatttttatatcagtttatatgttgtaaagcactttcacacatattatttaattttctcaaacaccctgtgattcattttcattcatttttatagatgagtaaactgaaattcatagaacttaagaaatttgcctgaggtcaacacaataagtgatgaatctaatattctacttttggatttctattatgcttcactgcttattcacctataccacagactgtgaatcatatgtgttgagaatgttactagatgaaaatatgggacagtcaatgaaatctaagtgtaggttaggtcgggtataccgattccttcttattttttaaagtctctgtatgatagtatcttacagttcttaggaagatgggtggatgagttttggagaatctcctcagccaattctgttattaaaagttgtgccatggaaaactggagcccagtcttaatagagtaattgtaagctctgttccagagaattaggcttggattgttagaaaaaggtcttaaagctgtttttttggagaatgagacaatgtaacaataatattggtcatttttgataaagcttaagtgtgggtaaccatttagcttttcatttcttttttttaataattgacagcaatcgtgtgaaataagccaaataccattcattatccttagttttgagaggtctaatccaaggcctcttggatatagaaataataacagttaactttaggtttatcctgtagactagtttttaattttactaaattgtgaattttgttctccttgaggcttgctttactaaatagaggcaggattaaaactgaagcccagtgtgagtgtcccagacctcagtcagttgtccctgctacttccttcataaagacctgattgggaataatccgaactccagctagctttttgacttttagaataaaggaatctcacaaagtgttgtactttcttaggaggatctttagaaaaccctgcctcccaacctcctattggatggtgaggtttaagacatctatcctgtttgactactgtcctcactggtgtttattaaataaaataaatataagtaaaactagtaatacaagtggtaaaagtcttaagtaactagcagatattcggaacaattgagtagacaaaattgaattggggaagaattttctaaagttctgggtcttaagggctatacccttattcatggtgctttaataatggttttatttttgcatttattgagtaagattttatgttttctattcccagtttttgaaattgacaagcataacatttatgagtttatgcttgtttaacaaatcctgttgttttattctcagtttaaaaaataagggtgtaaatacatctcaaaagtgtacagatttctcactgagtttgttttaacctttgggaaaccacaatagaccctgaagatatccataatttttacccagtaaattttttctttatttagatgatttgcagttttagtatttactgttgtaattagatggtaatcttaaaaatgcattgctaacttcaaaccatatttaaattatcagtagctatgtatatataatcacatggaggttgtagccttgccttgtatgattaaacagagaagaaaggtggtatttgttaacatttctgttttttacatgtatcattcttttatcacatctcataggtgatagcatcctatttttttctttattttcttgggattcagcccaagtctgtctccaaagtccatcttctttcctactgctctactacactgcagagaaataggacggtgaaactgaatatatatgtatgtactgtcataaaactggttataatgcgttctttttctccccccaatctaccttttctttttccccagaatccagattatcttcagtattctatcagtacagctctctgcagcttaaactcggtggtacataaagaagatgatgaacccaaaatgatggacactgtataatttggttaagactgctgaggccaagtgctattttgttacaagaaaggaagaacttggctattttcttgacacttttatgggtgctgcactttatttttgttcggtttttgatgggagggaaagagtactgaaatgttttgtaaattttttttaatgtgctgctaggttttttgttttgttttgttctgaagagaagagtggtaccatatgttgcaggaagtcaaactggactttttgtggctactaaatttgcttttaatcttattgttctcaattttggaatcaagtatgaaaatctgcacaaatgcaatgtttacaagaactggttgattctgggaggcatctgctacagtctctttttatatggatatgtacatgtcctattctacaaaaatgattaaagataaaaacatacttgtatcccactgctactttagctgtcaaatttggtgtttcatcacattaaaagcaataaatcagtagttggtaatgt

SEQ ID NO: 38523 - DNA, 54044 bp, Homo sapiens
ggcgggtctggaagcagagccggcggagggagcgccggggccctgggctgcaggaggttgcggcggccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagagggtccgcggcccgctgaccccgcccgcggatggtcacgccccagccctgctccttccccattcctggactcggggaccttcccaagggcgttccttgccgacgctctccctctaggagcgtttgggtctgtgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgggcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagtttttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttggtcttgaactcttgatctcaggcaatgcacctgccttggctttccaaagtactgggattacaggtgtgagccaccgcgcccagccctctagttgtttttcaagacagtttttggggtgcgggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcattgtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacgtcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatgctctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgaataagggccgttgtatatggagccaggcaggaaattgatgatttttatcaagaacaatttcaggccaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaacaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaacccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagtgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagttttttttttttttttttttttttttttttttttgagatggagtttcgctcttgtctcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcctgcctctgtgggtgtggactcagtgtcgacagccccctctacaggagcatgaacacgctgacagggtgctggggtcggggggcagccctgggttcacgctccgccctcgcacccccagagggaccttgtgccagtgtgggcgcccccggaccgcccaccccgcagtggccatggaggatgccttcggggcagccgtggtgaccgtgtgggacagcgatgcacacaccacggagaagcccaccgatgcctacggagagctggacttcacgggggccggccgcaagcacagcaatgtgaggcgggcctctgtgggcggggcccgggcaccagggggctgcatgctcggggctccagagtggagccgggacgcccgccctgaaccctggcccctccgcccatccctgtcttggctctctttgtcccctccgccccacctatcttctctctgagggggtcccgttctctctgcgtctctttgtctctgtctccctctgtctccgtgtccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccctctctctctgggtctctgtccccgtctctccgggtctctgtttccccttttctgtgggtcactgtcctcatctctttgggtctgtgtttccgcttttctctgtgtctctgtccccgtctctctgggtctctgtctctgtctctctgggtctctgtctctgtctctctgggcctctgtttccccttttctctgtgtctctgtccccgtctctctgggtctctgtcttcctctctctgggtctgtttccccctctctctgggtctctgtccccatctctctgggtctctgtctgtttctccgggtctccgtccctgtctctccgggtctctgtttccccttttctctgggtctctgtccttgtctctctgggtctctgtccctgtttctccgggtctctgtccccgtctctccgggtctctgtttcccctttactctgggtttctgtccccatctctctgggtctctgtccctctctctctgggtctctgtccctctctctctgggtctctgtccctctctctctgggtctctgtcgccatctctctgggtctctgtcccatgtctctgggtctctgtccctctctctctgggtctctgtccctctctctctgggtctctgtccctctctctctgggtctctgtccctctctctctgggtctctgtccccgtctctccgggtctctgtttcccctttactctgggtttctgtccccatctctctgggtctctgtccctctctctctgggtctctgtccccgtctctccgggtctctgtttcccctttactctgggtttctgtccccatctctctgggtctctgtccctctctctctgggtctctgtcgccatctctctgggtctctgtccctctctctctgggtctctgtccctctctctctgggtctttgtccccgtctctctgggtctctgtccccgtctctctgggtctctgtccctctctctctgggtctctgtcccatctctctgggtctctgtcccatgtctctgggtctctgtccctctctctctgggtctctgtcccatgtctctgggtctctgtccctctctctctgggtctctgtccccatctctctgggtctctgtccctctctctctgggtctctgtccctctctctctgggtctctgtccccatctctctgggtctctgtccctctctctctgggtctctgtccccgtctctctgggtctctgtccccgtctctctgggtctctgtccccgtctctctgggtctctgtccccctccctgtgtgccccgctcccatgtgtccacagttcctccggctctctgaccgaacggatccagctgcagtttatagtctggtcacacgcacatggggcttccgtgccccgaacctggtggtgtcagtgctggggggatcggggggccccgtcctccagacctggctgcaggacctgctgcgtcgtgggctggtgcgggctgcccagagcacaggtgaccgagggtgggtgggggctgtctcctgggcctcggcctgcctgccatctcccccacgactgtgggtggcctcccccgccgcccagtgtgtgtgtgtgtctctgtcttattctttgtttctctccccctgcctctgcatgttcctcggcgtctgtgtaggagcctggattgtcactgggggtctgcacacgggcatcggccggcatgttggtgtggctgtacgggaccatcagatggccagcactgggggcaccaaggtggtggccatgggtgtggccccctggggtgtggtccggaatagagacaccctcatcaaccccaaggtgtgacccagggacttggaaaagggggctggaggcctggactcctgggtctgagggaggaggaggggctcgtgtttgtccttctggccccgatgaggagacgccctggtctggccatttttcccctagggctcgttccctgcgaggtaccggtggcgcggtgacccggaggacggggtccagtttcccctggactacaactactcggccttcttcctggtggacgacggcacacacggctgcctggggggcgagaaccgcttccgcttgcgcctggagtcctacatctcacagcagaagacgggcgtgggaggtgagtggtcgaacccatgacccacaacccacgacccacaacctgcaaccccagcgctcaggatcccagtagtttggtctggtcgagatttggggaattacctatggttaagtgtctttccccgtcattattcatggttttaaaaacttctgtctgagagtgagttagctcacatcagtaatcccaacactttgggaggccgaggtaggaggattgcttgaggccagtaattcaagaccagcctgggtaacagagcaagaccttgtctctaccaataataataataataataataataaagaataaaaaataaattagccaggtgtggtgtcgtgtgcctgtaatcccagctacttgggaggctaaggtgagagaactgcttgaacccgggaggtggaggttgcagtgagccgagatcaagccactgcactccagcctgggcgacaaagcaatactccatctcaaacaaacaaacagactttattttgaaatttctcatacatacagaaaaatgcacgaaggtggacagcttgatgcatttttttctttttttgagacggagttttgccctgttgcccaggctggagtgcagtggcgcgatctcggctcactgcagcctctgcctcctgggttcaagcaattctcctgcctcagcctcctgcctcagactcctgagtagctgggattacaggcacgtgccatcacacccggctaatttttgtatttttagtagacggggtttcaccgtgttagccaggatggtcttgatctcctgaccttgtgatctgcctgctttggcctcccgaagtgctgggattacaggtgtgagccaccgcgcccggcctaatgtttgtatttttagtagagatgaggtttcaccttgttggctaggctgttttcgaacttctgacctcaagtgattcgcccacctcagcctcccaaagtgctaggattacagacgtgagccactgcacctggctccggctaatttttaaagttttttgtagagacagggttttgccatgcagcccaggtggcctcaaactcgtggtcgaaagtggtccacctgcctcagcctcccaaagtgctgggattacggtcgtgagccactgcgcccagccagccaatatcttataattttatcaaaacatgaacaagatacattactaggtttgaggaaagtttttgatttttgtgtatttttcttgtatcaatcctcttaccaaattttcttattgatctttatttttatttttggtggggttttccaattttctgggaatacaagccatgttttcttcaaataggtacttttgtcccttccagctttacaaaaaaccaaaaaccaaaaaatcaattttcacttcagtgatttcatttttttgcattattgagttagctcaaaactccaggatgaatacagtgttagtggtaatgtggtctagtttctaatttatttatttatttttttgagagggagtcctgctctgtgcacaggctggagtgcagtggcgtgatctcagctcactgcaacttctgcctcctaggttcaagcgtttttcctgcctcagcctcccgagtagctgggactataggcacgagccaccactcccagctaatttttgtatttttggtagagacggggtttcaccatgttggccaggctggtcttgaactcttgacctcaggtgatccacccgcctcggcctcccaaagtgctgggattacaggcatgagccaccgcacctggcctagtttctaattttaatggaagtagagtcgatatagtgctatctttatggtgcaattggattttggtaaatatctatattgtggttagatagccctttctattcccatttcctttactttctatttgaactttcactccctctggctcctggatggttaatcaatgacaggattgactcatacaagaaacacctgcctcattcagggactcaggagtctaggtcctcagccccctcctccctggggaagttaagcattactgtcttcaaaatctagctccctcctgaagtgtccaaagacatgacaattctggccaggcgcgctggctcacagctgtaatcccagcactttgggaggccaaggtgggaggatcccttgagtccaggaattcgagaccagcctgggcaagatggcaagacccctgtctctaccaaaaattaaaaagttagctgggcacggtggtgtgtgcctgtggtcccagctacttagaaggctaaagtaggaggatcaagatgtagtgaggtgtgatcatgcccctgcactctatcctgggcgatagagtgacaccctgtttcagaaattaggctgatgcggtggctcatgcctataatcccagcactttgggagtccaagttgggaggattgcttgaggccaggagttcgagaccaccctggccaacatagcaagacccccatttctaaaataaatacataattaagtaaaaaaagaaatgacaattccaatgagcctctgaacagaagattaggacaaggctgatgtttgccgactcctgggaaatgcggttttctcctatctccagcaaaggctgatgggaggtaatcaagcccccttctcttcttgcctcagggactggaattgacatccctgtcctgctcctcctgattgatggtgatgagaagatgttgacggtataggggcccggatgcccggatctaagggggaaggagggttgggggccaggactcctgggtcctgagtcttagggagggtctgggggtctgactccgggtagggtgaatatcctgccttttctgacgtgatgaataaagaatgcctttatcctgtagcgaatagagaacgccacccaggctcagctcccatgtctcctcgtggctggctcagggggagctgcggactgcctggcggagaccctggaagacactctggccccagggagtgggggagccaggcaaggcgaagcccgagatcgaatcaggcgtttctttcccaaaggggaccttgaggtcctgcaggcccaggtatgacactgggggcccaactctggatcctgagatgggagggaactggggacttgggctcctgggtctgagggaggaggggctgggggcctggacttccaggttccgggagaagagggtgctgggcatatagactattaggtcctggaggggaatggcctcctccatccctttggacagggcccaacaggagttggggatggaggcgggctagggatgcagaactggctattccacaggtggagaggattatgacccggaaggagctcctgacagtctattcttctgaggatgggtctgaggaattcgagaccatagttttgaaggcccttgtgaagggtaaaagttgtaccctccagtcttccccctctctcagttcaaccttagacacctttcctggcctgggcacttcatccaccctctctaatccaaggcccatgccccctttacccctcttaatatttttcccctttggggctttgcatggtgctatttgggcagttttcccagatgctttcattatgttccagcatctgctttcctctgttggatccatccatccattctttcatctttccatccatccacatgtacagatcgatctttccatctctttacctaccatccttccagtcatccctcattctttcatccatccatcctttcacctgtccatccacacatccactgacaattcctgagaattccatccgctcattcctccatccgtcttctcacctgtccatccacacatccactgacaattccattcagtcattcttccatccatccatcttctcacctgtccatccatgcatccactgacaattcctgagaatgccatctgctcattcttccatccatccatcttctcacctgtccatctacacatccaccgaaaattcctgagaattccatccactcattcctccatccatccatcttctcacctgtccatccacacatccactgacaattccattcactcattcttccatccatccatcttctcacctgtccatccacacatccactgacaattcctgagaatgccatccgctcattcctccatccgtcttctcacctgtccatccacacatccactgacaattcctgagaattccatccgctcattcctccatccgtcttctcacctgtccatccacacatccactgacaattccatccacttattgttccatccatccatcttctcacctgtccatccacacatccactgaaaattccattcactcattcttccatccatccatcttctcacctgtccatccacacatccactgacaattccattcacttattcttccatccatccatcttctcacctgtccatccatgcatccactgacaattcctgagaatgccatctgctcattcttctatccatccatcttctcacctgtccatctgcacatccactgaaaattcctgagaattccatctactcattcctccatccatccatcttctcacctgtccatccacacatccactgacaattcctgagaattccatccgctcattcctccatccatccatcttctcacctgtccatccacacatccactgacaattccattcactcattcctccatccacccatcttccatccatttacccatctacccatccatcttttcattcatccatccaactgttcttccatctatccatccacccacccattcttccttccctacatgcttccaatatacatgaagcactctggctagacatgaaccaaagcactgtctcccagtgaggaagtccagatatttcactagaaatggcagcttggaggacggaatgatgaaaaccaaggcgggggagcataatgcacacctgggagaggctggggagggtcttatttatttattcacttattgagacagggtcttgctctgtaggccaagctggagtatagtggtgtgatcacggctcagtgcagcctcaacctcccaggctcaagtgatcctcccaccccagccttccaagtagctgggaacatacccgcccaccactacacctggtaaattaaacaaaaaaaaaattttttttttgtacagacgaggtcttgctctgttgcccatgctggtcatgaactcctggcctcaactgatcctcctgcctcagtctcccaaagtgctgggattacaggcatgagccaccatgccagcctcctttatttagtcaacaaatacaatcctaggctccagagactaaagccaacccatttcctgctctcaaagaccccagatcccactaggattgtttggatacaaccttaggtaaaatttaagacagaagcacaggcaagaatcactgtcgttagaaggaaaacttcaaggaaaagttgtgtgtgtgtgtgtgtgtgtattttgagacagagtcttgctctgtcgcccaggctggagtgcagtggtgcgagcttggctcactgcaacctccgcctcccgggttcaagcgattctcctgcctcaccctcctgagtagccgggattacaggcacgtgccatcatgcccggctgatttttgtatttttagtagagacggtgtttcaccatgttggtcaggctggcctcgaactcctgacctcatgatccatccacctcggcctcccaaagtgctgggattacaggtgtgagccactgcacctggccagagaagttggcatttaaaccggaccttggccaggcacagtggctcacacgtgtaatttcagcactttgggaggctgaggagggaagatcgcttgagcccaggagtttgagaccagcctgggcagcatggtgaaatgccacctctataaaaaatacaaataataagttggggagggtggcgcatacctgtaatcccagctacttgggtggctgaggcaggggaatcgctcgaacctaggaggcagattgtgccactgcactccagcctgggtgatagggcaagactctgtctcaaaaaaaaaaaaaaaaaacctaaataaataaaccaaataaactggaccttgataagtcagtagaatttggatttagtaagctaacgagtgggacagataagtattcaggaagattcccagggctctgtgtggggagggtcatttttggtgtcagaagaacttttttctttttttttttgagataaggcctcgctctgttgctcaggctggagtgcagtggtgtgatcttgacccactacagtcttgacctcctgggctcaagagatcctctcacctcagccccacaagtagctgggaccacaggcatgtgccatcatgcctggctttttttttttttttttttttttttgagacggagtttcgctcttgttgtccaggctggagtgcaatagtgccatctcagctcactgcaacctccgcctcccgggctcaagtgattctcctgcctcagcctcccaagtagctgggattacaggcatgcgccaccacacctggctaattttgtagttttagtagagatggggtttctccatattggtcaggctggtctcgaactcccgacctcgggtgatccgcccgcctcggcctcccaaagtgctgggattacaggcatgagccactgtgcccagccttttttgtatttttagtagagatggggtttcactatgttgcccaggctggtctcgaactcctgggctaaagctatctgcccatctcggcctcccaacgtgctgggattacaggcgtgagccattgtgcttaggccagaagaattttacgggggaaatacacactaagatagaaactccccagatacacggtggcaatatatacagcattctacctcagctccccacccatgtttgtggtgtggtatatattttaattatttttcttattttaattatttctttctttttcttttttttttttttgagacagagtctcgctctgtcgcccaggctggagtgcagtggcgcgatctcggctcgctgaaagctctgcctcctgggttcacgccattctcctccctcagcctcccgagtagttgggctctctatttttagtagagacggagtttcaccgtgttagccaggatggtctcgatctcctgaccttgtgatccacccgcctcggcctcccaaagtgctgggattacaggcgtgagccacggcgcccggcctcttttttttttttttttaaagagtctttgtctgtcgcccaggctggagtgcaatggcgccatctcagctcactgcaacctcctcctcccaggtttaagcgattctcctgcctcagcctcctgagtagctgggattacaggtgcccacaaccgcacccggctaatttttgtatttttagtacagacagggtttcgccatgttggccaggctggttttgaactcctgacctcaggtgatccacccgcctcggcctcccaaagtacttggattacaggtgtgagccaccgcgcccggccttaattcatttttaggtattttttgagacagtctcactctgttgtccaggctggagtgcagtgggacaatcatagctcactgcagccttgagatcctgggctcaagtgattctctcgcatcagcctctgagtagctgtgcgccaccacaccaggctaatttatttttaatttttttatagggatagggtctccctatgttgcctgggctggtcttgaactcttgggctgaagagatcctcctgccttgacctcccaaagtgctaggtatagtacaggctgtggtagggtagaaagagcaagttatttttgctttggaatcagacaaaactgaatttaaataccagcttgggccgggtacagtggctcacgcctataatcccaacattttgggaggctgaggtaggatcacttgaggtcaggagttcgagatcagcctggccaccatggcaaaaccctgtctctactgaaaatacaaaaattagctggcgtggtggcgggtgcctgtaatcccaactagttgggaggctgaggcaggagaatcgcttgaacccaggaggtggaggttgccgtgagccaagatcgtgccactgcactccagcctgggcgacagagcgagactctgtctcaaaaacaaacaatcaaaaagaaacaaaccagcttggccctttcttgctgtgtggtcttgaggaagcagcttcccctctctgagccccagtttctctctgtggaaagtggagataatatcttacaggagtgttataagcctccatggcaaggtatgagttgtgcccggtcccggtgggggcccaataagagggatctcctcttaatatgattccatttcctctgggggtacatccttcaatataaggtaactctcagtgggcaaatctgattcactctgcggaagttaactcagcagcctcctgggagaaaatacggcagctctgcaagatgtggtttgagggggtggtgttgtaagcccagcaggagtggaagtgatcacagtccactgggggaactggagatggctgataggcttggggatagcagagttgaatggatggaatttcagcaagaaagaagggcaaggtcatgaatgcgtcttttttttttttttttttttttgagacagtgtctcgctctgtcgcccaggctggagtgcagtggtgtgatctcagctcactgcaacccccgggttcaagcgattgtcctgcctcagcctcccgagaagctgggactacaggcacctgccactatgcctggctaatgtttgtatttttagtagagatggggtttcaccatgttggccaggatggtctcgaccttctgacctcgtgatctgcctgcctcggcctcccaaagtgctgggattacaggtgtgagccaccacccctggcccatgaatccttcctaagagtctagcataggcaggcccagtgctgggcagttggtgtactcttttgcccttcatctcccttccctgcctgcaaggattatcaccccattttgcagatgaagagactgaggctcagagagaggaaaaatggcttgcccagggtcatccagctagtagcaggggtcaggcttttcatgtgagtctgtataattctcaagcccattgcaaggggcatgtttggagagaggtcagaggctcgcagggttggtatgtatcattggcatgaagggagtgttggagacaaggccagtgaggcaggtagggccaaaccacccaggacctcaaatgccaggcagaggggctaaggctgtccttgagaggcagcagaggaccagggtccgttatgtggataaaaaagactctctggccaagcgtgaaggctcatgcctattatcacagcaccttggaagactaaggaaggaggttcgcttgagcccaggagtttgagaccagcctgggcagcatagtgagaccccatgtctataaaaaattagctgggtatggtactgtgcgcctgtagtcccagctactcgggaggctgaggcaggaggatcgcttgagcctgggaggtctcaaagctgaagtgagctgtgatggcgccactgcactccagactgggtgacagacgaagaccctgtctcaaaaaacaaaaacagactctctgggagtgggtgggggcagagtggagaggagagaagagactgcagtgatggtgtttgggggtgccgaagcttgagctatagctggggccaggaggacagtcggggaggctcagcagagagtcaggaggctggacgtgggacatgaagcttgggggctgatggcctgtgagatgggaggagcaggaagggacaaggacagtacctgcgggtctgccttattgattgggtggacagaggggccattcctgagatgaggacgtagggaagatgggtttgagggctagatgctgagttgagtatggaacacggtgagtctgaagggacaaggtggggccagggtcgagtgcccaggtgacaaatggtgccagattaaggcggaatataaagcaaggtattattattattattatttttatttttttattttttttgagatggagtcttgctctgtcgtccaggctggagtgcagtggcacgatcttggctcactacaagctccacctcccaggttcatgccatcctcctgcctcagcctcctgagtagctggcactacaggcgcccgccaccatgcccggctaattttttgtatatttagtagagatggggtttcactgtgttaaccagggtggtctcgatctcttgacctcatgatccacccatctcggcctcccaaagtgctgggattacaggtgtgagccactgtgcccggcctattattattatttttgcaacagagtttcgctctgttgcccaggctggagtgcaatggcgtgatcttggctcactgcaacctccacctcccgggttcaagcgattttcctgcctcagcctcccaagtagctgggattacaggcatgagccaccacgcccagctaattttgtatttttagcagagacgaggtttctccatgttggtcaggctggtctcgaactcctgacctcaggtgattcgcccacctcggcctcccaaggtgttgggattacaggcatgagccacagcatccagcctattattattatttgagacggagtctccctttctcacccaggctggaatgcagtgacgtgatctcggctcactgcaacctccacctcccgggttcaagcgattctcctgctcagcctcccaagtagctgggactacagacgcatgccaccatgcccagctaattttttgtattttagtagagatggggtttcaccgtgttacccaggctggtctcgaactcctgagctcaggcgatccgcccatcttggcctcccaaagtgctgggattacaggcgtgagccacggcgcccggcctgtaaagcaagatattatgaacaattttgtttccttcttttgaaactgtggggaaagtaggagagcttcatagaatcgtagaaagtcgtggaaaagtccgctctgaatggacgtctgggttttgaaagagcacagaaagccatgaggtcctagacatgttactgcctttctgggcctctgtttcctcaagcacagccttggaggttacactggccaagctgtagtgtcgccacagcgtggaacttcttcccacagttactgtaattgattacagtgctatgaagggggtgccactatttcccatttaatagatgaggaaactgaggctcccaaggttcaatggcttgcctgaagtcactcagttggtactggtggaccggggactggaacccacgtctgcctgccccagagcctattgctcacctccactacatgagattatctctttctgtggtaccagtttttggagcaaccaaaatgagatgaatttgttttggagatagatatggagcaagtggaggcagaaggaaacctaactccatgtcacgacaaatgcccttcaggacttttcatgcccctgttgactgcacatgtttggatccactacatagctggatcaaatttttaagggtttctggttctctcttgctgtttcagtgacctccagggtctctcggagtccctctcctgttctcattttctgctgttgtcacctctttcccttcacaatataccccaagtttcagaaatcagagtgactcacgtttgtcatcatctgctgtgtgtgtgtgtgtgtgtgtgtgtgtgtgtgtgtgtgtgtgtgtgtgttgcacccgggcctttgcttctgctgtgcctgctgctttgaacgcccttttcgcaccttaggggcatacctcccagtcctggtggtctttcaaagtgctacctcaacacccattctctgggagctctcttgggccactctatacctctgtgaccatatcctcctctgggccctaatcatattatatgcctatagatgcctccttagacacccctccaccctgccttccattatggcctgtccagccttccctttaatcgcccatccatctctgattgtccgtctgccccatcttgtttcctctctccccatccatccgtctgtccatctatccatctatccaccctgtacatccatctatccatccatccgttcattcatccatctctttatcctttcatccatccatttatccatcccatccatccatccttctatctgtccatccatccatcctaatcatattatatgcctacctctgagggcaccaagcaccctgagggtagttatgtgttggggggacatatttcccccaatagaaccagcttcttcagggtaggaactgtatctgatttctctctccatccctcccactgcttggtccataacatacctcaataaatattaaatgaataagtgattccttttgtttcttcttgggggctgtaaaccagtggtctgtgctctggccctgagccaaatgaccttatgcctatgatagcctgactgctttaagacccccacactctgcccagtagcaacccctttatgcagagtttaaaagtcagacatgcaaaatagaggcaaaatagacattcagcagatgtccctcctcccctgacttcttgtcccctctccctctaatccttccagcctgtgggagctcggaggcctcagcctacctggatgagctgcgtttggctgtggcttggaaccgcgtggacattgcccagagtgaactctttcggggggacatccaatggcgggtgaggggtcagggcctgggggttgggcatactgacaaagggactgtgctgtcctccctctctgccttctttttttttttttttttttttgacggagtctcactctgtcacccagcctggagtgcagaggtgtgatcccagctcactgcaagctccgccacctgggttcacgccattctcctgcctcagcctcccgagtagctgggactacaggcgcccgccaccacacccagctaatttttttgtatttttagtagagacggggtttcactatgttagccaggatggtctcgatctcctgaccttgtgatccgcccgcctcaggctcccaaagtgctggggttacaggcatgagccaccgcacccggcctctctgccttcttagacgcccctcaaccctgccttccattatggcctgtccagccttcccttaattgtccatccatctctgtccatctgccccatcttgtttcctctctccccacccatccatctgtctatccatccatccaccctgtacctccatctatccattcatccattcattcatccatctacttatccatccatccatccatttgtccatccatccatttatccatccatccatccatccatccatccatccatctgtccatccatccatccatccatccatccatccatctgtccattcatccatccatccattcatctgtccatccatccatctacctatccattcatccatacatccatccatctacctatccattcatccatccatccatccatctatccatccatccatctgtccatccattcatctgtccatccatccatctacctatccgttcatccatccatccctctgtccatccatccatccctctgtccatccatccatccctctgtccatccatccatccatccatccatccatccatccatctgcccatccatccatctgtccatccatccatctacctatccattcatccatccatccacccatccatccatccatccatccatccatccatccatccatccatccatccgtccctcatacccttgcccatctcttgtccttaacctttgagctaatctcttcccctattcatcccaccctgccagtccttccatctcgaagcttccctcatggacgccctgctgaatgaccggcctgagttcgtgcgcttgctcatttcccacggcctcagcctgggccacttcctgaccccgatgcgcctggcccaactctacagcgcggcgccctccaactcgctcatccgcaaccttttggaccaggcgtcccacagcgcaggcaccaaagccccagccctaaaagggggagctgcggagctccggccccctgacgtggggcatgtgctgaggatgctgctggggaagatgtgcgcgccgaggtacccctccgggggcgcctgggaccctcacccaggccagggcttcggggagagcgtaaggaccgggcaaagctggggggcccccccgcgcgggaaggacctgggggcgggattacatcagggatggggcgtggccaaaccagaggcagggctggtggtggccagtgttggggaggggctggtcctcaccacccctccttttgctggcagatgtatctgctctcggacaaggccacctcgccgctctcgctggatgctggcctcgggcaggccccctggagcgacctgcttctttgggcactgttgctgaacagggcacagatggccatgtacttctgggagatggtgagtgctgacttggcgctcctgcatccctgtcctttaggccactggatgccagtgttcccgaaacaattaccatacaattccccgacccctgacgtcacctgacaggcgccccatcctccgtcgctgatatatgcctccaactgcttcctctttcttttctctctctcacatcatgcattattttatgtgtttattttttgagacagagtctcgctctgtcgcccaggctgcagtgcagtggcgcaatcttggcttactgcaccctcagtctcccgggttcaagtaattctcctgcctcagcctccggagtagctgggattacaggcacctgcccccacgcctggctaatttttgttttgttttgttttgttttagtagagatggggtttcaccatgttggccaggctggactcctgacctcaagtgatccacccgcctcggcttcccaaaatgctgggattacaggcatgtgccaccgtgcctggccaagattctctctttgttttggcctttgataatatatctcagtgtggatctctgtgaatttctttttctttttcttttttttttttttttgagatggagtcctgctctgttgcccaggctggagtgcagtggcatgatctcggctcactgcaagctccaccttctgggttcatgccattctcctgcctcagcctcccgagtagctgggactacaggcgcccgccaccacgcccagctaattttttgtatttttagtagagatggggtttcaccgtggtcttgatctcctgaccttgtgatctgtctgccttggcctcccgaagtgctgggattacaggcgtgagccactgtgcttggcctgtgaatttcttttacttggagttccttgagcttcctggatgtgtagacttttgtctttcatcacattttggaagtttttaggacattatatcttcaaatattatttctttccctttctgtctctcttttccttttggactctcattatgtatgtattaatattctgtatggtgtctcgcaagtcccttaggctctgcttattttccttcatttgtttttcttttttctcctcaggctggataatctcaatgtacttagcttcaaattcactgatctttattttgccttttttatgaatctactgttgagtccctctagtggtttttatatttcagttattgtgctttttagcttcagagtttctatttggttcatttctgtctctgtagtcttttttttttttttttttttttttttgagacagagtctcgctcagtcgcccaggctggagtgcagtggctcaatctccgctcactgcaagctctgcctcctgggttcacgccattctcctgcctccacgccattctcctgcctcagcctcccaagtagctgggactacaggtgcccgccaccacgcccagctaatttttttgtatttttttagagacagggtttcactgtgttagccaggatggttgcgatctcctgacctcgtgatctgccctcctcggcctcccaaagtgctgggattacaggcgtgagccactgcgcccggcctctgtagtctgtcttttttttttcctggtcccactacaaaactttatttttgattacagtaccattctcaatctcttctacaaaaagcagaaaaaaaagcagccacttcactcaagacctatatacagataagatgttttctgtgtttttttcttttttttttaatttttatttttaaaaaaataaattcagtgttcacatttctataaagaattaacccagtttcaggaaaccctgcctctatctctgtattcttattctctaggtggtgagacatctttttcctggctccctttagttcttttttcatgatttcctttagctcttcgagcatatttaagacaatttatttaaagcctttgctagtaagttcagtgtctgagtttcctcagggatagtttctattcatttatttttttcctactcatttctattcatttcatttcttttcttttatttatttatttgttgttcttgttgttgttgttgagacagagtctcattctgtcactcagactggactgcagtggtttgaccaaagttcactgcaaccttgacttcttggactcaagcaatcctcccacctcagcctcctgagtagttgggtctaccagccacatgccaagctaattttaaaaaatttgcagagatggggtcttactatgttgcccaggttggtcttgaattcttgggctcaagcaatcctcctgcctgggcctcccaaagtgctgggattacaggtgtgagccaccatgcctggtctctattaatttcttttttttccagtatatgaaccatattgtcttgtttctttgcatgcctcataatttttggttgaaaagtggaacattttgaatatgataatgtggcaactctggaaatcagcttatgccctccctccagggtttgttgtggctgctgctcattgtgggtcattgttgtttgtttagtgacttttcttttttctttttcttttttttggggggaggggggatggagtctcactctgtggcccaggctagagtacagtggtgcaatctcggctcactgcaagctccacctcccaggtttaagtgattctcctgcctcagcctcccaagtagctgggattacaggtgtgtgccaccacacccagctaatttttgtatttttcatagagacggggtttcaccatgttagccaggctggtctcaaactcctgacctcaggtgatccacccaccttggcctcccaaagtgttaggattacaggcgtgagccaccgcgcccaccctgtttagtgacttctctaaaccttttttggaaagtctgtattctttgcatgtgtggccatggaagcccctcttctgttagcttagtggtctgctggtgacttgacagagatatccttaaatgcctagaaccacagaagcaaatataacaagaaactccctataagtgctgggattagaggcatgagcgacgcccaccgtggctgtatattgaagcagtctttcaatacttagccaagctgtttacagttctgctttagtcttcacttcctgcttgtgcagagcctaaagttcagccagatgtaagagcttcaggttttctctggtattttctgagcacgcctctagccctagtcatgcatctagccgtctggatttcctggtacacaaggaagactttcaaagcccttattccctccaagtatttcctttcatggcctctttcttcccaagatgcttagtgtatctattactgcctctactgtgagtccttgcctcagatggatgtggttaattcatttgcctttaaaagattttaacaggccgggtgcagtggctcacacctgtaatcccagcactttgggaggccgaggcaggtggatcgcctgaggtcaggagttcgagaccagcctgaccaacatggagaaaccctatctctactaaaagcacaaaaaattagcctggcatggtggcgcatatctgtaattccagctactcgggaggctgaggcaggagaattgcttgaacctcggaggcagaggttgtggtgggctgagattgcagcattgcactccagcctgggcaacaagagtgaaactccgtctcaaaaaaaaaaaaaaagattttaacacacactgcctggaaagccactttttctctggggaaagctctaaggcaggtgaagcaaagtcaagtccttgagctgttgcttcagggagccaccagatagggccacacacacaaccacaattctggagggtaagtctgaattgctccctctagtactagcgacccacaccaggaatgtgtgtctttgtcttcaaggttgccactgaactggggagctgggggtagtaagtgggtaggttaaaatgtcacagtaccctcttactgaaatttagtggtctcttcattaagcattttcttgtttttttttttttataagttttcgattagattccagaattctagaaaagttgattctgacaacttttgatagctattgattgcttttgtggagggataaagttttgaagttccctacactggcatttttggtcacctctccaagggcttttaaaaatttcattgttagagacagggtcttcctcagtcatccaggctggagtgcagtggcatgatcatggctcactgcagcctcaacctactgggctcattcgatcctcctacctcagcttccctagtagctgggactacagaagcagaccaccacgcctggctaactaaaaaaaaaaaaattttgtagagatggagtctcaccatgttgcctggctggtcttgaattcctgggctcaagcaatcctcctcatttgtaaccacccaatgggttcacgttgcccgctgcctagacagagccgatttatcaaaacaaggaaagtgtaatggagaaagagtaattcgcgcagagccggctgtgcgggagacctcagttttattatcactcaaatcagtctcctcgaggattcagggatcagagcttttaaagataatttggtgggtagaggcttgggaagtggggagtgctgattggtcaggttggagatggaatcacaggggttggaagtgaggtttttcttgctgttttctgttcctgggtgggatggcagaactggttgagccagactacagtctgggtggtgtcagctgatccatccagtgcagggtctgcaaactatctcaagcactcatcttaggtgttacagtaatgatgttatccccaggagcaattgggggagccagaggctgcgtgacccctaaacttaatttctaatcttgtagctaatttgttagtcctgcaaaggtagactggtccccaggcaagatgggggtctttggggaaagggctattatcaatttcgtttcagagtcaaaccatgaacagaattccttcccaaagttagttcagcctatgcccaggaatgagcgaggacagcttaagggttagaagcaagatggagtcggttaggtctgatttctttcattgtcataattttctcagttatcatttttgcaaaggtggtttcacttcagcctcccaacgtgctgggattatagtcgtgagccactttacccagcctccaactgcttcttgacctgtctgtgactgctgaattgattctaactgcagcccagcccctgacttgcatccctggtctctgaaccacctgacttctggcattttcaactgactttcagtttcttccagatccatctccaaacattacttcatccttggcctctgatgaccccagttagtttctgacctctgactctgttccttcccttgacttcaggcttcctccccctctatgaaccctctttgacgcatccgtgccctctttgtctctccagggttccaatgcagtttcctcagctcttggggcctgtttgctgctccgggtgatggcacgcctggagcctgacgctgaggaggcagcacggaggaaagacctggcgttcaagtttgaggggatgggcgttggtgcgtggggcacggtgcctgggagcagggacgggggctgccgccagagggggatgtgcaactccgcactcctcacatatccctgcgccatccccttaaattcccttacctctcccttcacaccctcaccctactccttcccatccctgtcacataactaactcctctgccccagacctctttggcgagtgctatcgcagcagtgaggtgagggctgcccgcctcctcctccgtcgctgcccgctctggggggatgccacttgcctccagctggccatgcaagctgacgcccgtgccttctttgcccaggatggggtacaggtgagtatctgcgacaccaacatcccaaacagtctccaagtggactctgggaagtatggggatgagcccctgccattgggaacatctatggtcttgaccagccactctccctggagatcccccagaaagtctctcttctctctcagaaaggctgctcttcccataagaagccccgctcccttccaccaaaagccaaccttcccacggcaaagcccatcttcctaaaaagttccactccagatagagaaactccttgtgaccctgtcaggaaattccacctttaaccttggaagtccttcccgctttcagggaagagtccatttctttcaaaggaagtcctagctcatccacaggaagtcctacggcatccacaggaagtcctttccacttcctttagaggtccctagtttcagttttcagcagttagaatggcctcactgaacaattacctttttttttttttggacataaacaaactttggtctaggaaatctcacccttcctataggaaatcatctgccttgggaagccctacttgctcccacagtctctccgatcctgacaagttgacattttggaaacattatcaatatttttagtttaaatctgacaggggctcagagtcccactttagtacaggaagttgtgcccaacaggaagtcccatcctcatctgttggaatggtttggctgacatttcaaacagctacccagagtcccttgctgtggatagtggttaaactcatggattccagctctaccacatacaaactgtgtttctttgggccgtttccttaacctctctgtgcctcatgtgtaccaaggaggagatactagtacccacccccttatgtgtcaagggttcggtggactaatctacataaagtgcttagccctgtatctgccatatggtgtcaatttaagtgttgactgtttactgccaaaacctggcctaagttgtctttgcctttcaccaccgtttccctacctcaatagttgtggctgtgacattgggcacttgctctgtactctggagctgcagtccaacccttgctgggcgtcttagggacggggctgtgggggagatttggatcctaatccttcccaccccccacagtctctgctgacacagaagtggtggggagatatggccagcactacacccatctgggccctggttctcgccttcttttgccctccactcatctacacccgcctcatcaccttcaggtcagtaccctggggtgagagtggtggggatgggggcggggtgctcagtttctccttcctgccccctctgcccacctttcttccctcatcggcccattgtgtcccttccctaggaatgggactctctgtccctccactaagggagtgctgtgggaggtgagttttgggggggatcctccctgtggtatctctagtggcagttactctgcctttctggccatggctctgggggaaggtccctttgggatgactttaggagaccacctctctgtccctctgccatgtctccgggtgaagaagtttgagttttgctggagaatgcctctccaccttctcttcccctcatttcttgctctgtgcttccccccttgctaggaaatcagaagaggagcccacacgggaggagctagagtttgacatggatagtgtcattaatggggaagggcctgtcgggtgagtggagcctccagcactgtgtgaggtggggacaccctgggcagttcaggacatgtgccagttccacgttgtgttagtcccctcttgagttgctacaaagttgctaaacctgagactgagtaatttataaagaaaagaggtttcattggctcatggttctgcaggttgtacaggaagcatagtgctggcatctgcggctggtgagccctcaggaagcttccactcatggcagaaagtgagggaggagccagtgtatcacatggcgagagcagaagcaggagtaggggtgccacatagatctcatgtgaactaactgagcaaaaagtctccaaagggatggtgctgagccatttgtgaaggacccaccaccaggacccaaacacttcccccaggccccacctccaacattagggattacatttctttgttctttttttctttttttttgatacggagtctccctcagttgcccaggctggagtgcagtggtacaatcttggctcactgcagcctctgtttcctgggttcctgatcagcctgcctcagcctcccaagtaggtgggagtagaagtgcatgccactacgcccagctaatttttgtatctttaaagtagagtcgggatttcaccatgttggccaggctggtgtcaacctcctgacctcaagtgatccgcgcactttggcctcccaaagtgctgggattacaggtgtgagccaccgggcccagccagggattacatttctttctttcttttttgaaatggggtctcgctctgtcgaccaggctggagtgcagtggtgtgatctccgcctcctgggttcaagcgattctcctgcctcagcctcccgaatagctgggactacaggagcccaccaccacacctggctaacttttgtacttttagtagtgacagggtttcatcacattggccaggctggtcttgaactcctgaccttgtgatccgcccgcctcagcctcccaaagtactgggattacaggcatgagccaccatgcctggcccagggattacatttcaatgtgagatttggaagggacaaacatccaaactatatcacacgtcccatcagggactgagatactgaggaagcttcccaggtgccaagctcaagacttggctcaagatttggttctgccatcaaggaggccatcaccagaaattgattttcttcatgctacacatacttccatccctctgtagcaagcggaatcagttgattgagggatttttcacctattttgttcgtggtcccaaggcccctgcttttaatcactatgctatggttgccgttaaggtattttaaaagtcaggcctaagcaaatgaaatagaatatttatcaaacttctttttttgttgttgtttttgaggcggagtcttgctctgtcgccaggcaggagtgcggtgccgcgatctcatctcactgcaacctccgcctcctgagttcaagcgattctcctgcctcagcctctcaagtagctgggattacagtcacctgccaccacgcccagctaatttttttgtatttttagtagagacggggtttcaccatgttggccaggatgctccccatctcctgactttgtgatctgtcctcctcagcctcccaaaatgctgggattacaggcatgagccaccatgcctggcctatatatagttttttaagacaatgtagagaggatacaaaatatttatctgtagccataaaaaagaacgagatcatttcctttgcagtgacatggttggagctggaggccattatccataacaaattaacaggaacagaaaaccaaataccccatgttctcacttataagtaagaactaaatgatgagaacacatggacacacagagtgaaacaacacacattggggcctattggaggacagagggtagggcgagggagaggaccaggaaaaataactagtgggtactaggctaaatacctgggtgatggaataatctgtacaacaaacccccatgacacaaatttacctacctaacaaacctgcacatgtacctctgaactaaaaataaacgtcaaaaaataaaaaaaagaacaaaatatgtatcaagagagaagggaaaaactaagataaacatttggaccactgagaaaggttgatagaaggccccagtgtctgaggtcaggatcagtaatggtgtccttccctagcaatttctcatctgcacatgtgatgatgatgacgaccttgataacagctgatgttatgaaacacgtacaatgagcaactactgtgctcaattcttttgaaaatcagttggttttttttttttttttttgagatggagtcttactctgtcgcccaggctggagtgcagtggcatgatctcggctcactgcaagctcctcctcccgggttcacaccattctcctgcctcagcctcctgagtagctgggactacaggtgcccgccaccacgcccggctaatttttttgtatttttagtagagctggggtttccccgtgttagccaggatggtctcgatctcctgacctcgtgatctgcccgcctcggcctcccaaagtgctgggattacaagcatgagccaccgcacccgtccggaaatcagttcgtttaattccaacaacccagtgcaatagggcctataattattctcattttgcaggtgaaataatggagtcattcagtcacttgcctcagatcatgtggttggtaaatggtagagccgagatttgatcccagatcctcttgtacctgagtctgtgctctcagcccctgtggagcccccccactgagagctctgttgaaggacagatcccaagatccccccagagaggctggggctgagcccaggaacctgcctgtggcctggctggaggtgattcaagatggcagatgtgggggaagctttctgacccaccgctctcccttcttaccaggattctgcaggagaactgtgaaataccatgatggttttctctatcagtagggagcttgctgtcctctctgcatctgaccttctttctctaggagttcttagtttctgtagctttcactattctcctccttctcctcctccttctcctccttgtcctcctccttgtcatcctccttctcctcctcctcgtcatcctccttctcctcctcctcttcatcctcctcctccttctcctcctcttcctactcatcctcctcctcttcctccttctcctcatcctctttctcttcctcctcctcatcctcctcctgctcctgctcctccgccttctcctcatcctacttctcctcttcatcctcctcctgctcctgctcctccgccttctcctcatcctacttctcctcttcatcctccttctcctcttcctcctcttcatcctcctcctcctgctcctgcttctccgccttctcctcatcctccttctcctgctcctcctcctcctgctcctctgccttctcttcatcctccttctccttctcctttcttcttctttgagacaggatcttgatctgtcactcaggctggagagcagtggcgcgatcatggcttactgcaccctcaacctcccaggctaagccatcctcccacctcagcctctcaagtagctacagatgcatgctatgctcggctaatttttatatgttttgtagagatggggtttcgccatgttgcccaggctggtctcaaattcgaaggcttaagtgatcttcccacctcggcttcccaaagtgctgggattacaggcatacaccactgcgcttggcctcacttatttccttccttcctccttccttccttctttccttccttcctttcctttccttttctttccttccttcctttctttccttccctttctttctctctctctttctctctctgtccctccctcccttccttccttcttttcttccttccttcctccctctcttttctttctttctctatctccttccctccctccctctctccctccccccaacccttccttcctcccttctgagacaaggtctcactctgttgcctccgctgaagtatagtagcttgatcttggctcactgcagcctcaacctcccagtgtcaagtgattctcctgcctcagcctcctgagtagctgggactgcaggtataaacacacctggctaatttttttttttttttctgtagagatggggtttcaccatgttgcccaggctggtgttgaactcctgggctcaagcaatctgctcaccttggcctcccaaagtgctgggatttcaggcttgagctaccacgcccagcctcacttttttttctttttttttaaatggcagctttattgagctgtaatccacatatcataccgttcacttacttaaggtatacaattcagtgcttcttggtgtactcacagaattgtgaaatcatttccacaattcattttcaaatattgtcatcactccaacaagaaactctgtacatgcttagcactgcttttcgttttcccagccctaggccaccattcatgtacctgctgtctctgggtttgcctgttttgcacacttcacataagtggagccatgcactctatggtcttttcttcttcttcttctttatttttttattttttgagacggagttttgctctcgttgcccaggctggagtcaatggcgcgacctcagttcaccacaacctccgcctcccgggttcaagcgattctcctgcatcagcctgtcaagtagctgggattacaggcatgcgccaccacgccaggctaattttgtatttttagtagagacggggtttctccatgttggtcaggctggtctcgaactcccgacctcagctgatctgcctgcctcggcctccccaaatgctgggattacaagcgtgagctagcgcgcccagcccgtttctactttaatttttttttttttttttttagacagggtctcgctctattgcccaagctggagtgcagtggcatgttcatggctgactgcagcctgggcctcctgtactcaagtgatcctcccatttcagcctccccagtagctgggactacaggtgcttgcccctactactggctaaatttttatttttatttattttattattattattattattatttttgagacagagtctcactctgtcgcctaggctgcagtgcattgcaacctctgcctcccaggttcaagcgattctcccgcctcagcctcccgagtatgtgggactactggcatgcgccaccagacccggctaatttttgtatttttagtagagacagggtttcaccatgttggccaggctggtctcgaactccctacctcaggtgatctgcccgccttaactcccaaagtgctgcgattacaggcgtgagccaccgcgcccgatccgggtatatttttaaaatattttttgtagagatgaggttttgccatgttggccaggctggtctccaactcctcggctcaagcgatcaatccacctcttgaccggagatttcagaggtcagaggttagatacaagagtcaaaacccaagaaattagctctgggcagactgagtttcgggtcaggcagggtgagatgtgccaagccaaaagtctcgatgatggtggagatcaggactcagaggtcagagtgaggcctcctcccttctcttctcttcccccacaggacggcggacccagccgagaagacgccgctgggggtcccgcgccagtcgggccgtccgggttgctgcgggggccgctgcggggggcgccggtgcctacgccgctggttccacttctggggcgcgccggtgaccatcttcatgggcaacgtggtcagctacctgctgttcctgctgcttttctcgcgggtgctgctcgtggatttccagccggcgccgcccggctccctggagctgctgctctatttctgggctttcacgctgctgtgcgaggaactgcgccagggcctgagcggaggcgggggcagcctcgccagcgggggccccgggcctggccatgcctcactgagccagcgcctgcgcctctacctcgccgacagctggaaccagtgcgacctagtggctctcacctgcttcctcctgggcgtgggctgccggtgagtgccccggggccttggaaccctggcccctggccacctctcatccttcctgcccactcccggggtctccactcccggcttccccgcagctgggcagcaggtcaagccaaccctgctgattgagaacccctcttaggaaagtcgggcatgacgattgccccagggtaattggctggcacctggagatctggcttcagggacggcaggattcaggagaaaaccccactgtccgccactcagcctctgctgctatttattgctaggcctgaagtttaacagatatttatgggagcgccccgacctgggtgccaacctcacctcctcccttctcttcctccacatagctcgttggtcccaggccccttgccctcctgcccccgactttttctttctttcctttttttttctttctttctttctctttctttctttttctttctttctttctttctttctttctttctttctttctttctttctttctttctctctctttcttttctttctttctcttttcttttcctttcttttctttttctttttctcttttctttctctctctctccctctgtcctctgcccctctgcctccctccctccttccttccttccttccttccttccttccttccttccttctatgcttccttccatccctccaagctaagggtttaacccttgccctgcctgcattatggagtatcctgcattaggatactcctccttttgaggagagcaaacagaaaagtttgtggatacaacctggtgactggttttttgtttgtttgtttgtttttgttttctttcttttcttttttttttttgagccagagttccgctgtgtcgcccagactggagtgcagtggtacgatcttggctcactgcaacctccacctcctgggttcaagcgattctcttgcctcagcctcgtgagtagctgggattacaggcatgcaccactacacctagctaaattttttttgtattttttttgtagagatggggctttgccatattgaccaggctggtcttgaactcttggcctcaagtgatccactggccttagcctctgaaagtgctgagattacagatgtgggtcaccgtgcctggccaacaacctggtgactgtttacaagggacctgacacatcctgaatggttgacagtgatgacagtgatgatccctactcaagcttttcccagtagacacgctgagaggcaggcttcctctaagctatgttagcagtgttacaaagtgattcaacataaataatttattcaagcagggagcaagatatgagagttttgcagaacactaatacttctgtttgtaatttgttgtattttgtataaagtgacttttgagatgaaagggctaaggccatatgctaccatgctctaggattgccagtgatattttggacagtttatcaagcctaccactttccaggtgaaaaatggaaagatctcagcttaaaagggagaaacgggcctggcgtggtggctcatgcctgtaatcccagcactttgggaggccgaggcgggtggatcacctgagatcaggagtttgagaccagcctgcccaacatggtgaaaccccatctctactaaaaatacaaaaaattagccgggcatggtggcaggcgcctgtaatcccagctactcgggaggctgaggcaggataattgcctgaacctgggaggcggaggttgcagtgagccaagatcatgccactgcactctagcctgggtgaaaagagcaaaactctgtcaaaaaaaaaaaaaaaaaaaaaagggagaaatgtctaatcatctccggaattgaatggatgaatcatcctttgtttcgccagttccctctagatggacatttaggttctctctttctttctttttttgttttaaatagagacagggtctcactctgttgcccaggctggtctcaaactccagggctcaagcaatcctcccaccttggcctctcaaagtgctgggattacaggcgtgagctactatgctcagccttctgtttttttattattccaaaataataaaagtttacatcccagatgtaaagtttatgggtcaaagggtacatttatttttgacatggatagatttccttctaagtagcttcactcatttccacacctgccatcagggtaagagagtgcccccttgaggccatgctcgacaatgcctgatactttcactctaaaatgtagctctcaatttaactgaaaaaaaatttgccaatttaatgggtaaacatgacctctccttgttataatttatgcactcttgactaccagataggttggacatcttttcctaagcttaatggccatatgtccttgtgcccccttgttttttttttggtttttgtttttgtttttgtttttgagacggagtctcgctctgtagcccaggctggagtgcagtggcgcgatctcggctcactgcaacctccgcctcccgggttcacgccattctcctgcctcagcctactgagtagctgggactacaggtgcctgcctccacgcccggctaattttttgtattttgtagtagagacggggtttcaccgtgttagccaagatgttctcgatctcctgaccccgtgatccgcccgcctcggcctcccaaagtgctaggattacaggcgtgagccactgcgaccggccaccctcccgtttttttaattggggttcattgatttgtatatgtataaatgtatatactccttatactctggatcctaatcctcggtagttttgttggtcttaatatcttcatatcttctcgaagtctgtggcttgtcttttcactttcacttttgtatgtttcttttcttttcttttttttgagcctgcctcggcctcccaaagtgctgggattacaggcgtgagccaccgcgtctgtccatacactaggtttttaatccatccaaagtttaagtacatgaggatgcaaaataggggtagaatttttattttccccataggaattattgatgtttactggccgtttgaacgtcctctgtgaattgtacgtggtatcctttatctggcttccttccttttgcgtattagtttgtaaggactctatatgttttgccttttataggttggacagatattccggcagtttttccagcttgattcttacagggaccagctctttgctaaggccatcgttcattcagtcattacttaataggcgcagccattttaaaaatgggtgccagggccctgcatggaccagcttggtactgaataaatttgagtaaaccccgggtgactgggagggtcctggtcctgcccggtggaggctgcagcttcctctgaaggatggcattgggaagacttccattttccttggcgtcttgtgacacttgacccttgtggcatctccccacaccccaggctgaccccgggtttgtaccacctgggccgcactgtcctctgcatcgacttcatggttttcacggtgcggctgcttcacatcttcacggtcaacaaacagctggggcccaagatcgtcatcgtgagcaagatggtgaggcaggggcggggccaaagtgggcggggacatagggaaaggggtggggccagggagggagtggtccgtggagaaggggcgtgactttggggagcaatggggcgtgtttttgggatataggggtggggccagagtaggaaagggcggggccagactcagccacatctccccacagatgaaggacgtgttcttcttcctcttcttcctcggcgtgtggctggtagcctatggcgtggccacggaggggctcctgaggccacgggacagtgacttcccaagtatcctgcgccgcgtcttctaccgtccctacctgcagatcttcgggcagattccccaggaggacatggacggtaggggggatgacggcctgacagccttcctctgagtctctgtccccgctccctgggtctctgtcctcctggctctaagaaaatatctgtctctctgagtctctgtctccctctttctctggatctctgagtgataccctatattccccatcatcatctctctgggtctctgcctaccccaccccctctgtctttctgtctgtctttcttttttctttttttttttctttttttttgagatggatgttagaaatgtttattttgtggtgtcgtaaagaaatagtacttgaacataaatttaatttttttagtaaagccatttttattttttgtagaaagggtacactcgccagcagttttgtcatgagagtacacggaacaaaggagatagggtcatttataacctgacgcgtctattttactgctgtgtctggtttttattggctggaaccggactttacattttgtatttgtcttgattggctagtaacttagaagtttttaaaagaagcgaaggcagaggagaacaaaggaaggaggaagtaacttgtggaatgttgagaaaggtaaaaacacttttaaataaggaagaggaacaggctatgatctaatgcttgcttgaaccagtataagtatgtcagggcaaatatttaggctaaattgtgagagctaagaacataaagtacattgatttattttttatggctagtagatatttaagaatgttagcacaggtgtttgaataaattttgtttctaagagaagttactatttattgttaattagatggggaggaaagtctttgaagaggaacctgtactttactttttacatggagttttgctcttgttgcccaggctggagtgcaatggcacgatctcagctcactgcaacctccacctcccagatcgaagcgattctcctatctcagcctcccgagtagctgggactacaggcgcgtgccaccacgcctggctaacagttttgtgtttttagtagagatggggtttcatcacattggtcaggctagtctcaaactccccacctcaggtgatccggccatctcagcctcccaaaagtgctgggattacaggcgtgagccaccgcgcccggcagtcttcctgtctttcttaggtctctgtccccctcaccccatctctgaatgtctctcttcacagtggccctcatggagcacagcaactgctcgtcggagcccggcttctgggcacaccctcctggggcccaggcgggcacctgcgtctcccagtatgccaactggctggtggtgctgctcctcgtcatcttcctgctcgtggccaacatcctgctggtcaacttgctcattgccatgttcaggtgaggcctgactgctctctgatctgaccccacccagcatgacccgtggccctctcatgactcttgaaccccgtctaatgaattctgtttttagtccctgaactctgatccaatctaatgctgccttctccccaaacccaaccagaccctgcttgtaatttggactttggactgatcctctccctgagcccaggttgaacttccttatttgtatttttttgagacagggtctcactctgtcgccaaggctagagtgtggtgatgtgatcgtagcttactgcagcctcgacctcctggactcaagcaatcctcctgccttcgccccataagtagctgggactacttaaaattagccaggccagcaggcctgcctaatttaaaaaaatttttggagagaggggtctcactatgttgtccatgctagtctcgagctcctggactcaagtgatcctccctcctcagcctcccaaagtgctgggataatctgtcacctaggctggagtgtagtggcaagttctcagctcactgcaacctccacttcccactcccccatacccagttaattttttgtatttgtagtagagatagggtttcaccatgttggccttgaactcttgacctcaagtgattggcccacctcagcctcccaaagtgttgggattacaggtgtgagccatcgcgcccagccaactttgttttttattgtggtaaaattatataaaattttccatttttacttctttttttttttttttttttttgacggagtctcgctgtgtcacccaggctagagtgcagtggcacgatctcacaatctcagctcactacaagctccgccacccgggttcacgccattctcctacctcagcctcctgagtagctgggactacaggtgcccgccaccacgcccagctaatttttttgtatttttagtagagacggagtttcaccgtgttaacccggatggtctcaatctcctgacctcgtgatccacccgccttggcctcccaaagtgctaggattacaggcgtgagccaccgcgccccgcctttttttgagatggagtctcgctctgtcgcccaggctggagtgcaatggtgcaatctcagcttactgcaacctccacctcccaggttcaagcgattctcctgcctcagcctcccaagtagctaggactacaggcgtgcgccaccacacctggctaattttttgtatttttagtagagatggggtttcaccgtgttagccaggatggtttcgatctcctgaccttgtgatccgcccgccttggcctcccagagtgctgggattactgacatgagccaccgcggccggagttgatttttaccatttttaagtgtacaagtcagtgacattaattacatttacagtactctccaaccatcaccactatctattttcaatacgttctatcacccagaacagaaagtgtgtccccatgaaacagcaactccccacttcccctccccacaggtcttagtaacctccagtgtattttctgtctctatggatttagtctagatgtttcatgtaagtggaattatgcgatatttgtcttttggtgtctggctgattttactgagcatgttttcaaggctcatccctgttgtagtgtgcatcagaacttcattcattccgttttatgaatgagtaatattctattgtacaaatagaccacatttgggcccagcgtggtggctcatgcctgtaatcccagcactttgggaggcctaggcgggtggatcacctgaggtcaggagttcgagaccagcctggccaacgtggcaggaccccctttttactaaaaatacaaaaattagctgggctcatgtctgtaattccagctacttgggaggctcaggcacgagagtcgcttgaacccaggaggcggaggctacagtgagccaagatcgtgccactgcactccagcctgggcaacagagcgagactccatctcaaaaaaagaagaccacatttgatttacccgctcatctgttgatgaacacttgggttctttctgccttttggctattgtgactaatgtttgttggaacattggcatgcaagtatctatttgaatccttgtttttatttcctttgggtgtgtatctcaaagtggaattcctcggtcatgtggtaattctatgtatagctttttgagaaaccaccaaactggtttccacagcagctgcaccattttccattctcaccagcagtgtatgagggttttaatttctccacatcctagccaacacttgttattttccttttgtaaaaattatagtcatccagctgggtgtagtggctcatgcctgtaatcccagcactttggggggctgaggtgggaggattgcttgagcacaagagttcgagaccagcctgggcaacatagcgaggctgctgtctctaccaaaacaccagaaatgagataccacttcacacctgcagcctcaacctcctgggctcaagtgatcctcccacctcagcctcccaagtagctgggactacagttacgtgccaccatacctggcttgtttttttaattttttttttacttttattttatttatttatttttagtagaaacggggtttcaccatgttatccaggatggtctcgatctcctgaccttgtgatccacccatctcggctggatcccaaagtgctgggattacaggcgtgagccaccgtgcccagcggctattttttttttttttaatgaaactcctttttaatcctatgttaggtctctctgtttgcttcctttcttgttggcatgatttttgctgagaaaatataaaatttcattggctttggttgtttttttttttttttttttttcagagatggggtcttactatattgcccaggctgatcttgaacccctgggctcaagcagtcctcttgccttggccttccaaagtgctgggattataggcacaagcccctgtgctggacctattgtattagtttcctagggccgccagagtaccaaaaactgtgtggctttaaatcacagaaattgtctcacaattctggatgctagaggtccaaaatcaaggcatccgtcaagctgttttcttctgagggatgtcggggagagtctgttccatgcccctcctgtcacgtctagtgctttgctggccatctttggcttctagttgcgtcattgaaacttctgctttcatcttccagatttccccttttaataaaacgttacttaaattggattagggaccatgctaataacttcattttaacttgatcacatgtgtaaactctatttccgaataaagccacatatttcataaataaaaaatttaaaaaggtctcattctgaggcactatgggttatgacttcaacttttttttttttttttttttttttttggagacagagtcttgctctgtcacccaggttggagtgcaatggcgtgatctcggctcactgcaacctccacctcctgggttcaagggattctcctgcctcagcctcccgagtagctgggattacaggtgcctgccactatacacagctaatttttgtatttttagtagggacggggtttcaccatgttgcccaggccgatctcaaactcctgacctcaggtgatgcacctgcctcggcctcccaaagtgctgggattacagccgtgagccactggacccggccggacttcaacatatctttagcgggatacaattcaatgcatgacactcatagatttatgagtttatttctggactttcaattctattccactggattgcgtctatccttatgccagaaccacacagttttttgggttttttttgagacggagtctcgctcttgtcacccaggcgggattgcagtggcacgatctctgctcactgcaacatccgcatcctggattcaaacgattctcctaactcagcctcctgagtagctgggattacaggcacctgccaccacgcccggctaatttttttgtatttttggtagagacagggtttcaccatgttggccaggctagtcttgaactcctgacctcaggtgatctgcctcggctttccaaggtgctgggattacaggcgtgagccaccatgtctagcccacacagtgttgattactgtaggtttgtagcaaattttgacattggaagtatgagtctcctttgttatttttcaagattgttttggctattctgggcctcctgcaattctatatgaacttaaagatcagagtttccatgtctgtcaaaaaggttgttggaattttctttttttttccttttttttttttcttttttttgagacagagtttcactcttgttgcccaggctggagtgcaatggcgcgatctcagctcaccacaacctctgcctcccgggctcaagcgattctcctgcctcagcctcctgagtagctgggcttataggcatgtgccaccacgcccggctaattttgtatttttagtagagacagggtttctccatgttggtcaggctggtctcgaactcccgacctcaggtgatccacccgccttggcctcccaaagttctgggattacaggtgtgagccaccgcgcccggccagttgttggaattttccgagggattgcgttgaatctgtagattgcttcgggtagtattgatatttcatctaggtgttctttttaatgcttttccagcagtatttggtagttttcaggctacaaattgttcacccttttggttaactttattcctaggtgcttaacctttagatactgttgtaagtggaattgctttcttaatttcctttttggattgttcattgcgggtgtgtagaaacacaactgatttttgtgtgatcttgtaccctgcaactttgctgaatctgcagccctagaagctttcttgtgattctctggcatttcctatatataggatcatgtcatctgtgaatagagatatttttacttcttcctttccaatttggatgccttttattttttttcttgtttaattgttctagccagaacttccagcacaatgtggaatagcagtggtaaaagtggacatccttgtcttgtccctgatcttaggcagaaagctttcactctttcaccattgggtatgacggtagctgtgggtttttcagaagtaccttttctcatgttgagaaagtttatttctattcctagtttacgatttttaaaaattatgatgcatggtggcttgtgcctgcaatcacaatactttagggagccaaagtgggaggatcacttgaggccaggagttcaagaccgacctgggcaacatagtgagaccttatctcaataaaaaaataaaaaatttgccaggcgtggtggtgcatgcctgtagtcccagctactcaagaggctgaggtgggaggaaggcttgagcccaggaggtcaaggctgtggcttcagtgagccatgatttcaccaccatcatgattgtgccaccaacagagtgaaaccttgtctcaaaaaaaaaaaaaaaaaaaaaaagccatgcatggtggctcaagcctgcaatcccagcactttgggaggccgaggtgggcagatcatgaggtcaggagatcgagaccatcctggctaacacggttgtaggggccagccctacaaggtctgtgggtttttctccccgtgtgcagagacaagagattgtagaaatgaagacacaagacaaagagatcaaagaaaagacagctgggcctgggggaccactaccaccaagacgtggagaccgacagtggcccctaatgcctggctgcgctgttatttattggatacaaagcaaaaggggcagggtaaagagtgtgagtcatctccaatgattgataaggtcacgtgagtcacatgtccactggacaggggcccttccctgttaggtagccaaggcggagagagagaggacagcttacatcattatttcttctatgctcttttaagaaagatcaaagactttaatactttaatactttcactaattttgctactgctatctagagggcagagccagctgtacagagtggaacatgaaagtgaaacaggagtgtgaccgctgaagcacagcatcacagggagacggttaggcccctggataactgcgggcgggcctgacatcagtcaggccctccacaagaggtggtggagcagtcttctctaaactcccccggggaaagggagactccctttcccggtctgctaagtagtgggtgcttttccttggcactgacgctacctctagaccacggtccgcttggtaacgggaatcttcccagatgctggcgttaccgctagaccaaggagccctctggtggccctgtccaggaataacagaaggctcacactctgtcttctggtcacttctcatcatgccccttcagctcctatctctgtatggcttggtttttcctaggttatgattgtaaagcaaggattattataatattgaaataaagagtaattgctacaaactaatgattgatattcatatataatcatatctatgatctatatctagtataactcttgttattttatatgttttattacactggaacagcttgtgccctcggtctcttgccttggcacctgggtggcttgccgcccacacatggtgaaaccccatctttactaaaaatacaaaaagttagctgagcgtggtggtgggtgcctgtagtcccagctactcaggaggctgaggcaagagaatggcatgaacccaggaggcggagcttgcagtgagccgagattgtgccactgcactccagcctgtgggacagagcaagactccatcaaaaaaaaaaaaaaaaaatcgtgaagtgttgttgaattttgtcaaatgccttttctgtgttggttgagaagatcatatggcttcccccacaccttgttctattaatttggtgtttgcattaatttttgtatgtttaactacccttactttcctaggataaatcccatttcgttatggtataaaatccacttaatgtgctgctgaattagatttgcttgtattttttcaggatgtttacatgtatattcataagggctactgctctgtaattttcttgtgatatctttatctggctttggtattacggtaatgctggcctcatagaatgagttaggaaatgttctctccttttcaatcttttggacgaatttgagaaacatccttgttattataattcttctttaaatatttgatagaattcaccagcacagccatctggttttgggcttttctttattgaaacgtttttgattcaatctcttatgataattctactgagattttctgttttttcttgagtcagcttagctaatttgtgtgttcctaggaatttgtccatttcatttatctagtttgttgacatataattgttgatagtattctcatacaatcctttttatttcggtaaggtcagtagtaatgtctccattttcatttctgatgttagttatttgtgtccaggctaactttggagcccaactttaacctgacttcaacctccaccttataccgtgataccatcccaacttgacctctgacatctgacccttggcccttctaaactgactttttttttttttttttttttttgagatggagtcttactctgtctcccaggctggagtgcagtggcacgatctcagctcactgcaacctccacctcctgggttcaagcgattctcctgcctcagcctccccagtagctgggattacaggtgcccaccaccacgcctggctaatttttgtatttttagtagagatggggcttcaccatgttagccaggctggtctcgaactcctgacctgaggtgatccgcccactccggcctcccaaagtgctgggactacaggcgtgaccaaacgcccttggctctaacctgacttctaatcgcatcctgtaacctctgactttagtgatcttgacttctgtctgctgctatagactgaacaattattgcctggcatctaaccttcgtccttgcccctggctgggccctgacctcaagtgacctttgacctctggcctttgcagttacacattcggcaaagtacagggcaacagcgatctctactggaaggcgcagcgttaccgcctcatccgggaattccactctcggcccgcgctggccccgccctttatcgtcatctcccacttgcgcctcctgctcaggcaattgtgcaggcgaccccggagcccccagccgtcctccccggccctcgagcatttccgtaagaacagagcttggcttaaaaaggagaaatataggggaccgggagcctggaaggcgaggggaagggggcatgccccaaatgactaacgggcgtggcttaggtagcgaggggcggggtttaagcaacaaggggcggagcttaagcactgaggggcagtgcttacgggtgaggggcggggcatgttctcgaatcaccaggggctgggtctgggatagcgtgcgtgttctgagggtgtcggaaggggcagctgggattgggaaggggcgtggcctgagccctttgactccgcccgcccctgcaggggtttacctttctaaggaagccgagcggaagctgctaacgtgggaatcggtgcataaggagaactttctgctggcacgcgctagggacaagcgggagagcgactccgagcgtctgaagcgcacgtcccagaagtgagagcggggcctggtcggggatggggcttctggcctggggcggatcctgacttcagctgaaggcagggtcctgggagggagggagagagggaggaggcccgggaagcaggcagagccctgggggtgggtgggctgcgggtgcccccggtaagaggccctcccttctcagggtggacttggcactgaaacagctgggacacatccgcgagtacgaacagcgcctgaaagtgctggagcgggaggtgaggccttggggcctggctgggggactgtggcaggggtcccatctcccgctctgacattcctcccattccgcaggtccagcagtgtagccgcgtcctggggtgggtggccgaggccctgagccgctctgccttgctgcccccaggtgggccgccaccccctgacctgcctgggtccaaaggtcagtgtgtagcatcagcctgtgcatctccagcctctgttcctgtatttttgcgtgtttttctctctcggcacctttccagtgtccctgggtcactctcttggtctcctttgagccttttgtactctcgccttcgtctttcttcttttttgccagtctcccagtttttctgtctctccccttccctgccaatcacctgctctctcttttctctcttcccccagactgagccctgctggcggacttcaaggagaagcccccacaggggattttgctcctagagtaaggctcatctgggcctcggcccccgcacctggtggccttgtccttgaggtgagccccatgtccatctgggccactgtcaggaccacctttgggagtgtcatccttacaaaccacagcatgcccggctcctcccagaaccagtcccagcctgggaggatcaaggcctggatcccgggccgttatccatctggaggctgcagggtccttggggtaacagggaccacagacccctcaccactcacagattcctcacactggggaaataaagccatttcagagg
